United States Patent 9,328,346 (POLYCOMB-ASSOCIATED NON-CODING RNAS) - sequence listing, part 12

SEQ ID NO: 1805 - RNA, 106983 nt, Mus musculus
caacuuuaaagaacacuuuaauaaggaaaauggaucggaaaauauuuuuacaaaauuguaacucuuguccagaguuacaauguauugcaaagggagcaaaaguuguuaugucugaggaaaaaaagccaucuaacuuagucaaugugucccuuguguucugggucacugcugcagagcagaaggcauccaacacaggaaagccggggugggccccagggcaggaagaggguggccgggcugcgggaggccgaggcaggcgcggggcucuccagagcccggccugaagcugauccccgccguucgcagacccuacuuccaggcuucagcggagagcuggccaccucgcaaacucucaacgguacggagaaccgugaagagcgaaucccuggacuuguccgggccgacgggcucucgcgagaucucgguccgcgccagugaggacucgcgagagggcggcgccggaggcggggcacgccguggcgggaauuucgccugcuuccgguuuccucugcccggcgcugcguuccgcguucuagguuugcgggggccugcgguuuucccgcgcgcucgcccgccccgaacgccgcgcugggacugagggagacggagggaggcggcggggcugcgugcuccauccgggccgugcggggaaaccagccugaggaggugcgcgagggccucaaaacccacggcagcccggagggagcgagggcggcguuggaaggcuuggcggcuccggcgccugcgggacgcccggaggauucuggaccuguugccuucagcuucucugcuuucacguugguuuccccgggugcugagggcacauuuuggaucuccgagguagcuccuuaccguacuuucagccucuugcagcuugucuucggagcccgaacguaacugcccggaaccgcgguggcauugcagagcaggauguaaauaauggauggcuguucagcagcgucgaccuucuugacugacagcuuagagcuggagcuggggacagaguggugcaaaccccccugcuuuucuugcgcuuuugacaacagagaaggaaaauucucuggagaguccuaccuugccaguggcgcccuuaagcgguagguuaaaaaacaaacaaacaacaaaaaaccgaauugaagguccccacccccagcaauguugauuaucaccaaugucuaacguaggugcucagcaagccucguuuuacauacgcuuaguauauagaagaacuuucuggauaauugauaaucucuuaggaguggguagcuggauauuuaauuuacuuagacugguuucagagcagccuagucucuuggaacuuguauuuccuuuuaagggguaauaguuaucuauaaguuuucaguaguuuauaaguagaaccugauaguuuuuguugcacggguucuuuccauccaaagcaucggcauacagaauucauagacacauuagucgaaugaauauuacaauaaaauugcuguucuugaauuauuuagguaaugcccuuugaggaaacuucauuaaagaaaaccauuuuuuguugauuguaugauuauaccuuguuaauaauuuguuaauaaccuuaaaccacauuagguaucuauaugaugucauucuuccuaauucggaauauuugguguucugaaaacccauuuucuuguucaaagauaaauuacugugaccucagaccacuuuguauauugcuuggacuccauuuagauuuuccuuuuggacacaacauaaggugucaaguaaccccucccccccccccccaacacacacacacauacacauauacauauguguuugugcgcgucaucauggcauguauagucuggauucaaaugauuuaagucauuguuuucauuacagguuaauuuuaaaucuugauccauuaccaacuaauuuugaagaggauacaguagaacuauuuggcuuccaauggguuacagaaacagcgcuagucuauuccuguagagagcucuuucauuuauucagguauguaugugucuauuuuuaacucuaaugcugucuaguuuuauauugcugcuuuuccacuacugauuacaaaagcagggaaauugcucuuuuuuauugcuuugcugguggucuuaccaggaaacacucaagcaguuaugacugauaaauaaugguuuuaaggaguuguuuauauuguguauauugauaagcgaaauccuuaucaauauauaugugugugauuuaaucucuagauuaaauuagucucugauuaaauuaaucacaugugauucuagagaucuaaucuagguuauuguauauguuaggcaagcaucauacuacugagcacugaauaccugcacuguguauaauguacauauucucuauauaacauauuguauaugcauuguuuuuguuucuaagacagggccucaacucuagccaauguguagccuaggucaaugaccuaaaacuuacacagcaauccuuucuuagucugugaugcugggauuacaagcaugaaccaucauagauaaagauuugaacuacgugccaugaacccucauaaagagaugucgguguaucuuugauguaguagaugcugucaauuuuuuuucuuuguaggucaacacaaucaugcaugaauguuuugaguaucuguauguauuguauacuacaugcauguguggugcccuagaggucagaagagggcauggaauuagaauuauggaugguugugggcuacuaccauacaugcugggaaccaaaugcauguccucuacgagagcaaaaagugcucuuagcugcugagccaucucuccagccuuguguuauuuauugagagaacaagcugagcaaguuuucuguaauuguaaacauuguagugagaugggucuuuaagagaguuucaaggcagauaggaaugaugaaaugggauugccaucagggauuaaagcgaggcauccuaauagcuuuacauacauacauauauauauauaucauuuauguaucuguuuugcuuugcuuuuuugucacugugauuaaagaccaugacaaaaugcagcuuguggagaaaaggcuuuauuuggcuuacugguuucacuucaucaucaggagaagccaagguggagccuagauguagaaacugaagcauagaccaggaaggaaugcugccuucugacuugcuccccauugcuugcucggccugauauacuaucuaggaccaccuacccagggauggcaccauccccaguaagcugggcuucccauagcauacaaucaugaaucaagagaagguccuuagauuuuacuauaggcaaguugauggaggcgcuuucucaaguuagggucuucucuacagguaacuauuuuguaucaagguaacuagguauuaauaaggacaguaauccuuuucauuuucugaaccacuauacaagcuguaugauacaauuuaacauaaaacuuaacccuagaauguuuuuuuuccauuuuuuauuagguauuuagcucauuuacauuuccaaugcuauaccaaaagucccccauacccacccacccccacuccccuacccaccuacucccccuuuuuggcccuggcguuccccuguacuggggcauauaaaguuugcguguccaaugggccucucuuuccagugauggccaacuaggccaucuuuugauacauaugcagcuagagucaagagcuccgggguacugguuaguucauaauguuguuccaccuauaggguugcagaucccuuuagcuccuuggcuacuuucucuagcuccucuagaauguuuuauauaucuuaaguuuacugaagauagaaauaucucauugauauugaagucugauuuucaaauaguuucugagaucuaucuuuuauagauacuuuguaaguuuagacauaauuguauuuuuauguauuguguauuuuaaaauuuacuauguaggaagcugacuuuuaauaaacauuacaaagugaauuauaacaaaggugaauugcuccaggagugcuagaaacacaguucaaauaauugcuaugugcuuuauacauuaugcuaaaguuuacucucucacauuuuaaaaaucaggcaacagauauuuaacuuggaguccuugguacaagucagcugugauuuugguaaguguaauauguauaauuucuuuggaggugaggaauugguuggcgaacauaugcacaagauaaaggaguuaacagaccucuuaggacucuugaucuucuuuuccugguuucuaauucuguuuccuuuugacauuuaaugcauugcugauuuaguggaguagugcaggugccuugugaaggaacuugaacagcaguguuuuuauuguaggccagcugcuucuccuuguaagaauuuuagugcaauguaguauuuggaguccugacuuuauagucaaccuagguuuuaaacucagcuaauaauguguuucguacguaacaguuccuaucuuauugauuaguuuuuguacaguuuaaauaccaugaugcaugcuuaguguuuaucugugucuaucauaaugacuaauaaauagagaucggcuggaauguuuuuagucaaauagguuuauuaauuuaucaaaacauugaguacauacacaugcacuugcugauuuguguaagauguaauagcuauggggcuuuauucuggauuggauauuguuaaagagcgaaggcaguuagaugagccagccacaggaaggaaggaaggaaggaaggaaggaaggaaggaaggaaggaaggaaggaaggaaggggaaggggaaggggaagggauggaaggaagguagguagguagggaggguuuucaguaauuaaacugggcuucauagcaugaagacaaagauauugccuguggucucugauugcauagagccuuauuucuguguucagacaugacuauaaaggguugacaauaaccacagaguaguccuaucuuauuuuuauauuuaaugaaaauuguuuauuuucuggcaucauaguucuagcuguuaucaccugcuaguuguugacugucaaguuugucuuguuuucauucgguguuagaaguaaauacagauuuucauuguuuuauuuuauuucuagugggacuguuucgugccagacaugcaaaguacuuacugccuggugcagaguucuuguucuaucccuuaaguucucagguuuacuuucaguugaggcagaguugacccaucuuaaauauauggaguauguguuuaaaaucauuauuauagccuuggugacuggugacuuguccaucacuuuuuuuuuuuaaugguuuuuuuuuagacaggguuucucuguguagcccuggcuguccuggaacucacuuuguagaccaugcuggccucgaacucagaaaucgccugccucugccucccgagugcugggauuaaaggcaugcgccaccaccgcccggcccaucacuuuuuuuauugaucuguuuuuauugcuugauuuucuuuugguucugugauacauuuuucuguuuauuugaauaucuacuaauguuacauaaugauauaugcuauggauuuauuucaacuuucaucuuguaguuuuuuaguucuggcuugcgauuuaauaauuuuauucuaguacgucuuucuggaguuuguuuucaaguuugugagggcuucuacaaucagccuaggaagaauccuggcaaaccuuucugauguguggaaauuuauguuuuucaguucugcuaauuaagaacgugagcuguccuaacuggugugcaguuuuagaguuguuuccaauggucuuuagucuaaggcagugugauccugcuuuugggauccuuuuuuucuaccuuugauuaguuguuuugcauauaguagcaauguauauaauucuuggugacgugaaugauuaaaaaauugggcaaaaagagugucagggauagcugggcaugguggcacacaccuuuaaucccagcacuugggaggcagaggcagguggauuucugaguucaaggccaaccuggucuacagagugaguuccaggacagccagggcuauacagaaaaaccaaaaaaaaaaaaaaaaagagugucagggaugaguuuaggagaauuauuaaaagguuauuucauauaaaauaauuauaaggaguuuugauuucaguauaaguauaguuggugaccuuuuauucauuuugacuugagagcaacaagaauuaauucacagggcgagagaaauaguccuuacgcagauacugcucuuguggaagaguauaugucucuacuauacaccaauuuugggcagcucacagccaccugucacuccagcauuaggggccucugaugcucucccaggguauaugcauguacccacacacagucauacaauuaaauuaaaaaugguaucuuaaagccuggcaguaguggcacacgccuuuagucccagcacuugggaggcagaggcaggcagauugcugaguucgaggcuagccuggucuacagaaugaguuccaggacagccagggcuacacagagaaacccugucucaaaaaaaacaaacaacaaaacaaaaaaaugguaucuuaaagaauucauauuuuaagcaaauuuugcaaacagauuuuagcaaggugaaacaaaauucuacugugcguucuauugugguaugagagacuagagaagguagguauuucaagguauauuuguuuuaaacuuaguaagacuuauaggguagauuuuuaaguuaagccuauaagaaauuuuggccauugcucacugacaguguuuaagcucuccuugauaguaucuguuuccuuuuagggaaaauagccaccuugcacgccaaagcagacaguauuaggcaacaauguguaguguuccuucacuacauuaaaguuuucaucuucagguaggauaacagauggguauuuuuacuauuucacugauaucugugggucuauccacacagacucuuguguauuuauucuuucuaaugacuuuuuaggugucugaaaguacaggaagcagagagccacagucgcccugcccaucccuaugaggcuuuggaagcccagcuucccuccauguuggucgaugagcuccguggauuacuucuguacauuggacaucuagcugcacuucccaguguuacuguaggagcguuuguaaaucaaaaccagaugaagguuugauuaguuuauuuuuuaaauuauccaacuuuuuucucccccaaguaaaaguauuauucaagaauaagaagaauugguacauguguggcaugaaaugaagcucugaucugcuuauuaguuaugucuuuuuacuauauauaugugccuuaccucagucucucuaguuacaagagauuugggaagaauuaaaugauuggugugccuuaaguguguaaaacacuacccuguaucaauagcuguucuccauucaacaguguaaaugcuuagacuuuucaaauaaaaauuaacauguuugaaacuucugucauucucguugauaaagguuuaggcaaaugucaugucauuuauauguuacaguaaaauuuaagaaagcaaguucauugcucuuuaauuguuuuucacugucuuaugaaucugagguuggccucgggaugaccuugaacuucugauccuucugcuuuuuccuuccccugucccccaaguguugagcuuaugggccaaguuuaugaaaugcuggaaauucacucuuucucugagauuuuugugaacauuuugauuugguagacuugaagaacuaguuuauuugagguguauaagauauauauuagaucaggaggacuuauuaaaacauaaaauaccaaaauauuauucugcaaugaauuuuuuuuuuuuuugagacaggguuucucuguguagcccuggcuguccuggaacucacucuguagaccaggcuggcuucgaacucagaaauccgccuuccucugccucccaagugcugggauuaaaggcgugcgccaccaccgccaggcaugaaauaauuuuuuaaaaacauaagauuuuuauauauagcauaucaucuuacauaugaagagcauuuagcuacuauuuccaguugagcauccaaaauauuugcauuagagauauuacuuauuaguuuuacauauuacaaauaguuucugcuauuucuuuguuuuguuuuguuuuuucccccaccaauuaaccugaauuuuccagaugauugaggguuaggguguguguguguguguaugaguaugucugauuauauuuguugauucucucuuuuaugacauguuauuuaugcuguuaaaaagcacuuuaguuucuacauucauagcugccauucauuucuuuuaaaauauguaggaggcagggugcuaaagagaugccucagagguuuaagagcgugaggugcuccuccaguagagcuggguuugagucccagcacccacaugauggcucacgagcaucugucacuccaguuccagggaaucugaugcccucuucuggucuccagggucacuaagcaugcacauggaguauaugcauacaugcaagcaaaacacuugucuauauuauaauuuacaaaauuauguagggaaauaggaacucugcuaguuucuuuaaauggaugugaacacuauuaauggguuacauuucccucguugauuugagaugucauauuuauuugucucuucccuguucugcaugucuucccuccccguuccacuauguuauuagucuagcauuugaguuuguuuguagugacaaggaagaacucuugucauuuuuuucuauguucuucagugaaacuuguuaauguaacuuuuuacaguaauugacaggugguaacccagugcaccuaagaacuaaauauucugaguuuugauuucaauagaauuguuugaaugcuuaaucauggauugagaaauaaaauucuugaacuuugugaagaugaccuuacagguugguuugguaaucugaaguuuacuuuuuuaaucucuuaucauuccuacgcacucacuauauauauauauauauauauauauauacacacacacacacacagacauauacauaucucacuuuaguaugcacugaggaauauuucuaagauaaguucuaaagcaaaaacuauaucuuaaagauuucuuugcagcccuguggcuaaguauaaucagcaguugguuggaaggagucuguacuguccagucuuuucagccaucucaagugugugccuguauuaaacuagaaagaaaaaauguauccuuuuaaggaucuccagugaaagaauucucuagucaaagacgaauuuuuccugaaauuuugaguaguuacuugguucuuuaucugugugcauggaguucugugauguguaaaauaccuagugaaauaagaguuuuaauucacacuuuauaaugucauuuacagcucuucccuccaucauggcauuuauuacaucucuauuuagauacccacuggcugguguuggaaauacugcauauucugggagaaaaauugagugaguuuaugaauuucugucuuaauucuuuuuaagaauccuaaggauugauccuaaggauugguugauucuuuuuaaaaaucuuaagauugaacucuuaguuggugauugauugauugacucauaauucuauaauugaauuuaucaguugaguaugcuggcauauggugguuuauaaucccagcucauaggaagcucagauaggaggaucaugaggccacccuggauuauaugcugaauucugggucagccugaacuauguaguaagacccuguucaaaagaaaauaaacaauucuauugcauuauaaguauuuagugauguuuaaaaaaaguagguaagaaguguuuguuuaugccucucuuucacccaagguguccauguaucauuuagcagauugugggugcgugcaugugugugugugcugagacaaggucuuuggggguugguggguuuuucuguguaguucuggcuguccuggaacucccuggguaaaucagacuugccucaaacuuacagauauucacuugccuccgccucccaggugcuacacuuaaauguguguagcacaacugucugucugagacagucucugacugacuuagccgggauaugccauuuuggcuaaacugauugaccaacaagcccccagagucuuccuucccuaccauuggauuauagguccauguuggccuuugcuuggguguggggaucagaaguaggguuuuguagugauguagcagaauuuuaaccaagacacuuccccagcucccauuuagcagcuuuucagagaucuauuugugaaagugccugugguucagguuuucuaaggcugcauucuucagaucaacuacacuuguuuagccaugccugccuuuuaacaauaguuuuugguuauuuuuaaauauuguaaauaauauuucccagaaaacauucguacauacggcuuuaaucuguauacauguucuauaauguauuuucuuagacauagacuggagcauugaaguuuugacauuaaugauagacuauggauuauuuucuuauauccuucagauucuugccaguaauggauuuauguugcuaauacauggaaagagauaccaaaugguuuuuuuuuucuucauuggcuuuuugguuaucaauuaauaaucaacauguuuauauaauuuuaauuuucuguuauuugccuucucuuuuauuuuugcaaauuuucuaacuuucuuuuagaagcuuauauauauggauaauaaauaaucuuauauuucagaugcugugauauauuuuguucauuuggucuuuuuuuccuugagacaagaguuucacuuaacuauuuauuuaccucuggcugaccucaguauguagaccaggcuguccuagagcucaaaugauccaccugccucuggagugcugagauuaaaggcaugugcuaccauacccagcaacugcuguguuuuuguuguuguuguuuuguuuuuaaauuuugcuguuggcauuuuaguuuccaaagacaagugguaagcauaccagcaucaguuaaaaaaacaaaacaaaacaaaacuaggguauuagcuuuuuuguucuuagaguuuuagaugaauacuuuuuugucuuuuucuuuuauuuuaaagugacagcaauaaugcuuuuuaaauauggucucauuaauacaaaagaaguuaauuaaacugaauauagaacuggaaaaguuuuuauuagguaauacguggacccaaacuugguuauucucaaauuuaauuuacuuuaaaaaaaauccuaaaauuguauuuuacuuuagaagaaucugaaaaaguaaaguuuuuuuuucuugugagaauugauacaaucugagauuuuaaaauagaauuuauuuuauuugcagaacaaguuguuuauggucgucaguuuauuggucaggcaggugacaauuuaaccaaugucagccucuuugaagaacauugugaacaucuuuucugugacuuaauaugccugucacucaacagauuugacaagguaauguuuuaagaguuauuaauguguuaaugacaauaauccuuaauacaugugguuuaauacauaagaauuugaaauauguuuguuaauguuucucuuguuuuguauuugguuacuaauaucugggagcuagauguagcaagaauuuugauauaaaugucccaguaggcuggaauucaucuuacauguuaauuuuuaaagugguucauuaaaauaguaaguacacauuaaugacuauuacauauuaauaaugcguuuugguaaguauaaacauuacauaaugcucaaaucagguuaaauauuugaaaaauauuuaucauugugguaaaaacauucaggcugcuuuguucuagcuuuucaaaauaccuuuaaaaauauauaguaugaaacuauucucgcuguauauaucaguauccuggaacuguuaucccugccuaguuguagguuaaaacauguuuacuuugccuuauauuaaaugcgaguuuauuucuaaauuucuaucaggugaguguguguguguguguguguguguguguguguguguguguguguguguguguguauguuaguguguuagaugaaacagauacaauuaaguaaacugagugagguucauuccagcuuauacucaaaaccgguguugaauaauaauguuaugcuagaagguacuugccccaauguccuuucuaauuucuuuaucugcuauuacacucuugggccuauuuuaguaguugugacagcucauuucuaacagaaucuuaaagcguacugauuggucgaugcuuaagaaguuuucuuuuuuguuucuuuagcugaaaauuagguuuauuauguaauuugguuguaaaggcaauauuuuuaaaaaguuggugaaaugauacuuuucuuaaauugaggaaauauuuuaacucuuuauagcaaucaucucugacauguaaauagcucugcuucuuuuuguaggucaugccuucagaagcacuacugauuagucacugcccaugcuccuguguuaaagaauuauggguucuacuuauucaucuuuuagaccacagaaggaaauggucuguugcagauguaaguuggaaaauugcuaguuacuuguugugacuaguuuauauguugaauuccauauauaggagaauggcugcccacagcauacauaguauuauauuugcauacuagaauauucugcugucuuagccuguaucuuccagagaaugggcaucauaucaguggaauaaauaaggacguuauaagagauugacuaacauaguuauagaagcugguccugggauguaugugacaaacuggugacccaggagaacugucuauacaaguuucagucugagucuaaaggccuaaaagccugagagccagcagaucuagucucauuccacaguugaagagagggggcaaaaucacuacaccaacuuaaagaagucuuucuugaucugcagagcagcuuuuuaauuuaagaguaacaugucugguuaaguggaggaauucacacacauuaaggagggcaauccacuuuacugagucuacuaauuuaaauguuaacuugagaaaauuuaaaaguauguauccaguauaacauuuaaucugcuaucuggggauuugugccugauuaaguugacacaacaaacacauauuuuguauuauuuauguauuuguguguguguguguguguguguguguguacagauaguagaaugaggaagaauccugaaguaaugauuucccuaauacguugugaaaugaaaugagcagaauguaaaagauuguaguaaaucaucuuuuauguaggaaaccagagaaaagggugugugagcgcaugugcugguguacucaaagaaauacuggaaugacaagaagccaugagccuuggugaauuaaaaccauaaauugcugggugcuaauguagaaguuuaucagcaauggggcaggacuagccagagauaacucugcucuaucggucucugccuaguggcuugcucuguacuagggagccugaggaguuauuuccagagagcucuucgaaagugaagcugaaauuccagaccucaccucagaaaagcauuucaagaugagucaguaugaagcagaguuagaggcuuuucuguuguuaguuuguuuguuuuuuuuaaagauuauaauuacauuacuucuuaacgccaggccuucuuaacuacccccuaacugugccccccccccccauucagauucacagccucuuuuucuuuaguguuguuucauauuuguguguguagguacuuuucucuggggaagauuuuuuucccacuauuaccguuccuuaguugccuguaauucuuuuuguuggguugaauccuccuccugaauccuccuuccauauuaguaugucucuugcugucauccaccauguugaugacaauucauggguguagcuucucugacacagcaaaauuacuguuucucuuacucuugacaaucuuuaucaccaucauccccuucugaaaagaucccucaucuuuaggugcauucauuuguuguagauguuaucagauuggacugggcuccaucacuuugcauuuuuucaguaguguuuuuuuggcaauagucuacauuuguuggaaugauaaguuucuucagcaggagugagaaauagauguaugucgguauaagaacaguuuuagaauguaguuauguauuaacuauggggaaacuguaguuugucuuugauuuuugacuacacuagcccagagaaguuggguuuccaguaccaggugucauuuccuucugaguggauccaauuugagagcuguugguuacugccagcaucaauacuacacccuaugguuaucaucccuguugguuguuguaguacauaguugccauugcuaguagaacuguugguugcuuccuuguguuggaaacuagcauggaaccuucagguaccguggaagcuaggccuuagggaggagcuuccggguuagauugaccuggggucuuuuggacccugugccucaagugugucaugucuucaguuuuaaagguguaucuucccccuuugguggggaaacaacuaaaagagggcuucucaugucugggcauugaguuuuuuguuuuguuuuguuugguuagauauuguauuagucaagauucucuagagauacagaauucauaaaaugagucucauuuaagagugggguuuauuagaguggcuuacaaguuauaguucagcugugacaacaauuacugucaccugauauguccaugaauccauuaguguucagcccaagagucuggaugccagucucagcugguuuucaguauauuccagagcucuuaauacaagugagggaauaaacuugccagcgagaaugagggcaagcaggcauugagcaagagcuucuauuuuucucauguuuauauaggugcugccagaagguuggcccauguguaauauagauccuaccccuucaaaugcuucacuuaagaaaacucccucacagccagaggcgugguggugcacgccuuuaaucccagcacuugggaggcagaggcaggcagauuucugaguuuggggccagccuggucuacagaguugacuuccaggacagccagggcuacacagagaaacccuguuucggggggaaaaaucccucacagguuuacccagaugcuuggguuuuaguuaauucuagagguugacaacugagaauaggcaucacaugucugcccuugucauuuugacauauaaucauaucuccuuauguuaaugcuuaauuuccaaaugaaaacaauaacaaggucauaauuaugucuaauaugauauaacuagugauauacaaccacaaacacauuacauguuuuagaauaggugacaguguuccuugaggaacauuuaguauauuaaaacuugaaauugauaaccacugauguucucucaauuaauguuguauuacauguuaaagacaucaggaaagaaaauacaaauaccacauccuuaacaaaauauuguagcauggacuuuggcuacauaauguucucaguggguugugcuuccagccaccugcuccacccgccacucuuuggauccaagaaugaaagacacacacacauuagcuuauuugugaaaugccuuggcuucucaaaggcugggcaguucuaauccuaccacggcuagcauacuuuucccuuugguacucugggcagcccuuuggggagccgcuuuuccuuuccaacuacauuuuggaugaucuuuucucuuccacucuaaaucuggucccuccuccccccucucccccccuagucauggcaauucucucuccucccucuccuccccugcacccugacuugcgaagaucuaaggguccuauuccccuuucccagccuuggcugcugucaucuuuauugauugaucaaaaaaccaauuggggacaagguccuucaguguuuggacaugaagauuucccauuaaaucuguagaccaggauagucuagaacucacagagaucacagagaccugccucugucugccguguucagggauuuaaggcaugggcuaccaccacccgacuuuuuuuuacucuuuuuuuuuuaaugccuuaauccuuugaaguuuauuauuuuagauauuacgucuugggauuuauggaggaugaagaucauuggcaaauguuuuuacaggacucuuggaucuggagcagagacggacuuuucuaaaaauuuucuuuuucuugaaagaucugagauguggauuuguuuuguuuuuuguuaucucugugucugcuaugaacagagaaggguagguagaagaaaggauaugugggucauggugagucuagagguugacuauggcuuagggcaacagugucaagcagacauagucuaggcugguuugcaggauccagcuguggucuaggccugaauuuggguuuaaaucugagcauuuugaggagcaggaggaggguagggucaugugaacugaccgggcuagacauggagaaggguguguuggaucugucugaguggggagauugaaaugugccguggaaggggccuggaagugguguggggaaguguagucaagguagaucuugguagaaggaggcuucaggguugcuuaugguacaggcagcacggcuagauuaagugagaguuaagcgguguuuaguaguuuguucuguuguaagcauaggcauuaggaagagacacuucuacaagucuacaagucacccaagagcauaaguaugaucuucucaagagcaaguaacccuuaaguaucuuaauagcuauguauguaugauuuuugagacguuugauauuacaucucaaaggguuguaaaagcagcuuaaaugagcuaaggauaguucuaaaugugcauccuuaauuuaaaugaguugauacaguaaguaguuccagaugugcuucuacgagaugacugcuuuuagaguagaacucaaagacacggguggaaguggaguuaagaaguauguuguuacaggaaguacaaucucaauuuucuaaugcuccaacccuuuaauuuguggggacucuaaccauaaaauuauuuuuguugcuacuucauaacuguaauuuuacuacuguuaagaauuguaaugucaacuauccauguuuucugauggccuuaggcaaccccagucauuugacucucccaagaggggucacggccaauagguugaaaacaccaauuuacguaguuuugugaaauucccagaaaacugaagguuuauauaugggaaaguccaaagcuguacucaaacauaaaacuuaagcuuuguucuuuucuauuuuaccuuucuuaacuugaaauaccucuagcaaagaagaaauauugucucuauauuggaaauauucauagcaauguuaaccauguuggaacuuuuaaaacauuucuauuuauucuuuauuucauauaaguuugagcauauucuuuacucuucccaaauuccuuccagaucccuucccaccuuccuacucauccaaccuuauguucuuuaucuuaaaaaaaaaagguacacacacacacacaccaccaccaccaccacuaccaccaccacaagaguucaguuugcauuuucuuccuccuccaagcauggggccugcucuugagugcagucgauauacagugguggucggcauggcacuuggugcugauuugcucuccucggugcuggaauucugucaggcuugggcuugcacaggccguggucaugccgucagugucuguugugcugauugcuugacucuaaacuggcagcaauccucaaccacgaaugaaggccuuuuuuuuccucucaugguuccuugcuuuuccaugucuuucuccccugcuucaaaacaauuuuaguguggcuuuucauauaucucuaauuuuagaauaauguuauuguucccuaugcauaaaaguaaauguguuuagaaagugcacugaacagaauauagaauugaaggcauuuauauuucagaugaauaaaaacacgguauagagguugaaaauaauaaucuagauaauguuagaauaugccaauuugaccauguacuuuuacugcuaaacaaaaauuuauaaagaacuauaaacaacaggauuucacuaguuaacccaggcuaccuuggacauuguccucuagcugccuuaagcauucugauuacagguguggaccaccaugccaggcuaacuaucaaaucuuuuuuaggacauuuuuuuccuuccuuucuuuuucacauuguuauuugagaauuggcaauuuuagaccuauuuauagacuguaacugagggaaucuuaaauguauuguggguaauaugauucaaguuugucacauaauuggaaaaggagaagcuaguguaagccaugaaauaauaaauuagaauagagcuagguguggauguguguuuguguacauacauuuccuauuuuuuucacuagaaguagccaauucuaaguaaaauggugcagauugcugguauauacagauugguuccaaaaaacgaccacuuucuagugaacaccagcgagaguuggaaaaauagguguuuugagacagguccauuaaagaugaaacugagccagaagcaucuuaugccagauauuguuugcucaaaguaugaugggacaugucugaagaauacaacccaaaugaauaucgccuauauauuaaaccugggauaacuugauuucuauaagacauaguugaaaaggguuguaaucuauacaguaccuaugcuguacaaguagggagaagggauucuuuucugguaaauauaagucaggaaagcaucagaaaagcaguuaguguaguuguuuuaaguaagauucuucauugguugcuuagcauaauaaacaaaagugagaugaagauaaguuauguucauuuuuuuauugguuugguuucuguuugcugagacaaaaucucaacaugggugacuaugacggucucuaaauugccuuccuucuaccuaagucucugaaauaguagauauguugccauugcuuuggagcuuaaaauaaaauaggauauguuaguagucuuguaaauaucuccauauaguauuuaucacuuaccaagaaggaaauaguuaucauagaucuaaacaaucuggaaaguaucaccuuagccacaaagucaaaguuaaccuguaguaggauaaacugauaccaugcaccucucauaagaugcagugaaagaauaagaauguuuguguggcuuucuugcuccaaaugugaggucaucaugaagagacaccagucauaauugauugcaauuggcuucagagcaccaauguuaugcauagugaaacuugagaaacugguguaacagaggcugaagugacaugcucauaacuucagccagcuuaggaguguuuucauaaugguaccagggagacuuugaguacgggcuguguauaauauaaaagagagaaacaccaauaggaaauaaggaagcauuucuuguaguaggaaaagcagaggagucagacacaaaaaauaaaauaguaggagaauaguuuucuauuuuuaaugaaaacuaaucaaaucaagaaacacaaagaaccugcuuaauauaacuaaagaaaaaggcaccugguguauuugcagugaagucacggggauuaaagacaaagagauuuuaaaaaguaacaaauaugcagugaaauuaggggcugagugugacauagagugcuuggauccacuccuuagcaucacacauaucaaaaaaguaagcauuugauggcuacugacuuuuuagcagccuaggaaucccuuuaguggaauuacuguguaauuguagucaaacaaacaaaauuacucaucagcuuaaaaccucaaccaacaaaggcaaaauaaagcuguuuccaguagaacaacauuaaaaaaaaugcuacaaggggaaaagugggaaaggacugaaguguagaaaaaauauacaggaaacaguaaauaaguaaguaaguguggacuguauaguaaguuuaaggccagccuggcaacuuaaccaggcccugccucaaaaugaagaaaaaaaaaauuuaaaaagcuugaauagagcuuacugguagggcaucugccuggcaaagacaaauucuuagguuuaauucccagaaaaacaaauucucaaaucacaguaauauuagcauauaaacuggguugggcaugaaugaguuaguucuaagaauucaguuauguuuaagagcaaaauaguugcuuuuauuuuauaagacauuuaaauuuauccuguuauuuauuuuuuucauuuuuuuauuagauauuuucuucauuuacauuucaaaugcuauccugaaaguccccuauacccuccccccgcccugcuccccuacucacccacucccacuucuuggcccuggcguuccccuguacugaggcauauaaaguuuguaauaccaaggggccucucuucccaaugauggccgacuaggccaucuucugcugcauauacagcuaaagacacgagcucugggaauacugguuaguucauauuguuguccaccuauaggguugcagacaccuucagcuccuuagacaaaguuuggagcuaagacgaaaggauggaccauccagagacuaccccaccuggggaugcaucccauaaucagccacuaaacacagacacuauugcauaugccagcaagauuuugcugaagggacccugauagagcugucucuugugaggcuaugccagugccuggcaaaugcagaaguggaugcucacagucagcuauuggauggagcuagagaaaguauccuauuauuuuuaaggccaucauuaaauagauuaguaaaaaguauaugcaaccgaaaagaaaacauucguaaauacaauaaguuugcaaagagaacugcaguauaaaauuauuaacauaguuaaguuuuauaaaucaucuguaaggauuaccagaugauauauuuaaaagauacacacuuucagaacauucuguagaguguucauaaaagauaccuuuaaagcauaaaauacaucaguguucauaauugaugcucuguuuuguguauuuuaacgggaaauacuuuaagucaaaggucauuagaauagugucauaauuuaacugaauuauguuccuuuuguuucuauagucauuuuggaauugguugaauaaacuacuuagaacacuuuuugaaaagucaagugaccaacgaagaucuucugugucucuaacccaggccaaggauccauuaggcuuuaguugguggauuaguguucauguagcaucauuguaccagauugaucgccauggugugucagacaaaaugguaagauuuauaugugcucaggucgcaggggaaugauuuuccuuuuguuuuguuuuuucucuauauaguguuucuauaaacaucuccuaaucuugaagaauugaaaguucaugguuuuauuauuguuugauaaaugaaaagcaauuuguagaggacuuggucuucaguccugucucugcucauaaguacuuguaugacuuucaguaaacugcuuaagcucuucugauccacugcuuccuuaugggaaaaucaugguuugcauugcuccaaaguuugcuucuagccauaaauucucugagagugucuaaggggaaucaugugucucccagaaaugaauccguggguuuuguagggaauguguugagaguguuucuuuuggggcugaagagagaacucagugauaaagagcacacacugcucuagucgaagaccccaguuuuguucccugcuccuacacucagagggucacagcugcuuguuacuuuagcuucagggaaucugucuccuuagggccugcugcaagcaacugcaauaguguacaacccacacacauauaaaaauauuucuuuugcauaacauuucuugagguaccugcuuuucucaguuuacccuauuuaacaaaacuaucaagcuugcuucaaagaagaagacagauuuuuaucuauuguauguguuguuuuguuggaaacauucuuuuaugguauuacacuuccuggugacaaaaccaccuaguaaauauauuuauuugaaacccuauuugagguuuaugauuucuauguauauaauuaugauuucuauguguauaauuucugccauucucagaaaauagaauuauaccaacauaucaguguuauaaguuuggacuucugagucugaggcaggaggauugacacgaguucaaggguagcuuaggcuucauuaugaauuccaggccagcuuagcauacauagugaguaccaggucagccuggauuauggaauaaguccugucucaaaacucagcccuccaaaugaaacaagcauguuucuaggccucaccucuguagguccuugcugauauauaauagauacucaaauuuuagcaguugucauaauucuuuuuaugacccauuuauuaaguacuuuucuggaauaggaugcuaauguuuaauguauuuuaauuauuggaauauuacagaaacauuaagggaauuaaaaaauugccuguaauucugcaguuguaauguaagcauuuuuauuucucuuucuguucaacuuuaauucuucuaagaacacacuccuuauuuuaaucaguacauauaaaugugguaauuugucaaguauuucuaaguugugauauauauuacauauaauauauauuaggcauuacaauagguguugauaagaggauuuauauaaaauacauuauacuuugcuucagggaauauaugauuaguuuauuaaugcuuauuggaacugugauaacacuuuguagugagugcuauauuucaauagugguuguugaauaguccauggauaguccauguauuguccugucauugccaucacaguauguaaugcauugguaguucauucugagaacucugacauuguugcuuuuauuaucauggaaucaagauaguaaaugaaugugucuuuuaacugguaccucugugaguuuuaaaaauguuucuauaauucuucuuuauguggaaagauuuuuaaaggaaacugccauauuugaaaauggaagcuuucuaugauaaaaauaauuauauauaauuuauauuuagguaugcacauguaaaauaaaaguugcuuucagauauguauucucagaguuucuaguaucucugaacuuuguuaugucuuuaaaaaaaagucuagcucuuucuccuaguaaugguuuuuauuaagugugaauugcauuuugcacuuaauaugcaccccccuaacccccucccccuugagucuuagcuucucugggucuguggauuauagcauauuucucuugaacuggucagaauguaaaacaaagaagaaugauuuaaaaaacuaaauuaaaaaagcaaaguaggauagguaagaagcacauaggguagagaaccuuuauuuuuuucucucgugggaggucagggcacacuaaccuggcauuucugugugacaguauucagagcguauucuuaacaccaagggaagcucugccucuaguguuuauaguuuuuugggucauuuguuuguuuguuuguuaccuccauuacauguucaugaccuguaagagcccacauagcggaucuaggcccgcugacccacaguugcacugucuaugggguuggaucaaacccugacuuaagacuacauagguaugaccagccucuucuaugucaugucgucaaacuaucuaauaugacagaccuccaaaccaagguguuccuuccagguuucauuauucuaaugucucagagaugagugauuauuuugaauaauuaagucauuacuuuaauaauuguuauauaacaacaauaucucacucaguuucuaagacuuggggauuuuuuuagggcauuaucuaggugguuccugccucagaaucuucuaugaugguuuagucaaguugucacuuagaggcaguuccugaaggcuuacuuggggcuggaagauuuaauuuuggcaaauuguuuuaguuuucugucuugugggcuucaggccugcucacgguaggguuguuucccugauuaaaaauuaucaaguuggaagcuuccuggaagugacauacugccacucacauagguacugguagucuauuggcaagcauuuuauguacaguaggggagggaauuauagaaaugcuucauuccaaggguuagaggcuggucacuacuauuguuacuguauuucuuucaguaaggaaguacuggugugcagcuagcacuuacgugaauauucucuagcauuuuaaaaacauggguagugaauauaucuuuuauuaauuagagcucauauuuauaaauauagucaucugucugucugauaggagucuguaccuugauugauugauugauugauugauugauuggcugauugacugagauggccuuccuaauagcccuggcuggccuggaacaugauuagaucagccuccccuugaacucaagaaaucugccuccugacagcuaauaucaaaggaauacaccacaaaguauuguaguuuuuuuuugggggggggggggaauggacucuagcuuugcguuuugaaauuuaaaaaauuuucauacauuuucugcauuagaaauuaugugauuuuuuuuuuuuuuuuaaacgugcuuuucauugauucuggcuuugacuagugcccacauaucucagucucuaaaaacugagagaauauccuccaggcuuuccuguuagaaaagugacauuuugcaaaccuuuuuaaaguccacuguagcucucuuccuugcugcauagagucaugcauagaauuagaauugccagauagaugaccauuugccagaugaaagcauuaucaagauuggagcaaaaaagaaaauccuucugacacauaauaaucaaaacaccaaauguacagaacaaagaauaucaaguuuucuguuuauguaaaacuacauauuuuaauaagguagauuauauuugggauauuacaaauaaaaugaaggaaaaucucauguaagaaggagaguaagaaagacugucauguaaccuuaaaaauacauaauuguuauaucauuuuuuuccaguuagaugauauguaacagcaaauuaaguauuuaaaagauguguaagccuauagacguacuauuauaaaauauguccaguaugguuucuauuagauuagaacaacuguagauuuauuuuuuuccagguauaucagcuaagauguuacugaaagaaauaaaagacauugcaaagguauuuuaaugauagaauuuuacacuuguaucaucauuuuaaagauguacauaaucaagagcaauaguucaacauagcugcauucucucuuuucagaaacagauggaauccaauuggagcuuuauagaagaacuuuugaaacgguccgucacuguucagguaugcagcuaaagcgaggcagugcaugacuucugcaucuuauaguguaaauuuuauuuacaagagcuaaguaaacauaaaaugauuaaaugauaauuuauuacaaaucugagauucuuugaagggucaacuaaguaauucauauuaaauccuuuaaagauuuuuauuuuuaucacugaauuugucaguuaaaggacaaagauaauuaucuuaguuggugacuuugaaagaauguauucaaaauaaguggaagaugcuuuggaguuauaagccauuccuugacuguaugauagcaagccaggcgacaugauaaaggagauaguuggugguauuggaaaugcagcucuauccuccucacagcaggaaggugacuugccuugcugagcaauuugucuuacaggcuugaaucguauucucacugauaagguccucguuucugagcacucauuucauaccuuaucauuuuucuuuccgcagagcuguuaauguagugcuucauggcccagaggucagacuugaccuccuuuaaaauaguuuuaaaugcacuguucaucucaucuuuaaauauguuguagcucuguaaaguucuauaauguaaguaacccuuuauggaagguuauaguguggaauauuuuuuaauuuggggaauaaauugcuuuucuguuagugaagauuauuuaaaacuggaauugacauaaauaucauaaugcaaaaauauggcuuugugugugugugcuuauagaagugauauacacacacacaugaaaauaccuaagaauacuuuguauucacuuuuuugccuguaauuccucaucacaguauucagagggaaauagcaaaaauacuacagaacacagagguguuuuccacaccugucuggaaacuauaugagaagauucagaucccaaacaacccuuuugagccuaugucucuuagagguaaaauguaaacacagcaacaucgugaccuaagauuaucaguacaagacuaucauuagcauuaacuacauuuuguuauucgccaaagagaaauaucacuguuagcuuaaaugaucacaacaaauguaauaagauuuacaauucgacuuguuaagcacacacaguuuaguugcccacaaggccuuuuaaaccuggucuggcauacuauggcaugcuacucaacuuggaauuuuaacaagcccugugaguaucuuaucucaggagugugugugugugugugugugugugugagagagagagagagagagagagagagagagagagagagagagagagaaagagagagagagagagagagagaaagagagaaagaaugaaaaugagagcuaucuacuggcuguccccauuauaucuuacuuauaaucaaaauacuugcuucaaaaaacuaccuuuaacuuuuauaaaagaaugucuuccuguuuuauuuugaaaaaugaaagccagacauguuaaaucugggcauguuucauaggacaaacauuugauaaugaaguacugaauguuuuaguuuaguuacuauauggagauguuaauuuaaggacaaauuaucuauaauuauggguauacauaacuggcuagauuucucuauacauaauuauccaaaaucaauauaagauuuauuuguaaacuaacuggcaacuuacuacagcaugccugacuagaucuaacuaugggaaugacagcauuuaacuucaacagcucugucaagaucuuucugcucaagaagcauuaucauuacauguugguuugcucaggucccugaaaccucaggcuagguagacugagaugguugaccauccauaucuuaaaucuuaaaaauagauucaaccggcaccauuaaaauguuagugugccugugaaaguacauguaucugaaacucaagacuagcgaaggggaccuagagaaaccagcaagucuugaaucuaauccuuacaugucaaagucuuaaagagagucaacaucuaaagagaaaaggguaugugagacauucauuaauauauuaauuaagguauuaauuaaaagcaaauauuucuauggaaaggaguuuaaugacaaauugucccugaccaauaugugugugucuauguaacaaauagucuaugaaaagaccucaaaauucuguaaauucaguuuuauggagaauguuuaacuauuaaauacaacaaaauagggaggaaaggcuaggagaagaaaguuccaagcacacuuguaauuacagcuuuacuaggaaacugaagcuuagaguuucugaugcugauguggaaacuguuacuaaacacuaacacuaucuagacuuuaguuguacuugguuugcacaaaggugugagucauuaaaaaugaauuuaauuuugagugggaaaauucagaagggagggaugacaaaaauacaauacucauaaaauuuuaagaaaaaaauuaaagaaugauuuaguaucuuauuauaaaaauaacaauggccaguguaaguuauauuucuuauuucauuacuacucccugauauccuauauuccugaauuuaaaaguauauaagaaguguuuuagguuacuaaaccaacauacuauaagacagaaaaaggcaauuaaaauuauacaggaaauaugaaacaaaaauacuuuaauagugguuagggaaauauuuuaaaauaaaacucuuaagcuccugguauucuagcagacaucuagcucguaauugguaagguucaugagauaacuagaaacauuuauguauauguaccguuaacacagcauauguaccuuuagucauuuacaguguuuucagauauucagcuuuuugauacggagaauggcuuaguuuucauauacauacauacuggcuuaguuuucacauacaaacauacauacauacaaauaaauaaauaaauaaauaaauaaauaaauaaauauuggucugguuugugguuaugaucuuaagugaauaugccuacuguguauuccuaucaugcuguguuguuguugccuuaauugucggaaacuaaagaccaacaauucuuuucuaucugcaguuuaguugauacacacauauuuuuacauauuuuuucuuuuucaagauuaacuucacuuuuaccuuuuaagaaagguuuaccuuuuaucccaguguauguuuguguuuguuuacguaugcuaugagcaugcgagugugcacagauaccagggagcccacuggaguuaaggcagcugggaguuaccuucugcuugugcugggagcugaacccagcuugucuccaagggcacuguggacuccuaagcacugaggcuuuucccagcccugaacacauggcuuuuaacagaauuuuuaaaaauauggaaaaugguuuagaauaagagaauacuugaguauagaaugggaaaauacagaaugauaugacauguucugugauuggcaguaagcuuauaaacagacaaacaaacaucuuuuaaauaucacauucaacugacucauucccuauccuuccagaaccgugaauaauaguugaaaucaucuguagccauuaaaggccaauauuauuacaacuucaaaaaauaaaaaagauguacaaugcuguauuuauaguacaaagaacauagguucuggauucaaagacuguagaucgcaucuggcaucuacugcacauucuuuucauuuucuuuugcuauacaauauuuuguagaauagauuuccguggugcaucuuucucuuuaccuuuccaaacugccuccuuuuuuggaucaaauagacuuuuuuuggacacuacaugacaaaacaaguuucagauuccagauaaacccuucaagauaaacuuuacaagccacuuuuucuuuuuccugccauauucaaauaacuaaucucagcucaguauuaaugcugucaacaucaagaugagcuuagaucuagauuugcuuucauaaugaagccacaagauggacuuggcuaaaugaauaugcaaguacuuaaguagaacuggucucagacucagucuuagauuuguuucuggaggcuuguugaugaaugagacacuguacugagcugugaagauguuguucuuggccugagaggacucagcuugaaggauggcgggcauacuucauucccuccucugcaguuguucauucuggucaucauuguuuacuuggucuuuucccauuucuguuuucuuucacaguucugucuucuuccauuuccugacuuuccuucuuaaacaguguagacuacacauaaguacagucaucaucuuagaaaauacuucauuuauaagcucuucugagguuaaaucugaaaagccccacuuaccaucuucuacuccauucuuauccacaaguggauauugcuggaggaaauucaucauuccuccuuacuuguucgaccuguacauuuuucuuugugaguguaauguagcagucuacucuaaacauuuugcaaaaccaaaaacgaggaaaccagaacaaagacaguauccuaguaacuuaauuuagaacacucuguggcacauuuagcuauacccagcccacuaaacuugcuuggcacuuuauugagaaaaucuaccuggcaaaugaaaauuccucugucuuuacaaauguguaccuuccagccucuucuuguagaggagcaccugucuagaggaaguguucuuguuucuaccaguaacuaauuucuuuccauauacacaugagaaggguaacuucuccugugcugaaggacuuucuuuauaucuuauaucuccauuuaaaauauguucuucauccccucuuaucuccucagcuacccauaauugacuuucugacauggacaaagugcucuugucauagucaucacuuacuuguauauuguuaagucucagagaccuuauuuuucuuccguuuuuuuucaacuugucaauaacauucaacccuugucaucguuggauaaguacauuggauaaauuugaaauacuuguuuugguuuucaugauaacuaauuuucuucccauuucauuggccauuuguuuuauagauuucacccacauuccuuuauuccguaucuaaauguuaaaauuaaaaaaaaaaaacuccuuuuuauuuauuacucgugcuuauguguguucuuuccuuaacuuauugguaccuagccucauagcucuaagaacuauuaauauaaugucaacacccagguuuauacuaacuacuuugacuucucccaugaguuuuagaccuauguguuuuaguauguauuuaacaccugcuugugaaugcccuauguguuucccucauuaauuuuucacuauucuuugccauaacccauuuuauaaaagcugaaaucuaugaguuuaucuuaguugauaucuuccucugcuuccuuuucaaacccaucucuggaguuguuuucuuaucucagacuuggagcuuucuagaguuuccuccuuccugugaucuuauuuuuaaguauuguuauuacauguauuuauguuuguguugugugcauagacacacaugaaccaaaggacugugucauagaaaucagaggaugauuagcaggacucaguucuuacuuuuacucuguggguccccugagcuggacuaaaauguccauaccccaucucucagccuucuaauaauuccuuuucuuucuuuguuucuuuuuuugcuagucguacuagacccuccugaaugggagguaacacuuuucaacucuaauacuucuugcacuacuccugugguuuucuuaagagcaaauauaauucuuugaaagaauuugccugaauucuuuuuuuucuuuuaauuuaauuuuuacacuccauauuccauucccugccuugcccauccacccuccaacugcuccucgucccauaccuccucccuuccccaccccaccuugacguggaugcccccaccucccaccccacucuaaacucccuggggccagucucuugcugguuaggaacaguuaggcacaucgucucugaguugaacacagaccuggcaguccccuacugaaugugugcugugggccucauaucagcugguauaugcugucuauuugcugguccaguguuugagagaucuuggaguccagauuaauugagacugugguccuccuacaggaucgcccuucucagcuucuuucagccuucccuaauucaacaacaggggucagcugcuucuguucauugguugggugcaaauaucuacaucugacucuuucagcuacuuguugggucuuuuggagggcagucaugcuagaucccuuuuugugagcacuccauagucucaguaaaagugucaggcccugggaccuccccuugaacuggaucccacucugggccugucacugaacuuucuuuuccucagguuccucuccauuuucaucccuguaauucauucauguccuuuugggucugaguuaccucacucaggaugauauuuucuaguuccauccauuugccugcauaagucaggauguccucguucuuaauugcugaguaguauuccauuguguaaaugaaccacauuuucaguauccauucuucugucguggggcaucuaaguuguuuccagcuucuggcuaucacaaauaaggccacuaugaacauaguggaacaugugccccuguggcaugguggggugucuuuuggguauauucccaagagugguauagcugggucuucagguagaucuauuuccaauuuccuuaggaaccuucagauugauuuccagagugguuguaccaguuugcaauuacacaaacaaugaaagaguguuccucuuuuuccacauccucaccaacaugucccgucaccugagguuuugauuuuagccaacauguccacuuggacuuuagccaaucugauugguguaagguggagucucagggucauuuugauuugcauuucugugaucacuacacggacuuugaacauuuuuuuaggugcuuuugauaugagcccucucucggaugugggguuacuaaagauuuuuucccaaucuauagguggcugauuugucuuaccaacuauguccuuugcuuuacagaagcuuuccaguuccaugaggucccauuuaucaauuguugaucuuauagcagaagccauuggaguucuauuuaggaaauuucccccugugccaaugaguucaaggcucuuucccacuuucucuucuauuauacugaguguaucuggcuuuauguugagguucucgauccacuuggacuugagcuuuguacaaggugacaaaugugggucuauuuucauucuucuacauacagacagccaguuagacgagcaccauauauugaagacacuuuccuuuuuccauuguauauuuuuguugucuuugucaagugaccauaaguguguaguuuuauuucugggucuucaauucuauuccauugauccacauguccgugucuguaccuaaauucuuaagaugacccagguuucuggauuuuuguacauuuuaauuauuauaucauuucacauuccuuuaguuauauuuccuuuuuuguucuuuggguuccuaauaacaguuuucagacaucuauucuguuugguuuuaaguaacugaauuauaaacuuuccauuaucugaauacccuaguggucuccagaguuuuauguccaguuagaucuuguauucugaaggcugugaaaggccaugauuugaugaugcacauucuuccuguuuucagugguagguuguucuguacaguaucaaaugacuaucauguuagcagaacaaucgacugcuuuaugacuucagguuuauuuuuuaggauaguauacuagaagaacaauugcgaaugcaucuucauuguuguuugacacuuugugauuucugggagccaaauauuucaguugucaccauuuuaugggaguauuauucuaagaaccugguaaguaaagagaauauggauuugcuauaaaaauuugaaauuuauaauauuugacaagcguuuuacgauuuaauuuugagaaaugugaauuuuuuaaauaguaauuuuuguuuggaguaggauguagcuugcaaguauuuuaucuuucauaaacauugucuauagaaaacuggcauauggaaucagcgcuuggugucuuuucucuuuugaauggguaagcaaaguaaccagaaguauaggaucauacaaauuaacaaucuuuauuuauaaauuaaaauauaaaauuuaaacuugagcauuuaacauuuuuagauuuuuauuuauccguauggguauuuucucugcauauauguuggugcaucauguaugugcaguuucuucagaggccagaagaggccaucagauccuuugggacuagauuuagagguggugugagucaccauguuggugccgggaauugaacuuggguccuuuggaagaucagacauuaacuacuaggcuaucuccagcuccccucacuuauuauaauaucauaauauuuaggcuuugacacaauuaauauucacuguucacaauaagaaucuuuguaccugaguagucuuuaagcuaaucgauagcuauauacuucauauauacacugguaagggaaaaauuaaaauaccauguaacacagggcagagguuuuuuuauccuucuaggugaacauaaaagauugugaucuuuuaacuugaccuuugagucuuucuagucucagaagggucugggcugaagguguaguauagacagauacaugaggaucaaggagggcauuguucauuccucuuuuggugcuucugaagguaauaggaaugacuuggagagauggaacaugagucugauagaaugguaacccgaagggcugagcacugaauucuaguuaauucagaaaauauuagaaacccccaaugugacaucaaauauguuugacaaugugguuuauguagauaaaugacauacaggugaauuaguaguaguaauguacacaaauaaugugaguaaaagaaacuggauuuagaaaggaaaggaauaauuaggaaaauaaaaaauuugaaccauuuaaaaaccucaguuacuuuugugaguaagacaaauggguuuaggauguuugaauuuugggaugaauaaaauaacuucuuucucaggguagaaaauggcaauggaaauaccauauuuuauuuguacuuagagcuuauuaaauuagaaaguuuugugugaaauauauaguauaggaugauuggaaagauggcagauuuugcaacaaaauguguccaagcuuaguuaggaguuuucugucacagaaggcuugggaaauaguuaacagaaugucauaauccaauuuuaaguaacaccuuugccccgagagugaaaaucccaacauaacaaaggaaaugaaauauagcaugaaauaccuaaauucuaauaaacugacuuauuaggaagugcugcaauuuuacaaaagcaccaccuucuguguuucaggaaaugggcaucuagacaaugggcauuaguguuuguuaaagcaaauuggaagaaucuguugggagucacugauugcuggccaaucugccagcaaucuaugugaucaaccuuuacaucacagaaagugugucuuuucaugaacugcaguaggagcuacucaguacuacuagugauaaguuccagccaaaaccuuuaauaugaucaagcugucuuuccugauaugauagguaucaaacaauguuaugugaagaugugagaauagaucagaaugcacuguauauguuucugaaauggucaaagaacaaaaucaaugaaauaaaaaagaauguuaaguaaccuuaaagagauacaaacaagagaaauuguacaacuaaugacucacacacacacacacaaaauguauaugcuugguugacccuuguacaugcauauucauuguaguacuaugugcaauccucaaguuauggaauuagcuaugaaucuccauaagaagaaaugcugauuucucugcccccaucucugguugcaaucuggacauggcauuguaaugcauauucuaagaaucucugacucaaaguuguauaaaccuauuuauucucugauuugucaauaaaagcugaucagccaaugacugagcaggggagagaauacgucuggacuuugauccuaguggaagggggacaaggaggggacagagagacagagagagguugggguggggguuggggggggugaagagaacauucagccaagucuaggagacaccaugggaacaucccuggagcagggagagccagaccaauacuaaaaugcaaauaucucagagauuuuugucugggagguagccauguuagcuuggaggauuacaauagauuauaaacugcucagauauuaugauguaaaccuuauuaaauaaaucuuuauagucugugauucauuugggagcuagccaguauaaagaaaaaaauuaccauguuuaaaauaucacuaacacaaagacauuuaaaaacucugaauagaaagccaaaucaaacaaaccauugcaaaaagggaaaauaaacaauugaaaagaugcaagaauaaucuuauauacaccuuccauguaaaaucacaugaaaaagcuggauagaggaauuuaauguauauacacaaugaaguuuacuugaccauaaggaacaacauuuuuauacuuuggaaguaccauuaugguagaagaaagaagcuaggcuuagacaaaugucuccuauguucuaucauaaauggaauuuaaauuuaucuaagacaagguaucaaggccaggcauggugacaaaugccuuuaaucccagcccuugaggugaaggcaaucaaucuuugugaguuugaggacagccuggucuauauagugaguucuaggacagccagggcuacauagagaaacuauuaaaaaaacaaaaaacaaggcaucaaauuagaaggaauuuuagggauaacaaaaguacuagucagaauggauguaaagagaacugaguaugugacagaacaccuguauggugguuuaaaugagaaauaucugcaauauucucagccauucaaauacuaguauccaguuggugacuguuucaauaggguuagaaggugaggucuugcuggaugaaguuugcuacuaggggcauguuuugagacuucaaagagaagcaccauucucaguuuuuuucuaauuccuguuugugguucgagcucuuagugcucagcagugccagccaucuugcuugcuugcugucacacuucucugccauguuuccuagaaccguaagccaaguaagacuuccuuuccacaaguugucuaguguuugucacagugauagaguuguaaccaauacaacaugcuauacauguaugaaaaugucauaaugaaacccauuguuuuguauaauaaagaucuauauucaguauucguuauccaaaaaauuaaguuacauaacaaaaacauugagaaacauggaaaaaauagguuuuaaggaacauagcuucauuggacaaaucaccugguaaaaauacauuuucgggaaaauacaaaauguaaggaccccuucauguucucuguuuuuauguaauuaaaaaaaaauuggaggguauauaugcuaauuacagucuaauaaaauauauuuauaauuaaaacaggucaaacuuuuaugagcuaguugguguuuucagcuuucguuuguugguuuuucauuuagaauagcuccuucaguauuuccuggcuuccuuugaaaggccuuaccaauauuaucaagucuccacugucgaugcuuacacuggugaggaacugcuguagugauaaacaagacccugaccucuauaaguccagcagcaguuacaucauuuuucuuugcauucuggcaaaaguuguuaagaaagcaaugagaaccagcggcccucacccuuggaagcaaguuaaaggaagguacgugcuauauaguaucucuucgucaugaguguucaccaguaccuuugacuggugaauuaacuuaugauuggagcuuuugcacauuuaaaguguaugccuuaaccuaugaugccauuuuuuuugucuugucaauauguuauaaagagggacaauauuaauauucauaaacuagaggguuccaguuucuaacucaucuaauuauuacugaaaauugcaauucuguguauuaaauaccagaguauuaggaacaguuuuggcuauaguuaauuguaauauuauauaauccuuugcuuuaguuauugaaagugauagaauucuauuuuuuaauuuuuaaaaaucauuuuaugguacauugguagcuauuagguucaugcuugauuuuuuuuuuuuuuagaaaaauauuuuuauuacuauuuuacuguuagucauuucuguguacaugugugaaugucuguaugugccugaggguaggggcauccuuuggagcuggauuaacaagcaguugugagcugcugauguaggugcugggaagagaacucucauucucuguaagagcaauauauuuucuuaaccacugagucaucuuuccagccucaguaagguuuuguuuuguugauguuguuucagguuuuuuugagaauggguuucuuaguguagcccccggcuguacuguaacuugcucuguagacuaggcuagccuggaacucacagaaauccaugugccucugcuuccaucacccagaaaguuguuuaaacuuuuuguguucuuugaauccagguauuucaauguugcuuccuuaaaugagacuugaccagaaccuaguagaaccaaauagcucuaauggggacuaugccuacuuuucauucugguuugguguuucucucucucucucucucucucucucucucucucucucucucucucucuuucucuucugugugugugauugcgcgugcacacguacaugcacauuucuacuuuugagaguuuuuuaaugaauauaaucuauuuccaguuucuaugacuucauggaaacccucuuuuuaagccuuugccaugcaguauacuacuaucugauacuugcuuguuuuuuuuugguaagaacuuugggggagaaaauauucuuguuucugacauaaaguuuucaaaauuuguuuaaugagcugagugugcuaauaugcccuucuagcauauugggaauaugccaugagaauuguuaucucaugaucacccuuagcuacauagaaaggucaggaccaucuagacuggaugaaaaacuucucaaacauaaauacuucugugaaaacuccaauaccuuuaacuuuaacuccacuaauuaagaaaauuauuguaauaaaccugauaacguuaguaagccaauauuauauauuuaccaguguagugaugauaacaggagagaaagagaauuaaacaggucuuguggaacauauuaaaucuuauauaguuucauuauguaugaacauacaaucucuuguaugcuuuaauuauuuauguucaaacaaccaaguauagaaacuacgaaacuuagcagucuaugaguaagaagucaagaugacuugcguuccaguuccaguucuaagccccugaauguugagggaaauauaccugagcuguuagguacaaagcuguuaggcuuugaugaguuauuacauuucuuaaugguuggcuuauauauuugagcgcauauacuuuacaacuaaguaaaaauuucaugguuccucaaauuguuguaaagugcaaaauauaaccagguuuuucuaaagcguagauaggaaaauauugaagaaaaguugugaaaaguaguuuagucaaaauuccuauaagaacacuugaaauuguccuuaaaagaguuuucugauguugagacaaaugccugagguaaucaauguuuacauaggaaacgguuguuuuggcucucgguuuuagaguuucaguccgugaucuauuaacacuguuguguugguugagguaucgcauccucuugagaacacaucacagagcaacaaccacuuaacuugcugucagggaacagaaauaaaacauggcaggagguuggugugucaguguccuagugcuacuuggccucucuccuauaaaugccacuacuucccaggguucuucacuauugaucaaaucucaggcauuuguggacaguuugagauucaaacuauaacuuauauucuuucuuauugccaagaaggaaaaugauggaaauucaaaggcaaaagcuaaguaccauaggaaaagagcauuucuaccaucuuugagaaaagcuccugaaucccaugauucaaccaugaugguuuacugugucagugggcaaugggaaguagacggcaacaucaaacaaugaagaguuaauuuaaaauuugacccagggaaauggcucaguggauaaaggauaggaauuagaauuuugucaucuguguaaacucuagguagaugcagaaacugacacagucuuagcccuagaagagcaugaagugaauccuuggagcaagcugggaagcuagacuagcugaaagauaaaacucuauguucagugagaaguacuaucucaacgugggaugcagcugaggaagaccgugaugccaacauuggaccucucuaugaaugugcacagaagcacuuucugcacaugggcucucauguggguauacaugcaugcacacaaaauuagccaaaacuuuauaauaauacuguguugcaaauauuggaugaagauaucuuuaaaugauagauuuuaguuaaugaaauaaucuuaccaauuuucauguuuuguagaauauauucuaaguuucaucaaaaaagaauggaagaacuaacugaaguuggccuacagaacuuuuucagccuuuuucuacuguuagcagcuguugcagagauagaagauguagcaagccauguuuuagaccuccuucguuuccucaggccugccuccaugucaucucauggagcccuuguuuggaagggucagauggcauuucuccugauguaugcccagaaaaacuuggacauugguguuugggcugagaaacugucaugugaauuccaagagaaagcaaaggaauucuugguaucuaagaaugaugaaaugguacagagacaugcucuauggacacugcuuugcaucuauauugaugguguucaagaaguauuugagaccagcaguugcuuguauccuucucaugagcaucuucucaaugauggauuuagcauguuacugccagccugucgagaaucugaacuuaggacaguccugaacuuucuacaagcuguucuggcgagaaucagguauguuuucuaacgagguagugauaagcuucacuuuuuacauacuuauauaguccaaguguagaagaguuuguuuuacugcuacauaggcauaaaucauuaguuuuucaaacacuuaaauuuuuuaugcagacacagacaacaaaaaacugagagcagccuggugcgauucuggaacccugcauuuagaccuuccuucuguguuaccucucuguaaaguguuaauuaucaaaaaaggaauguuagucugagcaagaucgugaguucaaauuugauguggcuuaaaucuauggaauguuguucccauggacagauaugggcuauuauguacuauuuuauuuuaauuuaguauuuuuuauuaguguaugugugucuguguguguguguguguguguguguguauguaaugcaugagugugaguggguauacacaucuuaauggcaaauauaggagagaucacagcccccacuccucaaaccccacacaaccacaccucuaaacucccuggggucuccagucucgugaggguuaggugaaucuucucagacugaacccaaaccgggcaguccucugcuguauacguguugggguccucauaucagcugguguaugcugccuacuuggugguccagugucugagagaucucggggguccagguuaauugacacugcugguccucuuaaaaggucucccuccucagcuucuuucagcuuuucccuaauucaaccacagggggcagcaguaaauuauauuuaucaaaauguuugucugauuuauugaugucauaucauuuaccucagugucauuuuugugauugacacaaaauuuuguucuuuaaaauuaaauuaguaaauuaucuuagcauuaaugccaaucuaaagguuauaaaaaaaaaacugcuuaaaaguaccuuaugaaugugggucuguugacggagaccacguuguuaggaauucagauuugauuguaagaacugcagggaaaaaguucacccaacaguguggacuccauguaaggugaaacaaguuuacuucuguguuaguaaauguucuuaacugguucuagcuugagcucgagguuugcuguucuuggaacagagccugugucugugugucugugcauguguaugcuguuuauuuuuuagaccagccuaugaagaagggacaaauuauagugguaacauauacaaacuuuuguauacauauguauauuuuuuacucuuuuguaaaauuucuuuuuagaaaucugauguguaugugcauaugaaugcaggugucaguggagaccagagggguccaagaggccuaagagggcaucagauccccugagcuggaguuaacaagcaauugugagcucucagauguggaugcuaggaaccaaucuuggauccucugggaagcauucuuaaccacugagucacaacugugacugagaacaaaugccacaaagaacaucuuacaaaauugaugucaaaaauagagcuuugaggggauucugaggucagugcgaacagagugaagcagcuguguacaggucuuuuagugcuguuacacuuuagauuuauuaacuuguaaacugacucuuguauaguaauuuggucacaucgacauuaaaacauuugaaagaaauauuggcagcauagacaggcauuuucuuuggaauauuuugguggaagaucccagaaaucauacagauuuuacuuuagaaagaaagggugggacuuuuuaaaagcccucugguuaucagaacauaaccuggcuuguuccugauuucuuaauccaaaaucuauauuuuuuguugaagaucauuuuguagccuacucagccuguuuauuaaaaauauagaaaaacucagaacguuuuggauaguuuuuaaaaauuaaagcagaggcaccugcucucucugcuuuagaguugagaacaaagcuaaauucuuugacuuuugauuuagguagggaagauggauuacauagauugaugauauuuauucuuggcugcauccccggccaaggaaaaggaugaaauacuuuaccuucacaaucuccucuguuuucaaauucagaugggaauaagguauccgcccuugcauaaauguaugugcaguuguguguaugugcaaugugagugugugugugugagugugugcaguguggauauugaauaaguaacuguuuaauaauuguaugauaaaacuauagaauuaagacuacugauuaaaaggugaagcagcuucuucuaggcuguuaagaaauaauaacuucauaugccacuuucugcuaacugaugaugauggcucaccagagcguucuuuauugcugauuaaggagcguugugaagacacugacuugguuauguuaacuaaauaccuguuuaaaacuccgaaugucaaguagguuuaucggucaucuuuagcauuuuacauuuucuuuaugaaaucacauuucuaguuuucacuugcuguuauuggagguuaauauaaaaauggcagucuuucauuuguggcuagguguagcugaaagcuuuucuuuaauuauauccauucggccugcuauagcuaagggucugucagcauucccauuauaaaccucuauuuucagguuuuauaacauagcuaugaaaauuagcucugggcaaaaacuugacacauaaggccucaugggauucucccuccuccucaucccccuuuuucauuuuuacugauguaagggugagugguuucaaaaugccuuuuggcaccugcaaauaucauuuugagcuaaaaaagaaacaauaaauuuuuaggcuuuguaguuguuuguucuaacacuuaagggaaauuguggacuuaugaauuuaagcuaaauggauauugaucaacugacauacuauuuuauauuaaacaagagccuaguaucaaagaagucuaaggguauugaaguacuugccuaaaacacuaacuguugagucuaaaaguauguagcuuaaaggaaaugauuacauuuuuuguaauauggcuuauguacaacuucuuagaagacuaagccucuuucccgacuucuuuccccuuucuccccaugaggauuuuuaacugucuugauagaggagaaggagaaggagugugugacuaaacacguguauacaugcauacaugaguuuagauacauacuuuuuuguuguuuuuuuuucuuguucuagcuuuuuuuuugcauuuuuuuuuaauuagguauuuucuucauuuacauuuccagugcuaucccaaaacucccccacacccuccucccccacacuccccuacccacccacuccuacuucuuggcccuggucuuccccuguacugaggcaaauaaaguuuguaagaccaaugggccucucuuuccacugauagccaacugggccauuauuucugucaaauauuuucuacauuuaauacuucauuuuacuggugugauaucauuuauuuuaaacaaguuuuuuuuccccccuuuggggagaaaacuaagggugccugauuaggaaaguagguaguacaagaggagguacucucuugagggucugcugugccauauacuauucaugcugauucagaaaaguaaggugaacacuccggacagcaugcaggcuucuuucuaucauuauuguguauuuauuaaugaggauggaugguagcuggaauuacugaaaagucauuuaguacaaguaaacuuuuaaaauaaacugaaaucauuucugguuugccccaaaugccacugguguuucaucauauauaccacuauguaaauuugaagacaguguuauaauaauuugggggagagcacaaaagaguguuucacagagaauauauuaccagacuuuauuugagaaauuaagucaagauauguugcuuacucaagucagccaucucccgugcagcuuugguugcuucagaggugguacaguuaucucuaaguuauaucuaaggaauguaauauaaaucuuaguauuuagggaauguauaaaacauaaacuauauacauacauuuuuaugucauuaaauaccucauauauaguauuuugaucuuauggggcuaaaauucugcacuacacauaucuuacauauuuuguaaauucauguaguaauacaaacuacauucuauuagaauagcaaucuuugcuuuuuuggaauuuuacugcaguuauguacuuuuucacauauagguauuaaugucuggaucauuuauugucaauaaaguuugcuauagugcauuuuucuacaucagaauaaaauguuuuuuaaagaucguuuaagaaaaaauuauauacucauaucuuuaacugucaaggguuuagaagugaagguuuaaauauguuauuuauuuugaauauauguauaggaguggaauuguugaaucaugcuacuuaacuuuugcuaaacugucuugaaaggacaauaucauuucauguuucuuaccuccauauaaacaagauguauccuaucaccaaguguggcugcuacauggcguuuccauugugaccuugaugggugugacaugcugccuuacuugaugcugucugugcuucucucugacucauggcucugggcauagugucaccacuguagcuuuagauaaaucuguucguacauuuugccccuuuuaaacuauuuuguuauugaguuacgaaacacaucaaauauaugaucuacaaauauuuuccccuauggauuaauuuuccuguuguauucuauaguauaaaagcuuauguuuuugacaaagaccuauuuuuuguugcugugguagcuggcaacuuuaacuucuugaagaaagagucuguuuauacggucuuaaccucagugauguucuguugggcauagaaaaauaauuuauacaucucugugaucuucaaauccauccacagucugacuuuccuaacaucaauugcgucuuuuugugaaucacccuuuauuuaauuaauugaaacuauuacugcuuguauuuuuuuuugucaaaacucaguguuuagacuaaaaaauggccgaggugauagaaugaaucugugcacugaaccagcugacaaugugugaaaagcaugauuuucaaaagauuaaauucaauaauguaauuguuaaaaccagaagucagaaguagucagugcuucucaugaggggccuucagguaugguagcagaaaagggggggaauucgucuuuuagaaggauuugaggguaauagaaagaugauuuuacaaauuaguacauagaagcuguagauggagucagaaagccucauguauugaaggaguuggucaguaguccaguaagcuaacagguuugucuuuuguuucugcuucuugggaaaauucuagcaugcuuaauaguuacugcagagaguacauaguauaaacguaagggcuuaaagguucauaaacccuccuacucuuguuaacaguauagucuugggaagggacuucugggcaguguuuacugcagcaaagggcagaacaauggggcuggagggagagcacagagaaauuguugguauuggaugauuaagaauaguugcucuuacagaggaccccggauggguucccaguacacacaugacucacagccauacauaacucaguuccagaguaucuaauaccuucugaccucuuuggguaucaggcauguguagacauaacacuccuacauauaaauucuuuuuaaaaaaggcagaaaaaugggcuggagagauggcucaacgguuaagaacacuggcugcuuacucuuccagagguccugaguucaauuccacaugguggcucacaaccaucuguaaugggauccaaugccaucuucuggugugucuggagacagcuauaauguacucauauaaaugaaagaaauuaaucuuuuaaaaaaaggcagaaaagcaguuagacaguacugacuuaugccuaucuaaaacaaugguuguaauaaucuuuuaaugcauucagcauauggugauuuucuuuuauuauuauaugaacaauaauaccuuuuaagcaucucugaaauguaugcuuauccagguaucuuuacucuugaauaauguauuucauuugaauugcucuaauguccuuuauugcuuucaacuugaugguguaaauuuuuuccacagaggaugcauauuaaugcauaaaguuuuuauuuaacaaauucguguucaguaaaguagacaugugugaucuguucaaaugaaaucuucuuaauauuugugcauauguguauaauaucaaugauagacugauaggaaaaagaaacuuagguauuuuuaagucauagccauuuuguauucuguuauuuuagucacuauuuuaauagguaaugguuuguauuucucauuguuuucucuuuauacagcagaucuugucaauauauacaggaaaggagaaaguagugcuuauguaguuacccuguaaauuuaaggcagaaaucucaaauucauucugcuucuugccucuuaagcaucuuugauuaaaaugaccuccagaagauuuagaaacacauuuuuucuaauuaacugagaguuuuggugauauugaaaaguaaagcucaccauguuuauuguauguaacugaguuguuuguggcaauuuuuauuuuguuuuccaaguaaauaaauauuaucagacuauucuaauacuugacuagggaagcaguuuggguaagaggguucuugagcuucuucaucuuugaaaaguaaauucaguuauaguauguuacauuucauauuaaguccaguuccuaguucauuacaguuuuguaaaguuuuguaaaugggacuuuagauuuauauuuucaagauuaucuauucaggaaaucaagaaguuaaccuuauaagguuuuugguuuguuguuuuuuugcuguguaguuacugacaaaaguuuaaaguuaccaaaauuaugaugggggaagugggguggaauauagaaaaucuacuuuucaugguagcaaaggaaaaagagaaaagaacggguauugaaagaacagugaugugagauugagagcauuaugggacaggagcagagugcuuccuggaaagaagucacuuuguuucugcucaguuguggagggaggagaaugcugugacuacuuucuguacccuggaauuuguuaccuuagucagugguaauacauuagaagaugcugaggugaggugacagcauugcuguguuauuugccugaacucaagguucacucuaaacuuuagaccucgcagauccuugaaacauuaggugaaacucaguaaugagcuugugcgaagcuaucuacaguuugcuuacacagcaccaugucaggcuaauuauuaaaagacauguugucacaauacacaugagucgcuuuugugugacagguuugcuaaaguuaacucuucuacaauugugacuuuauuaaaugaacuaaacccagagaaauucagugagauacacuggcauugugacuugguucuacaagggaaguacucccuggaagucagaaaaauuuaaggcccacacauacguuguuuucacugaugggcuggugugauaucagagugggaaggaagccaaucucuucauuauccccagaauuguuuuuggauuaauagagacgcagaaggcacuauaaauaacagaaaaaaaccuaaauucguuguagcuugagaucuaccuggcugggcuuacuguguucuuuuaucacuccaaagcuguggucuuuaacacguauuuuacagagaacauacaagcacacauuuuauucuggcauauuggguuacuuuugccaccauauuguuuauaaggaauauccuuaucuuuguugucuuccugguaaagaagaaugaguaguugcucucuuaaauuuuauuuauuaacauuuuagcaaaauugagaacaaguagggagugaaacuagcauuugaaacucuuaauuucaauuguuucuuccuuaccuuacaagauacauauuuuucucucuuuaggaugucucuugucagauuuaaggcuuauuuaaaaugaaaagaaagcuggagcaauuuucuuuauuccauuucagucuccuaaggccuauuucccccuggugagcucauagcaacagggggguuuaagggaauucagcuuucugcaaauuaaugucucacaucaugaaaauucaggacuuuuuuuuuuuuaucuugaaaaguaauacagugagugcgaguauuauuucuugccagcggguggaagaugaaugauuuugucacaguuuuacugcuugaugagcaguguccugagggucaggcuuaagucugugucacuaugcugcucauuacucuugagcuaaauaagggcugauuggaucuaaauugccuagcacaugggccacagaugagcucagugagcaggggaugaccugcuauucagucugggaguaaccccggugugcaaaugcagcauuagaacaccgugggagaaugagaggcuaccggcugcugccagcaaaagaaaucgaaauguaaaaacucuuugaugcugugauguuagaauuugaaauguaggaagugacagguugaugguacuuaucagcuuuggcuggauuagagaacagugucaucuugcuuauauaaugacagaagaaugaagcgagcagcuaacuacugugcagagcagagccacugcuguugccacaggcaggcauugcugccuccuacuggcaguuuuccuggaaaccaggacaguauaaugaagagaaagcuuccacuccugauuuucagaaaucugcuggugugcuuuuuaaggugguaaaaagcugcuaguagaagaguaucaaaaacgggguggagaggagacuuaaagucuacuggauacaguaaaagcaucaaccuggggaaauugguuguucuagaguagucuagugaaucaaggguuuauaaaaggaaaguacucaaaauauagggcagaaaucccucuugcauucacccuaaaauauuguucuuucaggagaccugggguggguggguugauuuuguauuuuuuaucaauaacagcacuuuacuaacaaauaauccuuggaaucuuacagaguacuaagcacagcauuaacucaguuugaaauauaccugauaaggauucaaaguaaaaaaaaaaaaaauccucugauuauguagcguaugaugcauaaauuuaucucuuaggaagggacgguacagaagacaaaugccucuucuauaagccaaauggucuaaacagcaaaaccaucaaaaucucauacagugcugccuucuuuaacuuuacuucuucaggugugacuuaaaaaaacaucauuaucagacucaaguuucguguauugauccaggaaacugagacuaaacuggaaaagcuaccugucacauaggaguuacucucccuguuuuguuggaggcuaucauacuuuucuaguucauuugcauuuuaacccaacuagaucaaauauaaccaaauuaguggcuuuuaaauauacacgaccauugacagcuucuaauaucaauggcauuuuuugguaucauaauuauugugugugagcgugcgugcgcgcacgcgcacacgcacucggaccugcauauccgugcggguauguguauagcccugaaaucauguacuuacaagcaccacuaaacagacaaaccugguguuauuuguguauuuauguguuuaaaucugcauguagcaauauuacagaaaaaugaggccaugaauuugaaagggauggagaaucauauuacaugcuguagggagaggacauggggggggguugaggaugaacgagaagagcccauugcuuuuugugaaaguuaaugcuuuguuugauuuuccaaauaaagaugcaaagguguguggaaaguauuuuguaucuaggcaugcucuuucuacuguguaguuacuaugucacucccggggugucauucauaaagcauugcagauaagacuuugacauucacugacuuuguuuggggaaguuuuuuuuuuuuuuccuaacauauuuuaaaauauaggaccuuauguguaccuuuaaaauauuacugggagccacaauuuaauuaaacucaaggcuuauguauaugcuuauauagcuauauacaucuuauaauuuuuauuacuacauagaaagcauaaaggaaaaacuuaaauuaaucuuuuaguuuguuuauaagaagaaaacugcaauaguagagguggcaggcuuuuaaauauguggugcagugacuaaaagauugaguaaauuaguauuuccaaguguuaauuuuuguuucuuuaccuguuauuaaugugcccaacuauuuucuugguuuuauuuuucuuucuuucuauagcuggcauauaaaauaguuuuuaauguaacuucaauuuuuuuauugcuuaaaguuuuaaaauuuaaauuaaaauacaguuaauuccucuccuuucaacacauucuauguauucucacuccuuucaaauucauggcuuguuuuucuuuaauuauuauugcuacguguauacaaaagcacauaaauauacaaguaacaccugcugagucugcuuagcagugcuuuugcacagccuuuugggcuggccacuuagugugguauaaccaaguaagaggcucuuuuggggggaauauuaaguucuuucucagcagucauugguugccuguaauucuuugucuaggcuuggagcccugugagccuaucuaguuccacauuagcaucucuguugcuguuaucauuguuuaugacuuguuuaggcagccauauuguuccaggauuaaugguaucaugggugaagcuucccagucauuucuauacaaucucacaguagacuuuuuaguccucuggcuuuuaacaaucuuucuaauuaaucuucagugauauuccccugagucuuagguacagaaguaguguagaugcaucuauugaggcuagacacuccauuaucaguauuucugugauugaccagcuaugguuuucuguaauggucucucucggccauaaggagaagcaucuuuggugaacagugacaguuaucugaguguagaagaauaaguaauagaacuugaagcauuugaaagcucucgagagauuucaaugauugucuuacauuuuucuacuaucaaacuucuugugucuugaaaagacuaagugauacagaaguauauauauuaaugguagaaaauguaaguccugucuccuccagaaggaaccacuagcaauaccguggaaauuaucaucucuuuaaaauguguuugugugugccacaugugugcacgugcccacagaggccaaaggacaguauuaugugcccugcagcugaaguuacagguggcauuuguaaucuggccaacuugaauccugggaauugaacuuguguucucugcaagagcagccacccagcuucuuuacugcucuuuugcugcuuuuuguugcugcacaauuuuuauuuuauuuuuucccuauuaacucuuucaggugaaaaucaagcuuaaaaauuauacuaugaaaauuuguaacuugauuuguuuuuguuuguuuguuuuugagagcagguucucugaugcucuggcuaucuccuagaacuaacaaauguagguuaggccggccucauacucucagaguucugcuagccucugcuucccaagugcugggauuaaaggcaugcaugacuauuccuggcuccagucuuuuuuuuuuuuuuuuuguaaacugacaaggauauuaaaaacaucuuacugcacauacauaugugauaacacaauauaucaugaagcuuccauuuacuuaauccaguuaacauuuuagagcuguauauuaaauuaccuucauuuuugugcucauucuauuuuuuaagauuccaguugccugaaauuuuagguuacuuauuuuuuguuuguuuguucuguuuuuuuuuuguuuuuuguuuuuuguuuuuuuucugagacaggguuucucuguauagcccuggauguccuggaacucacuuuguagaccaggcuggccucaaacucagaaaucugccugccucugccucccaagugcugggauuaaaggcgugcagggauuuuuuuuuuuuuuuuagguugcuuauuaacaggauauuagcuaguuuauuuuucugaguuccugaaauauccagugucuuaaaaaccagaggaacaaguuucuacuuaggccaauuaaugcuuggaucaucacauaaaggaucuuggaaaauucuauuuauuuuuaaaggucacaaauacagauuugaggguuuuuuuuuuccuaccauucauaaucuuuagcaaaucauacaacuucucuaagccucauuuuucuaauuuguaaaauguacauaauaauauacuacagagcugcuuugaagaauuggagaaagaguacaugacuaaugcaugcagaaugccaauagcuuuuauuguccugacuuuccucccuggcucuggagaagagauaaaggaaagacaugguaacuuuccaagagaauuuuaaagucucucagugcgaaaguugugaguuuuguucugaauuaucucagugauauucuuugaaaaaauacucuucauauuuuaaguaaacauacuaucuuauuacucaggucacuuauguuucuugguacguggcagguaauuuugcuugugguuguuuuauuaugcaugagccagaaguuauuguuuuucagucagcucauuuuaaucagauguccaucggguagcuguuauggaacuuugugcccuguugagagaagagauauaaaagcagucuacugcccucaguccccugccaccuagggaaacagacauguaaauaaaugaaaggcauucugauugauagaauaauagacaaaugcugaagauauuuucuuuagacuucuacauccguuacagaauuuucucugagauugcccuguaccaauugauggaugugauuauguguaagacaauccugcuguagcacauagcuggcacauaagcuccaagggagauaccaaagucucuagaaacuuacagaucgaaauucaaaagguuuccuaaauuguucuugaucucuuuuacaaauuccuuuaauaaaaauaauuagcuccuuccacauauggaauuguuuuaaaucgucaugauuagacuuuguuaugaguacacuuuuccaguuucucucacacccauuuuuuucuguucucugucacuguaaugccccucucccucuauaugccuccuguucuugaucuuuugaucacagcauacucuaauauuuuauugugaaaaaauaauccgaaacaccauauugccuugugcacuuagaaauuauguaaauuauugaaccagaggggcugccacuuacuucuuuuaucuugauucugcuggugcauacauauuacuggagggugugcauauccgagaagugacggauuaaacuaggaccaagcaauacuagucugucauaggaggauucaaguaaugaaggaacaggagcuagacaguaccaggggcaggcaucuagugcuccagacugagaaaggcugauggcaagagaaggaagggagacgugggaagggggaaguuagaauuugaguuuucagggagaguaaagcuaacuucuuauuacaugccucagcuuugaaaaguauauauuccugaaaaauucuuuggguaaugacucaguaauacuuaucuugauauauacaaauuuuaagggaagcuuguaagauggccuaagaguaucuccugcucuugcagaggacccuggguuggucagugcaauccaauaccuucuggccucuguacacacauacauguauauaaaucaacauaggcaagacacguauaaguauaauuuuuuaagcuuugaaggguuuaugaauauaaauauaguauuaaaauuauguauacguauauagugguuaauguuuguuuccuuuguuugguugaugguugauuuccuaaggaaaaguacauuguaauuuagcaucuauuucuugauuuuauuuuauguuuuugcccauauacauacuugaaagacugguguauauuguuuuggacgaguagcaguaauggaauaguaaagagcagacacuuacugccucuaaauaucugugucucuuucauuguucucuucugaauucugaaauaguuggagcaugaguucagucccuaccugugauuuccugugugcugaagaccaguaagaccaaauguuagguaguugccaggauuuauguagucaauuccacaugcugaguuuguuuccagugauucagcagugccacacgucuguuccaggagagucugugugacuuguaaccacaucucugcuuucucacagggaagcuuagccuuguguaaaaauuaaaccugcuuuuaucuucucaucauaucuuacauuuugaaugauauucugaaucuauuaucuagaaaacugggugucagaaauuuuuaucauuuaaacauguaaacuugccuagaaaguaggauguacuuauucccauaagaguaaugggugaggauacugauuuaaauuuucauauaugcauauuuugucaaacuuacuuuuaugacauaguuugaaaaucacugaaguuagaaaauucuuuauucaaacugguauuucagcuuuucuauuuuuaauauaaagaaucaaagugaaagaaauagauuaaaauugcugccuguucauauuagcuauggucuuugauauuaaauacuuucuucaucugcucaaguagcuauuaauacaguauuuacauuuauuuaggaaagaggcuacuggcuuaaggcuaagugaaauuuauaugaagaaguaaauugagguaggauauacagugaucuuuugugccuacuuuauaccauggagccuuaggucacaugucauauuucuccucugucugaaggaugaggagcagauagccaguuuuauauugaaugugcuacuauuuugagguuuuucuuuuaaaguugaugacuacaauaugauuuacauugcuaccacaguuaaauuuaacucagguuuaguuugucuucuacuuguguguaacuguuucucauuuuuugcuacuucuauaaaauaaauguacaagagauaaugauaugaggaagucugaaagaagaccuaauaaugauccagccaucaucaagcauuuuuauguuagucaguaguuaguuauuaugagcuauucaguaccuacagaauuuauuuaaggaauuuuggaacagccacuuuuauaggauguuuucagauagagacauugauggugucauaguucauuagaaaccagcuuauuugcuuaggccucuuguguaucagagacuugaggcagugugaguucucauuuucuuuugcuuuggggaaaagagauuugaagacacaauuauaaauuguaacuaguuagguugacuggugaaagauagugggaagauauaugucuugacagccggccucauugaagagacgcuuuguaggguuacagagaugcucaaugcuuauggcacuugcugcucuuccagaguacuuaaguuggaaucccagaaccaggugggucacagccaccuguaacgcuagugcugagggagcugaggcccccuuccugccucuggccacccacaugcauguggcaggaacacacgcauucacacauacacacagcgacacacacaagcaggaagaugcauaagacuaagaaugaaucucuuuaaaaaugcaagggagggggccgugugcuacacaguuaaaugagagaaaauaaaaggauuauggcauuuaagguccuugaaaccaacuuagauauuucuacaccacugaaucuuauguucuuuguuaauccaguuccugaucuucuugcauugugagagaaacacaugugaauauagaaauauagagacaaggggcaugacaggaaggcacugugguuaucaaggcuagacaaauaaaaguguauuuguaaguguuaaucauuucuaaacugcaaacacauaguuuugaaguuguaacuaagcccagguaauaaaaggaauaauaauaauaaacccaaacaaacaaaaaacaccaaauguuuccaagaugcuggcuaguucccuacuaucacagaauauuuaacauguguuuugaauaauauagaaauuuuuuaaauucuaacuaauuuuuugacacagugucucaaucgagguuugagcuggagcuugguauguagacgagaguagccucaaacuucacagaaccccacuugucugccuccugagcguuuguauuaaagagacggaccaucacacuugcuguaacucugaaucuuuauacuucaauaugcuucuuacuuacguuuaacuaauacuuccuaugcucuaggagucuccuagugauuugucuaagccucuuccuccuaagcaugucauuaucuuauuuuaucuguauauaggaagagguugcaauuuucauugacucaugugcucccauauuacuuucuuucuuuuguuuuagguaacacacauuuuucugugugcguguagguacuccaauagucuaguauauuacuuaacuuccauaccccaccaagcuguguaucuggugguccuauuuauuuccuagcagggugaauuaagacuuagggcagugcauagaggugugaucuaaaaccagccaacgacuggaaaacugaggcaaccacuauguagcuccaacccaaagagaagguagauauucacauuagcccucggggucauuaucacuuugaaaauucccuuuggaaauaggauaguggccuuuuauugauaguuuuauuuguaugacaauuuaaaauuuuguacuuaauauuuuucuuucuaaagucgucacuuguaacauguuuuagggacagcagggcaucuuaauucuuaggugaauuauuuaaacuugacacauggcauuugaccagaguucugcuuuuucuuuuauaugugaaaaacauuggccaguauagugcguggugccccccgaagcuaccagugauuucuuucuacaccaaaguaauucaaagcugacuggagaucgucauuuccucugcucuaaucuacuuacagcagacaguuguuagaacaguuaggggacaguuaauuagggaaaaaugauuggaaccuuuuucccucaucuuuuuggacugcgcugcuaacuuaccuugccuguaaucuugaaguauuuccauuaaacauuuccuuuuuuacuuuuauuuugaagaucugaaauugcauuguuuugagaaauauuaugcuuuugaagauguuucuuggcuuggucuuuaauuuagcacuagauuauuucuauuuugaguaaaugguggagagaaagagcuccaagaaaguauuagcacaauuggaacauaauuuaucacaaaauuaaaucgcuuacaaguaauuuucaguaaacuuguuccaucuaaaaccuaaaagacacuacccagguuuucuucuuccuuuucuucaucuucuucaucucuguucuaauuuuuuaauaaacucuggguaaugugaccuuaccaacuuuugaucauauuggcuuugggucacugaggaaaugcuugguggaaacagcuacagggagaggugcauccagguucacggcugcuuugcugucugucuagugugugucugagccuggaguaaagaagcggugcaugacagaacagagcugcucacuguaguggccaccaggugaacaacuuaggguguuagagcucccaccuagcuuugcaaagcauacuaccagugacccaagccugacgaagaguccaucucuuccaguagcacaccagcaaucaggaagcaagccuucaugacaugaaagauguucaagccuaaaucaugguauauucccuucaaaaacauuuaaauacuuaauucucauuugaaaaagaugagauugaaggcucuucuuaacaaaaaacuuuugcccccuuuuuaauuaccuuugauagguuaagacaaauuauuauagauaaaaauucccuugaauuuuuuuuuccugcaaaacaagaauuggagaucaguuuugaaaacugcucagcgaccuuuuguuaaguguguucuguaaauugugcuucuagaaagaguggaaaguggaaaaggaaagugaagaauuaaaaaugguuccaauaaaaugguuuaauuuaugcuucugcaguuaagcagugcuccugguuagcagaaauacccuucagcuacacaggauuuuggaagguuggagggcacucauuugcacauaaauagccauuaacugauaaauucccagaggucuccuguugcauguuagugguucugaccuacuuagcuagcuucaauuuguuuuacagaauuauuauaauucuaugcuuaguacuuaaacuuugugauuaaugcaugccucacaauacaauuaaaguauaauuacacaguuuugcaguuuccuaucguguuauuacuacaagggucuggauuuugcaaauauuagaagaguuaagguuugauauuuuucacuuuuacuguuauugugugaucauguuaaaugguacuuuuguacaucugaagaauggaggaaagaaguuggccaaauaaauuaaggcuuguugguguuagaaggaucagaaaaugcauaauaacuuuggaguguugucuacacugauguguaccaagcauucuugucuaugguuuucagaacuaagaauccucauuccauuuucuuauagaaaccuugucacuacaccauuugcuguagaagcagaacaaguacucugagucuauagagaaacaauaaaacagaacaugggaaccugaaccuaaaaugaucaagguuucugucuucuguaaaugaguaguucuuacuagaaggagcaggcaaaguugcugcuagccaaaucuagaccauggccuauucauuuugagcuuaagaauauuuaaauguuuucagugacaucuaaaguaagaugugguacucagaacauaagugcucccccaacccucagguuuugcagcucccucacugggucuugugcagcuuucugaggcauugaguucagcacuugguucucguacagugcugcuguuccuagccuagcagaguagagugcucuuuaguguuuacagagugauuugugacacgucugacaucugucccuuuacuaccccuuguacauccaguuacuauucucuuguguuugaaauuggugagugcuccuuaaaggucauagcuugaaauuuacguuuuuuuaagaaaaaaauucuuagucauauccaauauuaaagugucagucccauugaaagggguaggaguaacaaaacacuuggauaauuugagacauuuaacacuucaauuauuaugaauacauuaaaauuguguuuuguuuaauguaauaguuaaagaauuuuaugauaaucuuuaauagacugcaaaaacuuuuccuaaaacuuuuucugaacaugaguuuggauuagugucaguagguuuuaucauauucccguguccuuaagaaaggaggugcuccuaugauuuuggcauauuugagugauauucgccuauauuauauagagaaauuuaccaucauaaggaauuuuaaaccauuuguguuuuuauauuauggauauacauuuaggcauuuccaggggaaaacaaaaacaaaaaacccccagauguucaaaguagcagccuuuguguaaaguugauguacaguuuuuuuccaaagagaaagugguuauccuauaaugaccagucuaaugaauucagaaauucauugauugucccagcucuggguagauuaguagagacuugcuugaaggaguggaauuuaugaaauguuugccucauccggcaagcugggcugcuguaauacagcugccuccucagugguuugcuuugauccuguggaaugaaaggacaggaggaucagcucaggucuaaaugagauuacagcugguucugccgcuuaucuggucuauugccaacuaguguggcuuugcacguccuaagggguuuacaacagaaacuguuuauugaguaucaucgguuuacucaacacaagcaggcuaauccuucccagccucagcaugcuguagaauugugcaggagccaaaccaaaagcugguauugccagacccucuagagcccuuugucucgcucuauauugauuuuuaccugaguuaaagacagugaaaaaaaaauaaaaccaauaaccauuccuauuaugagcaaaagguuaaucuuaccuaaaaucuuacaaaaagcaucuguuaacccuagaagggacagccuuccuguuuugcguuuuuagucaagugggauuuuuuuuuuuuuuuuuuuuuuuuuuuuuuuuuuaguuuugaauuuuaaagaacaagauaagaaaaacaguuuaagagaucuugcuaggcauugaaaguuaaguacuuaagucuucuaguagugauauauaacacauggcuuuguaaauggaauaugagguagcuuauuucuaaauaaaaguuuuuacuuuauauccauuuuacauggaauauuuuauuuuuuguauuaccuaccaggcuagaagcuuucauuguggaaaauaaaacuuaugaaugagugaucguuuuuaucuagugguauaucuugguuaauaguaaauuucuguaauauauaagaaguuggugguuugggggaacuguaaaggcaacuuuaguaaauaacucaauuuccauuuuuacucaucaaguuauucaaucuuuggaguuuuuuuuuaauuacuaaacaaguaauauuuaccuugaagaaucuaaugaaacuacauuagaagaguuuagaaaguaacacugaauuaaucagguuaguuaaggcuacuguaguugauaaggagcccaaaggcauugaagauuauaugcauuggauccuuccccugaucuuaaagugguguuuaaaagcuucacgcagcaauccuagcaaggccucagugacacagaugagucauucauuguuguauguguguacccauggguguggagacguggaaaagugaugccaccuuccggcaugguuccugaggacucagucacuuugacucuuuagacaaggucucucccuggagccuggggcuugcugauuaggcacacuaguuugucaagacagggguccuccugucuccacacucucagcgcuggcauuuuaaaugcaugccacuaugccuggcucuuuuauguggauguaaauaauggaacgcaggucuucauguuugcacaacagacacuuuacugacugggaggucuccccagcgccucuugcagagcuaccuuuagagguguauguucucagauagguggguacagaaguugccacaugagcacuuuucccugaaucuguagcaguaaguaccggguaagcugugagugugaaauuuaugcuauaaguuggccaucccuaccaaaaaaaaauccaaaauacaacaauauucaaaacuuuuugaucacugauacgaugccuuaaagugaaagauuucacaucuaacucaucugacagauuguaguuaaacagaggcacgugccucagaguauagacucguuaccuuuguacugugccugaaacucauaggagcuagcaagauugauguuuucacacaggucccaagcauuguaguugagagacucaacuguaguuuaaaauguuuaggaaggccagaaugauaaacuuuuauuuaggaucuauggccaagcucuauuuaugucccuucccgucugagaggacacuuccuagauaggaguagauaguaaauacugauaacugcacgugcuaggaaaagacaaaauagauuguuuaagaagaguacaaagcuuccuagcguuucuuucuccuaauuggugaggaacauguauccucagcuacagguacgugaaaaaauguuacuauggaaacauuuggagacuuucaaaauguacuaugugauggaaucagcuuagacccguacuuaucuuaaacacauaguuuguccaauauuuaaccuaaugggcaagauguguaccaguugaaauguaauauuuauccaaucauuucuguucuaucgagccaggcucuaaagcaagagguggcacucauucaguaauaaaugcuuagcacauuuggagauaaaagcuguugguggggauugcuuacacuuugugcucaauccgcugaauggcgcaaaucaaagcauuuugucaggcugugagaaguuucuccuagauauugcuucuucugcacaugggucaccauauaaauuacacucacaguuuauagcauagcuggugcuagaguuaaauugaugccgagugguggaacucguaaaacauuuuccuguuaauacaagcaggcaggguugacauugguggugcugagguccaucuaauaaaccauugguucucacagggauuuuuacuguguuucagaggugaugaugauaaaaguuuagcaguccaguaguucuucuagaacgacagaaaauuagcuccacugucucuauuaccagauaccaggaaggcugaaaguaggggugaugggagccuaauauaaccucguguucugcaagacaaugaauuacgagaacaaacuguuaauucaauauuugcuuuuuucacaaaggcaacugcugauuuuucgccaaaggauggccuuugaaaauaugauauuauugucuuguuaucuacauaauuaagacuuuuccuuucagaauaauuauaagcagugcaaguagcauuaucauuuauuaccuuuucuuucuauguuuacugaacuuuccuccgaauauucuaagcuuuaucaaaguggugaacagcaacucacuguaaacaguuugcucucauaagaguaaauuuggaaggugggguguccuacuggaauuguaauaauggacaccuuuuaaaaauguauugugaaccaacguggugguguacggccuuaaucccagcacuugguagccagaggcagaugggucuuugaguuugaggccagccuggucuacagagugagucccagaacagugaggucucuguuacaaauagaaaaacuuugucucuggaaaagaaaaauauauugccaaguauuuucacuuuguucaugaaauuucaugaaccuuaauccuuaaaaagggacaaaaguuugcagauaaauuaaaauuuuauauuuuuaggugauauuuacaggaugcugauaaaguccacauacuuuuccaguuccaucuguuugccugagaaucuucucuuaaaguguuaugcguucaugcucaauuaauuggugauauucuaguugguuccauucaccacaaaucuuuuacuuuucuuuuguuuuguuuuguuuuguuuuguuuuguuuuuuugagacaguguuucucugaguagcccuggcuguccuagaacucacccuguagaccagguuagccuugaacucaaagauccacuugccucugccuccucaguacugggauuaaaggugugugccccuaggccuggccacuucaguaguucuuuccucaguauguacaugguuuuguuuguuugcuugcuuguaucaugaaaugggugcuuuaaaauuauagacucauguuuucauugguuccauacagauggccucugcuaugcacaaauagcauaucucaagcccuaagcgugcagaaccaguuaaaagguucauuugcuaaagaauuauaaaaggaaauuagugauauaauaaaagucuuugaggcucuccacccuaauccuagagcuuuauaauaaaccucacagcacauugacuuaauggcuaaucuuuuaggaaagcuuucuccccauccuuuucuuucuuguaaaggacugcaguaaaaguaaagagugcaucucuuuagaggacuguuuguguuacuaagugucuugaaugacaguaacuuaaaauuguuaaguuucuuuacaauuaaauauaaucucauucuaagucaauuugagcugcuuuuuugaugauuaaguuuauacauuugauuuuucauaucuuucucugcuuagaauuaaaguucacuuuaaauugcuguauuuuguauauuaaagcuauagauggguuuuggggaauaguagguacucuagaagagauguaaaaucaagggagaagagaaauuggauugguaaauuaugagaaauuauuugcuucgugcuuagaagguagaagagggacaagagcuauauaugauuaugcacauauaaaaugucauaaucucaagggaguguagauggguaaagcuuauuuauaugcccuaguuggacauucuaucauacuggggacguuauuguuauuuccacuagaauuugcuuacacuuuugauacaaaaccuuucugaagcaucacuauguucuuuuugacuccuucuuggcugacuuguaauccaaacuacuugucacuguuggaucugaugaucggguuuuuuaaauccauuaacaauuggcaguggccaauagugucuccuauaauuuacugguuuucuugaaucugagagaaguacugaggaugcagaauguuuuagagguuuuagaaaauuauuuaucaaaggacacugcuuucccaguugcauuagauauuguaauuauacauccauacaaucuguugacauggaauuggauuugauuuaaauggagggaggaaaaagagaccggacauuuucaauauuuauugauacagccaauccauuaagauaaauuauagaucaaauuuuacugcgauagggccacuuuaguugauguaguuaagaauuagucggcauuaccauuagacccuuuccuuuuuugaaauauauucccaccaauuaggaaaagucuuagaaacagaauuuagucuuaguuuauuuguauaauaggugaccaaaguuauuugaguacauuuaauaaauuuaaaaaaugacuccugaauuuuuauuaaacaaaccauguucccucaucagggaaugucagcuaaagauauaguggaaugaucccauaugucauuagaggguaacaaagcacucuaccauuauuuuuuauaagacagcuggucuguccaaagccucccccugaacucaauuuuaaauucucaauuggcuggugaggccagaagggauauuuaccuaauuugguuccugagaugacuucauucaaaucaccagugaucacaugaucaaaaagaauugagugcuucauuuucuacagcugcuuuccauacucuuuauccugacuuaagacuggaacaacaaccuuagucagcucagcaucuuccauuuccuuagcuucuguauaggcagugcauuuauucucugcacaaaauucuacaggucauuaaacuucuggaaguuccucccccuuuacauuuuagauguauuauuaaagaugaaugcauuuuauuuucauauucuucacaaagggcaagugagauagcuaggcacacaagccugguggccagauuuugauucuagaacccacauaaaggugggugagaaccaacuccacaaaguuguucagaggucucugcaguuguccucuuauagcauguuugcccacagcacaucccggacguaaacaauaauaauaguaaauauuguuuuacaaaaacggucuuacuuaugacuacccucaacccacaagaacaaagauguauguuguucacuggugaucuaaguacuguuguauucuagacgcagaugaaccugaaaagugaccucucaucuagaaggccguugucuuauacucuuguuauuuucauccauuaccuugcuauuaaguuuggagaaugaguucauagaaacugaaccccuaacugagcaaaacuaguuugaagcauuuagaaaugaguugucauggucuaguaaugguuguuuuggggguucccuuuagcaguccacaagucauaauguaaugucauagaccuuaagaguuucuuacauuuauuucauagaacuucaucuaaagaucacuuguugccuuaauucauaacaauugcuugauacaucuuaaaguaaaauaaaaacagaaaccuuacaaugucauauaacacuuuucuccauuucuuuguuacauccagaguuuacauacucuguuauaaguuaagcuauuacuacaaagacaaaauaacagaaagauaguaauagagaaauguauucauucuacucaagaccauauaguauagagcacccacuacuagcauugcaaaauuagccuuugcauuuagcaagcuaucuaaaugaguagauccuugcauuauagugagauaucaguuguguaaggugguuuugucuggguugauuuuuuuuuuuuuuugaccuugaugacuuguuuacuuaacuccagcuuugagaacgcaaacuucugaaaucucaaagauuauugggacaacuguauuuuagcaaggauacauggacuucauuguaggauuacucauaaaagggaucauuugauuacccuaugucuuuauaauguuaacugcacaguauucugguagcagacaaacccagccugaugugcauagcagccagaguuugcccugcauuccauuaauauuccacuuaaauuucugucauucgccacugccacuugucauguuaguaccaaauuguugguaauucccuagaccaauaguucucaaccugugggucguugaugccuuuggaggucaccuaucagauauccaguauauuagauauuuauuacaaucuauaacaguagcaaaauuacaguuaugaaguacuaacgaaauaauuuuaugguuggggucaccacaaugugaggagaacuguauuaaagggucacagcauuaggaaaguugagagucacugcccuaaauaguauacaguuucaugucacuuugcuuuauuccuauuuuucucuuuuuuauuagauauuuucuuuauuuacauuucaaaugcaauccccuuuccugguuuccccucuugagaaccucccauccccuuccgccucccccugcuuaccaagccaccuacucccucuugcuggcccuggcauuccccuauacuggggauucuucacaggaccaagggccucuccucccauugaugaccgucuaggccacccucugcuacauaugcagcuagagccacaugucccaccauguguuuucuuugguuggugguuuaguccuagggaacucuggaaauacugguuaguucauauuguuguuccuccuauggagcugcaaaccccugcagcuccauggauccuuucucuggcuccuucauuggggacccuguguuccauccaauggauggcucugagcauccacuucuguauuuuccaggcacuggcagagccucucaggaggcugaggcucuuaggcuccugucagcaagcucuuguuggcauccucaauagugucugguuuuggugguuguuuaugggauggauccccaaguagggcagucucuggauggucauuccuucagucucugcuucagacuuugucucuguaacuccuuccauggguauuuuauucucccuucuacaaaggaucgaaguauccacacuuuggucuuccuucuugaguuucacguguuuugcgaauuguaucuuggguuuuccaagcuucugggcuaauauccuauucauauuuuucaauuuuuuggacuuuucugaaguauuuuuuuucaguuacuacaacuuucaugauggugcugguauuuccucuccacgaagcagucacuacacuccuaauuuuuuuuaagaucauaguccuuuguauauaucuuaaguguacauuucuugaaugcaagcauuauguaugauggcuagcacucuaaaguguuucauguaacuagauucugaaguguaucugugagcuuagcugcuggacgaaugguucuggugucuaaauucacucuuguacucgagacaaaguuaaaguguuuacauagcucuuuuuuucuuucugaaugcagacagugauugacaugaugggacauuacuauaauagucagaauggucauuuucccucuaacccuguuuuacauguucuuuuuuaagauauaaauuacgcuucuauguuuguggcuuaucaugcacuuuugaguuuauacaggauucuuaccaucauuuuuuuaagaccucacaugaucuccaaccuaguaucugcuguccugucucguguuguacuucaaaccacagggucccuuguuucugacucuguccaugcaaggcucaacaaacccucagugcuucugucuuucucucugcagugcucuucccccguguguccauggcauguccccuuuauucauuugggugcucuauuuaaaugucaacuuuccaaagguguuuuuucaucauuguugacuauuaguuugggucacccucucucaacacccuagaaacacccacacgccacaaacguugucccguuagcuuuguauccugccuucuaagaauauuugcaauuucuuuugaauuggaauugauuagauuuuauauaccuuccuucucucuucauuuucaucugaguagaugauacaugucuucuuucuguaaauuguaaaacagacuuacauguauguuuugugaguuggugaaacaaaucguugaacaaauuacaauuuguuuuuauauacacauauucaguagaggaaugaaauccaccuguugagaauuaaugacuuugucacuaaguaucaucuauggggcuauuagcugcauggccauuucuucaucuaugguagguaguaaauaaacagaaccuucucaauaaguggaagaauuacuguguuucagagaauccagguuuacucagaugugcacacacaugcacaugcauacagacgugugugcaugugaaugccugccugacuguaggugcuugacuuuauuaccuaguuuauuccugaagguacucuuacuguucccaguuuaaagauugaagaaagagaggaguugccugugaccuaacaucugccuguuggaaauacaaccuuuuaggacccugcaaacaucuacugaggcauaacuuaaaacuaaauaguaaacuuaagcccuuugugaacuuuaguuacuguaacaaacuucagugauaaucaaugugaaaagaacaaaaaugcuuauaagccuuacacuuuggagggucuagucacuaaucauagggccucauugcuuggggccuguggcagaacaacauaucacauacauuauggcaaaagcuuguaguggaaccagacugcucaccuuguggcugaaaagcacaaaaggaaggacagggucuuguuaaucccuuuuaaggauauguuccuauuggcauuguaaagauccuuauucagcccucuuccuuagaccuggcuccaacaccuuccaccuccuuggugaaacagucucauguuuuuauaccaguaguagcuggggaugguuaaacauccauuuuaaguacucagccaguauugcuacgugaaaucuuagagccuauuaccauagucuuugcugacguuugcauuugaaguauacuccaaagacugagaguuagagcuuuugcccucaucauucaguacuguugaggucugucucucuccgcuucugaccacuaugagaacagaccuccucugccuuguguuccugccaugacgugauauuccaccuccugcuaaagcaacagagccaagcagucaugaacucuacuuaaugaaaccacgaauccaaguauagaaacacgagcaugcuugauucauuggcauugggcucuuaguucuuucuugcauuguuguuuccauccuugcagauuaagucaucuggcccuagcaaaagcuuaaaugaucacguccuuaaccuuugauauccuuauaaaauaguguauuauccccauuaauuuuaaauuuugguauguugcaucucauauuccacuuuguagcugcuuuuaauaguuuuguauauaaacaaauacaguauuauaacacuagaaauaugcauuauuuuuuucagucauaaaacggcauuugagaaaccacagaaaaaugauuuuuauuugggaacauggaaucuauucuguucagguucuguugcccaugugcagaauagucuggucugugcuuuucuguacuuagaguucucaauauaaaauaaggucagcaagagcaaugagaacugcuuagacaaagacuaguacagacauuauaagucgucuggaauuugcuggcuaauaauaacaguuccucaguuuuuuguuauuuaagcauuuauaaagaacuugucaauaaaauuaaccacacccaaaguuugugcuuacuuuguggccaagaaacaacaagaaaaggagagugguuaauuuaauuuuuaaggaagguuuauuuaauaauuagaaggaaugaggaaauauuccuuauaugaggaaaugcuauauucuggcaugucugucuccagaccuguacuuuuucagugauguucuccugacucuaaaucacacucacuaggaauugaagcaauagaguuauaccugaacuacaagcugucuugacuuacaugcuacauaccuguuuucacauauuugauagguuaccagcucuguguauaauugugggacuuuauauuucuguguaauggaugaaaaacugaguuccaaguucuacgucauaaucuguucuucuuccuagacaaguguucguuuauacacuuugcuucacauaccacagagcucccuuuauuucccccaagucaucuguuguaugucacucacuguauacuuuaucgcugguacugcuucucaauagaaucuguuuguucaaagcagucauagcucugcuuugaucucaucauccacccgugcuccauggaguacuguaaaguacuccaagauuggguuuguaagacugguuucuuguuuaucacuuguacgucauagccuggccugcacaggaauucugaacagaacugaaacuguguuaccucguugucagaggcugugaaaguuucuguuuaccuagaggcauuugaggcugcuuucuccuccccacuuccagaucuuaaagacaggauuguauuagauagugguucucaacuuuccuacugcugagaccccaaccauaagauuaucuucauuguuacugcuguaauuuugcuacuguuaugaaucgcaauauaaauaccuguguuuuccaaugcucuuaccccuagggaggccauggcccacagauugagaacugcuguauuagauaguuuuuaagguuacuuccagguuuaaaaguuugggacuuggguuguauguuauuuuuguauagugaagcaguuaauaguuucauuucacagaaauggaacugagaagcgcauccaaggguaucugaaggacccucauucuucucuguuuaccagcaccuaaucagguggacacuuggaguaguucuacucagugauuugaaacaguguuuuguuguuuuuuguuuguuuguuuguuuuacacuaaugcagaguuuuaaagucaccauguuuggaauagagcuaaaagaaucguucagucuuugaagauuccugucaacuccuacccaucacauuacugugucauguuuguccugugguaggagcuucaucaaaaguuuuucuuuucuuuaaauugugaaacacaauacauuucuuuaaauugugaaaucaaugcauaccaaaaaaguaaucuacugugugaccaguuuaucacaggccugcuaaguuaccagggaagaaugcagagaagagccacaaauuguguuugcugcuacuccggggugguuggggaguggugggacaugugaaaucaagacagaugaaaacaagaaaacagaucguggaaggugggggaaggggaacugaguaacaacaugugcaaaucccuuuagugugagaaacgagucaagacagcagaacugaaugugaauaguggaugugaaagagucugagugugaucauggacuucugaagacucgugacuuacaagacucucguuagguggcuguaaaaaccguuaguuacugcuguuuuucacucaguagagcagaaauugggaagucauuucuuccaaggucacacagcucugcuggcucugccacaacuagcuacaagcacauucucuuuuugucucaauuucuucauuuauaagauuugaauaauaacuguuucugccucacaggaugaaaaauaaugucuauaacauaguugacauaauacaaggcucauaguaaacacuaauaaaugcuagguauugcuauuauuucuacuaugaaagcugcaauuugaguaacuugacauuuggcaaauuuauuuucugugauacuguauuuuauuauuuauaauguaagauggucugguuauuauacuuccacauguguguaucagaacuauuuuaaccuauaugaaaauugucuuuacucaaagagauuuccaaguguuggggaaauuuauaucuuuuuguuuuaguuuuaccuuuuaggcagcaaaugccuuccuguuuucccccugacggugguggaaggcagaagguaucugaagaugccuguggcaucuggaguuacaguguuucccuucacagugggccuagagauggcgcuuccuuuacugccugcacuuuccaauguuccacugucacuacuccuugauaguuaguuuuccauuccagaaacuuugauuuuaaaaauuaccugagacugcacagguauuuugaacuggugguuauaugcagacauuugauucagccuccauaauguccgaugcuugccguuuccucuuugucacugugauucccucggggauggagacguuauggucgaaucuuaauugcccuggaaggcaacagagcuaggaaauguggccacuggagcugugaguaggagcauuugcagguucuggcuaugcagcucucucugugcaguacucaggugcacacucucugacaugcuugcugggggucaggguuucagccuuaauuagaccccgucuuuccucugcucacucugccuugaaaggaauacacccuggcagcguuggauauuuacauaaugguuugugguuuaccauuauguauucagaucucugagucauaucccugagguaaccaguagauauuccugcugugucaucauuuuuugcugcagagguaaaaggugagucauaucuguuguacuuuucaauacugccuugaguacaucuuuuucuauucuuagcuaauauggaauucugcuauuuguuucaaagcucagggccaccuuuguuucuccuagaucuuuccuucuuugcugaaauuuccuuaguccacaugagaugaaacaacaacaacaauuaauguuuagucauuuaaaaacauguauguuguaaaggaagcaucuuucuucagcgucagguuuaggcuucaaugguggguccuuaacccugugaacuuuggaugcauuguuugacucuucugcugucagcuucaucuccuaugaugagccaucucgugggucuuagauuuucuuuauuuaguugacaugucaaaacaugguguuuauacaucuugugagguaacauguuguuaugcauguacauguuaugcaauggucaagucagcucaagcacaccucacucuucagacauuuauccuuuccuuugguacaauguucaagguauuucaaacuuagaauagauuuuuauuuuggggguggggguccuaguagggauuaacaccagggccucgugcaugcuaagcacauccucugccacugagcuaugucacaagccucuuaacuuuuggaauauacaguacauaauuauuguguauacucaucuuacauugcauagcacagcagaauuuauacucgccuuucuguaccugguuuauuucacuuaaugucuucucuguuugucugaaauuucauuauuuuugagggaagaaagaaguagagagguugaugggcacacaugaauauccauguaugaaggcuugaggucagcguuaggcaucuucaguggcucuucauuuuaguuaaggcauggucucucauugacuuagagguggcugacucagcuagucugauuggccaacaagucccaggauccuucugucucacccuucccagugcuaauauuauagacacaugauccuucacccaggucuucuauguaggggacagugcuccaaacuuggcuccccaaauuugcuuggugugcuacuaguuuuaugucaacaugacacaagcuagaguuaucuggaaggaggggaccucaauugagaaaauuuccuccauaagauccaauuguaggacauuuucuuaauuagugauuugugggugaggguccacucuauuacaagugguuccaucccuggucuuggguuccauaaggaaggaggcugaacaagcugugauaagcaagccuguaagcagcacuccuccaugucaucuguaucagcuccugccuccggguuccuucccuguuugaguuccuguccugauuucuuuugaugauguacuacaauguggaaguguaagccaaauaaacacuuucccucccaacuuguguuuuaucacagcaauuggaacugggacacugggcaaggauuuuaccaaccaagccaucuuaaagacccagaacuuuauucuuuuauggcugaguuauauucuaucauauauauauaggucccauuuucucuuuccacucuucacuugguggacaaauaggguuguuuccauuucuugggaauaauaagugaugcuacaggaaacacgggagugcagaugucucuuugacauccagacuucauuuccuuuggauucaugcccaggcgugggauugcuggaucauacagcauuucagcuuuaauauuuucaggaccuccauaaugacugaacuaauuuauaaucacuccugccaacaggguaaaaagguuccuauguuucuacauuaucaccagugcucauugccuuccuuuguuuaauacccuagaaccaccuuuuaaacuaggauguacucuucguauaaauaguaguuuauaucugucuaucauggagauguaaggguccaguagaaaaacaaacaaaacugaauuuugcuguacagacuuacaauaauaucuuucccugucuuagaaguuaauagcaaaaggagaugccuugcaaauaaaacuuuaaauuaaaaaagacguuuguuugagaauuucaucuaugcuuaugcguuuucaaauccauuuuauauuucucccuugcaauuccuccuugauacuagccauucuuaacuagaaugaagucaucucacaauauaucauuguggauuuaguuuuuauuccucugaugacuagugauauugaguguuuuucauaugcauguuaguuauuuguauguggucuuuugagacaugucugaaauauuuuaagugauuuuuguuuuguaaauaaugagauuuuuggauugcaugcuaaccccuuucaaauguguaguuuguaaauauuuucucucugauucuaauugcuuuaacuugacuguuuccucuguaguaguuagcauuuuaguucaguauuccaguugucuuauuuuuggauuacuauauguugggagggguggggccuuauccaaaagcuccuugacuauucaguguccugaacuguuucuucuaguaguuuguuuuaggucuuauauauaauucuuuaauccucuuugaaguuuuuguuuuguuacuugagagggcuagaagacggcucugcucauccacucauguuuugagguaagauauugaaguauagccagaauagcuucaaacucauggucccucugcuucauccuccucauugcagagaauacaggugugcccagcaagcaccguaggugggaagcuugcagauggaaacugaucagaaauguuacuccuucacagggaguagguuuuagugaguaaaaaaguggcuuauauagaaauagugaaucauacauuauuuacuguucuuuaaaaucaguauaccugaaagaaaaaaaaaaaaaaacuauuaaaacccaggguaaggugucauuauuuugguuagacuucagugcauacugucucuugugagacuaugccggggccuagcaaacacagaaguggaugcucacagucagcuauuggaugggucacagggcccccaauggaggagcuagagaaaguacccaaggagcuaaagggaucugcaacccuauagguggaacaacauuaugaacuaaccaguaccccggagcucuugacucuagcuacauauguaucaaaagauggccuagucggccaucaguggaaagagaggcccauuggacaugcaaacuuuauaugccucaguacaggggaaugccagggccaagaagugggaguggggggaggguaugggggacuuuugggauagcauuggaaauguaaaugaagaaaauaccuaauauuauaauaauaauaauaauaauaauaauaauaauaauaauaauaauaauaauaauuuuuaaaaaaguaugccugaucuuuucuguguuaccaggggcaguuaguugccaaagaauucuagugccucauucacuuuauucuaagcuacaggacccaaacuggucuuuagcuucaaguguaaauugaaaguaucucgggaauguuuuuauauggaaaacauaacagauacuuaauuuugggguuuuguuuuguuuuguuuuaaugagaacaguuuacuucugugaagguucugugccccaguauaggggaaugccaagaccagaaaugggagugggagggucggggugcagggggaggugauagaggauuuucggaggggaaacuaggaaaggggauaauaacauuugaaauguaaauaaagaaaauaucuaguaauuuuuuuuaaauuaaaagagaauagcuuuuuguucuuucccaaggcauuuguacacuuuuucuauacuuuuaguaagacuaaguggugucccaugaugugcagaaauacaauguaaagggacagaaguuccaauauuauguaauuuauauuuugaauuuuuacucccugguauauagucaugugacaagauguagucuuauaaccacuuuguagacugacuuuagguacauguccuaaauaaacugcuugaaagaucaagaaggcuaccuuaaaauuaacuguauuguaaaguacucuuacucuccuuaguugaaaacaauuucugacaaaggaagccuugggccuucuuugguuuuguuuuguuuuguuuugcaucucugcuuucucuauaacugcagcgagcaaagagaagaugagaauccacaguugcuucugcucuucagguugcuguggcacugauggaaucagacacagaaaauagccaugcucuacauuuaacacgacauuuuauuuguuucugaguggauugcuuuguaaaugccucucuucccaaucauugagaaguucuuucuuugcauagauagccugguaaucucaauuuuaugcaccuauguuucugagguuucaaagauguuuaaauuuugaguuaacaaaaaguaguuaaugauaaaucggaauuuaagacacauuaaauuaugcuguguuaaugaacagaauauuuuauugucugugaaaauuauucccuagguucuaggucuaguagccaagaccccauaguuuuguaugccagcacaaagccuucugcuuuuuuacacaagaaaaaauguucaauuggauauaccauaccugaaccaaauguucuucuuaccuucuucccaauauaucucuguugaaaaacccucaagagaaaaugguuuaaaaaacuguuuuaaugcuuagauucuaaguaaaaucacuugacauacaugaauugcaaaaugcagagccucauucugaaguugccuguuucucauuuagaccugacuuauuaaaaaggcauauaauuaaugguugacauuaguaauuaacauuaacuucaugguguuugauaugccuucuucauucauccuucaaauaauaagaaauauauuaugccuuggcaaaaagguuucaguuauauaaaugcuccuucgguuuucacaggauauaaaugugaaaaacaaaaaauguguuaaaaaacagucuguuuucauuucuugaguguuagauauauuuuuauuucuuuucaggaguguucaucagcaauugugucaggaacuucaaagagagaauguggaccuaacugugcagucuucauuaucggcuaaagagcgcccccuggcugccgucgcuggugcacuguggaggcauuucuuuuccuuucucaagagucagagaaugacacaaguugugccucucucccagcuugcagaugccgcugcaggucagcacuaacuguucacugcucauugcuuucuccugcugcagacuuuugucaguauuucccucugucuucuugauuacagucucuugauuuauaaugcucauuaugacauaugaugggacaaaugacaugcuuaaauuggguguguuuggcuuguguauuuaaucauugaaaaauuaaaugauuauuuauuuaaaauaaaagguaauuuucagacauaacacugaauguucgcaaacuuuucuugcucucacaauuauuuggaaaguaagguagcauuugauuauaucuggcucaaguaguaugcuuucauacuuuaugaggagauaacuaaauauaagauaauuuguauagagagaaacaacaacaaccccccagcccucaggauggaauggaaugcuuagaauguuaguguucugacuucaccuagauuuuauuuuaaauuacaauuuuuauuuaaauuaacuaaauugacacaaagacaugucguuagguguucauggaaucauguacaauuaggcaagauuuuuagauauauguacauuuuggcaauuuccugagaaguuauuauacuuuucuucaaagagcuauuaugucauaauguguuaaaaaguucuagaauggacaagagauuuguauuguuacuacauguauguaaagagaguuuauuuaaaggguuuuuuaauguauuuaacuauaaugcuuuaaacaaacaacaaugacaaagcucccuauggucuaaaucaguauuuuauucugggauggaugaagaaagaugagcuaaaaauggaggaaugaaugauaaaaaauugauaagaaguugaaccuuggagcaguucagacuuuauacaaaguacauaagacuaucuacacauauggacagaagacuguggcaggucaugcuuuccaacuaguguagugucugagauaauacauauuguuaguaaguugaaauuuauucuguuauccagaauuuugcuagaccaucagcaguacuuagggaacuagagggaagagacagacggagguggagugcaagagugagaggccgacaugugcuuaagugaugagaagucugcccucugagcagcugcaaagacuuccacguugauguggauggagauuagaaguuauuggugguuuuucagaagaggaaaugcagucauucugcugaugagguaaagggaagcaaagagggaaauagggcaguuggaaaauuauucaaacaacucaaaccaaauuggacuaaaguuguaguguagauagucagaaauggucagaucuaaaggaagaaaagguaaaacuaacaauauguacuaagcaaauaagguaaugugaccagaauaguucauucaugaaaggugucuagaguaacuagcaauuugcuuauaagaagauuaggaagggacuaugacagaauauugaagauucuuaaguucuuagaguguuuuggguuuguuuuaagguauucauugaagucuaaaugaggacuuggauauaauaagcaggcuucccagaagagcucugagcuggcaguuuauuuguaaucuaucuauggguaaauagucuuuaaagcccagaaacuggcuaagauggcuauuaauauaagaauggaugaagacagaacacuguggaucaguucacaguguauuucugugcauauuuguggcucaagagaaacaaggaagggcacuguagaggagugcagauaagaugcaaaccagccaagugugaugcuguggaaacaaggacagggaccugcaaaaggaaauuuuuuuugaaaaaaaauuuuuuaauuaauuauuuauuuauuuuauaguccagauuuuauucccccaguccacccucuguuccacaucccauaauccaaccucccccagcccccaucuccccgaggauguccccacccccaucccaccauaccuccccacuuccuggggccuucagucucuugcggaggguuaagugcaucuucucugacugaaaccagaccuggcaguccucugcuguauguguguagggggccucaucaacugguguaugcugccugguuggugguccagugucugagagaucucagggguccagcuuaauugugacugcugguccuccuacagggucaccauccuccuuauuugccagauaacuuacugcugaauaaggucaccccaucuaauucuuucugaacucuggcuggcugguucagcucagcuguuguggcucaaacuccucuccaagcugacugauugacuggcuucucucagcuucuccuggaauuacuuggcaaaacugccucugaacuccacucaucugaccuacucuguacuugaaagaaccuaguggggagaaucacgagagaccgucuugaugcaaacacaugagguaguuuaaugacagaguuccagaccaacacgcaucucacacaggaaacaacgguuguuggccacguggcucgaaagcuagggguuuuuauagaaaaggggcuggggcugggggaggaauuggcgugguuucacaugauugguccauuuaaacaucagcagacuguacaugcugaucaagguaacagcagagcaucugguuaacauuuaacccaugucagaagggcgggagauagggaggcaccaggccaguccagacgugucauucucuuuaucuuuauggcaaaacagccucaggaaugucuuaacgacgggccugcccgugcauguccuggccuguucugcuauguucucagccccagguuucaaagcucacaaacaacucuuugggcuauuugacauacauuacaugaaucacaggucacaggucucaaguuguauuuucuuugauaaucagcuccacucaguggaacugauugacucucucucccucugccacucuuuuaagucaccucuuuuuccugucuguucuccuaagaguugggcauaucuuauuuuugacucauucugucucugugauucgucacuuugucuaccccuuaauuagucacuuucaaacaugacugcuuccuucuacaaacuaauguuacccuagagauggguacuaaaggcaugucuguauuccagccagagggauugaagguguguggggagucuuuauuccaaccagaucgaagagaugggcgggggcguauaugguguuuggggaugggguggggguuugaauguuccugcacuguuggcugcucagccagcgaguuccaaggacccacacagcaacaccaggaugacagauauguacccugcgaucauguguguguucaagauuagggcucaagcuaucaugcuuacacagcaaauuuuucaagauagaguccuuaaagugaaguuuuacagagguuauaauugauaaugccaaguacuuuggguaucaacauggaaguauuuaaauaugggggaggauagucacuggaauaaaggaauuccaaauaauuaagaacauggcaaaauugcuguugaagaauaauaugaacgugggcaacuggaggguauacaacaagaagagcaugugacugguauagucugauguuguauagagauucaaagcuagaucuguuagagaggaaagagugagaaugguuuagaaguaacaauguagagcaagaaguaaaccuaccuugugugugaagucgguagaagggaaugagagagcuuccuaggaggcagugcuacaguugacgugggagcuuagguacagacugaacugaugggggucuagaaagugauagcugcuuaaccugguuucuggaucauggguucugaagaaagugggugucuuuaaucaugggagaucacuguuuaauugaagagaauggugggucucggcggugagcaugagugccuguggcggguggcaagucaauuaacuuaaucaaagaagacuggaugcaggaaacacuuucugacuaggucucugaauuauagaggcauauuaauaaaaugcacuggcuugacucggaggagccauaucuguaaucauauuacugagcuggaugccuuuaaaccuuuuugaagcucuaaaugguguuuacauugacaacaugaauuuaguuguuuaaacucaaauuacauuuuugaauguuacauuuuauuugagaauuuuuaaauccuuguaauuagaggcgaagaggugggguuugaaaaugucuuaccugaacuuucucuuuuuaaaucuagauuuuacuuugcuggcaguggacaugccaaacacagcaccaccagaucuucagccacagccaguuauaucaauaauucagcuuuuugguugggaugauaucaucuggccccaaguuguagcaagauauuuaagucauuugcuacaaaauagguauguaugcuuaaguacccuggaaggguuuuucuaauauaaacaaauguuuauuauauauccucucauuuggcaggugacauuuuaacaauaguaauagcagggaguaugaaaccuaaauuagugguuugguuuacauacacacacauacacacaagcauauagauguauguauguauguaugaauguauguauguauauauguauguaauuguuacagguucauacucucaguaagccugccucauuaucuuaaagugacuuugcuguauucccuagggagaaaaauuauauagauaucauugcugaaucaauaaaacacugguauauuauuuaauauuuagacuuaauaacaacuuuaaagacuugauacuugugagaucaugauauuuacagauuaaaaugcagguaugugaagaaaaagaaaaaggaaguuucuuuuacuuccuggaagauaguauauuggaauuuugugugugguaaucuuugauaguaagugcuuauaaagugaagaaggaaggaugaaaacaccauugauuggucagucaagagacauaucuagagugauauuuguccugaacagcuuuuuuaguagccucgucuacuaaaugcuauugauacugccauuuuuuuauuuguuuuuauuguuuggguuuaauugcuuaccuauuauauuauuaugccuucuugccaacauuuuuuuuaaagauuuauuuauuuauuauauguaaguacacuguagcuguccucagauauuccagaagagggcaucagauuucguuacggaugguugugagccaccaugugguugcugggauuugaacucgggaccuucgaaagagcagucggcgcucuuaaccacugagccaucucuccagccccuugccaacauuuuuuuuucuugacauaagccuauaaauacacuaacaauagaaagggggaaaaacauuagaauauuagaaaugaaaacaaagguguuuaacaucuuguuggguacaucugcagcauccauuuucagcaugucugaaguacugaguucaucugaagucagggaagccaagggaguugccugaaugugguuuuuccaagcucuguucccuggggaucccacugcacuuugguuuuaauguuccucaauuuguuuuagcagcacaguauaugaagcacuuucucagucaaguugcgugucuucucaguccuuaacuauaagaucauggguccguuguguuuugcaaaugcacauaaaacaccucucugacccugacuugcugauugaugugaauccugaacaggccguggguaagugucauucauacaaggcacgaaagcagauaucaaauauccaaacuauacuuaaaauuagcuauaaauauauauaaaauauacuucugcagccuguuucuuuuuauugauacuuuauuguuauuacauauggcaaauagcccugcuacaaagcuaaaggaauucauuuccuuagcacuaagaaccaaaacuucuuccucaggugacaggcugcuuuuccucuggagaaggggguccuguacgaaagagaaaucugaaacguacuaagcaccaagauagaagacuaugcagcuagagagagcugcccaucuucacaaaauauuuuacuuuucuguguuacuauuagucacugaagauuauuugugcauuuuagaauuuccaugcaguucuguuuuauauguaaugacuuuuuaaaaagcuguuauuucuagccucuuguaaguuucacugagguuugcugggcagugguggcgcacgccuuuagucccagcacuugggaggcagaggcaggcagauuucugaguucaaggccagccugguuuacauagugaguuccaggacagccagggcuacacagagaaacccugucucgggaaaaacaacaacaacaacaccaaaaaguuuucucugaggcuggccugagaagguuguacuucuauauccuguauaguuuuuuaugccucaauacauuuuugagguuaggauaauauaaguaugaaaagucuaauuucauuuuuaauuuugugaaaauuugaguuuuuguaacauacuuucaaaauugaaggauguauuccagcauauguauguauguacacuagaauauguguaacuuacauaagauuguaaauucuauugcauauuuauuaauaaguaugcucauugucucauuuuaauagaaaaagaguacauggaacagcuggcugaaaugacaagauuacuauuuacacucucagaaguaaagagugucuucucaaaggcucaaauagagcaauuacccagcccagacgaucccaagcaagcgcuuauucaguuccuggagguauuuuccuucguauaaucuuccagaucaauuuuuuuuucagaaaaccuugaaguauuauuaauuuuuuucaauaaaaugaauuguuuaacuuaacaagucauaucguuaguugccugcuauuauaaaauuuuggaguaaaggaaguguugcucucagguauagugugauuuacucuaaagacagaaaauccauauguaaugaauaauaaaaguaaggaagaguacauggaagcuuugcuucaaggccaccugaaaugaaauaaugucuuauuguuaauguugguggguuccaauucagauccuaacuaguauagagucuacagucguccagcugaguauuuacuggcccacaacaauucuguaaauacaagcagaagcuauuucauaguaggaucaggacuugaaaaucaaauguuucuuuugauuuuacuuucuaauaauuuccauuuaaaauuauaguuucgauccuuaauuuuaaagcaauguagugugugguaguguuuauugcauccuagcugagacuguugauguugggauuauuguguuuuguacauuauucauagcaaauguagguuuacuuucaagcauguugauacuaacuacaugaaaauacaauauuaagugugugaaaauaauuucaaccaauaaguuauuucuauauuguuaacucaguuaauuccauugauuuccaguaauuuaagauacaguuguagaagaauuagagauagcugucagcccuaaugauagcuaauaauaacaaaauaauaugcagaugagaaauaugaauugcuguugaguauuuuauguaacuguugaguaaguccugaccaacuguuuggggucacaaaggaaggucacuaguaguuaggucuccucuaauuuaauccaaccgaaaugaauuuuuucuuuuuaucaauaaaucaaugacagguuuuugcaaaaugcuagauagcauuaucuaguacuccuuagggauuugaaaaaccuaauguagucuuugaucuaaaagggacuuuacugaucugagaauuuaaguuauacaaagguuaaaauaaugauacaaaauguuaaauacuuaaugucaguauucaucaauaguagaaacucagaguuucuugcuguaaaguauuuagaauguauccuguggagaaaacaaaggcuuuuucuuuucccuaaguaagccuuauuuggcaagaugacuuugugaaaguuagcaauguaauguaaacucugguuaguguuuaggaggaagugaaagcugagaacacugacugcuccuuagcagagggcucagguaucuucuuguucucgugggauucagcagacagccucuagagccugucacagaaaaaggaugaaaaagaacaggagacagaggaaagguacauggcaugaaaucuggacaucaaagaaccaacccacccaaacacaaaacaccccaacccaaaaaguuucugugagucuuuucccaaugaaguuacccagaacaguuauuucugcagcaacaauuuguggcaaaacaucagauuuuuguugaccagagaaccuuagcacugaguguccaugacuaguuauauacacuccccuugucuuacacuuuguaaauuccugacuuagagaaugaaagcaagaauccaauauaaaaccuacugaguguagauauaguaaaccauucucauaagagaaucacagcaagaauuacuccaaaacguuaaagccccaaauacuaaggcccauucuuaaaugugggcuuuuuuuguuuguuuguauaaauagcauacuaauguugggcuuaaugugcuuuuucuacauggaaauaauaguaugguaugguauauacggaguuaucaaaguacugagaacacauuauggggcuggagagaugauucauugaguaagaguacuugcugcucuuaaagaggacccagguuuaauucugaacaccaacaaggccgcuuacaauguuaccuucaguucugggggauuuacugucuucuuaccucugagagaauugcacacauuaaauuuaaaaagaaaaguguauauguguguguacauguauauuaucuauauauauuuguauguauauauuacacauaauauauauauauauauuguuuuaguaggguuucuauugcugugaagacguucgaugaucaugccaagucuuaaaaaggaaaacauuuaauuagggcugacuaacaguuucagaagguugguccaugauucucauggugagagggauggcaguauucagcuagacauggugcuggagguggagcugagaguucuacaucuugaucgagggcagcagcaggagacugugugccacacuggguguagcuugagcauagaagacuucaaagcucacucccacaguuacacacuuucuccuagaaggccacaucuacuccaaccagaccacaccuaauagugccacucucugugagccuauggggccauuuucuuucaaaccacuacacauauuacauauacauauuauucauauuacacauauauuucaaauacauauuuuuaucuauuugaaaauguagagauaaauguuuuuuuagucuggaagaaauuaaaguuaaacauacuuacuuaggcaucaugaucacaacuauucaaaucugguuuauacacuccugugaguuacugauaccaucucaugauguucuuuauuccaaagccauaaugacguuuucacaaauuuugugaaagugaaagcaugaaccagcacuauggccucagauuaugauauguauuaaaauuuauacuuuuauaaauuaaagaaguaaagcuaguucauuuaggaauaguauuaauuagggaauaagauuuaaaugcucaugaaauuucaacccuuaagcucauucuccaaaugaaacuucagagugcacgugaaggggcuucagugugccaaagcaguccauugucucaagaaagagccugugagcacaugagucacaagcugcgcucgcugcuuuuaucuugaaagaaaacugacaaaaugugauuauucagacuugggcauuuggcagacauuucuuuuuuucagaaaugaaugaaguaaguaagccuaucacuucaaagaaaacaacugacaggaucuguugcuaauaaaacaguucagguuuucaagagaauuaaaauuugggaaauuuacaugaaccuucaugagcugagagcucccugauauuuaaaagcuucugugggaaugggaugguaucauuuuuuucccaggauggaaauggcaacauugggaagcaauaucacucauuaacuuuacaaauuucuaaaaguauuuagcagccacucaugaguaaaagaugaauucauucagaauucagaguucugaauuuuguuuuauugauguguuuucgaguccaugagaguguccaauuuuaguuacuauugaccucuaagaaaugucacuugaaaauuugggcauaauagaauggaaaacuuccuauuugaaacaggaauaugaaacaaaguuauuugaaacagcuuucaaaauacuuucuagcuuuguguguuugugagauuggacauucuucauucauugugccccuacucagcaccuaccagcaccguccucuuucucuuugcguguguaucuugaccuaaacaauaaaaguuucaagguauuugugcuuauaagggauaggagaucaaaaguuugugaacuucugaggaaugaaauuuucaaauagcgaaagccaaauaaaaaaaggguugguuacuaaaauacauuugccuccgccacugggcuucuuuccucuucccucuucuucauuccacaugaccuacuucugcuuucccucaaggcugugcuuccuuguuuaccuaccguaguuagaccuguauuagacaauauagccccuugcuuuguccgcugauuuacccacuaggagcugguaaggaagaucacauuacucuggugcuguuuuggucucaauguaggccauugaaauccuuugugagcucucaaugugaucugaaaacuuuccucaaacuuuccaauccauucuaggguuacaucuugauucuuuucuagcuuuuuacagccugcuuacacucacgcuccucgaaagcuuggaggguuuguuauugccucuucuuccucuucuuacuuacucaccucacauuucuguugaccacugcuugguuugucccaucuuuagccucucaaccgaauuuuccugaggucuccacuaagacaacuuagcuagcuagcuagcugaugucucauuaagaauauucuuuaagcuguaaauuguggggggacaucaauucauaucauagagcugaacuaagagauuuuccuuguaagaauuuggcaaugcuacuugcuccucuccuguaggaauuugaagauuuccagucauguggauuaugaaccaaccuuuuugaaagcuuuagcugacuauaagcuucuuguauaacaguuuaauguuucuucucccuaaugauuuugugaaucuuaaguccuguaaauaacuacugaugaauuguuuuuguuuguuuguuuguuaauucuuccauugaccuuuaguuauaaaagguaaaauuuaacucuucacuucagguuuuuguuuuuuuguuuauuuggguuuuguuuguuuguuuguuuugagacaugguuucucauguagccccuaacuguccuagaacucacucaguagaccuggcuggccuugacuucagaaauccuccugucucugccuccugagugcuaggauuaaauguaagcaccaccaaugccuggauuucacuuguuuuaauguuugugagucuuuauuggaaauuuaaggaugaagcccuaaguauaagauacauguguagugagaaagaaauaaaaaaauuaguuuucaaaguuuguguugucuaagacuuggaauguguaaaccaugcuuuccuuuauuuguaggcuguuggugugacuuacaggacucugcagacauuuucugauaaaucugccauggucacaaaguccuuagaauaccuuggugaaguauuaaaauauauaaagccuuauuuggggaaaaaaguuuccagugcaggguugcagcugacuuacgggauaauggguauguauuucauacauguuuuugcugcauuuccuuuacucaagccaguaaaaucuaaguugaaagaaauauauagacuacaucacuuaauucuacgugcaggcauaagaaagcauaaaauacagugguuugcugaaauaauucaugcuggcccucauuuuuugcugugcuuuuguugauacugauauuaauuaugauaauagaauauauguccaagcuaacugcugcaaauggcccauuugaaucacauugugaauacccaaaaccacuaagaugaaccuucuguuaauguuuaccuacacuugacuagaagguagaccaccagaaagucaucacuucccuuuguuguucccgguguucucugcaugaaggagguccacagaggauugguauaaaccagcgacaaggcuccaaaccuuauuccucacacacuaaguuuucucuuugccaaagaagucuuuuuguacuuguucuguaacgaugggguugauguuucuuuaggaagucaguaauuugaauaucuuuguugacuagaccauguugcuagccaaaaauagggacugaauaaaaggaaaugagaaaaauuuccuuagaaguuuuauagagaauguaaguuuuguuuuuuuguuuuuuuaaauuuuaccucuauggccaaaaccuuguaucuauucccuuuaaucuuguggauguauaaauaaaccuuauuugggcugucugaaaccuuuuaucuuuguugugaaagauaaaggaaaaugugaaacuguggaaauguggauaauguagaaggccccgaaagcaguauugcaauucagauuacuuaauuuuaggaaaaaaaaguuaguggaaagauuuauuaucaguucaacaguaagagcuguauuauuuuaacucaagcguaugauuuauuagucucuaagaaaguuucugacaucuccagauuuaguuuuugccaagguaaguggaugauuacagaaguaugucuuuacauuacagaguacaugaugacuguguuaggaaucacagagucccgugggcauugaugauuugugcauuuugggcaagauuuugcucaugagggcuuuuguuguuguuuugccuugagcugguuuugcgaacauauagcucuagauucuuuccaucugucuaugucuuaaauguaggaauggguuauauggcuaguaaauuacucauuaguuagaacaaguaacuugcuguuuucuuuacauagaagacuuagaacauaauggaaaaaaagcaaguauaaaggcuggcgagucugagccugacucagugugugaggguugggguaucauaaccauaggugcagguggaaccauuuaaaaucucugguuccuaacucaggauacugcuccucuuuguauacaaggcugcuaguggaaggcauuaaaacuacaucccagguuaaagagaguaucugggacucuaauaauaguuaaauaacuucugaaaaagaggaauugguacauugguaguaccuucaacuccccuucauaauugucuuucugagggugugauggacuggagaaaguugguuuggcuuugauuuaguucucuuucuuuguaugucauaugucauuucauugucccugugccuuuguuuauucuucccguuuucuugguugcgauuguaccagucucccuucagugcccaucucuguauucccgcuggcuuggccuuugccauuucaucucguuugucuuccuuguuuuuuguuuuuuguuuuuuuccccugcugucuauuuugacuuguuucuaugauaaaauaaguuguuuuuaaaguaagaaaauacuccgauuaggacauaauuguaacugaagcuguucgucuucuuucuuaggaauucuuguuaagucaugggcacacaucuuugccaccucuaaagcacagaagcuacuuuuucggauaauagacuguuuguugcugccacauacagugcuacagcaagacaaggagcugccuggacccaugcugacugcaauucagaagacgcuuccucucuaucuacaggugugccgagcguggaaacugccucaaagucuagucugaaauucagauugaaaagcuagacguuuuaauccccggaguacaugcaccuaugaggcguauccauugaaaaagguuuaaaugacuuugggguugucuuugaaaacaaaggugaaagaggcaggauccuaaaugugagagcugauaaaggccuuggagggagcugcucacuggcuuguuuuauguggcuugcucagccugaugucuuguagaacagaggaugacuagcccaggaaugggaucacccaaaauguccugggcccucacucaucagucacuaaguaagaaaaugccuuacagauggccuacagccagguaucauggagucauuuccucaacugaggcuccuuccucucugaagacucuagcuugugucaagaagacacacaaaaccagccaguaacauaaccaagacaaaggaaagagcuuuaagaaaaaaaaaaaaaucuagcauaauggggaaaggcaaaugguuguguuguggcuggaaaaucaucuaggaagagacuugugauagauugcuuuauauucagugccaagaaugugggcuucaucucacacauaggaagugcugguagguuaggagcagagaaguaaaaguucuacuuguauuugagaaaaauugugcuggugugggaguuagacuuaagacccaggaggcagugauuaguuuauugaaauacuagaagguuuaaacuaaggcaauguuggaaacugaugagcucugauuaaaaauacaugcuaaauaugguggaaaaacagaaaugaaugcuuccuagacuagaccaguagagucuagaauguggugcugguaacuaaacuggagaauucuagagaagcagcaaugaagauaaaaauugugggguuucuguuguuguuguuguuguuguucuuuguuuugguuuguuuuuuugcacuagacucugugacacauacccgugaugccaggacccaugaguuaugggccaggcuggaauacauagagaaaaaacuggcuuuuuaggaacuuuaguuugaaauaauguggaauguguaaauaaugguguccccuggacagucucaaauacugauguauuucauuagugugcaauacagaaaguuagaccuuucuaaauuuugaggcuccccaaagaagccgaggugaucggggcagguuucaauuaguuaacaugcagucucuuccaugguggauuuuuuuuuuuuuuuuaagcaaagcuuugagauuucugagaaguuuuaagcugacucuaguuaaguguuuaugaugggauuuaagucaaaguuuacugugucaucaagcacaugggccugauggaacaaauagcugugugagcagaguguaaguaccaggaaaguuggaguguuuguucuacaugguccucuuaaaccuaguuuacuuguaaaauuuguaaauauaaauugagacuuuuauagaauuacccacuugacagaccugucagaaaacugaucuuuaguuguuaaauguacucuguccucuuugaguguaugggauucauugcccaucgucuucuagcuguguacguuucuuaaacacagcacucaagagacaggacaagugggugccacuaugguucauuuaguuguguucuugccaguauuucagcaguucugcacugauuuucacaacaaaugaacuuucagaguuuguuccuggauaagcaaccaauuauggcugcaguggaaucauaacugacauguagaaaacucuuucuuucuccaagggaauggauuuaaucauuucuaaguuuuaaauaugagagcauuucacuaacucucaugcacauggaaggauuuaucaguauacaugcagcaaaauacugugaguuccuuugacuucuuuuaagcucuuuauuuuucugaaccucaguuucuuugacuguaggauggaaauguaguauuaacuccuuuauucuacaaauugaaaugaaauaaugaauauaaagcacuugaauaucauaucacauagaaaaacuucuaagacgcccaagcccaagcaucugcaucccucucccauuacaaguuguuuaaaaaaaaaaauucuauuucauuauaugaucuuuguuuuuaagcuuaaauauuauguucuuagccaaaauggccgagugauaaguaacugccuuccaccugccugugccucugggauuggccgucuaagcucuguggggugggcuuuuacucuuuuaccuuucucuuugauagcaaacugaguuuugauuuuuaaauacuguaaaaaagacugguggcacauguaugucauaguucagaaauggcauggguauguaguuggugaucuguagucaaguguugugugcaggaggaagagaggaagaaacacauuccuugucucuuccuguauguucaccuuacuuccuuugaucgugcuccuaaaauauauauacuugauuugauugcacacuguauguguuauccaaagucagcucuguaugccuuaccuauucaugaucccagaaguccuacuugacggugagaagguacaauuuuaccaugaauauuaaugcuggagaauguguuaguaaauuccuaaacacuauuugaaagauugccuuuuagcguuuuucuuuuuccuuauuuuccucuguauagggcauauguauuguaugcugccagucucaaaauccaaaugccuacuugaaucaguugcugaggaaugucauugagcaguacauagggagguuucucccaaccucgcccuguguuucagaucugggacagcacccuguucuguuggcacugagaaacccugccucuguucccucgaugacgccucuaagaaagcacacuguccaugccauaagguacauaugauuguuacagagaaguuguuaauauccucaaaaucucaaaaaaagugugguagcuuagaaacaggauuucccaggaaacauuaagaaugugucgcacugagaaggcaacaagcuaacauaauuauaucuuaauuuaauaaagauguauuuagaaguuuguuucuuaggucugucucucaguauuccacagcauagcuacaauaacuguuugcuggguuuccugcugaagacaugcaucucucuuccuaauucugucuuacucuuccuaggaauaacauugauauaaagucuuuaugugcgcaugcauuaucauuucucugggaagaaugaugggagggugacuguugggcacugugacagcuacauagaugaagaguccaccagaaugguuuucauggaacgguuugcugugcuuuagauuaaaaaaaauuuuuuuguuaaaauuauauuaugccaauuuucacuauauuucuguuacuuuccuuauguacaucccuaaagauacccauauaugggcuggagcaaaggcuuagugguuaacaauauaggcugcucuuccagaggacccagguucauuucccagcacccacccuggcagaucacagcugucuguaacuccaguuccagggaauuugacaccuuauacagacauaccuucaggcaaaacagcagugcgcaugacauaaaaauuuuagaaagaaaaagagaaaaguuacuuaaagguguauuuuuaucaauuuuauuacuauagaauauaguaugucaauuacuucaugaaugauaacugaaaacaugaaugcugauaugcaguaugaagucuuguguuauuaguuuacuuauuaucuuaauuguuuuauuucuugucuuauauuaacacuuucuguaaaaucugcuaucaaguauguccuuaucaacccagaggacagaccaacucccucuccuagugagcccugaguauuggcucucuauaagagugcuaauguugacacagugaucucacaaggagcauggagacagggacaccagaagcucacucacuauagacauagcugucacuuccuucucacuaaaaguauuuuagcucaaacagcuuaacagcaacagacuaaucugcguccugauuguuaccuucuucauguaggucacuugagugucucuaagguugguuaugugggauggcuuccauuuugugguguuucaacaaacacauaucuuaggcaugguuuuucccuccuuguagccuaggccugccuuuguccugucacuuguaaaauaccuuacagccauaggaccuugcuuuguagaaaacauagugaaaaggagcacacaguauucucccaauuccucagcacugaacagugacagaugugugcaccuuucuugccaguuaccaaaacauaagacgaucucgcaucaguuuuauucucagugaccugcuggugcaauaugcaguucccagcugcauaacuuaaggucuugguguagagagauugauucuucuguagaaaugacuguugugaagaaaccaugaggauuuuacugacauggaagaucauuuugaauucuucuagagaaccuguguucaaagaaaggaguugcccuauuugcuagauaaaauaacuuuuguugucuuggggauaaaguuauccucuacugagaagauaggaagaauauuucuagaauaugggcaauaucuggggguauguauuuuugguuuuggaucuuggaacugacaagaaagguacacucucaucagacuuauuagcucagguauaagacacucagaaguaugugucauuccaauugaaacagugcaaggcuuagcaguuuacuaaagaucagucccccaccuugacuucauuuuucagcggaugaaauuuaguuuuuuuaagauuuauuuucugucacauauauguaugaguguuuuaccugcaugaauggaauugaaccucuugcaugccuggugcguguaggagcuagaagacaucauagcccuaaaacuggaguucuggguaguugugaucugucaugguagcacaguucugugcaacaggaguggguccucucaccugcugagccaucucuaccaguaacugcucaggguuguuucuguuugguugguugguuguuuuuuguuugcgcuaaccuuuuuauccuuuaaccauaacauuagaauauucugugauagagauuaucuucccuuuaucuucaugaaguauuuaacauuauauuauuucuaaacuucugagauuccauaguaauauugauuaaugguauguaguauuaaguuucuguguuuaaaugcuacaacuuugcucucucuuauucugucucucucugcucucugucugucucugugugugugcagauugggggcacuccucuucaugggaaggccagaggacaaccaaagaagacaugucuuauugucaucuuucuuucuuugagacacuggcuuagauugcccaagaggcuggguugguaguccaccccagagaucauccuggcucuuccucuguaguaaugacauuacaguauaagcagccaugccugagcuuuuauuucuguuuuggggaucgaacucaggcccuuaugauuacaaugcaaguaaguacuucacugacuaagcuaccuccucagccuuuacuugaucuucuuaaugaucagauguaaacauacaauucuguuucucuuguguuccuagaaucauguuacugagaaguaacaaacuucauaguuugcucauuucacauuucucuuuucauauugcacuaugcucguugcuguauccguucuuaaaaaaacaaaaaguucuuuucccucucuuuuguuuuguuugcguguuuuauauuguugguuuugcuuuuguuuguuuuuguuuucuuuuuaguauaaguucucagugccacccugccuggccuggaauucacaaauauccacuaguuucugcuucccagcuacugggaguaaaguuguguaccaucuaggccagcuggguuaauuugcccuccagcguacauugucuccuuugcuguguaaugagaucuacuccagccauccagaguuugccaguuaccuguucuggugaugcuguccugucuuccacauguccugccaaccaugaccaugguuugguucuugcucuucaggaugcuuuauccuucccugcuuuaaggcuuugccuccgccagucucuucauuaaaaagcugucccucuggacuccuguuuguucuuuauaagccugcaccuaauaccacaggguagcauaugucuuguacgacccaacuuucagguucugaauaauuuuugccuuaguuggaucuuucauuuccagcaagacuauaguaaucuguuauagugugccagacauugcuugguuuuaauauuguuucaugacaaauggguaagugaauucaagucccuaucaccaaguuaagacccuggcuuaguaucucagcugggauucucagauuucuguuguauuucauguuuagcuaaggaugggcuuauucuucuuuccauaguagguucuaguugaccagaaacguguguggguguuugguuucaauauucagcagaaauagagguggguuccuguggcuccucuagucugcccuuuucuacugugugaucuguuugaguuaggcugcuugcucagaauuucugaugcuucuguccuuauguuugucaaaaagcacuacucacauggauuaauauuguucccuuuuugggguguaaucauaucuaacuucuucacuagauaaugagucugugguuuguucuuuuuuacauaauuguauaugcuuauuuuuaauuugcuuguggugucuaguaugugccaaauaaagguuuauuuggggcauuaguaauucagcagugcacagaacaaaaugaauacuacuucagagaguugauguaucuaggacuguaaaaucucaaucugggauugagagucacuguguagguggaacaagagugauucugaaguguaguuccuugaaugaauuuuaagcucuaguguucacugugucuccuuauguacuguuaguuuucaaacaaauauguguguauauauauguaguuggaaccagguaguauuuggguuugggaauguaccucaguguuaggaagcuugccuacuuuguaaguucaucagcacaauuaaaaauauaguggggugaggguuaaauaauauuugaccaacucugauaaugucuagauuuuuuuucaaaagaaacucaacacuugucacacuuacucauuuucugaacagugaccagaacuaguucuaagcaguuaagugggaagcugaguaaaggagguuguuagucuuacaaccucucuugaauuuuaauguuccaauuuauuguacccugagagaugauauucaaucuaaaguuaguucucuaaauuccuacuggaagaaagaaagguaaagcuagaacuggaagcuaauuccuaguauaguccuuuuauuuauuuagaaacauaagacccccuacuaaauucuaaauaaauaaaugugaggggagauuuauuuaugcaaauuugacauuagaggaaauguugauucguggcaaaacugagaagggauaugagacauccgugggaagaggagaaaacaaguuagcaauuagguuagguaaauucagucuacagcuaaguugcuuuaaguuucuuuauaucccuacuaccuuucagagcacacaacacaccaaaauggucuuuaaaguuaacaugacagacuaccuacauuguuuuuuaaaaauauacuuuacuuaaggaaaucauuuugacaguuaucuuuaacauacauggcauuugauucugcucaguagagcuuuaaauagaagaaaacucaacuaaaguugcuucuuuucaggaaauccuaccuugaguucaaaggguccucacccccuccucgauuagcauccguauuggccuucguccuucagcucuucaaggacaccgaaaugggugccugugaccuugagcugcuccuuccuggcauccugaaauguuugguguugguaaaugaaccccaagguugguuucaucagucuugauuuuuguuagcuuuuucuguguccaggcuaagcggcuaauuuucucauggguuaaauugauauuagagguacaggguuauuuucuaucucuuaguaugaaucauggcuaacgaaucaaauauugauaguggcugggcugagguggggaaaaagaaucaaauucggauacauucagccuaguuuauuuagaguuuuguuuuaaccccuugaggcaaguacuuuaugggguauuuccuuugauuaggcuuuuuauguccucaaaaaaaaaaucugcaggcuuccugugaugccacaugggacuugucaaauaucagguggcgagaggucugucucuucucuuuaguugucugcuagcuguuugggacaaaccuggcaaguacccuugauuccaguccauguccucuuggugucaucagccuuaauuugcaugaucacucuaaacugugaauccugccgcccccccccccccccacaugcuuuuaauaagcucgcugagaaugcagaacaggaauccuagcucuguccugauaagcaguuaggccauuguguuugugaagaggguguguguguguguguguguguguguguguguguguguuguaacucgcuaagaugaguuuacaagguaggcuggggaucugagagcaauccccaaaguggugguggaaagucuuuucucaaaaagguuaacauuuuuuuaaauauauauucauuucaguguuuguaguauuccugucuguucuuagucugauucaggaaaagagugucuauuacacuuccguauggugcuaucacuugguaggaggacgugcccucugguggcucuuagaaacacuguccuuguuaaacuucaacauguugaagugcaucgaaagccuugcacuucuucauucaagguuugcuuccucagagcaaacagcacugcagucguacaguuaugguuugauuuccugugguuucaccuacuacauguuauccaccauaggucaacuguuaauacuaacuggaaaauucuggaaggaaugauucauaaguuuuaaauuauaugccauuugaauagcauuaucuauauuggauuccaccagcucucagaaaacaugucucugagacagaaguagauaagcucccuuaccuaggggaagcagaugauaacuagaguguaggcuuucuugcugagauaacaaacgugguacaaacaugacucuggcaauccuugcacagcucugacaauacuaagaauugcuucacuguaugugagacgucuauuuccacacacugaaucauguaaacugcaccaguuuggagacacauuugauggggccaaaacaagaguuuccaaucuucugcugcaugugguagugcacaccuuuagucccagcacucaagaggcagaggcagguagaucucugugaguucaaggacagcuuaaucuacaaaaugaguuccaggacagcaaggucugcacagagaaaccuugucucagaaggaaaaaaaaagcaugcuaaguuuucuacguacucuguucaggucuucuauuaacacagcuucuauuagucagcuucacauuagcuuaccgaauaauaaaguaugggaaggaagguuugcuugccucucuuuuguaagcuucaguccguaauugguuggccugauuuaaggugagacagugaucaugggguacacacauggaggcacaaugcucaccugccacaguggaaacagugaagaaaaggaagagaagaggcacgcuuuccucugccccgagggcuggugaccaguaucuaacacauaagccuguggcauauuuaagauccaaauugcaccaguauuuuugcacuguauguucaggcacaccauuuuaaagaauuuaguuaaauaaauaauacaaaaguuuggcuaaguugaagcaaaggugcauuaguugggcuaguuugcuacuuaaagguuuguaagggauaaaagguguguugccgggcaugguggcgcacaccuuuaaucccagcacuugggaggcagaggcaggcggauuucugaguucaaggacagccagggcuacagagaaccugucucaaaaaaccaaaaauauauuaaauaaauaaaugaaugaaugaaugaaugaaugaauaaauaaaaucaauaugucugcaaaucuaugucuuuaaaagggcucccuuuugucuguaugcaucuguaaaauaggguagaauggauuuugaauauggauaccuuucuaaagggaaaacaucuuccuaugcauuauuucagcuuugagacucaaaauagauuuuuaaacuuuuuagguauucuucagaacaaacaaacuuaaaacuauuucauuugaaaacuuaaaaaaagcaugcacauacuugaagaaaacaacauguuuuucuaaaugaagaguguuaaaaaugaagauccagauggucaguucagacacauuguguaauccuaucaucuuuucuccuaguuaaaaagcuggccacagagaaccugcagugcaugguacaaaccugccaaguggggucagaaggaggaccugccacccagcugacuucucuguuuagguaacuagaacacaugccaacuggcaaggagacgauugccagccauuugacagccaacauucuuuuuaaauaacuaauuauccaaaacauaauguguuacuacuuguuuacaguguuucaauuauaguauuuggggcagugguuguguuacauuguguugcuuuguugaaaaaguaaacgugccaaggaaaaagguaagcuaacugacuuaaaauuccuugugucuucagugggaaagaaccuugacuauaguugagaaggaagaaacagaagcaaguguaaguucugacaacaggcgcacaggcauucggagguugcccaacugcucuuggggaugcuggguaaaaaugccugucccugguccuccagcuugcuuuacacacuaacguuucagaacgcuccuuaggauugauuggagucuucucuuagggcagagucuuugugccguuucuuccucagggcucugccggguagcuuuugugaauccugucauauauuccugcccuggcacaauuugacaugagguuugagauguuccuuuuauucugcguugcauauuugguuccuggucucuuccucucgccucauaauuggugcuugucugcuguucucaguucauuucaguuauggucacuuuaugauagaacauucacgaaaauuccaacuccaugggaggaaagaaaagguuaaaucuuuguuauauauaauuuuacuaagcuacuuggcuuuuauuauauuguuuauggaaugugaaaauuuuagagguaaaauuuuauuuauaaagacuuuguacuuaugagguuuuuaacuuuacaauuauaacuaucgaauaauacaagcaugugauagacuaaaacagugacuaggaaccaugacccugcuuacugccuuucacacucccaucccaauuuugaaggggaaaauaucaggaaaaguccucagaguuacguuuuuuuuuucuuuugugaggcaccugauucacccuguagucauuuuuuuuguucuccaaguguccacaagcugggccuggugauacaaaccgguaaucccagcauucuaaguggcagaagacaguggguaguguugaaggugaagccggaccaagcaagacuacgcugccuccaguacucaagcaaacaaauaagaaggccuggucucucaguccuuaugaaagaauaauccuuguguucagguuagaagugauuauaauguauucaaauggcccaagaaauugccucaaguugauucuuaaauugucuguuuugcuuucaggcaguucauccaggacuaugguaugcaauacaguuaucaaguauacagcauccuagagacaguagcaacgcugaaucagcacguugucauccaauugauuccuacccucacucagucucugaaggauucagagcucaaauggggccucggcagaaauauugcacaaagguauguuugauaauuauacuauuuuguguaccauauaaugcauguuuuaucuuuuuauuaaaaugcuuuauugcccauuuaggaaaaugggauauuuucuuuggagaugaaaagugcuucaaugcuguaacuguuguuaguucuguaaugcuugcgugaguagacaguagugugacuuagcagaggucacacgucauuaccauguuccugcugacauggccaccucaaagcugcacaucuugguggugcuuaccuuuucaaagcacaguguccuuagggagagcuagauuuggaagccucaggugacuugucauauaaaaccuguauugacugacagaucauaacugcccagcuguguccaggguaucuaaugauucagucuggauuuggcuacauauaauagcuaggguguucuguucuguuuuguuuuauaagcuuauaacccauccagaaauaucgcuggcuauauagauaaaugcaucaguguaagaaaccuaugguuucuaaagagacuauuuuagaggagucaguauggaaacuguuagaauguccuaagcuguaacagaauggaauacaucguucacauugcauauuugaccaaaagcaacucauggaugaaaggguauauauacuucaucaaugagggaagucagggcaggagcucaaacaaagcaggaacuccagaggcaagagcugaugcagaggccauggaagagugcugcuaacuaacuggcuugccccucauggcuuacuuaguuuguuugcuuauagaaccuaguacuaccagcccagggauaauuucacccacaaugggcugugcccucccaaaucugucccuaguuuaaauaauuccuuacaagcuugccuacuguuggaucuuauggaggcauuuucucaauuaagacucucuccucucagaugacauauauuccauuuuuagcugaaaaaaaaauuuuacuaugguauucuaugccaguuuauccacagacauccucaauuuauaacauuagcuaaguaaaagaguccaucuuugcagcacaguaaaugaaaauuuuuaaaaggaaacuuacaaagcucacaucucucuacaguggcauaucucuucuauagggaacuuggcuggccucucaccauuuucuacagagaaaacauuagaucucuucaaaucacagcuuaaagaaauagugccuucuucauaccauaaaacaugcucuggcaaaaacugccagcauuuagcuucugagacuuuuccugaaaaggcuggaguuucccuguaagcucugcccacuggacuacagugacagcauuugcuaaugugcuacuuguagugguaaauaguuagagucugcucugcuccagcagguguguauggcucugcacccgcccaagcccaggauucacgaauaaaagacacacacacauacacacucacacacacacacacacguaaccuuuauauuuuaauauggcuuagccagcucaguggcugggcacuuucaaaccuccccgugacuagcacgcagucccaucugguauuguugaguuaacacuuucuaaaucuauguauugugauugcugcuguuuccuucugggcagcccucccauggggccgcuuucucuuugcaccuacagcuacucuuuguggcuaugcauguucacaaggacucauuuaaaagauucggaaucccccagguauuuagacuaaugaaagaacuucuagguagaauauuuaaagaaucucaaauaguggauauguuaauggaccauaaaauuuggucauuguagacccugccacagccuucugaccagcuuuggccucuuggagccaggccaaaacaaucucaaauacagaugauuagaaacaccauuuuauuuucaaacuguuaacaauaaggagaagguaaagagacaaauaaggccuaugcuguugugacacugaccuguccugggguaaugcuauaguccaaaauuuuguuagugaaccaugucacuauuguaauccugccauuguuauauccuuaagcagugugccaugaguauauuugcuauggaugggaacuguaucauuucaggugguuaaugaacacaggugucauuuuguacauaaaguuacaugaaaaucucugcauguauccuaacaccugacuuuacucauuagauacauguagcauuaucuuuaaguguuguguuaaaucuguuauaaauucauuuauaaguacauaagugaauuuuuuuuuccauccuuaaacagggaagcauauagcagacuuuuaucuggccuaggacagguaggacagggcgagaagcagagacuggaaaagugacgaacugugacgaugcugcugccuuccugccugggaggucucugucuacagcucugugggcuaccccagcugcuacugugauuaauuguguacuguuguaucacaaauaauucccuucauugccugcauguaggaaguguguguguguguguguguguguguguguguacacguguguguacguguguguacaugaggagugaaggcuaauuaguaacuguauaauaggacauaaggaacacuguaaaacucugcucuaucuugaagagauuuuuaauuaaauuaaagauucuuugaaacaaaac

SEQ ID NO: 1806 - RNA, 6921 nt, Mus musculus
gugcgcaugcuccgugcguacagaggucaccggugccgguggcuucuacacgugcguagugaacuaagggcaucaugauuuagagaugggggcucgcgugacccgcgccuuaaggaacuucaacguggagaagcgagcggagcgagagaucagcaagaggaagcccuccauggcacccaagcacccuucuacccgcgaccuccugcaggagcaccggagucgugagugcagucccucccaggccuccggugacauugaggucguccccgcgcgggccccgggugguggcggcuggaaggaaucccggagcccaaggcagcccgcgcucucucccggcgucugcgcaggcugcacgcagacucucguccaaguguuugccccaagauguccagaugauuuuuuuuuuuaauauuguacauguuuacgaguuuagagauuuuuuuccuuaaaaaaaaaaaaaaaagauacuauggcuuauuuucuuuccuuagaguauccagaaaucgaagaaguuguuucuaaaaaagauaacaagcugcugucauugcuaagagauguauaugucgauuccaaagauccggugccugccuugccgguaauguauacguuaauuaaguuggcaguuuauuuuggaggucugagaaagugaucaagaaaaagagggcaacgagugaaagugcaaaguguguguguguguguguguguguguguguguguguguguagaggggagcagucaguguagagcacagacagcuagacacaggcaggccuggacccccuucgauacuuaggguauacuuaggguauacuuaggguauacuuaggguauaccgaaagaccugugaagggauugauuggauggaccugugugaauuguuuauugcagaaguuguaggguuggguuacggcauuuuuuagugguuuucugagugaccaguaugacuuugagagcuauuucauauucuguaaauuaagaugcucuuaaugacaaccucaguguuuggggguuuggagugggggcacguucauaguuuugaggaugugucccaacaggauauguaauauuauauguaaguuaauauagcaugcuggaaugauggguaugucuccugugucagguguaaguguuguguguagugauuaaaacaguaauuacucucugaggcccaugguacguugcggaccacagaccauuccguggaugagcagcuguacaacuauaauguaauuacgggcuggggaagaugaaaggcugcuucugaggaagugacauuuaacccugggccuggagugcaaauugaaguugcagccuggaaggcaaagaauuagauuaaaugaagaggaaguaccagccacagcccucaaaguuuuuuuuguuuuuuguuuucauuacaaaacuuuuuuguauuaucuaauacugagcaaaagacugcaauuacagcuacuucuauaauauucauaauuuaauagugacaguaggauuuaguuaguaccagauuuucacacaauaaagauacauugauuguuggccauaguguauuauuuuuaagcucagcaauacuuggaaggaggguuucccauuuaugcuaaguaugaggugcaugugagugugugugugugugugugugugugugugugugugauuuuuguguaaagauacuuauuugauauuauacuugguauuuagucuguugaagugaccaguuuaaccucuucaaauaggugccagucaccuaacuauaauuuauuuacuaauuuucugacuucuguuuauagacuuauugguuguuugguuuuuguuucaucuuuuucuuuuucuuuuucuuuuucuuuuucuuuuucuuuuucuuuuuuuuuuuuuuccaagauaggguuucucuguguagcucuggcuguccuggaacucacucuguagaccagguguuuuuuguuucuuaccacuagacccauacuaucucaauaaagugguaugacacauccuggugacuguuauaaccuaaaaaagcuucauaucuucucaaaucacuuccuucuaaaugaacuugggaaucagauuuuuagugucuuuaguaagccuuguuuagauuugaugauaauuagauuguauucacaguuuaacuaaagagagguaaagaucuucuaauuuuuuuagaaggucuuugaggaaggaagaaagauguuauuauuaaguagaaauuuucuuccccucauuuuaaugcacaggaaaauaauugauuuuuauuuucuagcuauugacauaacuaguuaacauaucugcuaggaaguaguuuuucaguuuuuuuguuuucuuaauauuuuauauuuauguggaauuuguaaauuuuuucugccuuuccacuaaaugaaaagaggauguuaaauuuuauucaucuugaugucaaguggaaaagccagaucuguauguauggagggaaaggcagauguaccuggguuuggaagaugagagacacuuugagauuuaggaaguggaagaggaaaagagugagugccugagacucaagugggaacaagaagguggagugagugagugugggagacugcuuagguacgguaugcaacaaggggagacugaaggggacuugggguaauggcugcaucaugaagaacaugccaagaaacuuuagauuuaucagaagggcuuuggggagucauugaaaaaaaggcggggggcggggagagaaauaccuugauauuggccuagaaguaguauaggcaggaauagcuggaaaugaagagaaagggaauccuuggcacggcuuagguaguaagcacagagacugagguuaagcucagguggguacucacgagauccaccugccuguggaugcuuaugcacagaccgagucucaaaaucuguacguaagugaaugugugugcacccuugcacgugcgugcaugugugcaugcaugggcuaccuuuugcugugauaacacugaccagaagcgucuuacacaucuagguaauaguuuaucagugagggaaggcuggaagacaguucucaaguaagcuguuaacagcgccguuagagugcugcucauucgaaacagguguaaugcguaucuaaucaguucucauucuucucauauacaaguugagguuucuuuaacuuagcuucuuaggaccugaucucauuuuggaauauauguauguauauuaugaagcaucuuugugggaggauccaaauuuaauuaugaaguuugcuuuuauuucauauacaacucaagcuugaaggcagguugaugagucauucuuaguguaccuacauuuugacugcugaucaucacaggaaguuagauguggcacuuucuacuugggacaugaugguggaguucagaaguuuuggauuuuagagcacuuugggucucacauuuuugggucaguaaugcucaguggcuauaauuucauggugugcaugcaguugcaauuuuauagaggcuuucuagcgagcuauaguuaggaaaagagugguacagugcaaaaucaaaguuugaggagguauauauguguuuauuugaaaagaaaugguuuagacuuaagaguuguggaagauguaaauauuuuauccuaaacccuuuucuuugguacuagguaaaaguugaaccacgacaagaaccaaaggaauucagacugccgauaggaaaucacuuugauaagaauaucacggacauucccaaaggcaagauuacuguuguagaggcauugacccuucucaauaaccauaaacucucuccagaaacauggacugcugagaaaaucgcucaagaguacuauuuagaacugaaggauguaaauucccuucucaaauauuuuguuacuuuugaagucaaaaucuuaccuccagaagacaggaaagcaauacaaucaaaaugaagaaaaucacgaaacaacuuccccuguauguguucccaagcuccgcgcccuuguuuugcguguauuaaauuauacaaguuccugugaguugagggccauaacguuugaaagcucuuugaccuccucaggauuguucauauaauuuuuuaaaaauuuauguauguguaguuccuggguauauguuagcuguauugaucauguggcccaaaugagucaauauuaaauuccacuuucuaguuuaaguugguuuguucuuuguaguagacacugaaagcaagaguccuccugacuccuauaagacuggcauuguguuagggacagauaaucagcagggaaacacagugacuauauuucccaagugaagaaagagagaaaacugagugaaaagaaagaaaaauacauauuacuacucuagagaugaaaaauccaugaggaucuuuuuaauguuuuaaauuuguuuuaaauauuaaauaauuuuauagaagaauuagugguaucugacaugcuggcugucucucuuuugacaaauagaaauagguaacuugaaaagguuucuaagagcgaggcaauacuuaaagauuauuugaacaaauagcuucuuuaauuuagaagugagagaaguaugaaagaacagcuaaaaauaagagaauccaauuugauaaccaaacauucauaccuguuuuuauuuuaggaggaaaaauaaccaguagaaguauagaauaaaucccugaagggaccuagaaaguuaccaauucauucacuuaagcucuggaauguuacauuccaguaauagaaucucagauaaggugagaugaguuuggcucauucuggcauguuauacuuguggguucuugcccauauuguuugaccucucugaaauugaauuucuauaaaaguauaccugccuuauauaaauuccaggacaacaaugaagauaaaugacaaaagaccaggcaaauacaaagucuuguaguuaaaaugggugucuacaaaacacacaacagaguuaccuguaguuuaugaugcaaggaagccagaauuuagguucucgaaauccuaguaguauuuuuacuuauucuguaaaaugaaauacauuucaaaaggacagaauggaguugggguaacugggcucguccauauucuuucacgggaacagacagacauacuugccucgagauuccacgggaaaagauguggaagaugagaagaauccagcgaugauggagggaggcagauggaacagcaaagaugggaggugacuggagaguuugucagcuucuucauaucuaguuccagugaagaaacuaucccuacuuauaugugauucaauacagaaguuuaagggaaccuacuaauuccaaucauugcugauuaugguggaaagugccgucaaaaccauccuccauuaauucaaaaugaauaugugaaucagcaguacugacucagguuuccuggguggcuagcagauguaaauaugguuucuuaacugguaucacacaauaaaauccuuccauuuugcacauuagcccacuuuucugguuuuuucuuucauguagaacaccaauuguaacgucacacaaggugcaugaaauuuacauuuggaaaagcggaguuuagaugucgguuccuuaacuagcugugucugacuugucuacaacuaaagugcaguuuauauacuggacacuaaccuaggugccuuacaugucuuagcuuuguuagcauugugguaacaagcgugaaguuaagaaugcuuuccugggaaaguugcagcccgggaaacuucaguaacuacaaagauuaguggauacugaagaguaaauagaauauuuuguacugacuacuacacuggauugccuguaugggaguuguaagaauuaugugaauugauacacggguuaccugagcacaaagggccaaaacuucucaaaugucugcuucuguaaguccuuuguagagcucugggcuaauagaugacuaaacgcucucugcuaugagagacuggauagcaagauuaaaaucccugaauaaauggauucuagaucaaagaugcucuaaaacugaccagugacugguauuggggucucacauuuauuuugaaaagugaggaaugggaaacugaauuugaaggaauggaauugaauaaggaggagaggagaaaaaaacuagauuuggcuuuuguaaaaaugagagcugagagagcuguucaugaagaagccugcagcagaagagugggugguuuggguaaaguucuacucuaaagagauaggcuauccaaacuuaggcauaccagcaaaaccaaccacuuagugucaagacacacauagauacacucagguaagcucacccaaccacaaagacugucucaaagccauuugauauaacaucuuagcuuuaccuuuuacuuuuggaguggguugguguuugagguaauaucuuacuguguaggccaagcuguccucaaacucuuuaacccagcugcagcaccccuccccccccaucccccagugcuguccuuagcuccaguauguuaucauuuagugccucaucacucugaaagagcuguguguuugcucaggaaugaacauccuucuuuccauauuuacucagugcacuuaaacacucaugaucuuugaucugaaucucuauaugauaaauagcuauuuaauacagagcuuuuuagugauuaauuccagagacccugucucccccaaugguuaguuacuggguaguguuaacaauaaagcuagucauggguucagccugaucaucuucauucacaguugccauaacugcccagaauaacacugcuuuucauugcaaugauuggcuuuuauugguagaauuggaaugugucugucugauauaagcuugagauaacccagguacauucugguuuggaugaagucauuuuugcucugacuacuuuauaaacuacugucauucuaacuuaugggaauucaccaacuccugaugucauccaggacugcuuuugucaaucaguccccaauaaacugcacugcaauccua

SEQ ID NO: 1807 - RNA, 10864 nt, Mus musculus
uauggacccacaugugcagauggaacucaaagugaaguucugugcauuuaaaccuuacaaauuuauuaucaagguuaaggguaugagagcugguaucacagguaagaaaaacaucuuuaaguuuuaaacaugacuacauaauaagcaauaugcauuaaauaccagagcauuuauguaugccucaaagugugugggccagaggacaagcaugaauaaaggagacugaaauugcagagagaauaauacucuccccacacccugucaucugcuguauuuccuuaaaugcaaauagcauuuacagcugugacugaacacuaauggacagccugggauuaaggcuaaaucuuugugaacaucugggauuguuucauuuagagaaaaugagaacagucuugaaauucugacuuggggcuucucuaugaagaaaagcaggaccuauagaggaaaaagaaggagaugcuaaugggugacuagacuuuuccauuaggaacaguaaaggaccuucaggucaaugcccuuauuucucucacaaaacucugcaguugugauguuacucaguguaaacagccucagaugaguauaaaaauuggguuauaaaaagauucucccugaccuacaguagcagaggaagaggaaagagaggaggaagaggaggacggaaagcaggaggaggaagaauaaggaaaaggaggagguagaagcuggagcagcagcaacagugacagcacccugcccuuuauuaucacauacaugcacuaaaucauaguauagaaaacaguauucaacacaucaauguugcaugucauuuaaugaccuggaaaguggccacagagcagucuacauacauaugaaauauacaauaaaaugcuaacaguaaucaccuccuuucuuucugcuuaucuggauagauuuccuauacuaaacacaugucauuucuaugaugagaaaaacuauugccauaugagaaugaagacuagggaaccaaagccuuaaacgcaaauaaauaugaaauaaagaaacagagggaagacaucaucaacggcauuucagcuuuaagugggggcaaaguuacccaacucauagaaaaugggcaauccuugaauugaaaauugguaauaaauauaccauggaagaaguagacaaugcaaagaaaauaagcaaguacugagagacaaugaacugagaaaaacugggaauggacucuugcuaguguuugacacugaaacuucagauggucuggguuuguguggguuuaaccaaaauggagcaacuaggacccaccccuugccaccuggaugaaaagccagcgaguagcaacaguguuaagauaguacugaauaggaaauggacugaaacacuucccucuggaaggcaggggaucgaucacauguccuuuccugucucauuccccuuuguacccaguauccuucuccuucguagaccagcagagaacaaugaacuugcagcagacaccuucagccuagaaccaaaaauccagcaaacaaguuauuugauucuuagguaauuuccagucaaaacgcuaauucucauccaaacuugggccuuuuaaaaucccuacuaucguucuuucucuaaaaaagucuucuaggcuuuuuuuuuuuucuuuaagaaaguaggacaagacaaggugucucccuuugguagguaagcacuacaaugcagaaugauguccgucuuuucugcaccaaccuccucaaggauuccucccaguucuuccuacagacugagcucaucuggucaaaugaagaaaguuaaccaagaagcuuuggccaaaacuuugcaaaagguauguaaaauacaugaguaaauuaugaggguuccaccuagaaauuaccuaagaaucagucagcauguaggucaggauccgacuggguaauuucuuaaucuuagcugggccuagacgggcauaauuucuuuugcauuauuuaugaaaugaaugcugaaaacaauaaugucacuauuaauuucaauaugugaucaauaguggacccucuuaacugcaaauacacacauuuuucuccaaaaccuuugagcugaguuaaacucccaccuagaugcuccuuccacuuacagcgaucaggaaugaacuuugcaggacacuagaauuucgugcauuaaguaacaaaaccuucugucauacaaacagaaaugcacacaaauuauacuugccaguuuuguccauaucuacugguguaggggcaaaaggcauuguauccuaugugccaagcucaaagacagaaacagcuugucgucaacuugagaauccauuuuuaacaagcagggccugcugccucaagccagcuaaacaccaaagcaugcugggcugcccacacugcaaauuauguggaauguucuccguguuuugugguugcgagaguacugauuuuguucaucauccaguucaaacuaaaagaccaugucugaccuuacagaaacuucccaaguaauucaaacugacugacaaaaaucccaucagcuucaaaaagaaaaaaagacuauugccuaguucaacauuuccaacgugauuuuucuuuuuaaguuaagagacauaauguaaauuugaagaaacucccuaauguauuucaagagaacaguaagaacucacccuaacccuggcuaucaaaagcagagggcgggauguuaugaggaagaccacuugcaacaauguaaagagcauuuauagcaaaagcaaauugcgaacgcauuuccccaauagcuagcaaauuaaagcaaaaauaaaaaaccacucuaagaguugcuaauuccaucuguaauguucauguagacacugaaaucccucagcaucagcuguggaaagcgacugcuccaaaggaagagcaugguacccuuaauagcccuggcagcacuguauucugaguacuguuuacugaaccaucagugggccacucucaaaucagacagcaaaagaguuuucacagaggggaacauagaacuuccucuagguuugcuacugaggucaacuuucuaaguuguaaacuggagaaucacccgaggccauuuuugaugugcugaaaaaucuaaguuuuaccuagagaaucaccuucuaauggugaaauuguuuugauccugagaaaaaugccugauucaaucaaccccaguggugggguugcuuugauagauauauguguguuuaagaucuuugguaauggcaugcuaguccaagcuuuauaagaguugaaguguuugucaggaagcaguauucuuuaacuaaaauguucaaagauaaccaacccuagcaagaacaguuuuuagcuucuaaccauauagaucugcuguucuuagugagcaugcgccauugugucccugaaugauuucccugugacaggugacagagauacaugacagacacagggcuuguaugacaucauuauaucuacauaaauccauauccaugcacgugaguacagagaaaaggucucaaaaagaauccucauacaauauacgucccaagucaaguauagcgauauaaucucaaagaagucacacugcccaggacucagucacagccaccuuuagagcaucaaacccuuaccaaccugcccaaaguacaaccaacauaagggacaacugcacccagaguuagggguuuaaguaugagacuucugagcaaauacuucuccaagaauguugacaaaaaauuacacacacacacacacacacaucagaacugaugauuaaaacaacucuguaagcauuuucugguaguacauacacacauacacagacacacacacauauaaaugugcauguacacauauauacauauauguguauauauacauacauauauguaacaaagugacaaaauuauauuccaagacaaaaaucaaugucccauuuuuuuuuacaguauucguggcuauuucuguuauugcaaaacuuccaugguacagauaaggcauuuccuuagcuauccuuacuauuuuaguagcaaguaucuuucuuccacauauaugaaacauaugcauaacuuacucugaaaaguucaggauuuaagggcgagaguuugauuauaauuguuccaagugaacuagaugauacaaucaauugugucacuaaaaugugggcuaugugauacuguguaauaccgcacagaacucuuuaucagcacuuuugacuuccagcugacaucagaugaccacacuaacaggagaacgcagaaugcaggaacugaagcccgaaagguaagcauguggggcuuccuucccaugugggacccguggagaaagaccguccgcaggagaugaacuuucuauuagccuuuaucaaauaaaugauugcuuaccuccuuccuggguaaaagugucugaaguaaagucauauuauacaauaaaccaaguauuguuuaccauuucuagaaauauuacuuauaaaauccuuaagaaguuagagcauucuuaaucuaagacaugaugaaaagcaaacuugucgauaaacaaagaaaauccuuuuuuaaaaggaugccacuaaaccucacccugccucacugggguggcgaaggcgggggugggggugcauucuaacgcaaaagccuguauuuccuaaguauuucagacaauccaaauauuucaucaaagaucacuucugaaaacuggaucagcccuggggguuaauuucucauaaagcuacguugcuaaguuuuuuuuuaaauacccaggcgaacaugcugagucucagccuagaguggagagcccagggcgggaaaguucccgagggucacagcccuccgcgaggucugcucggcggagccccggcuggagcaccggggaucaaggaggcccgaagcagcgcaggacaucgcguggccccgggaagccgcggccgcgccgggagccucuccggguugccggcugccgagucagccgcuuccugccgcgggguccggagagagccgcgcuccgcgccaccagccagcccguccgaccgaccgcccgcccgcccgcccgcccaggaugcgcucgccugccagggaagcgcucacaccucgcacaaaaggcgccgcggcgggacggcggggaguaggcgaccgcugccucccggaacuuugcggacaucgcaccgcagcuccacagcuccgagcccccggcgcaggaggaggccgaggcggcggcggagagucggggcaucgcccggcagugccuccgccuugccggcugccggcggcucccgcccccgguuaaccagcgcucgcucuuaaaggcgcccgcugcugguuaggccgcgagguaaggaagagaggagugggguggaggcaaggaaagggggagggggcagcucagacaggcucccgggagucuucugcagucuaaacucagacuccucucgcuccagguccccaggucaccccacccccuaaaacgggaguuaagugcucagacccuacaccaaagauguguagccacugcuggcuagcucaggaaaccucacauuugcuugaacugcccacaccucuguuaagaucuuuaucuuaacaccccccaucccugccugggccacacuuaccauagagcuaaaaucggcgcccaaugggaccaugcuucccuccgcugauugggcagccucccggguguuucuucauuuccaacacugugaggaggggcucaucuggagcacuucacauugaagaccagcuuggacccuuaccuggaccgcugaaggagucgugaacuauaguggcagacaugccuugcuuugacccaugcucaccugcccgguggcuuccaccuggauugcuagaaccacuggcauucaugaucaccaaacuggacucaggaagaaccugaaggaaagauaccaccaucaaaucucaguuauggugcuuuugaaauguugcuuccaagugauaaaugacacuuacuguuuuccuaaccaucguccacauuuauggcagaguggagggcccaggaggcucggagcacuagcaguuuuccugacuccacagcagaccagcauccaaagcugcuguuguaucuguugguuucaauccuugcuucgcaguccugugggaccacucuaacggaaauggaaaggaagauguuaggcaauuaggggguaugauccagccugggcuucaaacaucagucccagcaaaggacucugaagguaugagugacauuuucuaauucaaaggagcuugcaccuuuuagcccuggcuucaaccaacuugguucuuacccuuaggccacuguggaguacacggcugcuugcaagagguagaagcaauuuguguuaccagauggagagaaacuaagcuccaggcuuuggagaaaagaaagcgggagggagggcaaggaaggggaggagaagggaggagagaagaggggaggaggaaaagaaacaaggaaggcuccguccuagugaagagaauccaucauaaagcaguugggauggcuggaucuaauaaccaggacuuaauccaaagggacuuaagaaaaucuguagugaaggcuguguaauuuaucggcuccuauuuauaaagacuaguaaugacguagucacccccuacccccaaaaaaaaaaaaaaucuuuaaauuuccuuuuuaaauuuuuuucugcuggacuuaaagacucaguuucucuccacauuugccuguguuucccuuguacggauucuguuuucucuaagcaggagcuagaacuguaacuucgaaugcacuuccauccuccucaacaugugaugucuucagcaagugagcaggccaaggggcauuggaccaauggaacccugugcuugacauuuuauuuaacuuuccccuuaaccuauggcaccuuugccagcaaauacaccaaccuguacucauuguugggccuucuauuuuuaggucaucgauucuccugcauaacagucuauaggaauucuuuccaagugcguagucauuaacuggggaaaaugggguucacaaauagucacaauuucagugucccaaggacacagggccuaacuucuuuuuuauaacuuaauaacuauucugucuuuucagagcuagaauggagaaguugauguuuccuacccaaaguaccagcuuucccacugggaagauagcucaguggguaaagcugauugccacccaaguccaaugaccugaguuugaguccccaggaugauggacaaacuaacucccccaaauggcucuuugaccaccacacagcagccucaacaugaaugaacccccccacacacacacauacacacacacagagaauguaauaaaauuaaaauauguuaacuuccgcuuguuucuucccacauaggaaacuuucuaauugucacagaucuaaaccauuucauauuuuucuuuucacuuguaaguguuauaggauuccugacauaucauaucuauaacucuagaagagacuuuagaacaaccuaaaacuucccuuucauuuaaggaauaaagaaaugaaauuucaacaucugacuugcuggggccacacagcuguucucagcuucaguugugugccugcuucuaaauguacaggagcagugauggagaauauggccacaguccccaugaaaguagauugagcugcggagagaugacccuccagugggggggcggggggaucacaaagcaucaugugucauauaauuugguguaaaaacaaaugaugaggggagauggcucuaucaguaaagcaccugccaugcauacaugaauuccaauucuuagccaggcauggcagaaccaacccagaacucagcaauggagagcagaaauaggaggaccucuggagcuugucagugagacagucuaaaggaauaggugagcuccagguuccauaggauaaccuaucuaaaaaauaugguggggaaugauuaagaguccugaugugaccuggucuccucaugcacacaugugcacacacucagacauguucacacacauaugauaagaauaggccucaaaguaagugcuagagaugggagucaucuugaaagugcuuuugguuugggguuguuuguuuguuuguuuguuuguuuguuuguuuugcuuguguguuuguuuguuuuuaaagaaaguaaagacauacaacggcaagaaacacugaaguauauacauaaaugggaaagccuugguggggaaaagguauugccuuuuguuggaauagaaaagagcccuggauuuucauggcuuagaaaaaagucucuaauagccccaauaucauuuugcuauauauaaaucuguaucauuuucucuguuuguguuagaggcaaaguacagaucaggagucucaccuccuauaugcacuaagcaagugcucuaccacacggcuaaaugccuagacucuaucauuauuguuuuaauuagacaaaguaaaaaccuguguacuccuuuaaaacauuuauucauuuuuagauaucacuugucaguacuuuccaucauguauguuuggagugauguaauugcugucuuacuuucagucauguucaaaguaaguucaaaaagccuuguuuccgaacccaaauagacuagauacuaaacuacuuuucuggcaagauauuaagcaaauagugucuuucuaaaaaucaguuucucgcuagguaagucggcacauugcuuuugugugggggcuaauggaggaggaucgugaguucuaggacagcuggagcaacaugccaagucccugucucaaaggaaggaaaagaaaccaguuucuacguguacccaagguuuacagcauagcgagauacacaugguaaggccuacaaaugguucuucaaauuuguagauaaauugaaauuucucagcucugacuacacauuagaaucaccauauagcuugcuaaaaguagcaccugggacccacccucagggaagccagacagaaaugaaacggaagguccucggugauucugaucgccaugacugggagccccgggauguccacacagcagaguucguguagaccugggugggaagcaugaugguaugugugcucuuucuuccauacgcacaaugauccugacugaucuuucuggauucgcaguggugcuauagagcauggcaggcaggugauagacuucuaacugcuuucugcucugccuugccccugaaacauucccaacugugguggagacugcaugugguuuaucucagucggcagcacagccugauuccuaagucauacucucuccugugccuuucugcacgcgcaauguauaggcagucaucagcacacggcagucucuggacaagugagaagggaagaaaacaccaccgaagaguuccucaagaagaggucuagaagcaagaagcaagugguuuuggaucccuggauaauuaaaaaaaaaaaaucacucauuaaauuuuagcuauuuggauucugacauuagcaugguguguguguguguguguguguguguguguguauguguacucauauugccccuucuaaauauaauagugaugugcuuguuggaaauuguauuaauauuaauuccucuuaaaugugcauaacgguauuaguuacuuuucugcugcugugcuaaaacacuuuaaccagaaacaacuuaagcaauuuuugguggugaggagggggcuaugguuucagagcgagaguccauguugcagcagaaagcugaaaguccacaguccacuucagaacaagagcagagagggcaaacuggaagugggcuagcgcuguaaacucucaaauuccaccccuagugaugaacuuccuccaggaaggcugcaccuccuaaaauccuauaacccucccaaacaguacuacuaacuggagacacauauucaaauauaugagccuaugagggacuguggacuugccccagccagcuaggcucagucuccacugaucaaagggaagggcaaauaucugagugagguacccagaggacucaagauuuuugugcucaagacuagcacaaagcagccacuucuuacuuucauuauuacagcaagcaaaauaugaggugaugcucauaguguaagcaacuacaaguauaguuugcaauacaccuaguguuacaucuuaucaucucggccuugugaagucuugcccacagagaugaugaggacgugccaggaaauucccuuuaugcccuugcuuucaagugagcuuguuuaucauaguuuaugcauuucuuucuaaaaggccaccgugugagaagaacauccugcccuuggcccauacaugguucacaguaaguucacacuguucugccaaucacauugugccuaauggcugcugcuuugagaacuguauaaaggcucaccagacaggcuaugagugguuguucuuucuccaugugcagggcaacccaacauguuggaacaauaaauuccucuugcuuuuugcauugauucccggcucuguaucauucacucagggaguccccaguaagcuaaggcucaccagaguuuuacagaaccagccuguguccaucuuaggcuugaaaaccguuuuacaaaaagacaaacuagauucauuccucuuuaugauuagaugucugguuuucggauugggcuacuaucuguaaccuuaauuacaaauguuuccauacugccuguuccaggaaacagcaacaauguccuuguuucaggaacuuguuagaccauuuugcaaccaugaccaucuuacaacccuaccuuuguuucaaaggguuauuagggcuaccuuguaaugacuaccuuguuauguccuguuucuguaacaccacccauuugugugccaaauucucuauuuggaaacuccccaccccugagcuauaaaagccuuuaucuuccccaugccugauucugaccuuuugaaccccaccuuagugggagauggucauguaaauaaauaaaaaagcuugcuuuaau

SEQ ID NO: 1808 - RNA, 33326 nt, Mus musculus
cggggugccugcggcaggcugaaggcugacgugucugccguuucccugugucggggcgagcggagcagugauggcggacgccugggaggagauccggcggcuggcggcugacuuccagcgggcgcaguuugcagaguccacgcaaaggugcugguucccugcgguguggagccggcuuaggcccgggacgcugccccgcucccgcacugccugccggaacgcggugggaccccggagccggucugcugcggcggcugucgguagaggcgcucgcugcccggccuagggcgagcuugcaaaguccccagugcagcgcgcagcaaguagucugucccuccuccaaauccuuuuuacgugcagccacagaucuaagccaggcccacaugccaucugucauauuuuagggacuccgggacaccaacuuuucuacacuccagaaaugggggaguggccgaauuaccccgacucugcgcccgugauuacacaucgcauauauaaggcgaauagacuuugucucccugucaacgaguucuuguaguauuuuauuucucuuggaccuaaacacaguaguccguugaugcuguucuauaacauugagagcuacagacauacauacacucucacaacaaacaaacaacaaaacccggggaaaaaauuuagugcaagauggcugugaguagcuaacauuauaguaccuauaguucugcuaagccacaugaccugucuguacaccaacuguaccaguaaggccaacauacugugauuuuaaagaaaaguuuguuuguuuucagcuggaaaauuugauacuugaaggcaggacuaggagagaacaucuguagaaucauaauacagugacgugugugaauuaaauaaauaauucaagggaauauaaaccuacucucaaguuuucuuuuuaaauuacucaaccaauaucaucauacuaauaaaggacagauuuuguaauguagaaguuacucaaaauuuugcuuucaaauaccuggggggggggggggcggcauagcaaguacacucuuaaacuccuggcuucgcacagguugucagagcggaacugcauugagauugugaauaaauugaucucucagaaacagcuggaaguaguccauacacuugacggcaaggaauauaucacuccagcccaaaucaguaaagaaaugagagacgagcuacauguccgaggugguaaguaauuccucagugucaugcuuuugucuuuaccggauguuugaagaaaauacauuaaauuaaaaauaaguacuuacguggagguuauagggcauucuccucaauggcuccuucuuuccucuuuguguuggguaucagauccagagcacaaacuaggcaaauacuaccccugagcuguaacccuucucuacugauaacuugaugaucagccuucauaggaucaugcagucaaccuucguauguucauaugaacauaaucuuacagguucaugcaaacaugaccuuaacuauugccacuuaacaaauaccauguuuuuguuguauugaauuaaauguacuauauauguguguauguguauauauaccauauauauauauauauauauaugugauauauauaguauauaugugguauauauaugcauauacauauauguauauauguauauauguguguguauauauauguauguguguauaauauauauauauacccacacuucaugaccuaggggugaauaccuagcugccagugaucagguacuuaauuauaaaggagaaauagagauuucauaaaguuuuaagaucucaaauauuaaagcugcauuacuaaguuuaagaaacuuuguaaauugauguacuguggccugaggcccaccauauuaugaagugcaguuagcaccaucaaacguaaaauauuguuuugcuuuauguuuuugaaauuugagcaauugagcagacugagcaguuugacugaaacagaaacagccugucacuagauaccacuugggucuagccuggguguuuuguuucuuucugcaggagugcuaauaacacgugagcugugauuugcauuaucuaacagauccucucuugcugauagacacucguuucaguuuugagcaauggggaaaucaucuuaauuuagcugcaggcauuuccucuggucauuuuagcugaguugauuugugagaagaauugaaauuccuuccacggauuucuccgcguuguguccucugauguucguaauuggucugaugugauaaacacagcuuggagaacaguguugccuguggcuuuaaccaugaagauugaucagcgaguaaucuguaucuaaguccaucaguuacuacugagguccuaugcccuuccuagaaggacuuagagccaucagcacugucgguuagaguugaaccuguucaucugcacguccauguaauuucaauuccucucuuuuguucaaaggucgaguaaacauuguugacuuacaacagguaaauuuauaaaaauuuugcuuugauuucuuaaagcuuucuuaauuuauaaauacuacggauuuguuggguccauugcugaaaagagacaccaugaccaaggcaacucuuauuauaagggacaguguuuaauuggggccggcuuacagguucagagguucaguccauuaucuucauugugagaaacaugacaccaccccaggcaggcauggugcuggaggagcugagaguucuacaucuuuguucugaaggcagacaggagaagacuggcauccucagacaggcggaaacucuuuucccaccccuacaguaacacacacacacacccccacacacacacacacacacacacacacacacacagauuguuuuacucggugucccugucucaccuugccuagaacuggguauauagaccacacuggccuugaaaucauaguuguucuucugcauuauagguaucugccaugauacucagcuaucaauauuuuagaguaauuucaaauuuaucuaagugauauguaaaggguguauaaauaauauauauguauauaaaauacauaaaaguauaauuuuuaaucucaauguauaaucucaaauuuuaaaaguaguggaaacuaauuguaauuucuguguaauucuagguuauuaauguggaccugacucauaucgagaguagagucagugauauuauuaaaucagagaagcacgugcagaugguacugggacaacugauugaugaguaaguauaacacugaagcguucucucuccuucugucaggugcuccaggccaggcguggccagcuaggcuuuauguuuagagcucauguaauagagacauuuauuauaaagaccauucuuuuuaaaaguaagugcuaauuugggggaauacauauuuauaaauaauauauauuuugaucuuuuuccuauuaaagcaauaucaaauuuuaacuuauuuauugugaaucagcuacacucaaaguaauguucuaaaacugaugugaaaugacuauaaaauuucucuugucauaaggaaaaaaaccugccacuugauugcccuuacauuaauuauaucuaugagcaaaaacuaagguuuagaucugagcaacaagugaugcucauucccguccauuacuugggggccuacaauacucuagcagaaaagcguuaaaggggaagauacagaagggaagcauguuucauuuaaaaacaaaaacagaaaaacuucuuuucaauauuaggaacuaucuggaucaguuaucagaagaggugaaugauaaauugcaagaaaguggucaaguaacugucucagaacuguguaaagccuaugaccuuccuggggauuuucugacacagguacuguuuuuucuuaauaauggaaagaauuuuaaagagucugaguaggggucaggaccaggugauuuuauauaagguucaaguggauaugagucagagccauguaaauagguaucaccuacuugauggcucugaagggacuguucaacugauacaguuaucccaagccccgggcuaccacaggccugagaguaugauaaguucugagacugucauguguggauuugcucaauacuuagaauagcugcuauuuauaaccuugccaggauauauacaguuguaguauuauaaaauagagaguguaaagauuaggggugcugcucaauauuuugcaauguaaaacaccuucagcaaauaauuuucuuaucagaaugucaauagaacuguucuuuuugcugccauauuuuuccuccacugaacugugccuaugucucaagaacaaaaaguuucacauauucucucuuuagggauuuaugcugauacuaaauucugauaucaugacuauagugcaacaacaguguuaccuaaaaacugaagcuauauguuaucuuuuuuuaaaaguaguuuuuuaucucacagucauagaaauccaugugguacagugggaaacuuguaggcuuuagugucacauacaacuggauuugaauucugucaaugugacuucuuaguuaccugagauuaagaaagguguuguuucaucuguaugcuguuuccagugcuauaucuuuugagaaggaauaaccaugccguuugcauaagcaucggggcagcacucuagaaacaguaguuuguuuuuaauuuacugaaauaagaaaacagccaaaucucauucuaauuacugucuuaguuacuauacuauuauugugaauagacaccaugaccaaagcaacucuuguaauaggcagucaaagagagagagaaauugccuuggauugggcuuuugaaaucuccaagcccaccccccuguaacacaccuccuccaacaaagccacaccuccuaauccuucccaaacaguuccuuuaacuggggaccaagcauccagacacaggagccugugggagccauucucauucaaacaaccacaaccaccuuucacccuaaggaaaucuaacuuuagaucguuacggauccguaauuacaugagaccaagguguaguguagauuuauucacucaccuauauuaauagaauaagcuuuccaggcggcauuuaaaacacaauucagaaaauauaaaugucuaacacagcauuuuaaaggucuaaguccuauuuuuaccugaauaacuauaauucauagaaagucaagcuuaaaaaaauauaaggauuacaccaaaugguuucuucuguaacuguguuucuagauacuaaggaguuuccauuuguauuuucugaacaucacaaauguguuccucaaagcuuauuauauuuuucuuuguuguaaaucuaucaaaccaacuugaauacaucugcuuugagccggggaagcaggguaugaaauguguccaaaccuauuucacauggacuuguucagaugccgucuagcugagaagaaaaaaaauacuaucuugaauuugaaagcuggucaagaaaccagauaaucugccaguuuaaaucaggaaaaaguuguguuacucuuagagaauauaaauuuucagaacuuacguuucccuuaguugcaaaaucauggaguaacauuuauuccuacacccuuuauccaaagguccaaagagaguccuuucuaaagcagucaaucauguuuauuucccuuuagaaauaaguauuguaagcaagagcuguuauugugguuaaaccuuuaucaguuaacuaauaauuauuguuauagcuaaucuuuaauaauuugguaugguuccugacucugcagugagacgaugaaccucuccagauauuaauccuucauuuuaguuuaguuaucauauaauuugcgcaauugaaauuucugucacagcacauagcaggaauugagaaggauuguacaaaugcacauuuuaauuuuuuuauuuagaugaauaacaauugacgucuuauucccaggcauuaacucagcgacuuggccggauuaucaauggccaucuggaccuugauaacagaggagugauuuucacugaggccuuuguagcucgccauaaagcacguauccgcggacucuucagugccauuacacgguaaacaugucuccaaguguauauaggagccuacacacuuacacauuacgcgguaaacaugauuccaaguguauauaggagccuacacacuuauuuacguaguaaacaugucuccaaguguauauaggagccuacacacuuacacauuauucgguaaacaugauuccaaguguauauaggagccuacacacuuauuuacgugguaaauaugucuccaaguauauauaggagccuacacacuuauuuacgugguaaacaugucuccaaguguauauaggagccuacacacuuauuuacgcgguaaacaugucuccaaguguauauaggagccuacacacuuauuuugcacguuuugcguuuuuugccagcaacugaauguguuugaagcccagucucuuugagcacccaucccaguuguuaagcagguggauggagagcuuuucuggaagggggcuacaaagccugcagaguuccaacuucaccugucuccacacauuccccucugcucccugcuccaacaacuucuguccuguugagaaagcaguuuacaaucugaugcugacaucacgucauauaaaucacccugaggucacaugaaaagaccaugcaguuauuaaaauagaagcuuggguccauuguuauacugcacagcagccuugugugguggggcagugaagucaguagcuuaacuuacguggaguuuagauggaguuguuuuuggauccuuuuccugcgaguccacaguauuaaggcauagccguguuacauuagacaaggaacuaagucuguagccuguuuagauuuauugaaauguagaauucacaaagccuacauucuuaauugucuccucaccuuugcaucagauccugucgaguggcuuuggguucgaucagaguuugagauguccaucauuucaaacagcucucuagaugucaucuuccacucccuccaguaucugugcacuuuuuuagaccagugucugcauucacugucauuuucuuacccucugucccuucucaagccacuagucugguuuguagcuuacagugucaguaucacuaaucuaaugucuauuaucuauccuuguugucagcguuuaacugcacacaccucuuuuagauggggaaguuguagucauuuagcaacaggaugcauuuauugaauacugaacacauacaaggcaagaggagaacagaaagguuuggagaggacgcuuauagucugguggaacaauuuuuuuuuauucuuaaauaauuuugaacuuauagauuagaaaguuuuucuaugaccaguuucaaaguugguuaaauuuuacuacaaauaauuuugucuguguuuccuacaaaagcgcauuauucuguacaauacaaaauagaacucauagugagagaauuaccauugaugcauacauucaucuagucuuuggauucauuuugauauuuugauaugcagaaggcuucagcacugcccuuucuagcuguuucagguucgguucagaaucaccuauuucaucaaauuguuacaaguuuuuguucaccuucagucuagaacacuuguuuagguuuuuucugacuuuccugauaucaauauuuuaaaggucacagaucugguauucuugaaaauguuaacuucucuugucugcugucuguuugauggugcugcgaguguccauauuuacacuggccaucauugacaggaacacacagaagagacacuuuacucuucuaauuaaaucuuagcagaugauacacaguuagauuuuuuucaauuacugaugaauauguuauauuuacuuaacagguauaucugauaaaauucuuguaaagcugcuugcuuuccuuuguaacaaaaacaaacaaguagucaugugcagggaugaaauuuuaggaccauguaucccauuccucgucagacuuuguuuguuuauuuguuuuaucacugaggacuuaguguuccguaaauuuguuauuuggcuuuagguuguuauaaauuacauuuucauugauuuuacuaaaagauggcgcucagacuggcuuugaccuucuggcaugaccccaucgugccucugugguauacuuuuucacauauaggacaaaauguuuggguuuggcucauaguucccugucuagccauuucuccacggccaccugguucuucugugggagcacgucuggguacuuagaugcuucgcacucggucugcuuuucacuguuccuuggcccuuuugguaaggaggagaggaggcacugacacagauaugugcacauccuguagauggaaauguaaacauguacagcagagccacgcucucaaauugaucgcugcaacugaacagauacuaagcuucgcuucauucuuacugucuuguucuuccuguuuccauuuccuguauuuguaauucuccgcuucaagcaugggagacugagcauucauuacuugugacauguuuauuuagcucacuaacucccauuauguaccugacuugcugcugcuauaguuucuuccauguacucucucuuccuuggguucuuaccacccauaugcagucacccuccaaacacagcaaguguuggucuuuagggggugcagaacugggaagcugauugguagcaauagagggagacagguuugauaccuuugugcccuucaaguuucucauuuaguuaaaaacuaaaaauacuuuucuguuacuauauuugcuauuucuauuuugcugauuacuguagcaaguguaaauuuugucagaucagcaguuuuguuuuguuuucucucauaguagccuugagcuacuguguagagaugcugucaaacuacagaguaaggcuaauucugaacugaaaagauauugcugagacuggugucuuccagcuagugcauucaguccacuguauguguauaauaccuaaaaacuaaggaaccgcuucucuuuucuggucugaagccauguacauccaaaagguuauguuggcagcuguuauggguagcuaaacggucaggaaguaaaaacugauacgagugggacaugcaaguacacuggaccacguucuauuccagaccaaaauacaaauucauccaacaacaaccuuagaaguuuaggacauuuguuuaauacacacagugaguaauaccuaggaguuccaagguggaguccuuuaaggacggacuguuuuuauguuuucuuagcaggaggagaagacacacacagaauaacauguaagagguugugaugauugcuguaagauaaacagagaugacacauuucacagcauacugugaccuaauucaaacaauuuaauaaaguaaucugaucuucaugaaauuuuguuaaauaauuuagacaaaauucuccaaacacaggaguagcuuuuaguauuucauucaucuuuuaaaauaaguguuucuauuuuuaccaaguuucuuaaaugauuuaaaagaaaauaaaguuguggcauucuaaauaaucaguaaggcauuaauaaguuggaauuaaaggacuuugaguauacauaaaaauagaagcuaauugaaggacagagaugauggcuuagaguaaauagaaacaaaauguuacuuuaaaacuauaggcagugagaaguaaguucaggccuguggagaugggugaaguguauucuuugcaaguaugcaaaucugagugcagucucagcgggcuuuaaagcaaagcuuggaggcacaugugugugacccaaguacuguaggguggaggcaggcagauccugagagcucucuagcuaaacaggaagcuccaagaugagugaugaacucugucugaaaagguacagugaggagacauaggaagauauccaaaguugucccucugccucuauaggcucacacauaggcugacaugccuuuagacacauauacauacaaacacacacagugaaacaaaggcauacacuugggaauaugucagcuagcuaagagaauauauuggacuaaggauauaaauuagugauagucaccuauacauaguaaagucaccuauacaugcacaggcccagggaugaauucauaacaugauauuauuucauuaccacagucagauacaguguccacacagaaacauaccaaggacaugaauacaugauauucauuaaauccauucaugaugccucagacuguugugacaaacacuauaaauaucuaucagcugaugaaaauaaaaacaauguguggaauaucaguaugauagagugcuguucaggacugagccacuucauucaugcuucauucuugaugaacauccuguaagauaagacuaagugaaagaagacagaaacacaagacuuccuauugauucaacucuauugaaugucuggaaaggcaaauguacagacucagaacggaugacuccuccacagaguggcagcagugacugauggacugcaaaugcuacuguaaauuguaaaacuggauuguugugauguuuacacaagauggcaaaguuauuaagaccauugacuuacauacuugaauuaaguagauguugguuauauguagauuauauccuauuaaaauaguuaaaaauguuacagaaaauauacauaaguaaaaaaggccauuuguaaauugguuucucuaagucaaacacuuuugacuagaaacaucucauuccacauacauuuaagucacaucacacuuucuucaaaagcaaaaugcugaaccacucacgugaguauuucaaggugaagagggaaagcagcccaaggaaaguuacacacacccggccucacgugucuguggguuuucugccauucugggaugcaaccauggaccaaaaauauuugggaagaaaauugcaucuugcauuagaaaaccaggaaaucuagaaaugguacguguacaggguauagggagauccuccagcauuuuauacgagagccgugaacaucuuggacuucccuguaccgcccagugaagggcagaaaggaaucaccugguggaaucauaauaggaaccgaucuggguugugaacaaacacugaucccugcucucuagguagcacaacccugaucaggugucuaaaaugggguauaacuucgaugucauuuuuuccuuuaaguaacuugguaguuuuccuauaacaaauuccaguucuuacuuacuuuacucauauacauuguauacuaaauuaguuucaauuuuuucuuuuaauuucccacuaaggccuacaccagugaacucuuugguuucaaaauauggauuucaggaacagcuccuuuacugugaguuuuguuuaaauuuguaucacuuugguuguggguguaaugccguaauagagugucuucugagaauucacaaguaccuggcuuuccuccggaccagggaugagagaaagguuauuuuuauuuuauuuuguuuuuuggagacaaaaauaggacuggugaagaaaagacggggcuagaaguggagaugagagaaagagaggugguuugguuugguuugguuugguuucuuuuguuuagcaaucugagauuggguggacucauuuccugggaucucaguaggguauugcugcgugauagugguguggauccuuuggcaaauaaaacuaugccaggaacauaagaaagaggggaagagucuggggacacacagcccucuucaaguauauacauuuaaugcccaaggauuucccaguagguucuaccuccuacaaacuccauaagcaccaaguagccccucucugggaccaagaagauaaucagcauccaaaguacagcacugcuucauagaccauuaaugaaacaaagugaucucuuuucuucuuuuuuauuaugucuuauguuuuaagaguauaauauaaccauguaauuucucccuucccuuucugcccuuaaacuucccauauaugccuccuugcucucuuacaaugauggcaucuuuauuaauuguucuuguuugcuggugguugucaugguaguugggaguguguguguguguguguguguguguguguguguguguguguguguguguguuacuggauaacuaauugggaugcuguucccuggggaagacguucuccugcucugagcauuucuuaguugcccauguuaagguugaagcccccugggcuuucuucuaucacauuagcaugucuguuguugugggcaucuguauagguaggauuuugacauugcuaggagacucaauuucacaguaaauucccuguucucuggcucuuuccacccucucuuccacaauaguuccugagccgaagguauaagaguuguauuauacauguccguugugucugggcuccacagcucugccuuuugauugguugggguuuucuguaauggucuaaguaucuugcagaaagaaguuuccuugaugaggaguuggaaccacacuguggguauaaggacaaauauucagaguguaacuugggauuaugcugauuuuaguaaagugguaguuguugguucuccuccaaguguaauaaauauugggacguguuuuuguuugaacuguaauuuuaugcaugguguuaaaauuuugaauugucuucuaaaaguuuaggaagacgggcugaagacauuauuuggccuuuaaaacugugucgucccuauucugaccugucugugucgugugcauuugcuuuaagcugugcucgaggaccucgucagcacuggccgcuuacgaggcaccguggucggcgggcgacaggauaaagcagucuuugucccugacaucuacuccaggacacagaguacuuggguggacuccuuuuucaggcagaauggcuaucuagguaacuaugcuuucuuuucuuugaaaccaaaauuucuuccuagcacugaaauauuauucgaaaguauuguacuccagacuccacauacauuuuccugugguuacuagauagauugucaugguuucauuugacugcaaaaguuguuacuuucaauucuguggggcuuugggacugaagauaauuccauuauuacuaaaauacuaaaauuuuuaaaugccaaaagauauugauagcuucaauauguauaaaggugauauaaaacuuaagguuuuaauccccccaaaguaucauauguuuaauauauuguguuuauuguuuuauuaaauuuucuccucucauuuacucaucuuagaaacauuuauugacagauuugcaaugcuugcuuuuaucagcuaucuacuacucagaaacaauacuauuauucuaaaguauauuucuuagguuguaccaugauuucaguaaaguaaacugauugauuuaaagcaguagccacuuuguuugcugaaugcaguccugaucaagcugcaguguguugcauauucccauguuugugaagaaugguuugaauauacuguacauuagguacagggcuuugcuuguggucacuugaucucugaugauguguguucaacuuuaaacagguuagaacuuaguauuaauaaccaugcuaccuucaauaccaguaacauuuguaacucggaaccuguuaugcuaaaucaucuacuuuagagaauggcucugcccuaguguacagugauacaguuugaaaaauaaaacucaccccuuuaacuaaaauaagcaaacuagauuccaguuuugauuuuuaauuuggaccauuuccauuuccuuuacugcuguuuuccgcugcauugcucggcaguccuaucaacccuucagcuagagaaggggccaugcaacuuguauucacagagcacuuugcacuaagcagguuuccuacagagaccuuuaauaguaaacauccaggaauauuacccagggaacaagcuacacuaugucucuuuucuuuuauuccuccgaaaauaccagaauacauuacauccacagucaaaaauggguuuguguauaacuuaccuuuuugugaggcuucuggaagaugugagugauugacaguuccauucuacuuccuuguacauuucuagaauuugacgcuuuauccagacuuggaaucccagaugcugugaacuauauaaagaaaagguauaagaauacccaacucuuguuuuugaaggcaacuuguguuggccaaggacucguagaccagguggaagcauccguagaggaagccaucagcucagggaccuggguugacauuucgguauguuuagccuuugucucguacugauuuuuguguaaaccaaugauaagggauguuuuacuuggacgugcacauuuuagaacuaagccauguaaagguacucuugccugguuacaauagaaauucuauuauuguaggcugauguuuuuaguguucauaacuguaaaucucaaaaacaaacaggaaaauaauauagcaaccauauuaaucuugauagugaaauuaaugagauuuugcacaucugugaauuuucuuucggguugcugugacagauaccugauaaaagccaacaucaggaggaacaggcuugucagcuuacaguuccaagucuuaucuuuaggggaagucccaggagcaggguuguaaagcagcucaucauaguacguccacagucaagggcagagaacaaacugcuuuacuuccuuccuugucauccaggccaggaccuacaccuaggcaaugugccguuaacucuuaggcugagucuccccuuacuaauuaucagagucaaggcaguccuccacagacauguccacagaccaaccugaucuagauugucccucauugagacuccuucccaggugauucuauacuaugucaagcuauugguugaaaguaaccauuaugauaucuuuuuuuauuaaucauuuuauuuguuuacacuuuaaaugaaaacccccuucucaguuuccccuccacaaccccccauccuguccuccuuccccuuugccucuaugagagugcucuuccacccacucacccacucuuaucucacugcucuaccauuccccuaugaugcaucaaagauccacaggaccaagagccuccccucccacugauggcagauaaggccauccucugcuacguauguagcuagagccauagaucccaccauguguacucuuugguuggagguuuaguuccuggaagcucugggugguccaguuaguugauauuguucuuccuaugggauuacaauccccuucaguccuuccccuagcucuuccaugggauccccagacucaguccgauggguggcugugagcaucuacaucuguauugaucagaugcugguagaaccucucagggaacagccauaucaggcucuggucagcaagcauuuuuuggcaucagcaauaguaugggguuuggugucuucacaugggauggaucccuaggugggggacggucucuggauggccuuuccuucagucucugauccauuuuuuggcccuguauuuccuuuagacaggaacaauuuuggguuaaaaauuuugagauagguuaugcuaucuuauccaagcaugaacaacuacccugaccucagauauccuguugcauuugcuuagcccuucucuaguagucucuucuaauguauuagcauacauuagcaucauuguucaagcugugucugcccuucauuauuccaaagggauacuuaccuguggguaaagguuaccuggaggccagucuguuauuuuguucagaguuuagaaauuuauuuuaauaaaggaggacucaugcugugguuaccaaauuucuuaaggcaucuuuauacuuauuucugguuuuagguaguuucuguaugauaaucaccauucugaaugcuauacaaaugguagacaaacaaaugacuucucuuaggacaggcaauacuuaggaggagauauguaaacuucaaaauaauaauuuggaugauagagcugaaaggaaacuuuguacagguaaacuuauuaggacuuacuggugaauuguuuguaggucuguaagagaagaagcacagaggggccuuguggguuuuggugggaauuugccaaacuugacauuuguauagggcaugcaaguggagaaaugaguuaaaauaaaaaauggcauaugacucuugagugccaagugcugauggacccagaagacaguuuuggaaguuaugaucauaacugcuucugaaagccacuggcuucaacgaggauauaugagggaaauuguauuuauaaauauaucuacucauauauauguauauuauacauacaaaacauauaaccccuguuucccugcauuuuucucauuuucauuuugcucaaaauuguagccucugcuacccaguuccuugucaguugaagaugcugcuaugcugcuccagcaggugaugagaccauucggcaagcucgcuucagcuauagucuuuagugacacgguuguggugagugaaaaguucauaacugacugcacaggacuguucagcgaacggaugcaccaaaaagcugagaagguauuacagauguuccuccaccugcuaauccugacaguguuuccuuucucguuaggaugaucaucugcuaucuuuugggaaaugccauaaacagucugacuaccaaggaauauaucauuuuacauaauucuguuuuaucuucucuaggauuuauuguucuuuuucuucaucuucauuagacccuguuaaaaguuagagaacuaauuuuacaaauuaaaaucuuaucaauagaauuacauaguuuucaaaugaaguuaccaaaggcuuugauccacuguuaaaacacuaaaguaugcaguaguauguuaccuauauguaaaucaaaauuauuuugugcucagagaucaaagaaagaaaagcaauuucuuuguacauauuuuuaggacguagcauguucagcacuguagacaaucacuaaaucuagcauagccucauuaauuuuuacuucauuagaauaaacagggaaacucagugagaaaggaaauguuauuaacaagguuuauucaagcaugaugguacauuucuauaguuccuauaguuccagcucucaggagcuaaaggcagugagcaugaguuugagucuacuuaggcucaagguccgcacuagacuauauacauaguaagagugucuuaaacaaucuaaauaugauuuuuuuuucuuuuuguaaaaaaauuguuuuuauuuaucauugugugaccauguaugugugugcacauguguauguggacgcccucagaggucagcagagacuauuagauccugaaguuuaaguuacaggcagcuaugcugagccauguagguccucugcagaggccgguguuguuccucauugcugagccaucucuucaaccccugaacaauuuuguuuuuuaaauuuuuacucuuuagcucuacaacaaaaagaagcaaauacacccaagaggaguagauggcaggaaauaaucaaauucagggcugaaaucaaccaaguagaaacaaaaagaacuauacaaaaaaucaacuaaaccaggagcugguccuuugagaaaaucaauaagauagaugaacucuuagucaguggacacagagacaguauccaaauuaacaaaaugagaaaugaaaagggagauauaacaagagaagcugaggaaauuuaaaaaaucaucagauccuaccauaaaagccuauauucaacaaaacuggaaaaucuagauaaaauggacaauuuucuggacauauaccaaauaccuaaguuaaaucaggaucagauaaaccaucuaaacagucccauaaccccuaaagaaauaaaagcagucauuaaaaugucccaaccaaaaaaagcccaggaccagauggguuuagugcagaauucuauuagaccuucaaagaaggccuaauaccaauacucuucaaacuacuccacaaauagagacagaaggagcacuacccaauucauuccaugaagccacagcuacacugcauauucucccuuggaacaguuucugucgaaucaggaacccguuacaauuuccuuucuuagagaacuucauaagagauuuuuuuuucuacuucugucauguuuaauguuccaaauagauuuuaaaaacugguugagugcauauuacuuuuagcuucaaaagaucucauguacauuaaagagguauuuaacuauuauuaauuauuuuuaugacuuuuuuaagguuuuuuuuguugguuuuuuuuuguuuguuuuguuuuuuuuuuguuuguuuuguuuuguuuuucgagacaggguuucucuguguagcccuggcuguccuggaacucacuuuguagaccaggcuggccucgaacucagaaaucugccugccucugccucccacgugcugggauuaaaggcaugcgccaccacgcccggcuuuuuaacuuuuuaacuacugucuaaauguauuuugaagcagagugcuuacuaggagugucaucauagcuauguaauucaugguuguaguuaaagccaugaucuucguauaaagcaucuccucggauaaaacaagcccugugucuuaauauacuguuaauaaauucaugcagaccuauuaaauguuuaccuauacuauuuguguuuagcuauauucuuugaaaguuuacuagugcgaguaugagauaguuuucugcaauuauccuguuaggcaggcaagaauaaaaauauauagaugugauauuaguaaauguuaaguuuaaauauguuuauucuguacuuggacagguagaccuuuguauugcuuauuuucaaaaacuauccucuggaaaggauauauguaaauacaggcuagaagaguguguuugugugucugugugugugagucuguguguguguguguguguauguguguguggguguguauguguguaucacuuauuuccuugaacacuuguuuaacuaaaaaaaaaaaaugaguuuaaagaaagguaaucuuaucacuggaauccucauuauuaagcauuuuucuuaggaaaccaaaaaaggaaaugauaguauuuuaacugugacaauauuucuuuugucacuagaaauuaaagaacuauuucucauaaaaaagaacuaauuucugaagcuagaaauaguucauuguuguuuuuguuaacauaaaauuuaaacaguagagaucaucaagaacuaagucauaggacaaauagauuuauuugaauugguuugcaaccuguaaucgugagggugguagcaguuuccaugccugucuugucauuucaaguaucuacguggcauugcacucaaaagagucuccuuggggggagaaccuaagugauuaucuuguucgugguaaaaccagcugguaacugcuggagaacugcuucugcugcuccguagcuaggugcugcuugguaauuauagaccacucgauuuugcuagccaggaauagguacugaagcuaaaagagcagcagauguaauugaugcuuaggaagucagccagccucagagcagcagucauagauuuuaucaucuuuagcaauggaaccuaacaaggauaauuccgauguguaaguaaauaagcaacugcucgcuuauuugaaauguuacauauauuuugccuaccaacaaaacauguuuuauuucaggaaaugaaaaauaauccugugcauuuaaucacugaagaagaucugaaacaaauuuccauuuuagaaaguguuaauacaaguaaaaaggauaaaaaagaugaacgcaggaagaaagcaacagguaauggaucauugauaaguaagacacaaagaugaguuguguguaaauaaauacauguucaaugaccaaagggguuuuguugcacauuucuauucuugcauagcagauagccccucuucugaagauaaaccugagucagagcagggcuggagcugugacgaucccugacuacacuguaccacaaagacauaguguagggacagucagcgcgauacuggcacacaguagacacacagaucucuguguggaggaaaagucagcccaaggaguuucagcuaucagacccugacaaaggggcuaaaaacauacauuggaaaaaaaaaagauguuuuuuuuuaccaagugcugcugggaaaauugaguuuuccuuuuuucaugaacuuuguacuaaggccauuugaagguuuucuuuuauuuaacagauucauauuuuuauuuuaauggcuaaucugaaccaaaucuugcacuaaaugaaauuuuaagguuuugcuuaauuuucaauuuauguguauggauguuuuccuuuauguaugucugugcacacauguauaccuggugccugaggaggccagaagagggcaggaaauggaguaacaggcaguugugagcugccacgugggugcugggaauccaccaugaauucucuguaagagcacacaguguguucucaaccacugagccgucucuucagccccuaauaaauuagauuuuaaucaugaacagggaaaugacacaguguauucugguuuuguguguguucaugaaaagauacaaagucuguuuuccaucucuucuguuuucccuucuguauucucauauuugccaggcucauguccacuucauggccucugcacugacagggcugcucaaccucacugcuucuucuaaacugaaagaaacuggauucuucuuucauuaugaguacuacuccaaaugucacuuccuuggugccuuucuggucccugucaguacagaucacacuucuaucuuucccauuugggaugacguaucggugugcuaucuuguuugcaaaaagugccugugguuauaggucuaggaucgaaagcaccacuuggcguaguguaagguuuucuaagcaagcaaaucgcccugcuugcuaacauuauauuuuaaucucuuuuaaauauaugcucagugguaaccguucuauguaguacuauuauuuaguaacuuaccauugagaugugcguguauuuucccuguuuuuacuaguagaagcaaauuauuagugcuaugucaguaccaaaaacuuugauauucagcuuuuucauuaauagaaauauguaucaaacauaugcuuaaaacauaauuuuugcuaugaaaauuuauuucuguuuuauuauuaagauuguuccucuugugaaaccauuuuuugcaagacucuugaaauauuuuuaauauuuucuccauucuuccagaggagccacaauaaauuauuucggugauuccuaaucuucaugcauacacuuauucugacucuuuauuccgaguggcauuuagaaauacacgaguauugauuaaggacuuaagucaguauaguugauguauuucuuucucagaguuauaggucaucuaguacuuuguucugagugacugcaguuguauggcagcaauuaacuacagugcaugcaugagucauguccaacucaaaugucucccauaaaaacucaccaccaacuauuaaagauacauuucacuuuaggcauauaguuuuaguuaguuauuuuuaucuuuauaaagucaaggaaaauaaauuauaaaauaugaugagcuaugauaauugugcuuagguacuagaaagguauauuuaguuuauaagacucacuuuauuuaacucaguaauucuuaugaugaaaacuguuuaccacuuauaacccauugucagaugaguguucuguuuucuagacaagagauccuaaauguaggcgucuacagacaggaaacgaccucaguaaugaggcucgacugucacgcauaguacuugagcuucucuaaugauuuguauugaacucuuuaguaaguaauugaaaauaauuugaugauugauaaguuaauaaauuaauugaugauguuaguuuucugcuaccaauuuaauaugcccugacauuuaucaaguuucuguuacuuuuuuaaccauuucauauuacaaauuuauaauugaggugaguggcgggugaauaugacucauccaaacaugaguagcaaucagucguuuagccaagaaggcaaaaccaccguaaaaugucauagagaugagaauuaaguaaugcugugauagccgacaugaguaagugaaaggauguuucaaguugacaaggaaggagacaggguggcugaaaagauggcucaguggcuaaaggcaguagcugcucuuccagaggacccugguucaaaucccagcaccuaugugguaacuaccagccaucuauagcuucaguuccagaggaucugccuuaaugggcacugcaugcuugugguacacaaacacguagagacaaaacacuuguaauuuaaaaauagucauaauuuuaaaaaaggagaaagaaaagacgaaggaauggauuugucuaaaaagauaagcuacagaaaacaggcagcuuugaguauguuacaguuuaaaacaguuuuaagagauugcugaaguucaagagauuuagauuuuuagugauauacuuuauuuacuauuguuaucauccuuaguaccuuaacauggaaauugaucuuuaaaagaauuuaaauuuuucuuuaguuugcuuuucauuuuucuguuacauaguuuaauauaauaauaugguaucauuauuuucuaaaacguguuaauaauacuaacugauguauuucuaccagagggcucuggaaguguaagaggaggaggagggggcaaugccagagaauauaaaauuaagaaaaccaagaagaagggaagaaaagaugaggacagugaugaugagucccagucgucgcauggugguauguagcuuugaguucacuauuuauuuauguguagaugguuuucuuaacauguucauuaagaugaauauaauuagcuacagauguuuguaaagaaaguauuuauuuuacauuuuuagugaccacaaauuuuacaguuuaaucauauaaaguauaaaccugucucagauuucaagccagaaguuaacauauaaacggaaggggccuauuaaugaucuuuaacagucaagugucucguuuuaagguuuguugauauguaguauuucuuuguguaaaaacaacauggccuguaguuaacuguguugcuucucgucccuaaugauaaacccauaugacaguuuacaaaauugaacaguuaaaaggcaaaagaacugaaaagugguaacacuggaaauaaaguuacuaucaagccaugcaugggggcacauuguuauaaucuuaucacauuugaaguagaggaaggagaaucaguuuaaggacagacgagaugaaggucacacuaggcuacaaugagaccccgucucugacuaaaucaaaacugacgucaaguuuaaugcuggaguagugucuggaaaagcugacucaaccuucgugagguuagcugcaaauggagggacuuaguauugacucauucacugauaacauuuuaacaaaaggaaugaaauuuuuuagaaaauguaaaauaggaaaaaaaaaacaaaaacaaaaaaccuaacaacaaaagaucacgggucucugugaccaccagggacagcagaguguugauccacaugaggcaagaaggaaaucagguucagcauuucucaacagccagcauggguucagaugucuagagucaucuagacacaggggguuuauugugggcauauuuaaggacaguacaauuugguaaaaguuuuccuugguacaccacaauccucagugaacaaagaggcauaauuacaucaaaacguuccucaaaguacaugucacuucuugcaugcauauggguucuagagauaagcucuauuaucuuaaggguauaggggaggaucuaguaugguuugggucauagauauuauagagaucaucuaggcuacugagcauguccaguccugguuguauggauuuggacgaguuccuggccauacggauagcacagaggucaccuagacuauuagcuacaucugguccugcgugugcaagcuugguauggccuaguccuggaucuccuuaggccgggagccaccuccauuccccagcuuucaggcagaaaacaguucacaccuuccuuugaagcaacagcccugcguguuuaacauuccugguuuccccagugcuauuugugaacauaaagacuuuuaugcucccaaucgcuuuucacccuaaaagaacucuaggaaauaacuggaaacauuagaaggugaagaauauguauugggagcugaggcagagaaucaugugcuuguuugaacuuugccaguacauggccaguuuguucuguacaucuaagauuaauuaauuaacugccuuuucaucuucuaguucccagacuucuuaauauuugccaguguuaacuacagaagauaccauauuuccuuuucuaaauacaacuuuuuucauuuuuaacaugaaacacuacuacucccuccuguaucccuagcaacaguuauguacaugcgcacacgcacacagacacacacaugugagaagauaauaagcuguuacuggcagcaucacaaugcuucguccuuccuuaaaauauucuaagaaagacugaaaaacuaugauugucaaugugcagaaaauaauacuaauuaaggaaggaaacuauuuccucucucccccuguucuccccugauucccagcaucaauauggcuuuaugugcaugucauuucucacugugugugcuuauuuaugaauucccaagauguaguagggacaaggauaaagaggaauuuuuaaaaacuuauucucuaauaccuguaaucuuagagaaaugaggcaugugacauuguuuugugcauagauuauugaggcacuauaacagcaguaaaccauucuaccuuaaaguaauuucagugcuuugaaaaggguuauguuguaaucucugaaauggagggugaaauuagguucucagcuaaaauacagaaucaagucaguaugacagauuacuggaggaaauguaauuuaacaaccuguaaaaggcuuaugggaagcaaacaggaaaagacaauuuugcgugagcaucaggguuggagaacagaucucagaagagaauagaacuuugggugucuaccuuaaagcuauggcuucaacuguuuagauccucauuaagauuaaaaaucaauuuuugagccauuuuauuuuauugcuaaguuuucaccugcagaaucaauaaucugauuuagcuaaaaguagucaguuguauaaaaggcauagcuuuaucauuuauaauggaaauauuguuugcuuucuuugcuaccaauacuuuucaagugucugguuaggcugccguuuccacaauugaaaacauuuccauuacaguagcugcaugcuaauuuuauuguucaucaguauagaauugucuuugagaaagcaaaaauaaauuauaagggguuuuuccuauucauuuguauuuuuccaaaaagauaaauuuuaacuuaguccugucuauuuccgaagcucuuguguaaacucaaaggcuguugacuucaggaaguacucacuuuugagaaggaggaaggucuucuccuccguaucuauuguugaaugaggagaaaucacaguuuucuaaaaaacgaucuccacuugauugaucugaugucuagcuauuugcauuucccaauuuagaugggaggaaagaguuauucuucucuucuggcugucuuauagaaaacauuauaagggaaguuaaaacauggucaccuaaaagaaauucuacuauaugaaguuuuaaauuuuaauuuuacuauuuacaaauauuuacuaauauuuguacuuagaaguagcaguuuuguugacauagaaauguguugcugccuggugagguaugcauucucugccuggucuuugcuacuggggucuguuuauuuucccguugcugacauauguuacaggaaagaagaagccggacaucacauucauguuccaggaugaaauugaagauugcuuaaggaaacacauucaggaugccccugaggaguuuauuucagagcuugcagaauacuuaauaaagcaaguauaaauuacaccuucccccauuucuuacagcauguaauuuucacuaagauccucaaaaacaaguuuuagacuuuuuuuuuuuauuuaauuuaaacaugaaauuccaaauucauuuuccuucagagacacuuccuuugagccuuuauuuaguaaaugcgcuugacagaaugggcaguagaaacugagacccucugaagugcucacugacguugcacccuuaggucuuaauugggacuaacucauccuugacauagcgucaaagguagcaccuaaaaagagaaggugcucuuucuauuuugauuuggcaaaaaggaaacaaagguuauuguuagucucuggagggguacaacugaccucaaaaccaguaaggguagaaacuaacaccuugugagucagccaaguugaguuuccaugaaaaauuaaaggaaauuuuacauaacuuagccuauguuauccauaccuggucaucaaucaaguuagacccagcacauaagucucauagagaccauccaagagcucagcgaaccuaaacuauuuuauugugaaauagagcuuuuuuuuaauguaaguaaauuuaugcauaaaauauuauagaaccauacagucuguaaaaauaggaaauaaauacuacuggcuaugcaccauugaauuuuuaacauaaucuauuguagagaauauaggugcuuuuuaaaauacauuauguuaauacuacuucggaaauugagaguuuuuuugugguaauuucugagaaugaggaacaaacuuauuucugcuauuuuccaaauuaaauuuagaggucuguuuuauggaguguuuguuacuaucuuucuugucaucuuuacggcaauuacuuugaauacuuuaaaauugugaaaauauuuuaaauuauucaaaaauuauucuuagaucaauaagaaaaguucuuuacugagccucuuucaaauuaauuuuaacugcuagaaagauggaggguuuuuaaaauguuauugcacuauaagcaaaaugucuuaucuaauuuaaauguacauuuuaauuaaccauauuuaucuugucccaggccucuuaauaaaauguaucuugagguaguacguucagucuucaugucuucaacaucugcuucuggaacuggcagaaaacgcacaaucaaggacuuacaagaagagguuucaaaccuauacaauaauaucagauuauuugaaaagggaaugaaauauuuugcagguauauuuaagugucuuuuuuucacugaaccuuguaauucugcaaggaaggcaguuguaauaaaguguccuucuuuuccagaugacacacagacugcucuuaccaagcacuugcugaagacaguguguaccgauaucacuaaccucauguucaacuuccuagccucagauuuccucauggcaguggaggagccugcagccauuacaagugauguauguuagugaauugucugccgcuuggugcaauugaagucugagcacguuuucauuuucucucauuugaacaaguuuaaaggaaaaguaaaauaacaguuuuuauauagaaaaaaauucuaaagaauuuaaguaaucguacaaugcuuauaaaauuuuacaaggauugauaauauguccaaacuacuuauaguaaagagauucaauuacuuuauaaaaaagaugacuuuuuccaguaguuucugucagucuucuccccuuucuuguugauuuaugacucccuuaauaauuaguccaguuuucuuaaucucacagucauuuuuuaaauuuuauuauuuuuuauuagauauuuucuuuauauacauuucaaauuucaaaugcuauccugaaaguuccccaugccccccgcccuccacuccccuacccacccacucccacuuuuuggcccuggcguuccccuguacugaggcauauaaaguuugcaaaaccaaugggccucucuucccggugauggcugacuaggccaucuucugcuacauaugcagcuagagacaggagcuccgggggguacugguuaguuuauauuguuguuccaccuauaggguugcagaccccuuuagccccuuggguacuuucucuagcuccuccauugggggcccugugauccauccaagagcugacugugagcauccacuuucuagauauaaaauacaauaugcaaaacacaugaaacucaagaagaacgaagagcaaaguguggacacuuugccccuucuuagaauugggaacaaaacgcccauggaaggaguuacagagacaaaguuuggagcugagacgaaaggauggaccaucuagagacugccauaccuggggauccaucccauaaucagccuccaaaugcugacaccauugcauacacuagcaagauuuugcugaaagggcccugauauagcugucucuugugaggcuaugccagggccuagcaagcacagccauuguuuuaaagcaauguacuacuuaaauauugagacaaacucuuuaaguuuaugugcuugaaacuguuaucuuaaacuagagcccaagaccaucacuuuugccaugugagguagaaccauggcucaguuaccuauaggugggagguuuugguuuguuccugugguaacaaugaccauuccuccaccucuuucucuuccuucucgcccuucugggaccaucuuacaguuagagguucaggaaagcugaguaagaaagucuucauauggcugacugcguuuauaacuggcuuugagugugauaaaaccacauccaucuaauguggccucuguaacaugguuguugccacagggguggcaugaguuuucuugguguaaauggucgguaacucuguuacguaauaaaguccauccucaacccccagacagaagugcauuauuuacccgcuacugcuacuuggaagauacuagauucuaccucuuucacuuggagcaacaaucuccagcacuuuggaauguuccaugucuccugucuccuuacuaacuuccacucuaaaaagacaauauuagcauccuugcuccuuggccuuacaaagaacuaagagauggaagaagaaagcccugaauagccugugucuucauaguaugccccucaggucauucuuccuaaaauauauuagacagaucggucugucugguuuacaauaccucagaauugacaguauccucaucugugaaagaugaugaaagcuuccauaugccauguacuacacaagcaucuagccauagcauaaguacuuccauaugccauguacuacacaagcaucuagccauagaacuagcuacacugcccuuccuacaggcauccccucugugugagagccacucuucaggagaggcugaaaagaaaagccacgguguguuuacccaaguucucucuuuccacguggccagacacuagucuucuaauggaggcugucaagaugagggcugagcucugugauucuguaguauuuuaacauuuuuauuucuggcuugagaccuaacuuucaaaaccccaaauauacuacauuuagcauucuauucuaaauguauucugaauuuguggauauguuuguuugucuguuugaguuuauauccaguauauaucaaaaacacaaugccaaaagaauuuuuuuccauuacagauaagaaaaaaaauuuuaagcaaauugacagaagaaaccaaaguagcucucacaaaacuccauaacucucucaaugaaaaaguaagucagugcuaaguggugacuccaguuagcacuuuguguauaaauaaggugccuuaugaacaucccaacagagacaucauaagcuggaucuaaagcccggcggccucaguguacaggcaccuuuugggaaggggaaaggaagaagaugggagcacuuaacauuuuuaguccuaaaucauuuucuauuugccaaaugcccugcuaaaaauguguguuuaggauguaaaauuacaaaacaaaugucuuuaagaguaaaguauggaauuaccugucuucagagcauagaagacuuccugucuugccuggauucugccacagaagcgugugacauuauggugaaaaagggagacaagaaaagggaaagguaacauugauucuguuguugcuacuccuaaacaugagcuucuuugugguugaaacuuuugacugucugagccauagagaguuguagaccuccagucuacucgugccccuaacccuaggacauuuuaucaggauugagaccuucgguacagaaaaccuuaucguagucaugccuuguuugaucccaacaacauaugagcaaaaguacuugcuguauagcuuucucuguaauguuaaucuaccuaugacaacgaaaguuaaaguaggauauaaucauaucacccauauuuaaagaacuccuuaaaaugcuguggaaucaagucauuaaacuagagaaggugaaaaaugaaugcuaaaaggaaaauacauaaaugaugaggccucacuaauguauuucugugauuuggguuuugcagacaaauccucuuccagcaucgacaggcucugugugagcagcugaaggucacagaagacccugcucugauuuuacaccucacagcaguccuguuauuucagcucucaacccacagcaugcuccacgcaccuggaaggugugucccacagaucaucgcguuucuucacagcaaaaucccagagguauuacagcuucauaugcuagaaaacuucaagcuuucaaacguaguguucuggaugugaaucacugccaacaccuaagcagaguuagagacagaagcuguuaacaucugucugcugcgggcaggaauggggacagagugaggaauugauuuaaaaaaaaaaagaaagaaagaaagaaauugagcauaguucaagaaucuuucagcauacuguaagaugcauggugaaaaguccugugguuuuaaagguuaaguuuucaggaaagauauaagaaucucugaacuucugucucaguuucccuaguuuugauuuagcccccaaggacccuucaaaagucuuguccaguuuagcuaaggaauccaaccccuagcuaaaagcaccuuggcuucuuuaguccuuauuauuuugugucuuaggucguagaaccuggcuaaaucagauuccugugacauggucugcacaggucuuaugucuccugaucugcacucugagaacacagaccuugcuugccagguucagcuuuccauuaacaugccauuguuccgugaagauaaggcuauucuguuugugcuguucaaacaaauucuauucuccauguucacagaaaaugagaugugcuugguacaguuucuucuuucuuuccacaggaucaacauacucucuugguaaaauaucaagguuugguugugaaacaguuagucagucaaaauaagaagacugggcagggagaggauccgucaagcgaugaauuagacaaggaacaacaugaugucacaaacgcuacucggaaagagcuucaggaacugucauuauccauuaaggaccuuguucucaaguccaggaaaucaucugucacagaggaguaaugccccuaacugacuuuuguuacauaguauuuuccccaaaguaggugagugaucacaaaaugagucacucagcacaccuacucccccuccaacccgccccacacaagucaaauaaaguaguggugugguaauagaugcagacuuuaugggaagcuuuacugcugaguucuccgugaaacguuuucuuuucauauaauccgauguguaauuuuuuauguaauaaaauuucuucaaagaguucugaaucuagaacauauuauaugcuuuaauguucuuccagauguuaaaaugaaaaauaaaauagaauacuuuuuaucucuaggaaaggacuuguuuguuauuuaauuuauaugguauauuuuuuacaaggaaaaauguuuauaugucugaaauaaaaaaaaaggaaucagcuuuacuuuuaaauuuauagugaaugcuuuagaaguagaaauuuucaaauauauuuuguauuccuaaguucuggcucuugcuuuuaacagcuagaaggaaggccuccugcaugaacaucuccagaggccucagaagugauuuaacaagugagaacacugaagaagcaagcauugcuguguucgaauaaagcaagccacaggguaccgugagggaaagcgugaggcacgccgcagaacagugcaaaccaugugucugucugaggggcuaaaggcacagagaugcuucugucauuagcccaguuuagaguucuaagguuuaguuguuugauuuccguggcuguuuuuacccuuaguucuuuguuggaaauuguaugacagguagcuaggcuguucuaaugaacacagaaucuguggguguuuaaacugugcagaaauuauauucuaaaaguagacguguuuaaaaguugaauuuuuguuuucuaugauuauuagguaagacauacuaaaacaguuccuuggaacaauaauuuaaagcaaguuauaagcaacauccuauugucaaaauuuuaguuuuucugaauguaauaaaauuaaaacccagauguuuaaggaaugcuauuuuauauaaugucaauggaauuuuuauauuuuaaaauguuuaaauauauaaauaacacuaccucuuuucugaaauggcaaaguguuaauaauacugcauagaaguccuuaauuauuaauuaaaaauuuuauuaaaguugaugauagagauuuauagaaaacauuaaggggcuguagagguggcucagugggugcugcuguuguuguuguugcuguuguuguuguuguuguuguugcuguuguuguuguuguugauggugaugauuugcagcaucacauggaugcuuuguaucuccagucccaggaaagccaaugcuuucuggccacuccgggcacuaagcauacacaagauguauaggcgcacaugcaggcaaaacacccauacacauaaaagaauauaaaugauuucacauggguaauuuuuauuguauauuuucauauaaccaaaggaagaaaaguaauaaauucuaugacuccaaaacuacuuuauuuucguauucagcuuccaaauuaguacccaaccuauucaacuuuuguuuaauaacauguuucaaaaaauacaaaagugauccauauuugcuucauacucuacaauuaaaguaaacacaagagaugaucacauaaacucaguuuaauuacaaaacuaaaguaggaaaauguaaagcuguguuaaucuuacuugcauuuauuucauuuguccaaacaguuucuauuuuuccuucauaaaaaaacauguuuauaaauuauacagcugauuuugucucuauagauuuaauuucugauauuuuuuaauggacugaguuaagaacauuauuuaaaauaaaguugucuauucuauuacauuuuauguuauacagucuauguaaugcuuauauuuuaaauuauucugauuguuaauggagaugacauuucuuauuacacaaaaauaacuuccuuguauguucu

SEQ ID NO: 1809 - RNA, 661 nt, Mus musculus
aaagaaagaaagaaagaaagaaagaagaaaaaaagagguugacaacuggguuagaggaggaaaguacagcauaucugccuuuagagcuaucaacucagggguuuucucaauugugaaaucuugcagaaguuauuuuccuuucucaaaauccaggagaugacagcagcccuuacuccagaucuggcaucuuuucaucaucacugucuugugaaucaucaucugcuccaucuacuucugguaaaucuacauccucaucaccacccaugugauccaucaucucagagaaauggucaaaauucgacaugucuucaucugagucauccucccagucuuuccaauuauugaaguucacacugagccaauuaagcuuugcccuuuccuuuguuaaccuacgccaugacuggccggauccuuuucgcaaaaaaauaaauaaauaaaauaaaaucgaucuguccguucuuuuaugcuuggaaucauuuggauuaauacaaugaauaagaucaauuuaauuuaaaugcuuaaaauuaucgcuuccuccaagacaacugaaaguaaguuuggauuuuucaaaguuuacauuaacauguuuacugucuucaacacaaaauucaaugauucauagucccuucgaucguaccacuuugcagaagcaggcugcaug

SEQ ID NO: 1810 - RNA, 191118 nt, Mus musculus
cacaggcagcagauacaagggacuggagaagguugccugcauugagcucccugcugucgccuucuggcuggacaguccgugccaaauagcgccuggggggugggggugggggacagcaauaaggaacugacagaagcgguugcugcaaguccacaguuugaccuaaaaggagaguggaggaggguggcagacuaagagucugcauaucggagacgcagcaauggaaccaguggcuaugugugcgcgcacaggugccacaggccuggagagcaaugcugugucucugcagccucccgacucaacacacgcgguggcuugcugaaacugcauccgcagccgagcguggguacucccaggcacagucaccggaggaagagccaaaggaaagggcgcgaaggggguuagcauggagcggcaggguauuggggcaagacccacaggcucauuuuggagcuccucuggugggaaccuguacccggcugcuaugcuccucccuucucuucccaacucucggugaucaucuccaucuccccucgcgcaucccuuccccccucccugcuuucuuugcucucccucccugccgcgugccugcuccccucccccucuccuggcugcucugggcagcagcaaccucggcagcccgggagaugggaagagagcgcgcggggcgcugcagcucuggagcccuggaucuuuccucacccggugccuugagaccccgccgccgcucucgccucuuggcuacccccggacuccggcuacgcuacuaggacagcgccgccaccaccgccagcccucgucccgcccgcgccgcgcugcccucccgcgcccuggauggagcuuucccucgcugggaucggugaguaccagagacucuagggggucaggcacaggacugagcgcccaccguacaucguuagaugaggcaccccgaccaccugcuggguacccuccuggcacagguccccggggacauuugguuuuaacucaaccagcuuggaacuugaacccuuucucuuccagagauagcugcuuguacaucuuagucccuugucacccuccugcccucccgcugcuacccucauuccccgggcagauagccuucuccuggugucacuucaaagagagucauugcugcccuuguuguccccagguuuuugugaauucugucuucugccuagcgcucggaccuagguuucuccacaaaguccuccucugacccaccuucccucaaagccugaccacagagucauugguccugccaucccguuccuccucagagacuuagugaaugcugaccucauugcuuccacaugaugcugucuugaagcuuuucugacacucaccuccaaacccacacugacacgcgguguguucuguuuauugugucucugcaccugggcuauuaaggugauaaucaaccauggaaagaggacaaaaacaggaaaucuuuugggacuaaacuuuuugucauuguuucaaagugcccaacuauuuacaucgcuuagauuccuucuugucugagggcuuguccgcugagcacaaggaagggcccauauuauuuuaccuguuaucacagaaucuaccuuuuuuucagguuuagagcagagcaccuuacacaguccagcugugaaucucccuaagcuacgccaccaaaucucggcggcaacuuuuaaggauaggcagcuuuuuuaaaaagagguggaaccagacauaccguuuacaaucgcuuuauuauuguuguuaugauuuuaaauuucaauaaguuaaagcccuuauuuccuuuguguuuauugaccuaagagcggaagguuguacagagaacuuccacaccacgcgcuucaggggcgguguagguguagucucuagcuauccuaaugaguuuccugaaugcagcagaccuuccugcuggaaucaggcuuaucauuugugguuagcuugaacaaaaauaagcauuguguucaaagagugaaucugacggggaguggaggguuccugugaacaggaaaggaggugauuuaaauacuaaaauuuguauucaagauuccucugugcuguagugaaaagcaagaucccauacaacuuaugauuuacauucaaacaacuuguaaaauauuguguggcggcaucuuacugcacagacgugaacauaggguuaauguuuaaggaaaauugggaguauucaaagaaauguaagaaacuuugaaggggaauacccuauuuaagaauggacugugugaauaaguguuuugauauuacuguaagcaauuuagggggaaugagacuugacuugccauucuccuguuugcaguugguggagaggaugauguuuucaguccucuucuuggacaggcgauucucccucuauauaaaauagaaagggaaauuugaucaaauauacgaugaguuuguuuaccaaugauuaccuuuaaaaucccaccuuucccauugucaagcauuuuauuucacuuugcuuucuugguaguccuugucucagggcaggagcaaagugaccagcagugguuuucagcaaauguguucagcugcaccaaaauucacgagggccagguguacuacuguugguuuccuaaauacagaaauuugccuaauuaaccuuacuguuggacuaagaaaaauacucaaaacuauguauuuaaguuugcaacugcugcagacauucacauauggcaugccgaguggacaauaggcgacuuagaagaugaauuaaagaaucuuuuaaauuucccucuggagauauuuguauuuuguuuagcaauaggguaauugguauguacaguauauccagcaauaaugagucuucacugaauagauacgucacaguugaacgaagcagagcuuggaguaaugcugaaugcucuguuuuugugguaagcagaaguugagaucaaagcauucuaacagcauuguaguuuaugucaaaauauuaacacugccuaagaaucaucuaugaacaugaaaaugaauuucucauaaaauagagcagagguucuuguuauggauucuuauacagaagucaaaacccuucuggauuuaaagguccuguaguuaggaagacucugcaaaaucaucaaauauaacagaugaagagacaggaacaccaguauuggaauggugcauuggugagugugugaugcucuucuuuacauugcuaccaagaggacagguguaaagucaauauuugccuuggcaaaggggauuagcaguuguguaaaugacacaggaauuucaucaacaaguugccuuuaguccaugcaugguuuuacugagaauguaaggugaagagauaaaggcugagggagaugacgaacauggggugaaaauaaagaaccugugaccaccagcuugaaacuuacccagaugacgauaacugagcacaaucccuaaaguuuuagguaguagcuguuucccaaugugauuuuucagaagccuccuuuuuuuuuuuuaggaaaaaaaacuaacacaacauuuucuccuuuuuaugaagugauuauuucuagaaucugagaugcaaaggcaaacucauguaaucugucuaagugaacugaguucuaaacaaauuuaaaaccaagacuuuggacaaggaauguauaaacuaaugcuuaaauuuacaauguuugauggagguaaauaucucaugcuggcgaauuuacauuggugaacaucuuacucgauuuuauguacauuuacauaugauuuaauucacaaaagucuguauauuaaaacacaaacauuuucuuagcugaaaaagcagccaauggaauggauagcaagucauuauauaagcgcuuuuuuuuguagguuuuuuuuuuuuuuagcuucaguauauacaguaauauuuaacaacaagccuucuuagaaaacaaagagugaucauuucuaugcuagcuuccugucucaaccacagucucacagguuuugaggacgugugauuaugacuucuacauaauggagucucauguuucauuccuguaauucugguguuugggagacuugagacuggaaggauauccuuucaaaguuaaccugggcuguacugggaaucacucauucaaaaugacaaaaggaaagcucaaaccgacaaaagacauuuaaauuuugugcuggggcuuguggcuacuggagacccacuuccauucauuuuauugcaaauggaugacacugaaguuagguguggaugggagaauuugaagggcauucugcuucuguuauuugaaucaugauuuacccaagguuccuaaguaauuaccagauucagaauuggauuccgggcuuacucuuuucauacuguaucuguuuuuccagaguauaaaaacaagcccccucguuguuucugagaaagguaaugcaggauaauucaguuucaguaugaaagaaaaugggcagauaaacaaccaaagguuuggugcugcuucagggucaucucaaugcuucaacuuuacucagcauaguugaugguacgcagucuucccgacacuuaauuggucacuuucuucuuaaagcuugggaaacacuuuaaaaaucuuccaguuacaaggcuacuuaauauagccauuauuuuuuucacuucuuguuauuaauuguauaucauacaguguaaguuucuuuuauaguaauauuauaccacagauguuuuucauuuuaacuggauugaaacacauuccccuaaguagauguuggcuucuuuaggcauggaacagaaaugaauuuggcguuucacuggucuguuuccagugaaauccuugcuucacugcaaagagaguuuacauauuggugugcuuacuuucuacuuugcugcuugucuccuauagacuguguagcuuggggaguuggggaagaaaaauauguuucacaaaguucaagaccacauccuggcaucuguaaauuuauuuucaucaauauggggccaugaaaaaaauaaacgaauauguuaaugagacgccauccuuauugcuggcucaauacuaaagugccagaggcauucuugaacauggaggcucaucacugccaucuucccauggaaaaagaaugaauuacuguguguagauaacugagucuuaucacuuggaccacuauugcuucaucuaaauguggcuagauuggaguuauugaagagaauucguuaugcugaauugcuugguagcuugcucgacagaugagggaccaugucuuaaggguuccuuguuaaaggaguugaucuuaaaaccacucaagauggagaugugucuaacaagagaauuguauuuuuaagguuuccgugaccuaauuucuuugcagcgcauuucagucuucauuaacugagaucuuacuauacuguaugaucugaucugaugaauacagacacaugaaagcguaugauauagacucugacuucaaacacaugacaguuuagcuggaucggcuggauacgcagcauguaagugaaaaggagugcugaaauccagacugcucuuaacccaggacugcccaaacuucuugaacagaugauccaagaaaaaaaugaagagaacacaacacaggcauaucuucauugugucucauauauggaacuaugcuacuacuaagacuugaaacgaaauuaauguccuuccuuaaaagcauacaauuuuguugcugccuauauuuaaauauaucaaccaaauacugauaauacagaauuuuauuauacauuauuacaauaaauauacuugagcauuuauaacucuuacaaauaaacacauuaggugauuaaguuauaagguaaauuuccaagggaaauguaacuauuuuguacacuuucaauaaguauacaaauuagauuagaauguacauuuuugcuuucagcaaacauucauaagaaagugagcaaacauggggaagaaagcuauaaauagcuccuauauuguaucuuuaauacuuacaagucaacaaaugccuuuaauaagagagauauuuaaauuuaaguaacuaaaaucugucuuauuugauaaagagcauuuacugaauacuuacacuggaauguuaaaaaaauuauuugaaauauuaaaauguauucuugggaaauaaucuuggagagauuuguaguguagaccagggacuggaaguuuauauucacaguuaucaaaauuuaugguauuauuauaguauuuuaguuauugcaaagaaaugguauguaauagcuccuuaggauacaugaauaguuuuaaaugaaaagauuauuguaugcacaugaagaauuuauuucuuuaacguuugcucuuaguuucccaagagaauaaaagaaucuaucugauuuguacaaauguguguguguguaugugugaacagaucaaaggaauuguuauagcaagcuguaaccacguggaaaaaguauauuagaaacuuuguugcaugaaugugauuugaucuuuuaucauaaggggucuuaagcagacaaaagguagccuugacagaaaccaugagccauucuaggaguuuaaucugugcauucaauuacaucaacagcugggacuaugggaccaacagcuggauucagugggagauaauccacucugagcuaauaaaguuuauuaacucucucgcugucucuggaaagcugcuauauuaggauauugccucgcaugcugacuuaaauucuauaauuagaucuguggucauuuuuucucuauaauaauucagaaguuucuacagaaugauaugggaagaaaacaaaaaggaucaauucaagcuacuuuugccuuguuaccauguaucacauggguguuuguccuuuuuuuaaagauucuuuucugguacuuaacugauaauaugaaguaggcacaugaaaugcuauuuucuauuauacaaaguuauuaaacagagucacagaccuuugucaccagaagaucucuguugaaacucauugaagguccuuuauuuucuacaaauacagguaaaaaggugaccugaguaucuauauccaacacacccaauccuuuucucccugaaaucccugaacauguacauauucauuuaaaaagauuaauuuuuauuuuauaccuuuuccuguguaaagugguguguaugcauguguguauguauguguguguauuuguaugcaucauauacaugucaaagcuuuuggaggacauaaggcaucagaacccccagaacuuaugucauagaaggaugugggcuacuaugcaggcaaucggaaccauacccaagucccauguugcuauauuuucauggauacgguaucuaauaauucuggcugaagcagucuagacucauacaauagucucuuugcagaacuuucuuuaaucugugguauuggcugcuccauugugucaaaaauauuuaguucucaccagcaucugucuuagaaagagggguuaucauuucuacauaguguuggugagccccaauaucuggauuucuuucaucauucugguuucugauugcuuucugaauuauaacucaaguagacaaagacacagagcacaaagaccauuacaugugcacaugugucuuguaucgaugauuuccacaggguuuuuuuuuuuuuaaacucaggaaauucccucagaagacaaaaauuacuaauaaaacacaugcaugcacgcacacacacacacacacacacacgcacacacacacacacacagagagagagagagagagggagagagagagagagagagacaagagacagagagacagacagagaaagagagacagagagacaaagacauagacagaaaaauuaaauaaagcaacuuaugugaaccuauuguuacuuucaaaagauccaugauugccaagauaggauaagcuuaggugggauguaggccuagaacauuauauugcuugccauuucauuguggcaaacauauuuuaaagaaauauuuuccauuguucuucucacaggaaacaaucaagguucuaaugacugauauagugaaguccccauucaucauggucguauguguucauuuuugcuaauacucucagaaauccugaggauccuacggcuaucaaggacaaaucuuccugcuauuauuuauaggacugcacauguguaacugcuccuucuauugaagaggaagugguucuguuaacaggagaauuacaaacaaccgauagcuacauuuuaccuauuuuuuauucauuauacugaaauaacuucauugauucucuaugaauaacagacaaaaaauuuagaagaaccauuuauuguucauuguguguuuguuauuaacuccuauagacuuccuaacauuccauaaaaaaacucugcaagggaccucacccaccuuccugcaggaagagcaggagugaugucagucuuagcauuuuaucuuuuuuggcaacauugucaacaucuaaaguuugagauuuuucucuucuugcaccucagcacaaaagccuggcauaguuucauagaugcucucgaaagauuauagauuucuagguuagagggaauggaaaguuuguuagucauagaaguuucaaggagaauuagcauuuuuguacuguuugggggcucaguuuccauaagucaugaaauauaccuucacaugucuacacauaagaagaaaggcaaaacuucagaaauacaaauccuuuguaacaguaacuaugccucccuuuguuccaaaagguaauucuauuuaucccuccugaaaaugcuugauuuacaaacaucucaaaaaccagugaaagcaugcuaguuagugauccagacaaugcacagaaacaugaaaugcucaugggagauuaugucccagugaugacaaagaacuucaauagaugcuuuuaucaggguccuuuccaucauaugcuaaauguucauccaaauaauaagaugcuuuuuuuuuuaacaugggaugccugagauuuaugaaucacuaaacuuuuagaaaaaaauauguuguauuugauuuugaauuagauuuuagauuauuuucuuuuuuuuuccccccauaggaacuacugagaauauuuauuuuuuuguuuuuguuuuuguuuuuuguuuuuuguuuuuuuuccauguuuuauuagguauuuagcucauuuacauuuccaaugcuauaccaaaagucccccauagccacccacccccacuccccuacccacccacuccccuuuuuuggcccuggcguuccccuguacuggggcauauaaaguuugcguguccaaugggccucucuuuccagugauggucgccuaggccaucuuuugauacauaugcagcuagagucaagagcuccgggguacugguuaguucauaauguuguuccaccuauaggguugcagaucccuuuagcuucuuggguacuuucucuagcuccuucauugggggccaugugauccauccaauagccaacugugagcauccacuucuauguuugcuaggcccaggcauacucugacaagagacagcuauaucaggguccuuucagcauaaucuugcuaguguaugcaauggugucagcauuuggaagcugauuaugggauggauccccggauauggcagucucuacaugguccaucuuuuuaucucagcuccaaacuuugucucuguaccuccuuccaaggguguuuuguucccacuucuaaggaggggcauaguguccacacuucagucuucauuuuucuugaguuucauguguuuaggaaauuguaucuuauaucuuggauauccuagguuuugggcuaauauccacuuaucagugaguacauauugugugaguuccuuugugaauguguuaccucauuucuacugaguguauuauaaaauaaagaucaugucauugaaaaugcuguacaaguucguacaaauuugagcgcuaaccaaagacgauaauaaauguauauuuuaucuaaguagauuauaaauuaaacucacuaaaauuugauauuuauugcucucauguccuuaaaguuuccuuagaaauuacaugcaaguuuuccaaauaaucaaaagcuuaauuuuugcuaucacuuaagaauauucgaauuuaaauaaugccuuggggcucauaaugaccauuuguauaguaauagucguuuaaauauauaaauucuuuuuuugugacacaaugaaguuuuaaaguuuuauuccacuuuauauacuuuuauaaauugagaaaagaaucucaaauuacaggagugacuagaaaccaauaacuuaaguuacucaggauugauguuaguuuucugaauuucuaaccuggaaauuucaaaguugugaacuuuugcauccacagaacaaacuacugaugugcuuugcugucaugcuuugcccugaggcgcaguuucugucuuucuuuuucuucucacuguguucuacucuugugcuaacagauguucugcucacacaugguuuugcaguuucccacacccuauguccaucaccaaggcucugacucugcagucugcaguaacuuuuucuuaucucucagguacagucuuccaguucguuccaguuugaauuggucauucacaaucuacaaaucaaguaaacacaacaguaaaaacaacaacaacaacaacaccacaacaacaucuagucucaaagggacacaguauuuucuucugugaagggagaguugaggcccugacaugaugaugcuauccuguucucuucagcuggcugcaaugggcugauugugucgucacuucaguucacacuguguauuuauuuugugguccacaguauuauggaaaguuaaagaugacaaguucuugacauuauauugaacacauuuuuuucauaauguucauaauugguaugcccuuagcaacuguuuugcuucuucuacauugugccauuacuuuccugcaagcuuaucaggaagcuacuuaaucaugauggaauuuaggaaaauacaaagugaaucacuagacaauauguuucugcuugaacuaugaauggugagguaguaagacaauugguagaggacauggugauaaccuugugaaaauaugauuagcugaacauaauaugaauacaaaagcuccauagaaugaagagaugauaaaaccaccauuuguagcaugauaaagacaaaaaucuaucuaaccuauauagaucuaugaaaacacuacuauauauauauauauauauauauauauauauguauauauauauauauauauauauauaugaauuuaaaucuuauuuuaauuuauacuaaaguacaaauucuauggacucaaaauugaauagaauuacuaauugagagaguaacaucaauuuuuuuuggaucuauaagucucuuacuccuucacguaaaauauuuggaugcuaaaaauguacaauuagauaacauuagaaacuucuacaauacuaacacuaaauucucauucagcuaaugugagauaaaaugauucgauuuuuacuuaaacaggaagugauaccuagauaacccaauuauguaauuagcaacucuugggucgguaggaaaauuuagguuugauggguauauaguaauauaaaaacuagcauguaaugaguaauuaaaauauaauuagaaccauauuuugugaaaaaauuaaguaugccuuugaaaaggcaguuugcgcuuuuaauuauuauuaagcugcuauggcccaacauuucuuacauucauuaaauucguuaacugaagaagaggcucucuuguuaagcaauucuggaaagaauauaaauccuccucaaacaauaauagccagaggaagaacaaacacaaaccuuuucgugaacccaauaaaacacugagcucacugggccuccaaauguucaaaauuauuuaaagguccauccaugaagaaaugagucaugagcuucugcuguccgugaaaagcuuauaguaugaucugaccacaguagaagugcugauaaaaugaccacaauauguaucaucuggcaauacacuaaaguuuugacaaaugauugaaaauuggacaggagauguagagaaagagaaugaaaccuggggaagucuccagugaguggcuguuugaaguggcucguccugauuuuaauuggauuucuacuggguauuggcuugugagaaauaagaaaguggucugagagccagaaagaaauuucucucaggcaucaggucugucuacuaauauugcuucaacaagaaagacccagaccccuccccaaaacaucauuuuaaguccaaagcaaugcaauguacauaaagacuaacuucugguuagaguaauucacuucuccaaauaaaggcgcuuagacuauaaagguauaaaccauguccggguauaaauuaugaguauaaaucucaguuuacccugcauuauaaauuuaauaaaauaguuacacaacaaaaagaaauuuaaagaaauaaaaacauugccaagagucuaaaccauuaaauuggacuugaaauaauacagaagcuggacuaucagguggauucauuaaggagacuaaugggaaaacguggaggaguggggauaagaaagcauugggguggugaggaaggggggaaggaaggagcaaaagaaugaggggagaagaaggaggaagaagaggaaaggaggaagacaugaaaaagagggagaagaggaaaagggggaggaaaaagaacacaugaacaaaaauucaaggagcauucucuaugaacucuuggaccaugucaaaccacuacaccuaugugguaguuugaauauacuuggcucagcaaguggcacuaguaagagguggggccuuguuggaggaagugugucauuguggguguggucuuugagaaccuucuccuagcugccuggaagacaguagucuugccuguuuaaauucagaacaagaugcagaccucucagcuccuccugccccaugccugccuggaaggugccaugcucccacauuaaugauaauggacuaaaccucugaaccuguaaacuagaccuaauuaauugguuuuguuuuuguuuuuuuguuuuuuuuuuaauaagaguugccuuggucaugggaaacccuaucuaagaccaccugcaguugaauuuccagaggggggcaggggaagacagaauaaggaagaaacccugaaaaggaagaaggaauuuuuuuuuacagaaacagaaaauugucuugacuuuuucaaguucuguaagauaauaaucaaaucauaauuuuaaagccucaagagaauuaaaaacaagguaacuaacaauaacaaagaguuaaaauacacaugccacucaacauuuggauaaaaucaaauucgaaaagaaaaauugggaacaaaacguacaaggauauauauuuuaaaguguccuguuggaucaaaauaagaucuagacagaaaccugguguucccuaaaaaaaaguauucuaggaauaguaaacuaaagauaaauguaaggauuuuuuuuuaauauuccugcuguuccaaauaacaguuaauuguuuaaaaauaguaacacaaauuaagggcuuguuauccauguaaauguaaaauauauuaucccuggauucaaaaaauauauacuguaaauuucuuucauuuugcauaauguggaauaauauuuauugcuuugaugcagucugugguagguuacuuucauuucuaacaaaacugagguccagugaaaauaccuugaagacauauaacuuauacaugaaugguagagagacuggcaucacaaaaauggaacuaauacaaaagugaacaggaaaaaagguagauguaaaaaauagaaagcaguuaccauagcugugagccacaguugagcuuagagaagaagcuagugaacagcuuuucggccaaggauuucagaaacgacgcucaugauguagacuauaaacuauucgauaacaaucaugucucacugaauauuaaucaguuaugaggcauguuuucgccugguggcuauacuuauaaugguuuugaauuucuauuaagccuaaaguugcugugaaaaauuaucuauugacaacauaugaaauaaaaauuaaagauguguaaagguaauucaucaaaauuauuaacuaaauauuauguucugagugaaaaauuauauuaaggacuuaacucaagaagcaaaauuuaucaaaucagaugauacagauaaaucuacaagucuaccugaauauuucagauuucuugucucuauaaucacagaucaauagaaaugaucaagaauacauacaaugucauaacuguuaguuauaagacauauucacuuaggacagauuuuuuaaaauauguauuauaauaaacuaaaugcagauuaacaaagagcuaucacaaguccauuauggagaaaugcauaauaaaauaagguacaaauuuuugaggacucaauucaaauauauaugguugauaaagaaauaugugagaaaaaaaccugucaacauuuguagucauuaggaaacugcacugucaauuaaaaucagaguaauaugcugccacuguacacuggguagaagagaaagcaaaaacagcccaagcaccgauccuuaucaagggcaaggaugugcagagguugugcauuccuaggcggaaugcaaacugaugacggcaaaacagguaaaagcaucuucauaaaacugaaacaugcaggaccugguaugacgaccuaugacucaggaaugccauuugucugaacugauauuuacuaauguaacaugacaacaaguguguugaaaucccaaaaugaauguccguauccagaguuugcaaaaagggaaacagaccuaagugcccauaaauuauucaaugacuaacaaaucaaaguacucacacaacaucauauuauucauugguaaauacuaacuguuguacaguaaaaaguguuccucaaaaagacgcgugcuauacaguuacauuuauaugccuuuuuuuuuuuaaaucaccaaaacuuagaaacaaaacagaaagcagugauuuuuucagguuuagaaugggaggcuaaagcugaauuuauagcgagaagaggaaaauuuuggaugaugaaauugugcugcaucuugaugcaauugggugguucauggacugucgcaaaccuuugcucuaccauaacaaguaaaccacagauccuucaugcauccagacuaaacaauugccuuagcaagaccuagccuauaacuugccaguuugcaauccuuucuuugaauaaucaaacauuuuaaauugaagguuguguccuggaacugcauucuucuaaccuguuccacuacugaucuaagggaacacacuuggcuguuguguuuugaauuagacugagacuucaagaaaaguguuguguuuuaaaugaagaguuuaugaagaugcguauuaggauaaugugcaggggaaaggucucuggacuuguuccccagaaccgucauacuuaguuucuuaugcaucauuuugaaugauuaauuuucuccuucuacggauagagaaaucauggcuugaacuuuuuacaugcugcucuauccaaccauggucuuaugguugcaugguuaaaagcccauuucauuaguagugaaugccccccauucgagucuuuauugaaggaaagagacccagaggaaaggcagcaggaagaaggaaauacgucuaacucaauguauuuauugugugcuguguaguaaggagcugaguaaauucacaguauauuauuucucuaaauagcauuccuuaagaaauuuuagaacuuacauguauauaugagaauuaaaauaguaaaaauaagugaaguaauuucauauaauuuucuacguaagaaaauaggcaaccaaauguacccauuuguucaagguucaaaaccccuauuauuaacuauuauuaugaaaacuggaggucacuuuauuauugucuccacauucaugucauuucauaauguucaggucacaguugcauccagguucuggcuguuggaggcuguguaacuagagagauaagagcaucccauugagauaauaugcuuuuguuucucuuggcuaccuaaggagggaugaacuguauauauuauuaaagcaauuauagaaaaacuucaggccaaauuuacauguuguucaacucagcaugaagguguuugucucccagaaaaaaauuuauguguugccaaggagaaaaaaaauaaaauaaaaauaagucuacuagagcauguaguuuccagcccgcuacaauguguggugaaauuacguauaauuaauuagauacuauugagagaaaagaaaggaacuuuuaaagcaaacuauucucuuauaaaaaguuuaaaaaaaaaguuuaaacauuguuaccagucauuucuauaguacuuuaaagcuuugcucuaaauauucaguguguuauguuuauuguauuccacugaagagagauaauuauacuaauuuucaguauugaaaacuuuugaguuaaguuucuaaacagaaaauuucuauuaaauaauaauuauuggguucauucauagaaaaaaggcaugugaaggacuaaccucucauuccacugaaguguucauaaguagacuagucauaguuucuuucuuucuuuggaaaauacaacaauauuguacaaagucuauucccuuucagcauaaaguuauuuuuugaggcauacaaaaucuuauugaaaucgaucaagaauauauguaugaauauaucagcaaucuacuuauuuaccucugcuugucauccaaaauauaagcccacauaaacacaguuagagguaaacauauuuauguacauguauagacauacuaugcaauguauaaaaaacuaugcaauguauaaaauacauauaaauaugcuuacauucaaaugugcaaauacauacacaugcuuacauaauuaaauauaggucuucauauuuguaaauguauccagaagaccauacauacacacuuagauacacuuauacacuuaugccuaacuuucugaguuccagaaaaaaaccagucuucuguauauaguaacaacaaaggcuuuaacauaggaaugacaaccacagagauagaaaauguaaaaccacacaguccuaaacaaaagggaucaacuggcuaaugucaguagugguucucaggaauguucauguucauuucugcuccuuagaaaucacucucccuuuugucuucuucauuccuacaucagccacugcaugagaaggcaccaaguagagguaaggauuuuuuuggggggggagggggguugagacaggguuucucugucuguccuggcuguagccaggcuguccuggaacucacuuuguagaccaggcugaccuugaacucagaaauccgccugccucugccucccaagugcugggauuaaaggcacgcgccaccaccacccagcgagguaaguucuuaauagggaaacauuaguaccaccaaaugugggaggaacauguacuacaucacugaucaguaacacagaacaccaucacucugucacaagaugaucaugucaucaggcacuguucaacccugaugcccacuuauucuuugcuguauaggggaagugauauucaacugaaauccaaccugcacagcaaaauggcagcaaaaaguaaccauaaaucaacaugcaaaugggcugugacauacauuuuaugcaaagaauguauugcuuucuaauauaauuuccuugaauuacugccuuauucaacaaacagcuauuaaucugugugugagccuucaguauaaaauaaaugaucgugauuaucaaaugaaucaacugacaugaaucaauuugagaagcaauggaaugaaauguguuuauuagucacuauuacuauggggcaguuuaguucugagauuaggagcugccaccuguaaaucuuuguacccagcauugucuccccagagccccacauucacaaaagguuguugcuuugcuuucauuuguuuauuuauuuuauuuauuuauccuaguaauaaauauuaauuucugcuuucuucacaacucccaagccucgaagguggccaagauauccuucagagggaaauagauuaaaaaaauuauaguauauauggacuauggaaaaaucaagcaguaauaaaagaaaauacacuaacaaaggugaaagagaaucuuaacuggauccggcuaaucuacucuuuaauuaaagcuuauguaccauacaaauccaaccaagugguuuccaaucuggaaauaguaaaauuccgggcacagugaaaagauauuugacuaccugaaguuugaagaaaaagggggauaaucauggggcagugaaacauuuacaaaaauuaaacauuugguuuuuauauuauaauaagauaaaaacaaugaaaccugaguaggacaaacaaacaaacaaacaaacaaaucaucaaacaaacagccaaagaaaaggcacaaggagcauguauagacaaugggacacacauacuagcugacauagaaaucccaaaagacacaaaauugaaaaucaccauagguaaucaaaagaccuuuaggguaugagaaaaaggggggguugggggaggaugcugagauaaggcaccaugagacaaauacauaaauaaauaaaaugauuuuuuaaaaaccuccaaaaauccaaaauaccauugauauguguguguguguguguguguguguguguguguguguguguguguguguguguuggcuauuuacugauaggccuggacuuaaaagugguuguguacccagugagauucuguuguagaaaacuaauauuuuguaugcaugugguuucuuuuacuccuuucuguuuuuuguuuguuuguuccuuguuuuucuggucuuguuucuuuguuucaugcaagucuaucaguuggaaauagccuugggguuagggauaggagcggugcccaccucccucuuggcacugggacucaaucugaugaagaucugugcaggcccucugccugcucccaccaucacuaugaguuccugugcacuuuguuucugcuguauguagaaggcuuucuuucuuugauguucuccauccccucuggcucuucugugucuucuuccugaacuauguagcuuaauguggaaaccuaauuuaaucauuagauaucccucuaaaaaagaauuugcuuuaauuaugaaaaguucuaggaaggaucucauacugcuauaauaauagauuuugaagacugaauauauccugaaauuuguuucgcuaauuaaaucacauccagaguugugcuaauuugauauguugaaguugucaugaaagccauaacauuauugugcugcaugauuaaauaaguucuucgcauaacuggcugucauuauaguuuccuggccaaaguaauuuggagguuucuuuuauuuuccuuuccauuucaucuguaugaucauuaauggagaugucuucaccuaauaauaauucacaauuaaucaugauuauaauuaaaucaagcauagcacauuacaaagaaagauuuguuuucuuuuagacaguuauuauguuuuucauugcuaggcuuguuauuucacuguaaagccagaaacuuagcuucaccaacugcuguggugugucuguucuauaguaucucaaggagacaagagaaaagcauuuucaaauguccccaaauauucuugucuuuaacaggaagugucuuuaaagaaaaccuuauaguuuuagccaaacuugacuucuacccgaaacacaucaagauauuauuagaacacagauucugauucgguaaccuuguaugagacacgcgauuuuuguaugaauuccuguaaacugauguucaggaacuaugcuuuaaguagcaaggaucugauaaacuauaaagcaaaaucaucuaguucagugguccuuaagcaagacuuugagucucuagagaauuuaaccagaggauuuauuauucaacaauucauaagacacucauauguacagaaauaugaguauuuuucuggaauagaaauuuuaauuuuuagauucuuugagaagcuuauggcuaauuguuuuuaaaaauuucuuuauuucauauaugugaguacaccaucucugucuucagacauaccagaauagggcauuggauaccauuacugaugguugugagccaccaugugguuacugggaauugaacuuaugaccucuggaagagaagucagggcucuuaacugcugagccaucucuccagcccccuugugaccuaauuuaugugacugcuauucaguucauuucauuuuagauaagcaaacugaagaccaagggggcugagauaucugucacaguuagucacaauucucagacuugccuucacuguuaagggauccaagccaaaaaaauuuguaguacuauuagacugucauuugauuagaaaguggaucaaauuuaaaaggcaguauauaagugauaauaaacaaaaaauaaaaugggaauaaaaacacacuuaagcaguccagcccuuuaaggauuuaagaccauuuggcauagauugagaaacugauacagggucaugaacggauaaugucaugcauaaauaauguccuccaaacagaaggauagaaaaacccaaaggcugggacuaugaauguagaggcaaaggaguucaaaaacaaaguaaaauuuaaggucuaggaguauauuuccuauuuguuccagaguucaguuccaaagacugagaaaagauaaaaaugaggaugcgaaugaggaggaagaaggcacacaguuuuauagacuaacauauuuguucacaggcacuacaagauuuauccuacuuuuuauuuauaucugauagaaaaaaucauuuaaaaucugagaacuaguacaucauuuuaaauuucuuuuauaugcuuugagccagaacauuuauguuuuggguagagauuauagcuaauaacucaaguuaccuuucucugccugaauaaaaaguauaaaauuuuuauugaauaauacagugaggugaaaauuuuucuuuucuuuauuccaaaagaaugcauauaagcaugauuuuguaaagaaaacaaacuagcauaaauucuuugaaagaaaacuuuauuagcauuuuaguaguauaauugaugggauuagauauauuuucacuaauauauauauaauguauaccuauuaccuuccugcuuucuucucuccuucuguccccauuuuccuauucauugucuuuaaaauuuguuuugauuaugcauaugagcaaaaacauguaaaguuugucuuccugaguacaguuuacucuauuuagcaugaccaugucaaacucaaccauuuguguauguauucuaguacaauuugaaagcaagcauuguggaauuuccagagcuauugaccucuuggucuucaguuccuuuuguaacaguguguaugcucuuaaagaaucccugcagugguggaggagggcguugcuuuaauaguuguuuugucagacuccugaggcauaccuguaaaaacuucaagcugugcuguaauuccaaacacucuuagauguuuccaggcaaggaaccucauuagagauaaaacagagaccugagacauggauucucacagcagcuccugccuagaacagagaaaaaccuuuuaaacaguaccaaccagaggccagcaguccgcaaggaagaucucuaagauguaacuagauagcaaauguaaaaggaaugcaaauuugagaugcaagauuuaaacaugaaaaguuauaguuucccauuuaacuucaaaauauuccaauagaaugaacuaagaggacuaaagguuuucaggaaggaaauguugagagguuguaaggauucauugcagaccauccuggccacauuuaagucguaggaauucaacugaugguggaaucuaaaaugugagugauaucaguaguagcgcugucaugauuaaaggguauuuaggaaauucaaugauuugacauuguuaaaguaagugucuacuugaauggaaguuagggagaagaagcccagugugcuucuaccaacuuccaggguccuauuuaccauucaauccuuaccguguccuaauaauucucaauaccuaucaaugauauuacaaugucuggauaacauuugaacagcuagucuugguuuuaguuacuuucuuguuucuugacuauuucuggcuggucuauggcucauacuugaagcuuuaguacacugaccaaaaaaaaaaaaaaaauguguuuuuuccauguguaugaaaugagccuuuuucucuuccucuuauucuuucucuucuccugcuucucuuuauauucuacaaggagcaguuuuaguucuggauaguuaacucagaacuuuuugucuucuaggaaacucucuaauagucuaggauaggcaauauuuacugucacugugcaauauacuacugccucaccaugauuuguauuguuucaaaauuaugccagcaaagcuggcuuucuaccuacacugaauaaucucuaagacauggacuucauauugaaucccuagaaucacaugguagguguccaugaaauguuugcuuaauugaaguaguuaccauucaguuauaugacucauuaguagaaaaaaaaaaaaaaaagacauacuacgcuaugccuuagggcuuuauuguuguaaagagauaugaccacacaacucuuacaaaagagaacuuuuaauugaugcuggcuuacaguuucagagguuuaguucauugacaucauggcaagaagcaugacagcaugcaggcagacaugaugcuggagaacgaguugaaaauucuguacuuuuacccucaggcaggagaaauagacugugugucacacugggugaagcuguagcaugagaccauaaagccuuuccucagaguggcacacuuccucccaacaaggcccacaucuacuccaaggccaaacuuccuagccaugccagucucuaagggccaagcauuaaaacaggugaguugaugagggaccguucguauucaaaucaccacaugcuguuucugugaauugcagcccuguguacugagagaaacuucacagcuucagcuuucacugucaggcauaucugugcuugcuagcuacuccauaacugcuguugaguagcucaaaaauucccaccugucccagugucacugagcuauccaucacuucgaccuaauuuuauaccacacauuuguccuccuuuucacccauuccauuuaaacuuaccaagauguuugcuacuucgagauguagguaggugguaucucucuuuccaacguucuuuuucacuucucugauucuaaacucaaauauucucucuaguucauaaagacugcucuaaccaccuugucaaaaguagccacauagcuucuccaucguuuccuccugaauuuuuguucuuuuauuuucauaauacuccauuugaaaacuuauccuaauuuucuugcugcuugcuguguaugagagcggcaggaugacaggcaaaagcacuugccucuuaguucaauaucuagaacacaaacauaguggaagaaaaguaaccuauuuuauuuacucuccugaccucuaaauagguacacacacacacacacacacacacacacacacacacacacacacacacaaauguacagacauacucaggcauacacacacacuaaauaaauaaauauaaauuaaauuugaaaaaauacaucaucucuaaaucuuguguaucuguguaaggugaaacaguucaacuacauaguaaaacuaucagcaaauauauguagauuuaagaauuaggauuauuuucuuuauuuuuguguuucuauaaaauaaaaauuuauuuuaauguuaugugagaagaccauaucuuauuuauuaaacucaagaaccucuauuuuuccuuguuguuuuuacugaauuuucuccuuucucuuccuucuuuuuaguauugauuugguuauagucacauacugugugugauaucuuacaucacauugagucuauagaccuacacaaaauucuucagucucacagugcccaggaugcauuaugauucaaagcauaaaacuauuugccuucauuuuucagauguucuucagauuucaaggacaaaguuguuuaaaagaccaauucaauuaagaacuacuacaacaccuaagcagauuauuuuggguguugaaauacacuuugacauacugaacacuaccgagauaagugaaaauaaaugcacuuauuccgccaucaacaguauaguguggugugugaucuaaaacuuguguugccuaucagcaaggauuccauaaguggaaaggcaccagaauacaaaauggcacguucuccgaaaaacaacauauacaauacccacaauaccaaugaugaggucagaaaacacuaacgugauaguaacuaagguuaaauauuauuuguauuuuuugggaaaccaaguagaugguuaaaggaaguaaaccugaacaccgcaguccaaaugaaagcagcgaggcaggagcaaagagcagccucuucagcaaaaucuuucuggcacaugcaaucgugucuggguuugguggcugauuaugggguagaucccuggauggucucauaugaagcuauaccagugucuggcaaauacagaaguggaugcucacagucaucuauaagauggaacacagggccccuaauggaggagcuagagaaagcacccagggagcugaagggaaggggucugcaacccuauagguggaacaacaauaugaacuaaccaauaccccuccccacccccccgggagcucgugucucuagcugcauauguaguagaagauggccuagucggccaucauugagaaaagagaccccuuggucuugccaacuuuauauacccuauuacaggagaaagccagggccaagaagcgggagugggugggugggagcagggagaggggaggguauagcauuauauagcauuauauauauuaaauauuauauauagcauuuucaaaugcuuccaggauagcauuugaaauguauauaaauaaaauaucuaauacuuuuuuuaaagggaaaaaaaaagcacagucguuucaagggaagucaguaacagacagacauguuggagucuuaggucuccaacuacagcaugugggaacugaaguccagcaagugauguauuugaaucuggauuuggguugguacuaacauucacuacaaaaacguuagaaggugaaaggcugucaggucaauguuuuagcagaguuuuugggggguaugcauaaucaccguaacuauuuuauuugcucucuuacuacuacaguaagaggcuggaagcagagcagaacaugcuccugcaaacagcucacucugagaagaaggauaugucuuguuguuguuguuguugaucaucugccucuaacugcaccuguaacugaccgucccucugccucuugcuuauauugagcuaguauguuuucucuuaguguuucaguuuuauguuauaaagcacaacauagugaauauguuuuguguaugaaugcccuuuccuugugaacaggguuugaauaugcacuaagcaaccagcauaaguccuaccacauauuaaauauuuucuuuaaaguauuuuuacacuaagaaaaucagggugaaggguucuguaucacuuaauucuccauuauuaaacacaguaaauuauaugacucauuauacauauauauauauauauauauacauauauauauauacacacacacacauacguauauauauguuuguguauauauauaauguauguaguacuauauacauauaauauauugcauauauacuauuauauuuguauaauauuauauauuaauauaugugauauauuauacagugaauucaaaugcagaauauugaaacccaggcccaguagacacaccuaucuacaaaacauucuggccccuaaaacuuagaaauuacagaaaggagggcagaaagaagacuguaagaguuagaaggucagggguguuguugugaaauuguggcuccuaguaacaucagaagcuacacacccauaaagucucaccaauaugacuguugaaauguuaagucaggguguuuuguuguuguugcuguuuguuuuuguaugugaguuuuuaucccaucuuacagaucccuugaaaaagccuuaugacuuccaauuugagguuuucaugugauuucuguguguaugaauguguuuaucuaucuaucuaucuaucuaucuaucuaucuaucuaucuaucuaucuaucuaucugucuaucuaucuuauagaugauagcuauagcuaccuuaacuguugcaaguguagaauuuccacuuuuauaaaucuaucugaccacuagcacaacagaaaaaaaaauccaauaucuccuuggaugauuuuaaauuaaucuauuuucaagaucucccuuuucacauauguuagcagguaauauguuugcagguuuggggucuccuaaucuagauguccuaugaagaguguucagucaguguaccacagcgguuaagugaaaauauuugucaaagcuauggcacuaagaaucaaaucaauuaaguggcuaccauaguaauucagugcaaauauuuguagaaugggaauggaauuuugauguguguguuacuuaauuuaaaaauucuacucaguaaaggaguaagugguaauugcuuuccugcugauguaaguucguggaaagaugacugugaauucugacagucaugcuaucuuaugguuuuuaugauacuuaauauuucaucugagagaagaugcaugcagucuggaaaacccaagguucagacaagagaauugcauuggaagcuugcauucaaauaaucucucacucaucaagcaucucuagaccuuuacuaugggcaaguuguaaaaggaaagcagggagaaguuauagugugcuauuggagucagggucugguuucucaaguugaguggaagagaacugaaauccuagcuuccuguucccuccuuuuugauaaucugcaguagauuaaucuuucugcacuucacuuuuacugcauacaaaauguaacccucaacguuuuauugugccuuaguucaugugaaauauuugaaagauuuccugauauauaggaagacuuagauaaagacuaacuguaauuguucaaagacaaggagacauuauggcaaaaauaauugagaagaaaaauuuugcguggauucaguuggaaaguaagacauaggaaauuauguaggagucagguuguuuuuguuucauuuuuuguuguuuguuuguuuguuuguuuguuuugguuuuuuuuuuggauauuuuagguauuuacauuucaaauguuauuuccuuuccugguuuccccuccagaacccuaccacauuccaccuaucccaucccuccuccccugcuccuaugagggugcucccuucccauccacccacuccuaucucuccacccuggcauuccccuacacugggucaucaagccuucacagcaccaagagccuccccucccauugaugcuagauaaggccauccucugcuacauauggagcuggagccaugugcauucuuugguuggugguuuagucccugugaacuuuuacgugucuuguugguuaauaccguucuuccuauaggguugcaaaccccuucagcuccuucaguccuucucuaacuccuccauuggggucgccgugcucaguccaaugguuggcugugaacauccaccucuguauuugcuauucucuggcauagucucucaggagacagcuauaauaggcagaaguucuuaaaaaguauuuuucuuguaacgacauauagauuguguauaugugugugugcgugcgcgcgcguguguaugucuguguauguaugugauccucugaaaguccuaguuccaaaacugugauucuagacucaaaaaauuacauaagauaauaacauauauucucaugaaaauuuaaaaaccaauguccaaaaauauuaauauaauauauuauucaaauugaaaaugaugaaauauuuauguauaauuuaaauauauaguucuaagaaaggauuuauauauuaguccaggcauuccaaaaauauuuucuuucuucuccugugauuuacauauggucaccuuguuucaaagaaugugaucagccaagguaaaaucuuauacagggaauugaagagaauggguuauuuuaauucuucccccuuuucaugauacauuggaaauaagcucucucaagacucugaugcugguaccaucaguuuuaauuuuagacugagacacuaguugauucauuuuuacuuuggauauauauguuuuucuuuuuggcuuuuaggauauuuguuaauuucucuaauuuucuuuaacuucuguuguauuuuuguuucuuuuuguuuuuuuuauauuguuucacuucucuaauuuuauuuucagaaaagaaaaagaucagaaauuuugauucaucaaaccaauaguaaaguaugaaaaucuugacauuauugucuuauaggugugaccaguugauugacauauauauaugacuauauauauaugacuauauauauaugacuauauauauuauauauauauauacauauacauauauauauacacacacacacauauacauacacacacacacacacacacacacacacacacacacauauauaugacugagcacggcgaccccaauggaggaguuagagaagaacugaaggagcugaagggguugacaacccuauaggaagaacgauauuaaccaacaagacacguaaagaguucacagugacuaaaccaccaaccaaccgaagagugcacauggcuccauauauauauaacaacaugugaucuucaaaguuaugacagcguaucauugucaaccuggaaucccuaagccaaacuauuauccagcaauauaaaagguaugagaaguaaccuuucauagauccuuggcuaaaaauggcuuaaggacagcaugugcaugugcacaugugugauguguggauaaaugugcauguauguuugugggcauguacaucugugcauaugagugaggaggaccgaggucauuuuccucuaucacuucccacuugauuuaauuauauuuuuugagacaaggucuuucacugagcugagaacucacugcuuagguagacuggcuggcaaguuuguccuuggaacuacccuugucgccaucccuccccgcccagugcuggagcuccagaaguguaauacugugccuaccuuuuaugugagugcuaaaggauuugaacucagguuuucaggcuuaaguagcaaucacuuuacucucugagccauggcuccuuagggauaccuuuuaguaagaaaaaaagguugacaaggagugaauggaauagaacuuccuucccuaagacauguugguaaacugaguaagauaauuugaaauauauauauauauauauauauauauauauauauauauauauacucauauauauucaguaucacucaacaaaagggugugauguucauuucaaaaacugguacucugagaaauaggaacuuguuaaagagacccuucuucaguaggauuugguuccauaggggcacuugaaagacuguaggaaguguguugcaagguguugcucuccuugucacauguaucaccucugcaauguugccaaggauuuuccaguacacuagcguacacugcccaugugaggcaguucugagaagcacagcucacauacccaugaaucuacuucugaacuuaauccaaccuaaaugacguagauauuuuuaaguagugguuuguuuucuaucguuucccaguuacagguuuagcaauguucaggugcugaguuaauggucuagucacgaacaacuguucucuucauuauguagccaagugcuuuugaguuuuuuaacaaggcgagauguuuuuucuucuucucuuaguccaucauuaagugauacucuuaaagaacaaacaccuuguuugaugucacucaugucaaauucuauggaagcauguaccuccugaaugaauuacuuuguugucguuguagcaaaauaccuaacagaagaaacuucagagagagagagagagagagagaaagagagagagagagagagagagagaguuauuuuuaauuuuuuuccauuauaaauucuuugaucuaaagucucauacucacuguagcuaagauugucuggaauggguagucuacccuaaggcgguuucccacuugauuuaauucuccuggagauuccaucacacccagcuaugggaaguguuuauuuuucacuuaaguuucaaggggauaaagcucaucaugguagggaaagcuuggcagcugagacaccgcaucccuggaggucggagcuuggucagcugcuucccuuagcaggcagucaugaacccgagaucucaggcauggcacaggcgaacuugugacuuuuaguugucacucuugugcuccuauaucuuaaauguuccuccacaacuucacaaaacacaacuugcuacugaggauccuguguucaaacacaugccucugaagguacaauuugcccuucgacuaugccuauucugccuuucugaauugaccucaacagaagauaaauacuaucauaaaagauucuguguaucuucugaaagcccccgcgugucuucacaagaagacucugcugcucugucuccuuucaguguuucuguuuuccuucucuuugcuauucucucccuccaacuuuuuauagccuaagguugcucucucucucucugucucucugucucuuucucaggaaaacuuugugggucuagaugggacuaugauggaaaagaaaaaacgaaaagcaagcaagauaucccaauaguccaaaguaucccggcuguuucuucaugcaccucccccauccuugucagcaaaaguagggagauuauguucccaaagaggaacugcagucacaccuaagacacaaagcaguggucacacuggaucugccucccagugagaaagcaaaacacauuucagcucuuugugaauguuuuguuacugcucaaacucugagagggaccaaugaggaauaugaguacuggucauagagaaugcacaugcacguuuggaguuucuucagggaccuuggaaguuuugacacaugaaugguaguuggagagccauagagcauaguggguaagaucaaaguucauugcacaucugaaugaaaauuucaaagcaaaaacugucauuuacuauauaaauaaauguauugaccauucaauaauaaaaguauaaauuccaaggaaauuguuaccuaccuacacuagacaguuuucucaauauauguguucuuuguuucucacaggcucccugaagguccauucucaaauuccauucacaucccaggacauuuucuauaacuguaaauuaaagacaucgacaacgagucacauuauucuucuggacugccaauccguuuuacuucauaguuuuuuugguuuugguuuugguuuuuccucuucuuuaaaaucaugugucagugguagagagguuguaagugaucuucugagcuggaaaagcacaaacaaaaacauuuuggguugggcacaguucuguucuguuaugcuacccccauuugucaguagguaaaaacugcccaguccccagaaggcaguaccuccugugaauaguugcuuuagacaagccuccauuguuccgaaagcuggauuucucacugaguaaaaaccaccgcauuguaaagaugccaguucacuuuuuuuuuuuuaagcuugguuguuuuaaagcuagaaaggaacucucacuguugagacaaucaugaaagaaaaccucuuuucacuaccauagaacaaguggaugaagagaguaagagccaaagugcagacggggaaccuggcucuucuccaaaacaacagaaaagccacaguuagaagaaguaauugaacacuuuggaaaucucuuugaagaccuaaugcaguggaacuuaacuuuuuuuuuuuuuaaaugaguaaaauuuaaaugcaugauuauuccauguaagaaaauauaagugcauguuuuaagugcugagugauuaauuuauaaauguuuaauguagcgagaccaaggcgaagugcccuacugcaaugcacauugagcauuaacaaagcuagcacuuggaagagacaaaucaaaaacccggcaagguuuuaccuguuacuauuuuugugcucauacgcuuugcuuacuuucugaugaucacauuaucucuauugaguaugcuugcuuaguagaauuuugugcaccugaaauagaaauuugggcacaagaaaaguggcacagacauaaauauaaaaauuuuucacugcuuaauuuugagaauaauaacauuaagcgauuguaugcauaacuuaagaaauaauuaauauucuuuugucuaccuggaaaacuauagaaauagauuuaaccauauacagaaaagauguuagcacucaauuaguuuuaaauagucuuguuauaucaaaucuaggcaugagaaucaucauuaaagaauuuuaauguaaaaauaaaugugaauugaagaccaugagggcugaaccauauaguguacaacauucugaguauuuuucaguuuuuguguuuuguguuagauuggauauaagcuguuacauaguuaauaaauacuacuaggaacaucucuugagaauuucaguaguuauuuuauauuauuuuauuuuagccuauuucucuguuuguuuaaucuguggugaccugauuuguaguauccagaggaaguauuaaauuaaccacuuccauauacacuuacccucuaguauuguuuuaauuugucuagggcuuucaaaguguuggggcuugcuagacuccugaauacauacauacacacacacacacagacacacagacacacacacacacacacacacacacacacacacacacacacacacacacacacacauaugggacuauuauuaugggaaagaauguaauaguuaccuaggcaacucuccaucucaucccacugucaucacucugggggaaucacuaacuagugcugcuuaagacucagucuaggacuucauuugguuuagguuuuagagcagugucccaguuuuucauauaauaucuuccuuuaaugggaaacaguuaccuccuuuuauuucaaaauaagacuauaaagcagggaggcggaguuucuucugaguccuauccugucucugaaaacgguucuuaaauuggcaucucuaaaauauuucacaucacagcagcaugguugccaugggcugaucaagguggauguuuugaggauuuugugucuuuuuucccuguucuuguugcaguguuaaaggacugugcucacagccuuaugcaugcuaaguaaggcuguauguaccccuauguuacccacuagcucagggugaaugguucaaacaguguuucuguauuuguuuuguaaucuccucuguaugaucauaugauaacuauaaagguaauacguaaaggauacaaaggagcacaauguaucucuuauguauguagagaaacaauguaaugucuuuaguaguggauaucauuucauaaaagcaguacaugacaaaacuucaucucgucauuaauuaucugcauacaacacaagagccuuaucugaauaaaaacucuuaguguuuauugucaaauuuaacaauacacacucacaucuggagggcuuuccccacagauauaaguguguguguguguguguguguguauguguguguguguguguuugugcacgugcauacgcauauguauuauauaugugagaaugcauguguaauuaaucuuuaauuaaucuuuaccuuaagcuuugauagucucucacugaaccuggagcuuacagauguggauuggcaagccagccaucuuugguugucugccuaucucugcaucuccaaaugcugggcuugaaggccgaugcugcggcugcggcugccuuuuuaugcgugggucccugugauaaaagucagcuccucacccuugcauggugcaagucaagcacuuuacaguguagcguuccuagccacaguaauacgcuccuuaacacaauaaaugaguauucccaaauauaagcaggauucccucccccaaaccauuucaccuuccaacaaacauuuaguaacaacauauaaaauuaauuuaauuuuauuauacaacuuaugacauguagaaacauuaaauagagaauauauuaaguugcuauuguuuauauuauuaguauauuacuauauauugaaaauaauaacuuaaccucuuaucuuucaauuuauaauaaagacuacuuaaagccaucacaccuuuaauauuaaaaaagcuggaaauuuaaugcaauuaaauagugaaacucaauuuuaaaaagucaaugucugacuucaaaccagagaguuuaagaaaguaaauguauuaucauuguauuuugcuuugcuuuuuuugaauaauauaaauaaacauauauuacccugugacuacauguuaaaauguauuucucaccugauggucauuaacacugagaacaauuccaugagcuuucaauaucgcauucuaggaauaggagaggagcauacucucucuguauaaauuuuaaauuugccuccuauucuacauaaauggucucuuuuauaaugguaacaauggaacagguuuuacaguguacauaacucuaggauggaaccacuuuucagaaugaacuuauuauggauugguuuuuaacucuccacaggaauuauuucagcuaugcuuuuucuggaaggaguaaauuuugacaaucauaugguguaacuuuaauuuagaauucauuaauuauucccuagauagucccagcaucccuagcuuuuucuuaucauuauuuauauuguuauucacacuuuuaugggagggagggagggagggaaggagggagggagagagagagagagagagagagagagagagagggagggagggagggagagaggagagagggagagagagaccaugaaaaugcuucuugaaaccuuaaaauuuucuggaauuugcauguuacaaaguuguuguugcuaugaugauuuaauucaugugucucugacgucaccuuuuuaagcuuuugguuccucuucuuucuaacagagucaaguuuucaacauugucauauuacagauauaguaaccuaccccuaucaggagcuaguuguuuaaucacacuuaagcagaaauuccucuuagcauucucuuuuuugaucaaaggcuuucccugagcacaguuuuuuauuagacucuaaggagaaaacugaacacaugcccguauugaguuaaagaaguaaugaaauugaucuugaucauuuuuuguggacucucugaguugaguaacuaaauguuuuaacauuaagauaugccacuguuuugaaagugucaugauaguguuaugauaguacucaagaggccaucaagugaaaucauguguugaaauguuugaguugaaaugaauaauauagccagagagugaucuacuccuuguuucucuggagucagaaauggggagaguucucgagucagaggaaacggaaacaaauaaucagguauaguuuugcaaaaauagaagacuacaucuccuggugauugcacaaugguaaagcaagagaguccucuuuuccagaaugugucuaucauuuagacuguggaguuuagaguuguuucugguauauaagcccagacuguguagaaugaaggaacuugaaagauuauaagcuuguauauguuccgggguaucaaaugugcauaccuaauaaacuggaugcccacugaugcuugaaauuguuugacagcaagaaaacaucauaugguucaugaggacgguuuuaguucacaguuuauagaaagauggguccaaccaauuuacuuuuggaaagauaaguuuugcaagaaucuugcaaaugccguugauucuuuucgcucaagcagauucaccagugucccucaucagcuucauuaagaguaugacauaaaagugguaagcgugcauugaagcuggcaaacaauguacuggaagaacaucuguacaauaaacuccaacauaaauuauuauuauuauuauuauuauuaguuauuagaaaaaucuucaaauaaaauaacaacucaguuguuugacuacaaaauuuugauuacauuguuagguuguaguaugaauaauucauuuagaaauuacaaugaaacaaucacugccaaacuguacauauucacgaugucucagcaguaauggcauugggcuggaaacauuggcuuggcuuuauuaucucggggucacucacuagcgagaagaugcuucuccauguugacugugaugaggaaccuaugaagcaacucaucgauuuugacaauaucuucguauuugaccuguuaucuaauaacugcaccugacugaggcauagucagggugcuguguuucuucaagaauaaucuuuccugagaaccauacccaauaaaacacaacugacaugcgagugccugaugaguagcacaucaaaaaagagauguucaauuagcacugcgaguccuuaacagaaucugauggccacaguugccaacuuuuguuuggcuugcagcacacaaaauaacucauauguauaaagcccaauugcauuucaaaucaccuugauuucuuccucuuuauggcaugguugugagcaagguucuauccaaaccuuuccacauuuucaucuuuaccuuaaugugaauguuccuacuuauguauacacacacacacauacacacacacacacacacacacacacacacacacacacacacuucacuucuuacaguaaauagucuaaagcugaaaaucuaguaaauccuauuguagagaaaacuagcguacugugauagccaaaaccauggaacgauuaugacuguuaaagugcugugauccagaacaguauuucucaaagaacucuccuagaucagcucuaggagaagccccugagcuacaauauugcugacucccuaauuuacacuagauuuggggaaaggauggggaacuguauuuuggcuugcuuuguggcuaaguucuuaccuggauuucaaagaguuggucgauuuuauaguucacuggaagaacaauugccuggaguucaggucugcucucuuggucaguggaagaauacuucccugauauucagagaccuugagaucuuuguacccacaaaugcuuuauuuuuauuucaaacauaaugacuuaaaaaaacaaaaacaaaaaccuuccucauuccuggcuuccagagacccaguccauuuuucacuuacuggaacagcaauuggcugauguccaggucugcucuguaggucaguggaagaguacuugccugguauuuagagauuuggggaucuuuguaccacaaaugcuuuauuuuuguuucaagcauaaugacuuaaaaaaaaaacuugcauguuuaugcagcaggaugacuaguguuauguggcugcuuuuugguuuuguuuuaguuuucuccuauauaaguggccuaaguguauauuauaaaaaauauuauugaacuucauuuccuugucuucuaaaaaaacaacuaaaaugaauuuucauaaauaaucuagguuuaguuacuacaguccacuauucaacuguucaguauaaauguuucauaauguagaauccuugcaaacaguguuugcuuagaagauagucucucuucuuccuuuccuuguuugagugucaaugucuucaacagccacagacacaacagugcccagaaaauauaaacuuguuggugagaagaauagugaugguuacacauucuuggcaacuugcuuaguucuuuaagucucucgccaugugauuaucccaccuaacaaaauggaguguccuguauuuucaugauaaaguuauuguugugccuucuugaauuguauuauauaaaauuuucucauggaauuauauggauggcaaagaaauuuucauggaaaaacuuuuaucauuugcauacuucauauaaauauucacacacaaaaucuccauggaaauguuaugggucuaauauuuuuucuucucuuuauuagauauucaguaaucaaguauauagcgugcuuugauccucuuuagcuaacuauacuacuuucuccaagaccuuucucccuucccccuuucacccauuuuuaauucuuuccauuuuaaaauccaucaauaauacuuuacucugcccuuauacucuuggauguauacaauuccacugaaauacaaucaacuaguggaaaacuacucuggaaaaaaaaaauuggccauccucuuuccagcaccuaugaucuccuuugugcucacaccccauucuguauguugggauuuuauguggcuugaacuuucacaggcucugugcaggcuggaguaacuacugugaguccaaaugaacagcuccugggcgguguccagaaaacacuguuuucuuaacguuaccaagcacugauucauagcccuuauacucuuucugccuuuuuucuacagagauuuuagagcuuugagaggagggcauauaaugauuucuucucugcauuuugaccagugguauauaucaccguuaauugccacaugucagugauaaaagaaguuaaaguagaaaggaaaacaaaagcucuucugaugaggguugagagaggcacuaauuugugggcauggcaauaauuaauucauuagggguagaucugauaauacacucccuuaacagagauguaggcucuccuccagaaucuaugaccugacuacccauaugauaccugauaugagaggcacguaugagaugggucuuaaaucaaaucagaaagguauugguuacuccuaugacaaauaaugccacgauuuuacuaguggacauacguugagagacaaguuauuauuuuauccuuauaaugauuacuuauccaauauaguagcauguaugccacaccagacucuucuuuuuuucauuucauuuacucaaaaaaauuauucacccaaaauuugaaucaucaggaacaauagaaaagcaagaugaaguauaaacaaagagaagcagugguguacagcacagugacaguuaggugacagggauaauuugagguuccauacccacaaugacuuuuuauucacguucuaugagucagauauguagugucuuuagcacuggggucucaccaacaguucuagagcauaaucaagagcauuggcaauaaucugcgauuuuagaagguguauugcuuuauuguccaacaacuccaaaagagcuaacuuauuucucgcacugggauuuguauuuguuagucuaugaggauuagcagaggcauuguugcaauguuauagguaaguuuauuuauauuauauuuguuuauaggcgugaguauuugaagugggaagcuucugaggugcugcauuuccauuuagaaagcuucacaugaauuuucuaaaagguuuuuaguauuaguuauccauccuuauauuuucuuaaaauauuuuuuccagaaaguuuggcauuuuuuuuugucaucgguuucaaaauuuauaggugagucaagaagaagacucagcaauuaugaguugugagauaaaagaauggaauugcuugucacaagauaaugccagcugacugugagauaaaugucaagucaaagucauugcacagccuggcaauuuaucaaaaauaaacauugaaggaaagaaagcauuuaucaagcaccuguuugaaguuuuauuucuccagccuagcuaguuuuugauugagaugcugccacuguaccaaccagguguguguguagcuaaaugaccaggucacugcugcuaauauuacuuaggguuuuauaaccuugacuuuugagugaucacuaagguuagcacaauuaaaaaaaucuuuaaaaaguuagugaugauuuaauuuagguuuuuuuuuucuaaucaauuuuuaugcauucaccaaugaaugaaaaaagagggcaugaauuuuaaagagaucaaggaggucgaaaugguaggguuuggagggaaggaagggaaaagguaagauuauaaucuuaaaaauaaaacauuuacucagaaaagcuaacaugcaauugcauauuuaauagagaaauacuguagagauugauagauucuagaaccaaggaacacuauacuuguauuaguacaagguuauuagucuaauuaacucuagugauugcucuguaaaauuuauaccuggaaaguaucaucuauugaaauaagugugugguacuuuuauuagauacuggcaguccuuuaccuuccaagcugauucuaaaaauuacauuucauauaauuaaaaaauauuuguuuucuuaauauaccguguuuucccauguuucaucuaugaugaaggacucagaauccagugacucucuuccaaccauaguacacaaaccagcuuuuucauauuuagagcuaaaccaguaaacuuauaaagcauguggguauuuuuuuaaacucauauaaacagcagugagugcucauauccugagaugugaacguauuguguaccuuauugccguaccuagguuuuuguagcauaacugaagaaauuauauagcaaaacuuuucuuccgucuuuuccacacaaauugcaaguaacucuagcuugcccagaaccugaaucuuacauuauucuuuugcuuaugagacugacugacagcaauaaaaaaauaugcuuccaaaaauaugauugccuugaagcuuugcauucuuuccuuuauuguuucuucauuuguuuucucauaacaaaaccucaucacggagcugcugaggugagauauuucuguucuuaugauaaaaaacaauggcuauagcuauauauuuguauaaagauaugcagauuuauggauaaaucaccauauauucaugggacuuugaauauguguauguauguauauauauauacauauauaaaauacguguauauauguacauguacauauauguacacacauguacauguaugcauacuuguguacauguaugugcugacauuuaaguaaaaauaaaaguuugauaugauuggaaccauauuuaagcagaauuauaacauuugaaaugcuaggcuaauuuagacuauaaaagucccuguguguuauacugagaaguuugaauuuuaucuggaaugagaauuuacagaaauauuuuuuuaaaacgaaugauacaaauuuuauuuuuaaaaaaaguagugacacaaaucugaccugguuauacuagaaauagcaaagaaauauaaacuauuagaaacauuuuuccuauacuuugaaacuugaaauuucuaggaaaaugaaaagguaauagauaugauaaaauaucagugacuauuugagagaccaacaucuuggugaaacauuuaaggauggaagaggaaagauuggcucaaggaggacucucauuguauuuagccugggaagacauaagggugaauagacguuguggugagauuaaauaguuaguuuaaccucuguauuuuaugagaacauccuuagccaguuuacuuuuuaaaguuucuguucuuauagaaugggcgugacauuuacuauuacuucauggaguagaugcaacauuaaugacuuuguaaagaccuuguaaauauucuuaaaaugaagcuuuaaauuuguuuugugaauaaauuucauaguucuguuauauuauuguuaucauguaacaucauuauuauagugacacuacaaaggagaugguuuauaaagaauauuuaaugaaaaucacuuuuaaauaaauucucacaugcauugcaucccuaccacaggucccuauccacuuugcucagucccuccugccauauauucucuccacuagaucuacuccuucaccauuuucuuccaaaaaccagagcaggccuuaucgacugaacauggcaugaaaauuaaacacaagacugaacucaaacccuuguaccaaggcuaaauuaggcuacccaauaggaagaaaaaggccccaaacagaggcagaaguguaagacacccucucccuaacucccacuguugggagucccaccaaaauaccaugcuacauaacaauaacauuuucagaggaccuagcuuagaccuauacaggcuccauguuugaugcuuuuaucuccacgaacaacuaugaucccuaccuaaaugauuuugugggcuguguccuauguucuugugguguccucaacucuucuggcuucuacaauccaucuuccuccuuuucaggaggauucaucuggcucugccuuguguuugguuguaggugacugcaucugcucucauuaguuggugaccaacugagcuuggcaccaaucugcgaguauagcagaauaucuuuagaaaucauuuuccuuucccuuccuuccuuccuuccuucccucccucccucccucccucccucccuuccucuccuccgccccuuaccaguuugguucuauucugggucauuuggcucuugcaaaggguuuccacugagcuguguuucuacauagccccuguaaagccuucuaauuccagucacgucucaguaaucuccuccucagcuccuccccggcccugauugcugcucauucaaccaaagucagacaugggcucuguggaaugggucucaagcuggaccagucauugguuaguuagcuacugcuacaauuugugucucaucauuaugaaagcacaucuugcagacagagcauauuuuagguugaagguuuugugacucggguggugcuccaguuccacugcugggaguuucacauguuuauagaagauguccaguuuaggcuccauauucccuauuauauggagccuucacuacggucacucugagauuucaaagaguuuccauuguacugcguuucuacauacgcccuguaaagcccuccuguuccagccaccucucacccauuaugguauuuuucuaucccuauucauucgccugaaauuuuucaugaugucuuaauuuuuuaacaucugaguaauacuccauucuguaaauuuucuacauugucuuuauccaucuuuucuugagggguuucuagguuauuuucaguuucuguuacuagaaauaaagcugucaugaacauuaaacgaguauccuuuaguaggaugaagcaucccuuuguuauauacccaagagaugagucuugagggagaucaaguaccaguuuucugaggaacugccauauucauuuccauaguggcuguacuggguugaaauaccacuuguaauggaaguguucuuuuuguuccacauucuuaccaauaggagcuguuuuuuauauuaaccauuccaauggggguaaggcgaaaacucaaaguaguuuugauuaguaguucucuuauggcuaaagauacugaacauuucuuuaaaugauucucagaaauuugcguuuccucucuugagaauuauguuuagaccuauacucuguuuuuuuuuaaauuauuugauuugcucauaucuaauuuuuuggguucuucauauauuuuagauauuagcccuuuguuggauguggaauggggaaaaaucuuuuccuguacuguaaggaugucacuuaauacuaaugacaguguccuuugcccuacauacuugucuuaauaucaugagaucacauuuauugauuguuguuauuagcaccugugcuacugguguucaggaaguuguuucuugugccaauguguucaaggcuauuccuacuuucucuuccauuagguucaguguaucugauuuuauguugaagucuguuauccacuugaacuugaguuuugugcagugugauagacaugaaucuauuugaauuuuucuacaagcugacaucuaguuuuaccagaaccauuugcuaaugaugcuuucuuuuucuuuuuuuucuuuuucuuuuucuuuuucuuuuuucuuuuucucuuuuucuuuuucuuuuucuuuuucuuuucuuuucuuuucuuuucuuuucuuuucuuuucuuuccuuuccuuuuuuuuuuuuugacuucuuuaccaaaaauaagauguucauaaguguguggauuuacaucugggucuucaaaucaguucgguugaucaacugguguguuuucaugccaaaacuaugugguuauaguucuguagugcagcuugaagucugguuuagugauacuucuaaauguucuuuuauuguuuuggguuuguuuuagcuauccugugcuuuaaucuuuccauaugaaauugaguauuguccuuucaagauauauaaagaauuguguuguaauuuuaaugggauuucauugacuuuguugauuguuuuggcgauggccauuuuucuuaugcuaauccuauguauccauaagcaugggaaaguuuuccaucuuccgaugucuucuuuaauuuuuucauacaagucuuucauuuguuuaauuagaguuaccugcaagguauaauauuauuuguggccuuugugaaggauguuguuucccugauuucuuucucagccgcuuugucauuuguuguuuuguuuuguuuuuaauguuguuggcgguuuauuuguuuguuuuuaaauuaaccuuguaucuagccacuucaccaacaguguuuauuaguugcaggaguuccuugauagaauguuugcguugcuaauguuuacugccaugucaucuacagauaugcuuugacaucuuuuaccauuauuaugguuuugaucuccuuuggcuuuauuauuguuccggcuagaacuucguuauuauacugaauaaauguggaaagaguggauugccuugucuugucuuuguuuuuaguagaauuguguugacugucucaccauuuaaucugauguugauuauugguuuucuguaacaugccuuuauuauauuuagcuaugucccuuuuauuccuaaucauccuaagacuucgugggugggugcuggauuuugucaaaggcuuucucaacaucuaaugaggugaucuuuuuucuuuuccguuuaguuuguuuauaugguugauuacauugacugauuuucugauccugagccaucucugcaucacugagauaaagucuacuuggucgugguggauuauauuuugcauguuuucuuggauucaguuugugaguauuuuauugaguauuuuuacaucuguauccaugaagaaaaucggucuguaauucucuuucucuguugaaucuuugagugguuuggguaucagguuuacuuuggucuuauacaaugaauugggcauguucuuucugauuucauucauugaaaaaaaauuaagaguauuggccuuaucucuucuuugagucugguaaaauucugugcuaaaacugucugacucugggcuuuuuugguugggagaauuuuuuggcaguuucuauuucauuagugaauagaggcuuauuuaaauuauuuaucugagcuugauuuuuugcuugccuuuuccuugauuuccuuuuaggguguacuuauuucucccuuaaacaucucuaauaucuucuuaagguuggcuuuaagguuuuucuuuguacuucaguuguauuggaauauuugaggcucgcuguacuagaauagauauggucuggucauauugccuuggcuggcuuugauuguguucuuacacuggaaucuagaaaucugguuuuuggguaaaauaugugaugguuaacaucuaucaguuugucuuuguuagacgagucuuuuuuuccuugguuucuguuucauuucuagucuucuggugagacugaacugugauugaauagaggguuuucucugcuugaguugugaacuagacuucugacuguuggaaaggccucaggucaaggaggggauuuuagcuugaguuaagggcuggauuucuaucagcuugcauaauuucugguccagcagcguguuuccucuggcauucugguggcuguuuuguccucugguggaacugagggaguguugauagucuaaaggcauuagugggaaggcuuaucuggugaugcaggaaaaucauucuguuuuaaauauuucucuaaauauuauguguauaaguguuugccuacuugcaugucugugugccauguauggugcccguggaagccaggagagcauguuagauccuccagucuugcauuuccaggugguugugcaccaccauauguguguucugagcuaaacccagguccuuugcaagaggaacaaguacucugaaccauugaagcaucuguccagcuccaugaaucucucuuuuaguuaauuaaauguuucagaaaaacaaccggauaaaucucacaaaaaagcaagucauucaaaguaaagucuuuaugucugaagauguugguuagcaguuaaaaccaccugcugcucauaaagaagguuucauuucuuuucuuucucaggauacucacagagguguuuuauuuuuuuaauuuuuuaaaaauuagguauuuucuucauuuacauuucaaaugcuaucccaaaagucccccagacccucccccccacuucccuacccacccacucccacuucuuggcccuggcauuuccccaugcugaggcauauaaaguuugcaagaccaaggggccucucuuuccacugauggccaacuaggccaucuucugauacauaugcagcuaaagacacaagcuucgggggguacugguuaguucauauuguuguuccaccuauaagguugcagaccccuuuaacuccuuggguacuuucucuagcuccuccauuggggacucugugauccauccaauagcugacugugagcauccacuucuguguuugcuaggccccugcauagccucauaagagacagcuauaucaggguccuuucagcaaaaucuugcugguguaugcaauggugucaguguuuggaggcugauuaugggauggauccccagguauggcagucucuagaugguccauccuuucgucucagcuccaaacuuugucucuguaacuccuaccauggguguuuuguucccaauucacacagagguuuauaauuaccuuuaacucuucuucccuggauaucagacaccuucuucacccacuucucagggcaucagugguucaccaacauaugcauaaaaauaaaauacauuaauauaguucugggaagauauuuuggcuaauauaacaaauuggaagucagcaaucacauuuuugaaguuaugcaauaauuugaacuuaagggaaauauaagaaaaaaaauaaaaauaaaacagucgucuagaaaggugagcaauaaagcaucagauaaaagucuaugaggucucaacccuacauuaaaaaaacuauaggcaacggaggaaugcuggaaugaagagaguggucaggcccagggauaagcacaccaauugauuuuccagugauaaguggucagcucacaaacuauacguacuaguaacauuacauagacugaauagguuaacuuuacugauauauaugccuuuuugcauaaaaacuaugcaauaacauuuaguguuaaaaggaggccaugaauuugaaggagagucguggguaggaaagggaaggggacaucaguaaguauaaugucaaaaacagaguccaucacaauaucugaaauauucccuauacaaugaaauaacauggaaaucugguuauugacauuaaaauuauaaaacuuggugaaaaaaaagugaugaaaauuguuauuaaagauguucauuguuauucaaaaauaauuguaaugaaugaaguaauaauauaauuugauauuuagaaauaauugauaacauaaaaauccauuuuccccauguucuuauuuaucuuaauuagggaaaguugaaaauaauauuaugguaaugauugaaauuaaaauuacauuucaagggugauagugucaggauugcacuggcagaggcugugauuuuuuuuaauuagguauuuuucucauuuauaucuccaaugcuaucccaaaagucccccauacgcacccccccacuccccuacccacccacucccccuuuuuggcccuggcguuccccuguacugaggcauauaaaguuugcaaguccaaugggccucucuuuccagugauggccgacuaggccaucuuuugauacauaugcagcuagaaacaagagcuccggggcacugguuaguucauauuguuguuccaccuauaggguugcaguucccuuuaguuccuugggugcuuucuguagcuccuccauugggggcccagugauccauccauucaauagcugacugugaacauccacuucuguguuugcuaggccccggcauagucucacaagagacagcuauaucuggguccuuucagcaaaaucuugcuaguguaugcaauggugucagcauuuggaagcugauuaugggauggaucccuggauauggcaaucacuagauaguccauccuuucgucacagcuccaaaucuugucucuguaacuccuuccuuguguucccaauucuaagaaggggcaaaguguccacacuuuggucuucguucuacuugaguuucaugcguuuagcaaauuguaucuuauaucuuggguauccuaaguuucuggguuaauauccacuuaucagugaguacauauuauauugugugaguuccuuugugauuggguaccucacuaaagaugaugcucuccagguccauccauuugccuaggaauuucauaaauucauucuuuuuaauagcugaguaguacuccauuguguaaauguaccacauuuucuuuauccauuccucuguugaggggcaucuggguucuuuccagcuucuggcuauuauaaauaaggcugcuaugaacauaguggagcauguguccuucuuaccgguugggacaucuucugcguauaugcccaggagagguguugcuggauccuccgguaguacuauguccaauuuucugaggaauggccagacugauuuccagagugguuguuguacaagccugcaaucccaccaacaauggaggaguguuccucuuucuccacauccucgccagcaucugcugucaccugaguuuuugaucuuagccauucugacuggugugagguggaaucucaggguuguuuggauuugcauuucccuaaugauuaaggauauugaacauuuuuucaggugcuucucugccauucgguauuucucaggugagaauucuuuguucaguucugagccccauuuuuaaugggguuauuugauuuuauggagucuaccuucuugaguucuuuauauauauuggauauuaguccccuaucugauuugggauagguaaagauccuuucccaaucuguugguggccuuuuugucuuauugacagugucuuuugcuuugcagaagcuuugcaauuuuaugaggucgcauuuauagauucucgaucuuacagcacaagccauugcuguucuauucaggcauuuuuucccaguaccuauaucuucgaggcuuuucccuacuuucuccucuauaaguuucagugucucugguuuuauguggaguuccuuaauccacuuagauuugaccuuaguacaaggagauagaaauggaccaauucgcaaucuucuacaugauaaccgccaguugugccagcaccauuuguugaaaaugcugucuuuuuuccacugcaugguuuuagcucccuugucaaagaucaagugaccauagguguguggguucauuucugggucuucaauggcugugauuuuuuuuaacaauggaauuuuagcuuuccuuuacauugaacugcucuccaaguaagcuugcucuccagacuuuagucauacucuugugacaaaaaauucagauaguuuugucuacuauuuguccacuguagauggaaagaauaucaaaauuaacuggagaauauagucaaaauuguuauuuaaauaaauaagcuauuugaauacaaggaaauaacuuccugaagauuuucugaaauagguaauaucugcucaaguuacacccaaaauuauuauauuuaaaagaauagcaaauauaauggcuaaaaugaauacagauaaaauugcugacuuuuacauuauuuugcauaacuuacuagauuuauagaaugaaagcauaacaucaugaaugaggaaacuggaaaauaucuuuauuuucaauuaauauuguacaauuuuaggaaauuacaaaaaaucuuaaaauuuauguaaauauccaucuugugcuaagauuauuuugagaaagauaagugaacaaaaguaauuauuagaguuuaaaaaauccaaaaauuuaaaaucuaggaaucaauuuuaaauaucgcaacagguacaauuuaugaaugguaaauuaaaaaacuauaaguuucauuaguguagaaacaaaaaaggucaugagugacacacaaguuaacauuguuagcuaguaaaaacaugagaauaugugcauguaaugaugguggauggagagaugcccucgugauaacaagcaugauuuucagcucccacuugcuuauuugcaaguugcuauaacccagcuucaggacauuugguucuuucuuuuaauauccaaacauacaaaggauauauguggugcgcguacuuacaugcaggcaaaacacuaauacauacaaaauaaaauaagucuaaaacaugcaauaagaaauauucuuguaucucuuugauucaaaucugauaugagguaaaccagcuuuaugcuugacacaaauaauuacaugguuaaaaauugcuuauucgggcuggagagauggcucaccgguuaagagcaccgacuguucuuccaaacguucugaguucaaaucccagcaaccacaugguggcucacaaccauucauaaugagaucugaugcccucuucuggggugccuaaaggcagcuacaguguacuuacauauaauaaauaaauaaaucuuuuaaaaaauugcuuauucuuagucucaaugaucaucuuucauuucuuguuguaauaaauuccuaauauagaaaagacauauauuuuaauauguuuauuuguaguaucaaaauauugaaagcaacauaaauaucccaagauugagaaauuuuuaguauaguugucuauauuauacaauuuuaucuauaaaauaguuuuauuucucucauaaaucaagguaacauuuucugcaguuauuauuauugcuuuauaccauauuucaauuaacacauucuaauaugaaauacagaaguguagccaccuaauacaugauuauucugauuaugaugaaauuuuuaaaaacauuuugauaaauuaugauuauauuauauacauaagauguauaucaguuacauaugcagcuagagacauaaguucuggggauacugauuagaucauauuguuguuccaccuauagguuugcagaccgcuucagcucuuggguacuuucucuagcuccuacauuggggucccuguguuccauccuauagaugacugugagcauccacuucuguauuuuccaggcacuggcaaagccucagaggagacagcuauaucaggguucuuucagcaaaaucuugcugguguaugcaauagugucugcguuugauggcugauuaugggauggacccucuggugggucagucucuggaugguccauccuuucaucuaagcuccaaacuuugucucugcaacuccucccauggauauuuuauucccuauucuagggaggaaugaaguauccacguguuggucuuuguucuugauuuucuugaguuuuggaaauuguaucuuggguauucuagauuucugggcuaaaucuaguuggccaucauugggaagagaggccccuuggucuagcaaacuuuauaugccuaguacagggccaggaagugggagugaguggguaggggagcagggcgaggggaggguauaggggaccuuugggauagcauuugaaauguaaaugaagaaaauaucuaauaaaaaugguuaauggcaaggggagaggauugaccaucaacagaccaaccauaccugcagccacauaucuaggaugaggcuagaucugauaaguuugauguuauaguucaagaaaauaucaaauagaaaaaacagaaauaaaaagaaguugaacucaccuugccagauacuucagcaguaguaguuuuucugcuuguuucaaaaauacugaaguugguagcaagccauuuauuuaaagauuaagagaagaauauaaugagaaaaaauucaccaauaagauguaugucaaacaauauuuauuuugugaauuuggaaaucacaaagacugguauaagcuggagguaaacuuuugaaacucuaaagcauucaggagaauuguuaaagaccaucaaauauuuauauguacccuaucuucacuaaaagagcauuuaugauaccuaagguagugaauuaaccuguauccaucaauaaugaauaaugauaauugaauacauauaguauggaauauaaauuguucauuaaaaaaaagauauauaucaguguugccaaguagagguacagaaauuacaaagaggaagcagagacucuuccuaaccuuaguguuuuucagacucuauagcuacuccaucucaaaacacaagaagauaaauacaauaccuugcauacauacacaaacaucauuucuaccugaaugugguagaagauagacgucagaggucuuaucaaagugagauuggaacagcuccauggagaagagauacaaaaagaaacgauuacaccgacaauacacagaaaagucagguaaaggcugaaaagacuuugaguauuucaucaagcguguguguguguguguguguguguguguguguguguguguguguguguguguguguguucacacacacguaauguuugcuagaucaauugccgggaccuagcaaacacagaaguggaugcucacagucagcuauuggaugggucccaauggaggagcuagagaaaguagccaaggagcuaaagggaucugcaacccuauagguggaacaacaauaugaacuaaccaguaccccugagcucuugacucuagcugcauauguaucaaaagauggccuagucggccaucacuggaaagagaggcccauuggauuugcaaacuuuauaugccccaguagaggggaacaccagggccaaaaagugggagugggugaguaggagagugugugugugcgggggaggguaugggggacuuuugggauagcauuggaaauguaaaugaggaaaauuccuaauaaaaaguauauuaaaaaaagaaaaugcaagugugaauaucaagacuaaggucaaacuagagaacugguugaacagugucaacagcuagauauuaacuaguuucuugguacaaaauaacaagcacagcuagaagagcaauggcuagaaaugauaauggagggaagagaauagaaaaguggucuggugaggauuaccagcuaaugagauguccuagaggaugcucccucaaaaaauuucuccucuuaaaguccggccucugucuucaauggagcauuguggagcaaccaguuccugcagcaauuccugucuuccauaaagggggacagagaagagcucuugcacccccaacuuaguuuaugaaagcguggaguuccucaauaguaacaaaacuccacacagcauuucaauaucacaagacaacaauauauacaguuuuuuuuuauuuagauccuucaaacuguggaccugaaaauaauuuauaauaaaaaaguaauuuaaaauaaaaauaguaacgcuuaccuuuauaaaaaucagaaaaccuauugaaaguuuuacagcaauucaucaaggugauuaugagaggccauuucuuucuuuuuuuuuuuuuggaaaccauuguucucucggugacuacuuucaauacuaauguuugauauagaaauauauaucauucuguuuccgcgucugaccaugcauggagucugccaacuguaugugcugauaccaguuuuuguuuuuguuuuguuucuuuguuuuuguuuuuguuuguuuguuuuuucuuugguuugcuagugucaaauaguauuuaaaaucagagugauuucuugaaauugccuaacauaaugaaauuaagagugugcugugaauauaaauuuugucaauauaccuaguucacaauuaccuacaugagagucaaauuuuuaauuuaauuaugauacuuacaaaagcuaaacuuaucccagagauguagcacuuuucuacugugugaaacaaguaggauaacaauuacuuuuaacucuugcuuuauguagauaucuuauaaauguagauauccuuuugaacagugugucuuuaaaucugagcauuggaaacaauccugguuaccaacguagaaagcacauuccuucaggagaaauaaaaauuuuacuuaaucgacaaaucagauacuaagauugcauaaaaaacagucaaugcaucaauuugauaaauuuagacuacagauaguguauaaaccuaccuguguauaaacguacacauauagucaccuauguaucuacucuuuaggaaauccauauucuacaacauccacaucagaaaaacuaaaauuguguguacuuuucagaagccaaaaacuacaaaagucuugcuuucauauugcaaaccccaaaugauauuucuuaaccuaaucuuuuauguuuuuaauuucauauauguguuacuguauuuacaucuuucuacuuccugcuucuaguccuucuaauaucuugcuuacuucccuucaaaauaauuuuaucuuucucucauuagugaguguauguguauauauuaguauauaaauauaaucugcugaucauauuuauauguauauauuuauauauauauauuuaguauauauguuuuaggaauaaccauuuaguauaggauaagcaauuacaaaguucaucuuuggggaaaacuaauucucugacuccagaagucauugucuucaggucuucuucucauggugaucccggguaggauuucccucaacugccuugauauaucggcuauugccauuuucacaucucguuaggcagucauguuauucuguacucuuggauacaccuuuccugguguauguaaauaacacuuuucuggucuuucuaccuucuuuuccauuacaucugcuaagccuuaaauguagaggcauuuuuuuuuuauauguguaccaauuaugaacagaaaucccuugguuaguaguucuuaguauuuugacuaguuguggcucuaugcaagauuaucugucuccagauaaggggcaagagcuacucuuaucuucaaaucuaaacuugaguguuuagaaugcaauuagaaauuauaaugguagggaagaaccggaucagguuccuuucuagauuccuuggccaaacuagucagagguagguaguuggcuauguucucaguaucagacaugaacucaggcuaauuagauagcuauugguuacugccuagaauuaucuaccacuguuguaccucuucagaccucuugcuaggucaguuauuguugugguucauagauaucaaguuuggguaggauuauucauuaauugucuccauugccaugguauaggauggcaccuuucuauaccaugauagcuaguuuucuuagauaaagcuucaggaaagguccagcucaguacccccaaauucuguguucaaaguauauuuuaucuucaacaauaagagcuuacuuucaacuugggagagucuagucggggaaauggcaauagccaguauuguuuuaggguuuugaaauccuccauuuaacaacugaaagaaagauuucucaucccucuuacuggcguuuuaauuagugauauaaccucuggugucauauuuucaauaacacacacaugcacacacacaaaaccucaugaccacuaccaccaucauggucccuuucuacucuccuuauucuugcaguuacuccaggauauauacucacaucuaaugacuuggaauuaguaaccacaauuagacacaauauucuucuuuuuucucuaagucuauauuaacaaacgcauucuaaucuuuuucaguuccaucauuuaccugaaaauuucaugacuacauuuuuuucuuuuuuuuucaguacaauagauuuuuuuauuagauauuuucauuauuuacauuucaaauguuauccccuuuccuaguuuccccuccaaaaauccccuauucccucccuccuuccucuguuccccaacccacccacucccauuccugguucuggcauuccccuauaccggggcauagaaccuucacagaacccagugccucuccucccauugaugacugacuuggccauccucugcuacauauacagcuagagccacaugucccaccauguguuuucauugauuggugguuuagaucugaggagcucuguggguacugguuaguugauauuguuguuccuccuauggggcuucaaacuccuuuagcucuuuggguacuuucucuagcuccuucaauggggaccuugugcuccauccaauggaugauuuugaguauucaugucuguaguugucaggcacuggcagagcuucucaggagacagcuauauuaggcuccugucagcaagcucuuguugacaucuguuuauggaauggaucccaaaguggggcagucucuggaugguaguuccuucaaucucugcucugaacuuugucccuguaacuucuuccauggucauuuugucccaccuucuaggaaggauucugagcacuucguuuuucuauacaacucaacauuauuccuuuuguagauuuaucauauuuucauuauuuguucaccagauccauuuagguugauuccauuucucuauugcuauuguuaacagaguaguaauaaagaugucugagcaagugucugugauguagaccuuuuguuauaugccaaggaguguuguacucaggucgaugggagauucagcuuuuuggaaauucucugcacugacuuguagaguagcuacacacauugcaauccuaacaauaacaguaaaugaggcuuuccucuuccucacaaugugaugucagccauuguguuaucagccauugugagucuguaaagauggaaucucagaguuguuuuaauuugcauuuuccuaauagcuaaggauagugaaugccuuucaagauauuucuuagccacaauuuuauuucuucuuugagaacucuuauugagauucauagcccauuuuagaauuuuacuaucuuuuuuaaucuuuguuuuuuugagucauuauauauucuggauguuaauucccugucuaauuugcagcucaaaagagucuuucuuacucugugggcuuccucuucacuuaauugauuguuucucuagcugugcagaaauguuuuaacuuuauuccccuugucaaguguaggcuuaauuccuggacagauggaguaccuaauucagaaguccuuuucuacaccuuucuuguagaggacugucuauauuuucugcuagaaguuucaauguuuaggcuucacauugaugucuuugauucauuugguucaaaccuuuguucugugugauaaguauaauuuuauuuuuucaugacauguuuagaagaggucuuaaaaauaguccaucagaaaacuuacagaaauaaucaauaauuucaccaaaguaucagaauacaaagucaacuuaggaacaucaacaguuuuucugugcaucaucaaugaauaugaugaggaagcuaucacucuuauugauaauagccucacaacaaugacauaucuuggaauaaacauaucuaaggagguaaagaccucuacauugaaaacuuuuaaaucucugaacaaacugaagaggacucuuaggaguggaaggaccuccuaugcucaugauuauaggaauucauauugucaaaaugaccuuccuacuaagaauuuccaaauucauuucacuuccaaucaaaaucccuauagccuccacagaaacaggacaggacccuuaauuucacauggaacuccaaaagacccuggauuuccaaagcaaugcuggggggaaauguugaagaaauuacuauucccaauguuaagaugcacuggaaagcuuuaguuaccaauauuuucuuuaugaugucaagauuuuaggaaaaucuauuuggguugaauuccacuuugagacuaaggauuacugaaaagaaaaaggaauguuauucagguuuucuguucacauugauguccuagaaauggucaaaaaccuggaaaaggcaggaaacccaaacucuuccaaucaugucuuugauauuuugcaucuguuauaaaaugaugaggcuucuuuccucauaaugaauaauuucuuaacugucuaucaucuaccuaucucucucuauauaucucucuaucauauuuuugauaccauauuucucuguuuagcccuggaacuuucucuguagaucaguauggucucagacucauauauauuugccugcuucugccuucccaaugcugagauuuaagacauaauccauccuuaccaagccugaagucuguuuuuugacaaauaaagguauuggcuuucuuuguugcaaaagcagauuugacuuaugaaaauauucaagugacauuauuuuuauuuuauuaauuuuaacuaauguaaugguuauacuugaaaagaauuaauugaacagauaguaaauacacugugaaauuucuguaauauaaauguguagcuggaacuaauaauaacuuuaagguugguuucaauaacuuagaggucgaagugauagacuuacucaguccagagcaucacuagcugauucuuuguaaucucagcucuacaaagggauuugucagcaggucggggaggaaggccugcagaauucuaauaugcaucccaugagcuaagauacauaagaggauaacaucgcuucucuccuccuucauguguuacaguagguuuaccaaguauuuauagccucaaagagcgugcugcuaaagcaucuuuuuuucuuccucuucaaugcaccacuaaagaacuggcucaccagcugugcugcucacagccucucacccgccuaucuauuuacuauaaguaaugugcaaguggucugagggaggcugggucucagggcacucaauuucucgguggauaacagcccaugaaauucagaaauagaaccacaggaucuccauuuucuuucuuuaagagcuaaaacuaaaaaaaaagacugcuugcauguuuguacguugccaauccaaauuugauuuucuaaaaugaugucaagauuucagggaauauaagaagacuuuuuggauuuggauuccaagugaacaaguuuuaaugagauugugaaggcgucuuuacaaaugacgaggacagcagauccacuugauaguuuuguuggcaacggccaaguaccugagggauuggaaguggcugcugaauugaucuacucuacuuuguggauauuaauuacaguuuugccucauugaaugagacgaauauccaccuauuuuaaggggcuuuaaccauacuuguuaaaauuuaacaacaacaacaacaaauccauuaagcagugcacuauguggggagagaaguaagaaagagaugaauuuucuccuucagaagauggaauuauugagaugaucgcauugaguauugucuucuuuuaugauuuaucuauucacuuauucauacauuauguucauuggcauuuugcuugcaugaagguaucagauuccauggaaccugagcuccacauagcugugagcugcuaugugugugcugggaauugaacucagguccucuagaaaagcagccaauucucuuaaccacugagccaaccucuccagcucucgguauugucuucauaaguacaaaaucaauuacuuaaaugagggcaaaaaaguucacaggaacaucaaaaucuagaguguauucaucacgccacuauuuugugccuuaugauaccuucucuaugaguguuccuaaguuuccacagcugucacaggaaacacuccacaaccauaauuguugaauucacuuuacauaucgaaacaaguuugugugauuuggauuuccuagcuuucaagggacuucaauaagaaaaccugaauuaaucaguguuauucuuuauuuuccaaauuguuuuguuuuguuuuauugaccccauaguuucucucuuagcccuaaguguccagugugcccauuacauuucuaaguacccauuacuucuucugaagggccaucuacagaaagcagccagaucuuuccccaugcuuccacucugucuucaagucacucuguuuuaauuauguuccuccuccagaacuaaauacugcuuacugaacuaccuuuuaguggucggaggccaaacugcuagauccucaaggaugacaaaaagaugcucaacaucuuugaaaauuauauccagguggugguggcacacagcucuaagcucaacacucaauaggcaaaggcauagagaucucaauguuccaggccagccuagaauagaaaaacagguuucuacacagagaaacccugucuccaaaaccaaaaugaaccaaaaccaaagcaaaauccaaaccaauaccccuacccacccccaccccccaaaaaaaaggaaaaaaaagaaaagcucuuaagauaaguaaucgauuuaacacuuuuuauuuuucuuuuauuuucaugcacauauccuuuggucacuuucuuggauuuuuauuauugcaaaagcauaauaaagguaaacauuaauauucaacaaaauacuugccaaacauguaauuaacugacaauguucuacaccuuauccaucucauccaucacugcugugacuagugucuggcuggccauuaaacagguguuauguauucuaccacaccggcuagacagaccuaaguucauugugucuugaacauucuauuuucuuuuaucugucuacuaccccuguuacucucauucugcgcccucuuccacagugagcccaaagcauugagaggacgagaaugcggacauaaacgucucauucagagcugaucacucuguacucacuauuuucuucaucuuguccagaguaagccucacauccauugccagcuagugaaacugaugcuuuucugaugagcuuucagagaugugcugaucuguagguucaacaaguaguuaggagucgguucuccuaagaguagggauucuuccuugaugcccaugaccucuagucauggacuccuagucccaagacaguauaagaaauagacuggauuuuuauuuaguggugaguaguuguugguaacugaugucugccagggggaaugcuccaguguuuaggcacauagcaaaacgauguaagaauuccuaaugggacuuguggacacaguguggaaugagcauggaauggggauggaucugggagaaacuggaaguuaaaaaugugcagaguauggugucuagauuuuccaagaauuaauaaaaauauuuuaaaaaugguccugccacuacauaucuauucgcaaauagauacucaguggaaguacacaagguuggaguugugguuucuucuauaaagaaaaagugaguaacauucuugcuuuuaaaaauaacaaacuaaagcuuaacgucacaaaaauucugaagcuugaaagauguuagcucuucauuuccuuuuaacaggggaaauaaguuugagaugauuuuccacagaauuuugugaaaaagaaaucuuuucacaaagauguucccaacuuuccuggaaagaccaucuggcaugucucgaacgugugaugugcuauuucaagcugcagacauugcucucuggcugagaggaagggauucgggguaaagaacuaaauucccaaacaguuguuucaaauuuuacuuuucaguuuugcuccaacuuauccuuuucaaaaaaauauuuucuaauuuuugaaauuauaauauaauuauaucacuucauccuuuccuuuccuucagagccugucauguacacuuugccugcacucuuuuaaauuaguggccucuuuugcauuuguuguuguuauacacacacaagcaugcacacaagcaucccacacuccuggauauauaaauauaaccuguucaauugguauaauguuauuuguaguauuuuucagaaccggccauuugacauuggauaaccaguugguaugcuauuuuggggaagaccauuucuccuguucuguaugcuuuugguuuccauaguuccuuguauagaucugaggcccuauaacauuccccucuuccauguuagcaugucuacuuguauuguacuuguucagaacauguuuuggcagcuaggcuaaauuucuugguaugguuucucacauuuuuaggacacaaagucuuacagcaaacuuucuuuuccuuuggcucauaaauuuucuagcugcuguucaaaaaugauuccugagccuuggaucgcagacuuguguugcagauuuaucaggagugggcuccaccauucuucuacaugcuuacaaguucaaaacaaaauuugucaaagcuguaaggugaugacuuaccuuacagcugaguaaauuuuucagaacacaaaguuaauuuuauuguauaucuguuuguguccaguuguucuuauauguagcuaccaauuagagacacaugcauacaugauuuauugaaacuauccugaaauguauagaaggaaaccaucaaacuuauaauuguaugcucaguggacaugguuugaacaguauagcucaaaaauuauguugaacucucacauagauaccaauaguucuauccagucugaaaaguuccuuugaaagacauccauuauauccuucuauuaugcauugacauuuucuccgaugcuuaauauuuaucucuauauagauauuuauccuugcaaaauaucuguuuaguguuugugccaaauuuuuaguauauauauauauguguguguguguguguguauauauauauauauauauauauauauauauauauauauauauggauacuguuauugauaaaauauuacgcugcucaguuuucuguuuuucuauaugcuuucuacgcaaguaguuaauauaugaaucauuuuccucaauucguuguugaagaggacaguuagacucuacagagcacacuugcucaguguuuuauuuaaauguaaugugcacaguauaauaaauguaguacugacaauaugaaaagccccaaugauauuccauacugaaaggaccauaauuuggaaagcgcaaaggaugucugguccucauaagaagcuggcucacagucaucuauaggauggaacacagggcccuccauuggaggagcuagagaaaguaccaaaggagccgacggggucugcaacccuauagguggaacaacaguaugaauuaaucccagaauuaaccccagagcucgugucucuagcugcauauuuaucagaagauggccuggucggccaucauugggaagagaggccccuugguauugcggacuuuauaugucccaguauaggggaacgccagggccaagaaguaggagugaguggguaggggagcagggcgggggaggguauaggggacuuuugggauagcauuugaaauguacaugaagaaaauaucuaauaaaaaaaacaacuagauaaaaaauaaaaaugauacaguuuuagggaaaaaagaagaacaagaagaggaagcugccuaccuuuucuguggccucuuauaaagacaucacuuacauugguggaggcccucguuuuugcccaaagucuauguuuuauaauaguauuaucuuggaaguuaggauuucaacauuggcuaugaagaaacaaacuuaaaagccaugcccaucaaaacacaaguuuaaaagaagcuuuggaagaaauaaauaagcucgaguugccaaacaccagucaauaaagugaauucaccaaggaaccaucuaauacauuguaaauucuacugcagcuaauuggccaaaguuucaauagcaccuaaagugauuuagaaauaagaacuuucuaacauuacauucauuaauucauuguuucggauucccuucuagcagacaugaguguguucauuuaccauuuaauugaccuccuagaggugagugcugauuuuacauccaguuucacaaacuacacugugaugugcacauggauggauuggcuugaguagguuucuuagagcaacacagaggugugauuuguagagcaagcauguaauguuuuacucaaauugaacuuaccugagaaugguagggccuuaauaauuuucauccuauaacaacgccaaccuggauauauaaaaauauauauuugcugcacacauacauguggcaacuuaaagcugucauaguguuaaaaaaauccuuuuccccauuuccccaaugacacuuuucgucuuuaaaugacucguuuugcaucauaaugaugcaagaccaacauucuuugaacuucuauguaugucuacuuauuaguuagccauacauuucuacuuuugauuugugauauggaauuuuaguucauuccccuuugguaaacauagguuggucuucaaguauauuuuaagaaaacucccucucauuuucaguuauucauuaacuuauuuugugacuuaaaaaaaaccuauaauuuugaugcagcaaauuaacuaguuuuucaucuuuuaaguagaaauguacacaacuugauaaagaauuguuucccgaucuuaagauaccaaaacaaauucuuucauguguuuugccuucauaucauguagaauauaauccgcuugaauuuuaaugucauugcuaguaguaaauacaaacucaacauuaucaguuuuuccauauuaaaagcccaguuugaggagaaagucuugacacuugccuaccaaauauuuuggcauuccuuugguuaauuuccuccugcuuucccucucuuucaguccuuacaggacaaaaaccagcuacaauaaggucuuaggaggcauaugaugauaugaggacccaccuucagagaaacuaggucuugcaguuuaggaaugugccaccuagagguguuugguuuacauaugugccuccugaauaauugucagagaaacaagcauuugagcacacagugauaaaaaaggaaggauaggagagaaggagggaggggagaaggagagagagagagagagagagagagagagagagagagagagagagagagagggagagagagagagagagagagagagagacuauuagcugauuaccaaaagucuuuguucccaguauuauuucauggcuuagagcauauuuuugaaccuccuugcaaucauucuuccaaugauacugugccacuucacauauaguaucaaaaauuaggauuuugauccccuuuaaaccuucaaaguuuuuuuuuuuuuugacaaacaaaccacucuagaguuuaauaguguccaauuaucuacaaaaaaaaaaaaaaaaaaaaaaaaacaaaauagaacaacauauuagacaaguagccccuguuggggauugguuuuaaugcuuugauuuaauuagaaaucugaauuucaaaaugcugaagguccuuggcccuaauugguuuuugauugaucaauaaagaugucagcagccaaaggcugggcaaaaagaaaaggggugugggaccuuuacauuugugugggcuaggaacugggagaaagagagagaauugccaugacucaggagagaaagaugagaugcaggagcugaaggagagaaagccauccagucuacagacaaccuucaaacuauugucauacguuuuacuucuaaauauguuaucacucaauaauauauuuuuuaaauuuuuagucaaauaguuuauuucuuggcagguguucuuuuuuuuuuuuuuucuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucauugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccaugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaaugucgcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucugcuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuugacuguugugucgauguucucuauggaaucuucuacaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugaugucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagcccggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucgaguuccgcgcgauuggauuggggcaggcacugugauccacucaccagaggucuuagggucccguggggaguccuguguggacccuugcggguguugggcaagacucugcuggcaagguagcccggggcucgagucacgagucgaguggaagggacuugugccccagaucaggcccggguagccugcuucccuauguaccgcagucucaaguuccacgagauuggauuggggcaggcacugugauccacucaccagaggucuuagggucccguggggagucccguguggacccuugcggguguugggcaagacucugcuggcaagguagcccggggcucgagucacgagucgaguggaagggacuugugccccagaucaggcccggguagccugcuucccuauguaccgcagucucaaguuccgugcgauuggauuggggcaggcacugugguccacucaccagaggucuuagggucccguggggagucccgugugggcucuugcggguguugggcaagacucugcuggcaagguagcccggggcucgagucucgagucgagcggaagggacuugugccccagaucaggcccggguagccugcuucccuauguaccgcagucucgaguuccgcgcgauuggauuggggcaggcacugugauccacucaccagaggucuuagggucccguggggaguccuguguggacccuugcggguguugggcaagacucugcuggcaagguagcccggggcucgagucacgagucgagcggaagggacuugugccccagaucuuggcagguguucuaaugaacagaugaaguguacaucaucagcucuucuuacuguuccuguuguucauuauugaucuaguuauauauuuccucccaggaccccuuucuacugcagcucucucuuuaauguaucuuccacugccauuucugugucugagaaagucuuccuguggucccuacugggcaagaugcuuucacuaggaaaaggauuuggguuucagcacauuaagucaccccacuguuagcugcuuccuugcuucuaguuagucgagugccuuuauuucuuuuuuuaaaauaacuguacucugcacauacuacauuuugaauuccuugauucuguacauuuauaaucaucaccauacuuaauaaguuuucaucauugccuauuaaaauguuacccuagcccucauaucuccugcuucuuuacaaacuucuacuacacaugugucagauggcuugaaguuuuuccaaagcuauauaaugauuaguuuauuguuugcauuucuguuucagaccagaucauugcuauugucuuauauucagucacauauauugucuuuggcagugucugggacauggauaaccucacguauuuuagaaagggugauaaucuuaucucuagaacucaauuagagcacuaaaaacuuccuacauguuucaaucccucuuuuacccauucuuuugaacacuuacaugacuauuuuguauuagauaguauuuuuuguaauuuuuuucauuuguuggaugcagauauuuauaugucuguauaaaugguguaguuugguucaguucuagagucaauuacagucugggaccuuuccuuuugacaggcuuuauucaaaugcuaccaacaccuccuaugauauuuugcauaucguuucaacauuugauaaacugugagauuuuuucccauguugccugacuauagugcuauccguuaauggguacauugaucucuggagaugcauuucugcuguuuuuacaugguucuuugcucugccaucaauacuaucuugucuaucaauuaauacuuaccagauuguaguauggucuuauugcauguacugagaaauauucuguggauauuuuuucaucuaaaugauuuuuuucaagaguuccauucagcauccuuugaguccuuguguaugauacacaugcuuacugaguuuuauuuauucuucgcuuugcagaauaagcauuauaaaauguaaugugauucuguuucccugcacaguagcuaguaguacaaauucuuugauuccauuuauuuauauuuggguucuagguucauuaaaacagaaaacaaacaucagggacucugccuucuuauaugugaggucuagacccagcuacacuuuucccacccuagaguucacaaauauuaaaauauuaauuuugggacaaaggagcuuuuacguuucuuuaauguuaccuaaugaccgagaaguaauuaaaacacgauucuguauauugcaaaagcaauagucugugaacuucagccgaacagaugaacauuugaggaaagcuaguugagucuuccuguucuaaucuacuguucgcuuagaguaguagugcugugcucugaagaacuacaaggucgguauguuuuggaaaugguugugccauguucucauugaguucuaagaaagccuuuguaaaagaagccuucccauugcuuaauucagcauuuccugaaugacauuuaagcagacuuuuuauuuuuuuaaauguaacauauucuuggaagcuauuccaggcaagaaggagcuauaaaugugccuucucuuuucuuauuuuaaucucuuacuuuucuuccuuccuuuuuccguuuucauuuuaucaguuuuucuuuuuuuuuuuuuaaagaaugauuuuuuuuaauuagguauuuucuuauuuuacauuucaaaugcuaucccaaaaguccuccauacccucccuacccacuccccuacccacucacucccacuucuuggcccggguguugcccuguacuggggcauguaaaguuugcaagaccaaggggccucucuuuccaaugauggccgacuaggccaucuucugcuacauaugcagcuagagacaugagcccuggggguacuuguuaguucauauuguuguuccaccaauaggguagcagaccccuuuagcuccuuggguacuuucucuagcuccuccguuggggacacugugauccauccaauagcugacucugagcaucuacaucaagguuugccagucaccggcauagccucacaauagacagcuauaucaggguccuuucagcaaaaucuugcuggcguaugccaguuuuccuuuuaauaaagacuugcauuucaggaagacauuucuaauggggccauauuuucauuguuuucgaaaucuuccugggcuagcuuuuugcuagaacacacaaguacuuuuuaugauauauagugaauucauauuuauguaccaauugaaauaucauaucaccaguggaacauucugccuccagucaacccccuaccaguauaaauucacaugcuuauauauaaauacaugaaaaauaauguaauacaauaauaucauugauaccugucauuaaugagcacuaacuacccaucuuaaagcaucacaaauccaggaugguuuugcuuuuacuagucuuacagagaacuaaaguucaauuccuagaaucuauuaggugacucacuaccauuugcaacuccaacuucaggaggucugauauccucuuuugaaauauguaggcauuaugugcaucacauauauauuauuucaaaaauaauaaauacuuaaaaaucaguaauauuuaauauguaccaaagucauuaugauuauaacucuugauuugcuccaaaguucauaauauuccuuugaaccucuaaagaaaaauccuucaguugucuacacaugcugauugaauccuuuucucaauauuucucuuggauucuaaucagacuuacugcaccauucaccauaguuuguuguuguuguuguuguuguuguuguuguuguuguugucuaagagccauuuauaaacuggugaugccaagaaaagcaaaggaccaggccccaguuuccuugaacuuuaagcagcauuugggggagucaauccuccuuuagacaucuuguauucuaagacaguauauuuuuaucauuuuuuugucuuuuguuuuuuggcaugucacuagaacccacuuuuucuaauuuauucaauaucugaaucucuguagcuuguaaagugcaacccuuccugauuuuacuuauuuauuuauucauucauuuauuuauuuugguuaucgcacugauaauucauacugauaauguauuuaguauacugacccuugagguaacaagcaguuggggguggggcauagcuaucaaccucuccuuauuucuaucucagcuucuuuauugggggaaaauaaacacccagcaaccugggaauuagagcaguaucuacgauaaaacauucagaauguuaaaugaauuaauaucuacaaaaggccaaagguaaggucuggcauuguaugugagcugggauuuaaucuauaccccggugacuuauaaaaaucuacuaacccagauuuucacaaugaaacuguggaucaaauauccaacuaccuauauuuggacucuauguuccacuucaguuucaacgugcacgucaaacuuuuaugcauaacauguaaaacuuuaucaauccaguuaacugacucaaugccaacaacauccaaaugcaaaggcuaagagaauuggaagcauauuugucuuuucuuuuaaggccaaccaaguaacaaccgaauauaaaguuguuuugccuucacauuauuuuaguuuaccucaaccauguuacgucacgaucucaaccaucaaaauacuucaacuuacguguugccuaagcuugauguucacgucugaaacauuuuuuuuauaaaagaaaaguuuaauuaaauauuuccucugcuuaaaaaguuccugugacuuccuuucuccaaaauuccgagcugaaaccauuacucucucuaacaagacuguaacuuagcacuacuaaggggagugugaaguagcagagcaacucuguaaagcagugugaaaguucuuaaagacagacaacacccaaggugcuagauaagccagauauaccaggccugaguuauauuacauacauaaaguaugaaaaacauagucauaaauauagaaugacaaguacuuuguacuuuuacucauaaaauauuaaagaaaacaaauaaauaauuauauauauaauauauauacacacacacacauauauauauguauauaugauauaaguguuuugugugagugugugugucuguguguguguguguuuguauuugagaguagugauuuacagcuuuaacuccagcacuugggaggcaggggcacacagaucucugugaguucguguccugauugcuaagagagccagagaagagugagcagacagagaagagagaagggcaauuaagagugcagucacgagucuguauuuaaagcacuauaucuacaugaaggaaaaggucacacuguaaacauuaauccaugcaacugauauacauuaguuaaaacagacaaacaaaaaaaauuaaaaugaaaaaucauauaagagaaucacuuccaaauaaagauacaacauauuccagagcagcccagauguucuaaguacauucugagaugaaagaacucucccugaaaaugaaagaccuugaaaggcacccaguugaaucccuguucccaguauggaugaaacacauugcuagcuuaagaaaaugaagauaagauuugaagguggauaacucgggagaauaaauaacuuuaggugccucuuacuagacucuaggucuuauuuucucaaaguauuuuuaaaucacagcuucaaagcucacacauucucaucacauucucaucacauucucugcuaggcaguguuucagagaaaacacauugaugcuuuugccacacucacuacauacauuguucuugccauaguucaaaauuccaguaauauuuuaggagacauuuucccucgugauacacaauagucuaucauuuggcuaaaacuauagauuguuuuuuguuuguuuguuuguuuguuuguuuguuuuuaagcaaaagaauauaaacugaauuuucccauuucuccauuccuuagcaaauuucagguuuaacucuguauucuugcuuuccaaauucauugucaguuuuaacaaauugcucuagucuuucagagucuuugaaaauuguacuaaagccaucgcuagauuucucagcaugccuugucuaugauugaauuguuggcuuuuaauuuauaauuauaggcagauucauuaguaagguaucugugacuuuaaagucuggccugagucacuaaccacuucccuuugguaaaccaaaguaucccacaucauuauuaacuacacuaccgagcuuucaaauccaugugcauuuacguguuccacagcuauaucuuacaaguuauuuuaucuuacuaaaauccaguugauucagguaaaacacagauucauguguagaauauuuucccugagauugaguugcaugcuuccccacuguagcccauagaccucucuacaaacuccugccauggacuuuaguaaaauguaccaugauauccauuugcaaccgccucacaugucuuuuaugaaugaguuuugccuucaguuuucucuauuaucagaaggugcacguagaaguuacuccaucaaugcuuauuaaauuaacaaguaaccaagauucucaucguuucaucuuaaauauagaguucuacauaaaguuuacagcuuucucugaaauuauuguaggaagcaaauugcuaaaaugacucacaacagucugggggaagagagaagccagcgccucacuuaaaaugcuauuuuugcuucaugaacauaugggcccuguccguuuuguaaccgaaagaaaauuccauucuuccaaacaaaacugcauguuauugugaucucuccucuguugcuacuuuuacaaaacaccuuugcauuucuuuaugaaaugucaggaacaguaucucauuagcacccaugagacagagaacuaagacuugaaguaccuuggaguaccucacugaaaaucaaaugaaaaugucaaagugcaguaaaaucaugcuuuuuuggaguauaacuugaggucauuuaugucugcguuuucagggccagaaacuuuuuuaaaagccaaauuccuacaaggaaaggcucaucaauaaauagucagugucccugcacuuagauugaguaauuaguuucaauggcagacuaaaaaaauucaauggaaugagaacacagugaccuugaauuuuauauagcaucuuuccuaauugaacuguaagcuagcccuugagauuguuauucagucuacuacaaaaaggacaauggaauaucaauaaaucuccucugauuugugaauuaguuuucaaaacgcuaauguugagucaaaauggcucgaauuuauuuccaauacaauagcaaaggaaaaaauuacuuguucuuacucaaccacuuguauuuacaggcaauacauucacaaggaaauuugcaagggccguuuauaaaaguaauggucacauugggaguugaacguguuucuaauuuuuguuuuaaucaugcaauguccuaagaauuaauuuaaauuaugaaaaugauuacuucauuuaaaucuccuuuaaucuuaaaaaccuacuugagccaaugguaaagcauaauauugagacuguagagugcaagcuuaauuauaagaaaucuuuggacaugauaugcaauuaacuauggaagaaccgagguuuggggaagaaauuuaauaagcaauuaagaguuaaaaaucuacacuagaggguuaguauguagaauuaaacaagccuuaaaggaaguacucagcaagggcaaaaaugcaaacaaaagcucuaaaaagguaauuugaggauauaauuugaaaugguggacagacuuguguaauugauuuguguuuggggcauacaaagacaagaagaaaaggacauauguaguugaaguuugaagaccauccaugucuuuccaaauuuaacugcugagacuuuagcucuaguagugaggaauuaugagacugucugaguuuuguaaauaggaacaggaugugggaaauaucugucacaagagagaagauguaaaacacuuaaacaacccaguggaaauagcagugcaaacgggacagaagggaauccagagacguauuacaugauuuccagucagaauugagauuuucucuuuacaggaaagugaagcuggauguggcaagcauagcgugacaggaucauacacuuuccccucugccaacuccucccuuccuuucucccaaaaaacuuaagggucuucagguucucucugucucucugugucugacucuuucuaucucucucucccccgucucuccuccucucucuccccuccagccucugucucucucuguaucugggucucucucuucucucuucucucuucucucuucucucuucucucuucucucuucucucuucucucuucucucuucucucuucucucuucucucuucucucuucucucuucucucucucucucucucucucucucucucucucucucucucucucucucucuucuccccaccucucugucccccucugucucuccuucccucucucucucaaaaaagaaagaaaagaaaacuaauaaacagcaauagaaauaaaggaaaagucaaagguccaaauaaacacaaccccugagaacauacacaugaauaaccagauauaggccaaucaacuuacauuuagaaauguauauguguauccauauaaucauguaauaacauuuaauggaaaaagaagacagagauuugaaagaguaaagaggggcacgugggaggauuuggaaggagaagugacaaagaagaaaugauacaguuuuauuaggauaucaaaucauuuuuaaauucaaaagcaaacacaacaaaauaaaacuugaaguccauuuugugugaaccaucuacuccuagcuauagggcuuuccuuggcgugugauugacaaacuaagugucacuucauuggaacaaccugaucuuuuuuucucaguagucaauuguaaauagcuucuugguuaggggugggacauuuuguguguuuuuggucucaguaagugauguugguuagaaccuguuugggucuuuugggugucaucacaguuucuguuagcuuauuugcauaucaauccguugugucugaaaagacacuguucccuuuguaucauccacuaacucuugcuccuacaaacuuucuucaccucuucaguguacaucuuuuaucuuagaacacauggauuugauaaaauauaucagucacaaaagguagacuuacaauagaaaugaaaaucuacauagauuuuaaccucauuuuacucuguaguucaggcuagccucaagcaaaaaagaucucccugccucuaccucccgaauccugggauuaaaggcaugcuacacuaccacucucaacuuaacuugaacauccuuagucuugaaaaaaaaugauaaauauuugugugcacaugcucacaagcacacacaaaucuucaagaauaaauucuaaugaaaaucuuaagaaaacaaauaugaaccuuccuuguauguucauucucgugauggcuauuuuucucauuggagagaaaagaaacauuuccucuuucauacucucccucauuacccaauuaacaucacaagaacccagauuuuuuagcccacaaugaacccaaaauguuuaaguaugaagauacauguaacuaauaagcagagcuguuggcccauuuguuuccaugcauggauguuuguaucuauuguauuaagacauauauacuuuuacaagguaguugguagauguuucuauaaaaugucaugaaauuucccugauuuauguuucuuuacauauauugaaaugccagguaucuauauggaauuaacuagaaguuccguuacagggaucaguuuuuaauuugccugcaugcgcaaaggaugccauuauccacuggaauggcaaaucaguacucaucaaaaacuuugcaugugaacaaauuaaauuugucuuaauuaaaaacauagcuuuauauuagucaaucauuaaccagaacaagaacucugggcccuuuauuucuuauugaaaaaauuaacacaugauuauuuuuuccuuuuauuagaaucuucugucaugagauguuuuguaaagugagaauuugauguuuggguacuuuccuucaaaaugugcaauuuaaaaggcuggaagauggcugaguaagaggaagauuguucuagaggauacaagucuggcuccuaacaccaagaucgugagguucacaacugcuaccaucuccaguuucauaggaucuucuaccuucugcauguaccugcacacauacacacacacacacacacacacagagacacacagacacacacacacucacacacacacagagagagagacacacacacacagacacacacacacucacacacacagagagacacacagacacacacacacuuacacacucacacacacacacacacacacacgcaugugcgcacacauacacacacaugcauauacacucaaauuaaaagaaguuauauuuaaauuuucuuucucaaaguuuuccuagaggauuuauagauaugcugaugcuauaaucaucuguaauuuagagacauuuuaagauuucaguugucauaauuacauaugacucauugaauuugaguuccaagucaauucaucuuaagauauagauagauacucuugguuccaugacccagaaaaaaaauagcaaagcgaauaguuaaguugacauucuccauccagauauacuaaacugugugucuaugcauaacauaugcaauaacauauauguaauaacauaugcaaugaacauccauacugagacacguuuugagacaacugccagaugacuuugauggugaagacaaugauaaaggccaagagaauauaaggcaacacccaggguuucucuuguuaccauuuaaaaaguaacuggaagagaugcguaggcuacuggugcccagccaggcaaccuaugcugucagucagcuugaaaggugaaagaggaguagcuugagaauuauuacagguaauaacauacauaaugaguucauguugagucaaaagacuuuaccuaugucaaugucuauauccuaucuaucuaucuaucuaucuaucuaucuaucuaucuaucuaucuaucaucuaucuauaucuaucuaucuuucuaacaucuauuuucuuuaucuacgugaggguagguguagaggucuuucuuaaauauauccuuuuucccuauucaccagauucuauguuuuagguaaacaaaauucuuaucuugcuuuuuucauaugcaagaagccaacauuaccgcauuccauuauuuuacaaaugacuuccuuacucaaauccuuauuaaauccaugagagacccauuaauuuucagguuugccauaauaaauuaguacagaacuuaguggauuaaaaggaccuuauuuucucacaauuuaaauggaagauuuaccacggcucagcuauuacagcaccccauaggagcagucuccuuugccuuuccuuggcuucugaaggcugucaccaacccuugagauguaguauaucaccuaucuccuuucuaucuuuauguauucucuuuccaugucuccaaaucucugucauuacaagaacaguuacuaggggacugaggggacauaacaauccauugugaccuucucauaaucuuagcuucacuaaggucauucugcuuuuauauuauuuugcugugauggggauagcgccaggcccuggucaugcuagguaagcauuaucccauugggcugcaucaccugcuuuauugaugcagccuuggcaaaggaaacuuguauagauucaagguauagagccugauguuuuguaacauaauuaccauaaucaagcuaauuaacauugccaucuuaaguggacuacaucagcaaaaccuguauucccaagaaaacuuaagguucguuaguggagucuggaaugaagauuucaaccugacauuuguaugagacauaacuuaacucacauuaggacacuaauuguguguugauauuuagcaggaaaaucaguuacuauaauuuuuauuuacauuucauucaaaaaaacucuaguguucauuagguaucuaaggaucuuugugugacauaacacauaaucaguguacugcagggaccaagguagucuuauauauuacuauuuuagucuguuuauuuuuaaguuauaaacaaguauguguauuugcacaguacaauuugaaguuuucaucuauggacaaauugaagaaacaagcuauucacgaaacuacccccuuaccccuauuauuuuugugauaagaauugaaaguaugauaaaguugaaguacguagcacauuagagaagcuauacucaauauucauaucccacauuguauaugcugugauauauaacuuuccuuccucaccuccuaucucugauaauaacuguccauuucuaugauaauuuguuuuuaaauuuacaaauagaaggcaucauauaguauaugucucugcuuagcuuuuuacacucaauauuauaccuuuggguuauacauauggacauguauauaugcauauauaagcaaauaucacauuauuuuuaaaucauguguuugccccuuuucacucuauuguauucuuuuugauugucuagaauaaauuccuuuccuuugaucuuugaacaaagcaccugcuuuggaagaugccugugcuugaagugugcuuuaagucccagaguagggaagcucacugucuuagaauucuauugcuaugaugaagacuacaaccaaaagcaaucuggggaagaaagggucuauuucaucuaacacuucuagguaacagaccaucccugaaggaagauaggcaggagccugagggagggaauugaagcaguucccauagaagagugauggcuuauuugcugguugcucucagcauucuuaccuuccaagcucccacaguauguuccaccgaucucugagcacucaacagcuuuuaaauccuuaaaugccaguuucaaaacaccuuuacuguccuccacaaaacaauguggucagauuuguuacagucaaacacauuucuaguaccaauuuuuguuguaguuacuguuucuaccgcugugguuaaaaacaaaaaacaacaacaaaaaaagccugaauaaacaaaaaauaaacaaaaccaaacaaacaaaagcuguuacuaaaagaaaguuggagaagaaaaugucauuuaccuuagauuacaguuccacaucauaguuccucaugagggucuucagaagaggaacucaugagaagaaccuagauagggaacugauaaaaacaucaugggaaguuccacuuucuugcuugaccaccauccuuucauggcuuccucagccugauuucuuccagcacccaggacugccaccccagugauggcacugcucacagugaccugguucucccacaccaaucaccaaucaagaaauguaccacaggcuugcccaugagcaaaucuggagaggacauauucuuaauuguguuuuccucuuucaaaaugauuguagcauuuuuuuuaggcugauauaaaacuagacagcacucucauaaauuuuccuuccaaggucuuaaaagaacaaaguaccccgaccauacccaaaauaucaugcuaauguucauguugagacauuaaacucagcugcauauguaucaaaagauggccuaguaggccaucacuggaaagauaggcccauuggacuugcaaacuuuauaugccccaguacaggggaacgccagggccaaaaagugggagugaguggguaggggaguaggggaggguaugggggacuuuugugauagcauuggaaauguaaaugagaaaaauaccuaauaaaaaaacaaaaaacaaacaaacaaaaaaaauccaucaugccagccuguacacugccaugcuuccugccaugguuguaauggauuaaaccucugaacaguaagccagcccuauuaaauguucuccuuuauaagaguugccaugcuccuaguaucucuucauagcaauagaaacacuaguuaagaaacuuggauuucugaguaugugggaauaacauugucacauagaacuguuuacaggacugaaugaggguauagaccauagacugucuuguucucuuucucucacucuuccucuuucucccugcuucccuuuccuuucugucuccuucuuacugaaacaggcaugggcauacaacauaaaacugccuguauauuauaaucauuguuuaauuacaugcugcuguuauuguugugagguucaaacucucaggcccuagcucaucuucccugccuccugcauguccuccauugcacuucccaugucucugauccacuaaagucagaugacguuuuugucccagacucuauuauccucccucuugucugugagcaugcugcacuguggguugccuuuuagcauucacugggcacaguguauuuucuauuaagccccugccaggaaaaauggagcacugcuacauuuguguccccagacaaauauuuuguacaaaguucuucauuauucuuccuuuucuuuuuccucuagauaugaacuuuucaagggcgaggagaauguguuaguaaagucugguauucauaacaccuagucacucuugguuacauagaaggcauuuagaaaaaccguauguugaauuaaugugggcuuguagacccagucuaguaauugugaagccauaaaauucuauuuaaaguacagccacaggaauugacucugugaccccuucuagcugcaaaucuaauguauugcuguaaauggcauaaaguaauugucauuauuuguucaaaagucauuguccuuuaaucacaucuacugauuugaaccaaggggcauguguccauuaacagaaugaaguuuugaagauaccaacaaugguaauagcagcaucauuuaauguccucuaaaguuuucuucuuucaaguuagguuuccauuucuaguucucuguucuuuugauuugaauauaaugcagcacugugauuaaugauuuucugucucuuugaucaacuaauugagcaugaauugaaaaaaauauguaaaaguaauauuuugccuuugguaauuuucacucaaauguacuauaguguccuguauaaauauucauuuauauuacucaaguaaacacaucuauauagaaaaguaauauauugugagucaucaaaauucagauccaugagguaucauggaggguaaaaguuuuuugucaugaauguaaagaccugauuuugagccucugaaacugcauaguggaagcaaagaaccaggucacauaaauuguucacagauguccauacacagucuauaguacacacacacaugcacauucacacauauacaugcagauauacacauucacauacaguaaaucagucuaaaaacaaauauauuuacauuaaagaaauaauaaaauugauacuggagagauggcucauuauuuuagaguacugacugguccuccaaagacuuagguucaauucccagcaucaauuuggccucucacaacccucuguaacuccgauuucaggauauguggacccaguauacucuuuuggucucagugggugacaugcaaacaagcaguaggcagauagacauccaggcaaaauacccauacacauaaaaggaaaaaagaguaaaagaaaaugaaaaaaaucaaauuuaaaauaucucacaaaugcaaacauguccucucucugauuaccaauauuuuaacugcccagacacaacuauuaaaauggccuuugggaugauuuccaguuaucuauugagauuugaaugaguucauguuaguccuuuacugaaacuccuucuaucacauggugcuuugagaaucugaguuccuuagacuggguuucaagcccaacaaggugcugaaagaaccuaguggggaaacccccacucauauccgagucgguguguacccaaagaaucaugagagaccgucuugaugcaaacacaugagguaguuuaaugauggagcuccagacuaacauguaucucacacaggagauagcgguugucggccacguggcucaaaagcuagggguuuuuauagaaaagggucuggggcuagaggaggaauuggcgugguuucacaugauugguucauuuaaacauuagcagacuguacgugcagacugagguaacagcagagcaucugguuaacauuuaacccaugucagaagggcgggagauagggaggcgccuggcuaguccggucugguuaacauucucuuuaucuuuauggccaagcagccucaggaaugucuuaacgacgggccugccugggcacguccugcccuguacugcuauguucucagccccagguuucaaagcucacaaacaacucuuugggcuauuugacauaaauuacaugaaucacaggucucaaguuuuauuuucuuucagugcaauccuucuauaaguucuguuuccugucauggcaccaacuacagauacagucauuuuuuuuuucuuguccucuaauauggauuauuuguuucugacuuguggucuuugugucugccuuugcaucuuagaaggucuaaaguguaaggucuggauaugaccuuaaauucaaacaugagacuaguguccuggggcuucacccuccucuuuauuaauaucucuuaugucaggaauuacaaaugauacauugcaagcuucaugaaaguaaaugcugauuugugguuuuaccugaaauauaguucagcagaagaaauuccaccaacugcagcacuuucauuguucuuuuggaauuugagguauugacaauauuaaaaguuggcaccuaaguagaauaauguguaaagugauucucaggaagcagagugcaauugaauuuacaauuaagaaacaaggcuuugugaugucagggcugcacgugaccugugacaugggcauuugaccugugcuccucagcaccucccaauguuuuugauuaaguuacuuauuuaccuugcauccugcuugcagcuucuccuccuuccuguccucccagaccuuccaucucaucuaucucuucucuccuuuuccuagagaaggggaggcucccaguacccagguggggacuggaucaucuucaaggugaaagugaggaaagcaaaccuuucgaaaaguccugcuuagagcucauugaccacagugcuguggaguagcauagcaugacuccauuuucugcuacauuuaauaaaaacaaaacuaaacuaaaaaaaaaaaaguagguaacauuuuauuuuuauaaacagucaguacauuucuuucucuuuuuuugccaauuuuuuuuuuauauuuuauuuuaauuugaccuggggaaacuuaauuuauagaaguaaaauauggguauaacaagauuauugaacuuuaaagauaacuuauuuccuugauuuuaagauuaauauuuuagaaucaaaauuaugauacaaaauuaauaacaucucauuugguucauagaguaacaucagaaugauucccuguaccccacauuuaucguuuauuucuuuuucuguuuuuaauauuuuauuagauauuuucuucauuuacacuucaaaugcuaucuccaaagcccccuauacccuccgcccccacccugcuccccaacccacccacuccagcuuccuggccccagcauuccccuauacuggggcauauaaucuuugcaagaccaagggccucuccucccauugauguccgacuaggccauccucugcuacauaugcagcuagagacacauuuuugggggguacugguuaguucacauuguuguucuuccuauagaguugcagaccccuuuaguuccuuagguacuuucucuagcuccuucauuaggggcucuguguuccacccaauagaugacugugcgcauccacuucuguauuugccaggcacuggcauagccucaaaagagagagcuauaucaggguccugucagcaaaaaucuugcuggcauaugcaauagugucuggguuugguggcugauuaugggauggauccccggguagggcagugucuggaugguccauccuuuugucuuagcuccaaacuuugucucuguaacuccuuccauggguauuuuguugcccauucuaagaaggagugaaguauccacacuuuggucuuccuucuucuugaguuucauguguucuccaaauuguaucuuggauauucugggcuaauaucuguuuauacuuucauuuucuuaauauguuuuaaaauguguuuuaaucaagauuaaaaugcauaccuuaggaaagggaguacuaaaauugacagaaauuugcauuaucuuuaucucaaguauacauaacuggacaguuuauauaacucccuacuaaaauuagagaaaauuauuuaaauauacuauuuucaguaaagcaaauuuuaaagcuuuaugaaacauggcauuggaacaacaguucugugugugugcuauguauguauuuauguguauguguacaugugcauaagugugcaugcaaggcaucuagcaaagagcccuaaauggcaucuacggauaagcaacuuauugauucuuuuaucaaaacauguuuuagguagaauguaagccuuuguagucagauuuaaggaggccugaucuuuucaucguuuaauuuguauucucuaagauaaagauguuuguucugauaaauuggcuacacacccaaugucaucccagugcugacugaagagugggaagcuggagcaggaugugaagcugcucuucgcuacuccgacagucucuaaacuuuaaaaagauugcuucuugcucuguagcgugacucuagggagucaacuucccaucuuuuaauuaaugguaaucuuauucauaauaaaaugaaaauucaagaaguugugauaaauguucucuuuacuuauaugaaccgugcaugucggcuuacaaauaucaacucaaaaaugaaagacguuuaugcaggucaccuagccuuuugaccuuaauuuuucuaagcacccauacaacugaaacauuuagacaauugaguaaauuuauuuuacuuuauacuuuuuccuguggacacaauuuauaauacaaaauaaaaugccuacuaaaagcauauuguguauaaaauauauguauuugauuaucaagguuuagccacuccauuagaguuuuacagaauccauucuuuaaacuuuacauaaauaccaauacuggugguauuuuguauguguuuugauagcauuugccuaagaacuaaaaugaauacuauuuauuagcaugagaugauacuguaugaaaaagcuauuauaaggugaggugcaugauguuuggccaccuggucauuuaauaguauguguagcacacuccacacaccuaacuaauugcuucuucaucuucaacagcuuuagaaugugauaacucacgcaucugauagcaccguggaguaguucagcacucaucucugcuuuccaugcuauguucucuacacugugaguauacauucacuucuucuaagcagcuuggugguauggaaacacauucaguuugcauuguuggggaaaaauuauaaguuaaucaaaguauaauaaauuuagaugaucugaucugaggauauuguuuauaguauuagucuuaauacuauuucaacauuacagcaugaaguaauugcuaugguaaaguaacaugcugacauucaaucauaugugaaaucuuuaaguuucuauggucuuuaaguaccuuugcauuccuagaaaaacauaaguauuauauuuagaaacaguugugcuaaauugugaaaauuucuugaaacgucuuugauagauguuauuugcaauggacuuuuaaguucaagucagcuucuuuuuuccuauuuuuucucuauagcuaucuauugaaaauguguuuaguaauauucaccuggucaaaauuugaaauauaguuucuauaugaauauuaguuuuaaacuaccauaaacuuucuaagaucacaaauggaacuaacauacauuaaaaauaauucauaagccggacagugguggcgcacgccuuuaaucccagcacucgggaggcagagggagguggaucucuaagaucaaggccagcgucaucuacagggugaguucuaggacagccaaaacugcacagagaaaccuuaucuugaaaaaaauuaaauuauguacaaacauuacaugacccaauaauuauauuccuauguauuuacccaagugaagagaaaacccauuuuacuugaaauguguguaaauauuuauacuaacuuaauauuuauucaucaaaauguggaagugagaaaaauguaguugggugcaguaacacauggcuguaacucaagagaccaaggcaagagaaaaugucugaggguaguguggaaggguuucaagccaguuugaauauauaguucuacucagucacauagagaaaaaaacccccaaaaacccaaauguuauauuuaacuguuguugaagaacaaacuggaguauuaguaccacaguacucaacuauagaaaggaucaauugguuucaugaacaugugaaucuuagucuuuucuuuucaauauugaggaaugaguucuaggccugugccugcuaagcaaggacucugacauuucgcuauacaccuaagcccccaaguauaaaucccaaaaccauuuggcaauggaagaaagaagcccuaaaugucuaaguauugugugauaccaaguaucuaaauccuggaaaagguacaacugaaagaggaagaagugaagccauuguugugugggacagaugcauaggauaacuggcuacaaauacauuucugauugaaucaggaaauauggggaugacaagacuguucuguguggucucgauugcugggcaaauugaaucaaaaugcaaagaacucuuaaaguucaacauuuuuaucucacagguaguggggaaacugacaacuuuuuguaauuaauuaagaguaagauaugauugaguguagcagagagaaggcaucaguuuuauauuuugaaaagauaguacuuugucaaaucaaaucugaagagaauaagauuaagugccuaaggaauaacagauauauuguacuucuauuggauauuuuucccucaaugaaguauagguaagcagcucugaaaccauuuuuaucuauauagcauaaccuauaugaguaaaugaaccacugguagaaggaccaaaguuuucauaagagaagaagcuauucacaaaaagaaaugggugcuuugaaauaugcauguaagaacaacuaacuaauuaagaggcuaucaauuuuaaaaagagcaaggaguaauauacagaaguauuuggguauaggaaagcaaggggcguguagccaugaguaccuauggcuaucugucauaacacuagcuguauuuguggaauguuccuggaagccaugacacuguguggugacaguugcucuccacgucugagcuucaacuguaaaaccuaccucaaccuccaggaagugauagcugacuguugaccaggacaagaaacaugcaaugcaauucugaaacauugcagugccgaaaagcaugaacauaagaaaaggagaagaaaagggggaaggauaagaaugaauucacuggaucauaacagagcaaaagccaaccagugaaacugagcuuucgguugcuaaaguucaacugcaagcugcuacaaauaaauaacaggagacuacaguuuggcugagaaaacacagccccggaauucacacucauauaauucuguguacaauuaaauaagaguaaagacaaauauucuuugaauaaaauuugcaauuauuguaugcugaugccucaucuauucuccuggaaaggaggcugaauucuguuccugaguguaguucaacuugacagcucuuuuauagagaacagaauguggaagcaaguguuagagagccuagcaggcaccaccuucauggugcuaucgacauuaacaucucuaaugguaaacacuguugauaauuucuacccuggugaugagguaaggguauacacuucugugauacccucucucaaagcucauauacugaguuuucucauaacaacaaguuagagaaacuuaaauuaaaaggaauaaguauaaaaugacucacacaaucaugugaauguuauaggguaaugaugggaagaauugaacaucacagcugaagaucacaacaaauaaagaguaugacuuauuucaaugacauauucugaguuagggucugaaggaaaaaaaugaguaagagagauucagcugacaaaaucuauaagaagcccgugccuugcuuaauguucuugucugaauugaguuuugacaacugggcuaccccauguuaauuaagggagaauccagaaaguggaacagauaaugcucuauacaucuuuaucuuuuuguuuguuuguuuguuuugguuuuguuguuguuguuguuuucugagacaggcuuucucuguguagcccuggcugcccuggcugcccuggaacucacuuuguauuccagccuggccucaaauucagaaauccgucugccucugccuuccaaguacugggauuaaaggcgugugccaccaccuccugcauugggguuucuauuccugugugacuaugaccaaaagcaacuuggggaagauaggguuuauucagucuuacaguuuuauuucacagggcaucacugaauaaagucaguacaggaauucaaacaggacaggaaccuggaugcaggcacugaugcagaggccuuuaaggaguauugguacuggcuugcucauccuggcuugcucagccugcuuuguuauaaaaccuaagaacaguagcccagaguuaggaccacccacaauaggcuuaguccucccauaccaaucacuaauuaaaaaaaaaauucuucacagacuugcuaguaaguuaagagcauuuucucaauuuaaguuucugcuuccaaaaugacuagaacagaauuaauaugccaauauaaauaucuuuaaaaauucaaaacaaaagcacugaaaaaggaguaaaggcucaugaauacacaucaucugagauucgcuagguagaugcaugcauuuggguaauggaaauaaaggcaguguuugguagaaaugccaagucuagugucaacagcaguguggagauuagaguucauuguagucuaucauguaaaugcaaaagucaucuuaagaagaggguuauuaauuauacugauuaaccaauagauguuauauguuugcauuggaauauuacauugggcuugauaaauacaaaaaaguauuaugugcuaaucaaaauaauauuuuuaaauguuugagauaggaauguaagugacccuguuugaucacuauccacuagauaacugguuauaugccauguuaacuaaggcauaacacuaauaccucauaauuucauuuaauuaaaauuaaaauggcaauucuacuauuaggaagguuguuuuacaugaaauaugagcuuucuauuuuuuuguagaaauauuuagacauauuccuguguuuacuguaguuucauuaucuuccauauagacuuccuuuuuggcuaacaauauaguaauuauuaaaguugcugucuuagucaggguuucuauuccugcacaaaugucaugaccaagaagcagguuggggaggaaaggguuuauucagcuuacacuuccacacugcuguucaucaccaaggaagucaggacuggaacucaagcaggucaggaagcaggagcugaugcagaggccauggagggauguucuuuacuggcuugcuccccuggcuugcucagccugcucucuuauagaaccggagacuaccagcccagagauggcuccacccacaagggggcuuuccccccuugaucacuaauugauccacaguuggaucucauggaggcauuuccucaacugaagcuccuuucucugugauaacuccagcugugucaaauugacacaaaacuagccaguacacucaccuauguuuagauuuuaacaacauacucuccaagcuaucuaaaugucaaauuucauuucucuauaguccagucagcucuguuuucuuggacgguauuauccuucuggacaaacaagcauaacuuagauaucauugugauuuucuuucccuuucaugacaacauaagcaauaaaggagaagauacauccuaugggaaaaauuuucuauaucuucaaaagcuagcagguaaaaggggacauauagaaauucaauauucaaauuucccuuaauaugugccaaauacaaaggauacugugcaaaucauguccucaaaucuaccacuaacuuaggguugucaguacuuucguuuuuccucaguaagucccuauuuuaauagugagaccuguuucacuuuuuucagcgcuuuguuuucguuucauuaaaaguuuauccuaaagucuuuuguaccguaaucucaacucugcugucugguagauaagacccacuuaaaauaguugucuucaauuccuaaggacauuagcauggagcacauuuuguuuucugcuaaaauaaaacaaaacaaaaggaaacaaaacaaaacaaacaaaaccccaccaaguuugcaauuucaggaguaaugggaaaucugagaaugacuucaagugugggagggcucuggagugccaugauugacacugagugcccuucauuuauaaagacaugauucuuauuguaaagguugauagagaugcagagugauccauaguguguaaggggaaggaguggaguggguggauaacagauaacacauucuuccauuauaccagguacaucacaaauaggucauaagcacauauaaaaagugagcuuauagaagcaaugcuuuaagaaaaaaguagaguaaaagccaguugcuguauuguacuguguauuauauuauccuauuuuuugcucauuaugaauccaaugauauuuuauuauuuuuauuagauauuuucuuuauuuacauuucaaauguuauccccuuuccugguuuccccccugggcaccuuuaucccauccccacuuccccuacuucuaugaggguguucucccacccauccaccuacuacugccucccccgcacugacaauccccuacgcugggacaucgagccaucauuauuuuaauagucaucuauaaguacuucaaaaucuaugcuuuauaaaauaugucaaggcgaacaaauaucuagucaacaaaauauuuuuuaaaacgugcuuuauuaccaugaaguuggccuuaaauuucuacaggggcuucuguuuucccuguagcuauacuauaaagagaccaaggcacacuucacagucaccaaacccccauaggaaaaucacagugagugaauauuuacacuggcaauaagaaacauaaguaguagaagaaaaaaauucucuccacuuuuacuugaaaccuauauauuugucacaugcaauuucuagcuacauaugaaaugaaacaucccuccugauuuucaguauaaagcauugucuucugucuuuauugguuucauuuauuuguuuacuuuuauuuuuauuuguucuuuguuaguuucauacaauggacuucagucauauuuacacuuguuuccuaauuacuuccuccaucuguacuugcccaacuuuauauccuguuuuuaaaccagugaagacuaauuuauacugcucaaauauuauugggugugcauucuucccacuggcgcaugguuaauuuacuuaucgacuauacucuuggagaaaacuaucuuuucuucucccagaaguaacaaguaucaauagacuaggacuaggaauguuuguccaacuuucuucugcaugcucuuuucaucuugcuggucuugcacaggguguuuacuauuuauuuuuuuuucuuuccauuuuuauuagguauuuagcucauuuacauuuccaaugcuauaccaaaagucccccauacccacccacccccacuccccuacccgcccacucccccuuuuuggcccuggcguuccccuguucuggggcauauaaaguuugcguguccaaugggccucucuuuccagugacggccgacuaggccaucuuuugauacauaugcagcuagagucaagagcucagggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccugaauauggcagucucuacaugguccauccuuucaucucagcuccaaacuuugucucuguaacuccuuccaaggguguuuuauucccacuucuaaggaggggcauaguguccacacuucagucuucauuuuucuugaguuucauguguuuaggaaauuguaucuuauaucuuggguauccuagguuuggggcuaauauccacuuaucagugaguacauauugugugaguuccuuugugaauguguuaccucacucaggaugaugcccuccaaguccauccauuuggcuaggaauuucauaaauucauucuuuuuaauagcugaguaguacuccguuguguagauguaccacauuuucuguauccauuccucuguugaggggcaucuggguucuuuccagcuucuggcuauuauaaauaaggcugcuaugaacauaguggagcauguguucuuaccaguuggggcaucuucuggauauaugcccaggagagguauugcuggauccuccgguaguacuauguccaauuuucugaggaaccgccagacggauuuccagagugguuguacaagccugcaaucccaccaacaauggaggaguguuccucuuucuccacauccucgccagcaucugcugucaccugaauuuuugaucuuagacauucugacuggugugagguggaaucucaggguugagauuuauuuaaccuauuuauauuuaaucuacuuauaaauagauuuaaaaucuauuuauuuuaaucuguuacaaucacugugaguucauauguucauauacccugcccuauccagaagauaauguuuucuuguaaucaucuaacaucucugcaucuuguauuuuuuucugcccugauuucaaaaugaccucugugucuuggcaggguaguauaguauacaauguuccuuuuagugcugagcauucugucguuuacuuucuucaucuuggcaaguugugauucucuuugucaaucaccauauacuuguaaacagauacuucucagaucagaguucaaaaauguguacaucuacagauaaaagucaaagucauuaggauuagguuuaauacuauguccacuuagcaacauaauaggagcaguuucucuccaaggcuucaauggccucaauggcacaucuagucauaccuuuuuggaccaaaaaugauguuugcuauggguuugcuuuugcaauguaguucaggacuugaaacuaauuuggaaagugauggguuacucuucugauauucaugacacuauuucacuggcuuccauuauuuugucucaugggcuucauagcucgguaccauugauaauuacuuuuaucuucugguaggaugcuuaguaccguguagaacuaucaaagcuagccaguggcaaugaaguuuucagauccauaucuguuuaauuuggccauguacuuugacucaaauauuuucggcaauaggucuuccugccaaguucugugggauaucaaagaguaauggcaauagccuagauauuuguagaaccuaaugaagcaaugauucaaaaagaagugacccauuccugaaucuuggcuuuguuuguuugucucuggcaucuaaugguggaaucuuugcuuugcuauaggaauagauagauagauagauagauagauagauagauagauagauagauagauguguauguauguguauguauguguguuuaucuguauaauaccaauuuaggaaaaggccaugaauuuguggaugagcaaaggaguucgugaaaggaguggaggggagaaaaggaacagggauauuguguaauuauacuacaguuucaaaauaaugaacuuuauauuauauuauauaugauauuuuugcaugcauuuuaagaaucuucuaacauagguuuucauauauauaugauauauauacauauauacaugaaaaauauauauacacacauauguguauauauacucagaaguucuuuuacccuggacagauuuuucuagacaaaaaaaaaaaaaaaaaaaaggacaaaugcuggcuggcuugauuauggggacaaaagaucacguauuuacuaagggugacaauguaaauuauuguacuuaguauaaaaaucugagaaugugccucaaaauucuaagaguacaucuaugauaugaucgagcuguaucauucuugguuauuacccaaaagacugcauaucuuacccuagagaucacugcuugccccugcuuuuugguggucuacucacaucagccaggaaaugggaauagcuuugauauucaucaauuaaugaauggauauugaaaauaugguauauuugcguagcugaauauuauucagcaacuaaaaaaaaauaaaauugugaaaacuguaaagaaguugauguaggagggauaugaucauuccgagcaaaguaacccccaccagaaaacacaaacguucccuguucccucaucuguagcuauuaauauugaaucuucagauauauguguuuuauuuagaauacacauaaaaucaggaaauuagcaaggagccauaaggaggugacuucaugaaggagagauagaacacacuguaguaauggauuaaaggggaaugaaugauggaaggggaaggcguaaacugugguuugggcacagagugcaggauagagacgagaauauaggacggaauaaagaacagcauuuuucguaauuucuuucuaucgcuuuuuaaaagucuucauuuuccuuguuuuuguuguaaugacuguuugaagucacuguauuuuauacaccaaagauuacaggauauuaaucuaaauguacaacuuuaaugucauuaaccuaccucccucaaacaaacaaacaaacaaacaaaaaaccaaaaaaaaaaaaaagaaacuuugcaucguguauuuuacaugccuuaauuuggaauccugcuuucaaaggcaagcacaaugcugcuguagggugauaagacaccauaccaagcuacacuugugcucagagccuacacugaagacaggacuuauuauacaaccuuagguaauaaagugagaccaugugccaucuucagcaggaaaugagagguguuaggcaggcaagaagaguuuuaggaacaugacggucuacaccucacagcuucuuugcugugauaugagaucuuuuucucuaaaucuuuaagaccaucugcuaaccuuacauauguuguaugugcauguuuagggaaaaagugaaaagaaaguuuaagagauaaauuccauauucagaguuaugcaacgagaggaauuaagaauauuuauguugcaaaagccagguuggaaauuuggaaauaaauuuucaggguacagucaaacacccuaaauacugagucaucacaugccugcaauucucaaaaauauuguaggacauucgaauagucauagaauaugugauguuugaauagaauucuugaauggagaagucaaaauguauauucacauuuccuuuguuacaacaaaaaccuuuagggaguuauuaaaaccacaaucgaaaaauguuucacucagaauccaaccauaucagaauuuauauaguuauuugcccauguuuucuuucuuuuaugccaugguuauaauuaaauauuaaucacaaaauucucaguugccaauauugccaacuuucaauuuuaagcaaaauuauaaagcaguuucuuuuaccuauuuaugaauggggguaauaauaugcacauggauuaucagagaaaauagaccugcuauccaggcucuggaggaugagugaccugcagugauggccuuggggagaugggacucuauagacucccuuuguaaauacaugguuccuaagcuaggaaugccauugauugaugaacucucagaaguguguucuuuggaucaaccgacuuuuugaaguuuguuuuguugccaucugguugacuugcaaauguguguucacugagguguacugccauccauccuugacacucgugagaaauccauucugacagcuugcagaacugucauugauuaagcaaucacuuuuaaaacuacugcaggugacuguuugcuaccauagcucaaaaaaaaaaaaaaaaugauuguccccuggaaacaugaggacuuucuguucuugggcuauuagaaauaaacauaugaggacaaaaguaagggacaaugaggaggaguaccaagcagcaaucuccaccagggaaacuggaaguaauagagauaggcgcuuaauuaaaucaucugaugggaaauacuguggcagguaucaaacagugaggugaaugugggaaguuacuccccacugauaacaguacggauaagauaaaaagguaaaaaaccaaugaauaugcauaagucaaguugcacgaaauaucuuauguucacuacuuaguauagguaggaaaugauacuuuuuugagauaaggucuaacugugcaacccaguguggccuucauuuuaagaucuucccuucuuagccaccccaaaacuuugggauuaucaugcccuuugguguaaucauaaauaucauuaucuaucuucuuaguuuauagggcagauuuucucuaaaaacauacucuacugggguauuugaugggauuuguucuaugcuaauauauuuuguuuuguacugucucuuucucuauuaccaaguuuauucuuugucuauucuaaaaugauccaaaguccuuuccugucuaucaucuucuuguucccuuguucacugacauuucaguuugcaccucuccuuucuccuucucuuucuccuucuucuccuucuucuucuccuucuccuccucuucuuccuccuccuccuugcaguagaauucucuuacugcaguguuggcuccuccuccuccuugcaguagaauucucuuacugcaguguuggcuuucuuucugcacuuccgaccucugcugcucuguaauacggugauuguguucuucucuucuucucacuguauuuuccaaaaacugcucuuccuuuucuccuugagaaauaucccagugaaauaaugggccuggguuagcucacauuaugcgaugugcccgguucuaucccucuuggaaaacuaauugcugcacuacgaacagaugacucacuucaaugucacccuugagagggagcuugaauuugaagauuagacaaaauaauaaaugauucccauaucucccauuuacuggcugacuugacauuuccugccuauuucacacuuuacaagaacccuguuuuaaaagauagcugugacauagugaaauuauauagaaaauauauagcacacccuucauacauagaagaaaccaccagagaaaaagauaaaucuuguuuguguuuuuucuuuuuuucuuuuuuuuuuguuucacuaggggacuuaugagucuuaguuccaaacauucauugucacuaccugacucuuagacuuaagccagguuaauuaacuauucucauuuaaaaugauaacaucccaagcugaaagacaacaguaaaacaacaaaugauaauuaagccagcaaacaaugucaaccugcaugcuagguguguacugcaaguuguaacugggauuaagcuucaaaaacacauaacuuagaugcaaucuucucacuaguuaugugauccaagaauaagcaacucgggaagggaagagcgagaagagaaguucccuuugccagcaccuccaugagcucuguacuggucucugacacaguuuuaauuuccuguucacuguaaaugauacuuggcuauuacuggaauuagguucccucaagacuaaauuuguuuccagaagcuucuauuaaacuuccucagaguguuagaggauuacauccugcuugcacucacuugagauuacauuucuuucuuuccuauauagacaauuuacacuuuuguaguuguauaccgucaaaguucauauuugccacaaaaacaagcgagagagaugccucauggauacuugcugcucuuccagaggaucuggguucaguuuccuguguccacuuggcagcucacagcauggcuaacauuaagaagcaaaguaauauauuacuccaagagauccuaagccucuaaugcaguaggcaaaauauugagugaaaauuucaaaauuuacagugaaaucucaguaauggccacaaauagaacacagacagguacauaaauacagagaaaaccaucaacaaaauguaugaaaaugucagaaaaacaaacacacaaaacaacauuuagaaaucuaaacagacacaaguagaggaaaaaagucauccuaugucauacucaguaugccaaaaaugcaaagcaaaaaaacaauauuaagagccaucaaggggccaggugugauagcucacaccauuaauccuagaccuggaaggcagagccaggcagaucucugcuuuuaaagccagucuagucuuuagagugaguuccagaauagccacuaacaaacagagaaaccauguccagaaaaauaaauuuuuuaaaggaaaagccauuuuuccaacaguggcaaaugcauuauagugucagcuccaucauuaacaacacauaaaacaagagaagaguuaguuggucaacacauuuuaagcccuaaaagcaugccaaccaaaauuacuguuucuaagaaaacuagaguauauuucaagacaagcacaaacuaaggcagugcaugaucaucaaaguagcuguauacuucauggaggagaaagacauucccaaucccaagaacagaagaaaaaagggggaggguucauaagaguaugaaaugaauaaaggagaugcagaaaagaguccaucacccacaucuuagaaggccaccguccuaaaccuacagggcaguaagaugcuguaucuuugcucuccacuuaaaucugagucaaauaagagauguaucuuuggaugauucuguaaaaguguuuccuggaaagaauaacuaaaaggagugaaagucuucccaagaguggguaacagcuuucagaaauaguucagauaguaaaggguccagggaugggaggaggacuuacugcuuuuugcauaucugccuuuccccuuugcugguguguacuuguucuaucaauucuguuccucuagugcagugguucucaaccugugagucccaaccccuuugagguagcauauccgauauccuguauauauauauuugcauuuuuauucaucacacuaucaauauuauaguuauaaaggagcaaugagacaauuuauaguuggggaucagcuaagaaccauuguucuagcaaauccuaacuaacuaacuaauaauuuaaaaaauacauagcuacuaauccaauuaaccaggaaagugauaauuauuugauuauuagagauagauagauagaugauagguagauagacagauacauaggaagauagauagauaauaaauauauccaauauuuacauuuauauucauaacaguaucaaaauuacaguuaugaaguagcagcaagauaauauaugguuagggucaugaauuugagaaagaggaaggaaggacaggaaaggggaaacggauauaauucugauuuccuaucucaaauauaaaagaaauauuuuuuuaaaggaaagauagucugucuaacugaauuuuuaaaaaaacaucuaaauucaacuguucuuuguuuccaagaaauagaccucauguguaaaaauaccuauggagagucaaagaauguaaaucaauuaccaaguaaaugauugccaaauacuucuaacucacauucucauaucugauauaaaaaaaauggaauagauauugacauggaucaagaagguguaacaacugaaaauauguaugaguggaauuggugaguuuccaauucauaaaauaaauauuaaugcacacagaaagucagguagguccagauacaguucuaguggugacuuaauauuccaaauucuuuuuuaguuaaaaaccuccaaaguuauccaacaaagaaacaucagauguaaaccauuucacagguuaaaaaccuuuaaaacuucucuacagaauacuaauggcaacaucagagaaugcauacucuucccaacagccccugggaagcuuugugacagacaucucaucuguaaaucaaguuuuaaagaaauguaagagaacugaaaucauuucuuaauuuuucaccuugcuuuaaaaauuccaaguaaugaucauggcagcuugugugauaauuuaucuauucuucaaacaauagacaagaaauaaaauguaaauuauuguguagacagcauuuuaucugaaaaacucgucauaagcuuuauacaucuguaggugaaugaagcaaauguauaugcccauggcacuuagaugauacaaguggaauuaaguugcccaaaucauguaaaacgugagaccuuucaaaacaaauaagaugaaagacaaaugaagcagguugugaaaauuaaaguuucaugguuuucaccagcggcucuuucccugcccaccauucaucuugacugucucaauaacacaacgcuuuaucuaagaauugcuuuuaaaaauaaucuagacaauuauccuauaguuuaaacacccucaggaguuauugguuuuuagacacuaaaguaauguagaauucaugcuaucgauaagccuggugaagcccagccacuucagcccguaaaauaaucgauaacaaacccauuuuucccacauuuuucuuaagcacuuuauacaauuuuaguuaaauacauugaguguguuuaaacauacugugaggacagaaauaaucauuauccugcccuucuagcuugugcucuggcauuguguggguacggauacagccauuucuguaaauugagugaagaagaccaucucuucagugaguaaacgaguauuccaacagaccauguuggagcaugcguuaguguugugccuaggcgcaggauuaugcagcauccuuagcaaaucugagcugacagcaguguuuugccugggaguuacuaagucucuuuucuucucauacaucaccauagcugcccccuuuaauuucaauucuaugccauucguguuaacauguaaaaaugcauagagaaggucccaagugacccaaacuucugcuaccuaacguuuaccuuguggagaagaggcuugauuuuuccugcuucuaaucgucuuucccucuugcucuaucucuauauuuuaaguggcuguagcacucaaggaaagauguacugcaggagucucgaggucacacucuauccccacacaguuuuauaugucugaugaucguaaucaauauucagcuaucaugaggauucuagcauuugcuucaggauucucucccugaaaagauuugcagagaccguuucuauucugccacuucuaggcucaugggcacauucaggagaugcuugacugaucagacauuuccggaugagggaaguaguacagcuuccacaggaucacccauugauaucucaggggcugguucucacacacccaccuaagaaaucaaggucgacaaagguaucccauugcuuugaagauauuacaaaaaauagacagaagucauguuucuuuucuauuauauaggagauuuacucuguauucccaaacacaaguauggucaauucccuacaagcuggagacgaauugaggaagugaauauauguguguacaucucucucucucucucucucuccccugugugugugugugugugugugugugugugugugugugugugugugauaugugcaccaagcaugugcaaaugggcaugugugucgggauagggcagucagggugauuguaaugugcuagauugauucuaaaacauaucauuaaaucaguaguuaguuuuaccauuacuacagucuuaugaaaagguauuauaaucuauuucucaugugaauaauucuuuaaagcuagagauuuguguacauuucuaucugaaaucuaugagccaaaaagagccauuaagcaucauccuggcagccuuccuagaaaaauccauguuaccugauacauuuuucccacccuaauauuauacaaauugauuucagaacaaauauaaaaaucuuuccuguuauguaccagauauuuuucaauaaauaccaauaccacaguauugcuuucuguaccacaguaaugcuuccuugauagaacucuagauuguaaaaucuuuuaucaagugcaucacauuugaaagcagcugaacauagugggugguauguggcuauacauuuagcagucccaacauauggauagaagaaucuuuugaucuaggcaaaccugaguguuucuaucagaaagaacagaaauggcauggucuagggauauaguaacuuguagugcucuugcuuggugugcaccagguccuggcuuugagucccaguagugggggggggggagcaaaaauuuguaccgcuuaacgaagaauaccuuuuuuuuuccuucucagcaugauuucaaccauaaguaauucuaaaaagugcaaagaacuuacaucuuagcugcucuuuccccaaccagccucaccucugcccaucucugguuuuguugguuggaacgugugcaguccaucagcgucacgagugggacucuacagaagaugaauucuacuguagagaauauaucauauaggugugucuucaguaucuuuucacagcgaggcugugacaguagaaaaauauaguuugacagucugucaacacaggagccauuuaagccauuugaacuuuuguaugauuuagugauuuggacauaaucauuucuuuuaugauuaaauacuuuauucuaagucuuauaguacuuuaauagaaguugugcuaaaauuuaaaaguucuauuuuaauuuucaugagaaaucuuaauaacauuguaaagcagaauucaaugaggaaaauuccauuuucagacuacuguuguaaaauucaagacaaauuccaaaagaucauuuuguuugguuuaggguacuuuucacugugagggugugugugugugugugugugugugugugugugugugugugugugugugggugugugugugcauguguguguauguguguguguucuagacuaugauuauguauacacauacugaauauugaugaauguggaucacaguaaaaauaaauuuucauugcuaugaaacaauccacaaagagagaacuagaaagaaacacuuuccauaucugaauacaaaccuucuugcuucugugcuaguugauuuaaagcagguaagaguacaacgauucugcaaacuuagcaaaacagaguagcauuccaucacaaaugucuuaguagccaguggcugggguuuucuaauguuguuaguaguauaaacauuucuuaggccacagccaauacaaguuacagucagauauuaacucuaaaaauuugcugaggauaaaugcugaacaaaguuguuaaccaauuagcugcucaucuucaaaucugugguaaauaugaaaauaacuucuuaaaguaaucagaagaguuaaaagacaguggaccuaauaccuuacacuuaaaaaauuuccaguaacugugaacaguuggaccaacaucucugcaguucaccuaaaauugucuuccucauccuugccuguuucuacaggccugcauggcuaauacucugguaaaacuauuuucuucuucuuuuuuuaaucacuauuuuuuuuaauuugauguuuucuuuauuuacauuuaaaauguuauccccuuuccuaguuuccccuccagaagcccccuaucccccccccuuccccugcucaccaacccaccuacuccugauuccugucccuggcauucccccacacuggggcauagagccuucagaggaccaagggccuguccucccauugaugacugauuauucagcuagagccaugagucagucccaccauguguuuucuuugguuggugguuuagucucggggagcucuggagaaacugguuaguucauauuguuguuccuccuauaggguugcaaaucccuucagcuccuugaguacuuucucuagcuccuucauuggggacccugugcucuguccaauggauggcugugaucauccacuucuguauuugucaggcacuggcauauccucuuaggagacagcuauaucaggcuccuguaucagcugcauucuaaguagauaauaaguuuuacuuucuugccaaagagauaucauuugaaaaaaaauccauuuucaugaguuuuggcuagaaacaauuuuucuuuugcuaaauauuuuuaauaaaauauuaguuguugaagaaaauaugauuaagaugguguuucaaacuaaugcacuuguauuccuuuuuuugucuccuaaggacagaaaccaaggaaagagagcauugagaacauuauugggcauacaaauuuucaaugaguuaagauggaaaaauaaaaaucagagacauuuucaaguaaaaauucacuuuuaaaauaaauauuuuaugauuauaaaauucaccuaugauuuuaauguccuucucuaaauauuuccuuaacauacauuuuuucuucuauuucccaaaauaguuaccugaaagaaauacaccugagaaaguguugaacauugauuaugcacuguuuguggaauuguuacaauggcacaugagguauugaggaauauuaaccccauuuuaaaagucaagcaacagaaguuaagucaguugucaaaauuccacaaaauacugggauuaaaaaugggacuaacaguuucccaaacacauuuguagccauuauuuaaucaugcuacaucucccuggucuauccacagucuaaauuucuauaugcacuuacuaaauuauuuuuuuuaaaaaauaauugguagugaauaaucuaaaguguccucuauggaaccuuaucaacaacugucuguacuuucaaauuucauuucuuuucaaaaaagcugcaagcagcacuguugcugagacaaccuguugaaaaaauuaauguauaguaguuugugucaguagaaaucaguacaggauaucuaauaaugacagucaauguggaagcagaaaaaucauuuguacagucugagugauauaguucuaaauagauauaaagagaucaaagaugucuauauaauccacaguaaacauguggaugguaacuuacauuuuguuagaaguaucgcagccuuaacuaaauauucuguuuggauuagaaauaauuuauauucauauuuauauaauauaccauuuauaauguuccaagugaguguuuaaauaagagaaaaucagagacuauauauuaacaccaauucauagaugcuuugaagcuagagaaaccagucucagggcaaucuaauuaauuucauucaucauucaacauuaaagaaaauaguaaauucugcugauauaaaauaagauuauggauacugcauaugacauguaagcaugugcccagaaaauguguucuuuucuccauuguccuagcucuuaaaaggaaaggcauugggcagagaagaaagagugccaccagcuaaugacuaugaauuugaguucugaaagcagucaacauauuuacugugaacuuauuaauucaauacugugagguauugaaacgaaugagagccaugagacucauuguauuucuucaaagauuuacagaugagucuuuauuuucucuuacauacaacuccaauuuuuuucuuccaugcuuguuuuauuuggaagacugcaaugacuuuacuauauuccacuacuuuucaaauagacaauugaucuaugaacuuagauuuuaaccaauuuuauuucuuacaguuaaguguagagucacuuuaauuccuugauauccaagcaacaacuuucuuauuaaaauuuuaaaagugggguggaauguuauucagugguagaauacacuuaauaggguaaaggaacugaauuuggccacacacacacacacacacacacacacacacacacacaccaguuguuuugucaaauggaugcugagugcauaucaaauugguuucuaagaauuuguguuuacacccauggauuauaagugcuauuaucguuggcuagucauguacaguuggcaaugacaucucuagagacuuauaaccagccaggcuacuggggauaaguaacuuuaccuauaguauuguugcucaaugcucagucauagguaaagaaaaaauaaucagauaucuacaucacucucuccaggcuuaaaagaucauaaugaaagagaaaguagaaauggaagauguagaaaguacaauguucauaguuacuugcuucaaauuguaauguucccuccaggagugagaaaggacucagaagacuagguaaauaaaaagggcuuauaaaguuauaaagcucugggaagaaaaugaaacucauaaggcuaaggaagauccugaaaguuauaagaucuacaagcuccuuuccuuaaggaaaguaauaguaaaaacuguuuagagaaugcacauuccaauugccugagccuucuacaaguuguauggggagauuuauggauacacuuaucaugaaucauagcucauaaugggguuuguacuuuccaaugauacagcugccuuuauguuacccauguuccuguaaguaacccgucucuacacugaaaacuaaugagaaauaaaccuccccagcucacuaagcgauacuugagugagauuguucauuggucuccuggucagugcagcuucuagaaugagcaacauuugacccuauuuccaaggaaaauagacaaagaguagcaaggugcuggaaaacaauguugccaauuucaagaccuuugagccccucuuugauugaaaguggagggaguguuuucucaaacacaauuagguuuuauuguaucuuucuuuguauuuccacacuuuguaggcaaaaagcuuucaguaucauuagauguaugucaaaugcuuucaauuaaucaagaaaauccaccucuuuucuaguacuuguuugcuguuuuaaaauagauauucucuuucaagacuacuucagcucaguugauagguuucaaguaaaaucacaggcagaaaaucuacaggagcuagacaccaauugaaggaaggaccagucccuaaauuuauuaacugauuauugauugccuucaauguagaaaguauaaauccaaauuuucacucguuaaaacauugaccaguagcuaaaaacaaacauugcaugugcauaggggcauccacugaagcaggacuuauaccuguuuaaacaacaacaaaaccugacuccuucccagaagccaucaaccacccauaacuucacgguuauagauggauaaccaugaacccguucucaaucuuagcuagagcauugacuggcuugaucuugugaaggcagccauagaagcugugccuuugugagugcaaugguccuuucaucaaagaagacaguuuuguuccaaucuucucugaccucaaauauugaaaauacuuuuauccccuuccaggauggccccugagcauuggguaugucuuugaucuaaauguccaagauuuggcuaagugcauaaaaaucgcuuuuuuuaaaaaaagaacaguuggacugagcauaggguccccagucaaggagcuagagaaaguacccaaggagcugaagggguuuguagccccguaggggaagcaauauaaacuaaccaguaccuccagagcuccuagggacuaaaccaccaaccaaagaaaacacaugaugggacucauggcuccagcugcauauguagcagaggauggccuaguuggucaucagugggaggagaagcccuuaauccugugaagacucuaugacacaguguagggaaaagccagggccaggaaacagaaaugggugguuggugagcagggggaaggggaaagaguagggguagggugcuuuuuggaggggaaaccagggaugggauaacauuggaacuguaaauaaagaaaauauccaauuuugaaaaaaaaaaaaaaaagaacaguugugauuuucuacauucaccaccauccauugacugaaaaaucucugacgcuucucuguauuuaugguuggagagggaauaaauuuagagggcaguuguuuauuaacaaauuaauaaaaguagauuuaccccgaggccuaagaucuauucaggcuaagauucuuggcuagauuuguagaaccaagggguuuuucauccaagcagaaaucuucccucauuacauuaagaccauuaucacacagaucagcacauuucaccacaccuguuguuauuucaguucacuggguucucgggauaagauaacaucacauuguuggugguggaugagcagccuccauagcaccaucuaguacuguggaaauuaaacagaagggaaacuaucuggucaccccccaaguugauuucuccguguacuaugaccaauguguauggugucuucaguaauaaaaucuaaaaaucaaauucugguggguaaacaagaucaaugucauuacccucuauugcuuuggaagucuagaauacauaugaccaacaacacaagaauaguaaccuacugggcuuuuuguucccagagaccugggaauauuauaacaagaggagaucuugcaaguguaagauaaaaacuaaucuguuaaaacagagaagaaaggcauggggacccugggucuauaccaagaaaaucucuagugaaucgaauuaagaagggauaaggggaacuugcaagcagguugcuacagguuuaauggugacccuaaagagaucauaauggaggaagaaggauagugugaaucaucuacuuuggucucaaucugauguggccacuagcguuccagauagauaggguaucuaggugucagaguugacacaaagcauuaggaaaggcucaaaaggaagaaugagagaauacacaggaaaaagaaaagcugggucuauaacaagguuuaggugauguucugagagagugggguugggcuggagaaggguaccugcaagcacauggucagaaacuucauguaagaauguagagauugucaucaaggacaggaaggagagugaaaaacaccuucaguggagucucagccagaaguggccaccagggggccagguacaauguuucuauguauggaugacugacaucaaggaauggaaaaaggcuagaagggaacgcugcgaagucuaagcacaaaagucgaaccagcagcaagguucagaagagucuccagaaaauugagguugccagugaggagaagcacuuagaagcagucugcuacagggcauagguguuaagacuaaaaugacugugauauaugucaggaaagaggguuguggaaaguucuuauuucuccuuuaauuucaauaguuaauucuuucagauauaauacacuggguugacagcugucuuucagaguuaggaaauuuauuuugaaauguauuucacaucuucagguauuuugucugcagguaugacuuugaaccucaugcauacagugccaacagaggccagcaaggggacugagaucccuggaaccgaaguccucaauaguugcuaucugucuugaagggguuggaaauagaauguguauccuccagaagagguacaagugucuuuagucacugggccaucucacuaauuugggaacguggaauagaacuuuacaagcucuucgggcuuuacaaguuuuuguuaaauaaucaaguuuuaugcugaugaaccugauuuuauaaguggcuuaaccacucuaucuuagcacugucuucacuauguguacuuaauguucuaauuacaugcuguggaaaguuuguuuuuguuuugcuuguuuauucuguuuuccucguauuaucuagguauuguauauuguuaucuagaccucuuguagcagaauagauagcucauuuuuguguuuaauaaaguuucuucaauggguuuagugaaaauguuuucuaugcuuugguaugaucuucuuagucuauucuuauaaccugaaagucaguucuuuuaagcucugcaguuuccuguuuauuuuccuuuaaauuuaucuaagugauggacaaauaacuuuacugguaaucugauucacauaccuucuguuugggaaucuguuuucuaugugauccauuguugguaaagcuuucuaaaaaggagaaauuguuauacuuuuaaugucauucuaguuucaacuuucuucaccaauucuaucuguauuuucaaaucuuggauugauugccuuaauccauucaucacuuucuuuuguucucuuugagcauauuuauauuaucauauauauuguuauauguaucuuauaacuauauagauuaguuguacauagucacuaauauuuuuuucaaauucuuuaugcuauaguucuuuuauucauauucauuagaugcucucauugugguguuaguggucuuagaggacacuccuugucuuuuuguuucauauuguuucuguuucugcacuuuggcuuauacaccuggaguuuguuguguaaggcuuuuuauuuuucuuuuuauaaguuuuauucauaaaauccaagucacuuuuuuaucuuagugguggcauuuacaguauucaguggaguacuaaguccugcuaggguccaagaaggcaucccaacugggccugaagcuuuccauuggaguuguggaacucucuaugcaguuuuuggguuuaaucagagauauguauuauacccaccuucaucuucauucaucacucaucaccuaagucaucaacuccccucugaagguucagcuuuccccacaccuggagccccaaccuagacuuuaaauuuggaucccagccuguuucuacaacaucccuuagaguugaacuacucucuugcaccagugacuuuaccccaguuaaggacuggucuguccucuuaugucuaagaaauuauuuuauuauuauuuuauuuucaugugugugugugugugucugugucugugugugucuguguguguguguguguguguguguguguguguguguguauagaugcaugugagugugugagugcccaagaaauccaaaaaagccacacuggaucccuuguagcuggagugaggcacaguuguaagcugucggagguggaugcuggguacuaccugcuaucauuugaaaaggcacucuuaaccacuggacaaucuuucuggccccagggaaugggaauguccuuuuauguccuauauugaacuuagaauuacauaauacuuaaaacacuccaacuucuaugugauagugaagauauuacauaauaaauuaggauacauuaaaagaaagaucagaaauagacagaaugggaaauuuguuuuuaugggcauucucuauguguauuuguguauagaaucaugaaauucaaggaaaagacguagauuggugcaagcaaauaaauuguaacuagagucacaggaauggagaagucccucaggcaccaaucaggaugugaaauagaaaaauaaauagcaacaagauuuaaaugcuaaaugcuaaauaacuaaguaaaggucacagcuagaaugacaucacaguauagggacaaagagauuaucuaaggguuuccauuucuguggagaggcaccaugaacaaggcaacucuuguaaaggaaaacaauuaauuggggcuuacuuacaauuucagaggucucauccauuaucaucaugguggcaagcauggcaucaugcagguaaacauggugaucggggagcaaagaguucuacauuuugaucaggacgaauccagaaggagacugucuucgauagucagccaggagaauagucuucuccaugcugagcagaacuugagcacuaggagcccucagugccagccuacacagugacaaacuucuuccagcaagaccacaucucuuaauagugucccuuccuaugggacaagcauauuaacaccacuacaguaaguguaagaaagcaagaaaaaaggaaaaauuaccaauguuacuaaaaauuucaaguaauauaaauauaccaaacaauauaaauugagcuuaauaaugauuuacuaauugcuauuuaaaugaucacaacccacugacuuucagugaaguaacagaacaaaucccaaguaaagaaaugaagugaaagccaauguauuccagguagcucauauauguaauuauuuccaaaacuuuuacgcuaguagaaagaacagugcuuagagagugagugccagggaaacacugaaauacaaggaaagaaauggcugguuaguucauauucauguauugacuucauaguauguagagucaucuuuugugauaaccaaagcaaaaauggugcugaugaaaacacaggcaaacaugucauaguuauaaauaugaaauauggaggacuuuccaccugcuagauuguauauucucuuugaaguaaaacguaaacuauucugcgaaugaaaaaaauuuaagcucuggugguuuagauguaggaggaagaugguuuuguuggaguugaguuggguaaccaauaguaacauuguauuggagccuuauaguccgugguugucuuugaugaaggaagaauuaacguaaaaaugggaaagcagagagccaggggucaagaauuguugacaacaaagaauacaggauaaaacaaaugauaaaguagcaauaaagaagauaacccaccaaaauuguaaaagcaucaaaaccaaggacaaagcacucaugagaaacagugcuagggaaagguugaagcauggacuuuauggagcacugaagguccucaagagaagacaaagaagcgagggccacucaggcauggacagagaagcaugagguugagacugaauugaggagagaguacaccagaggaagaacuagguggagggacugaaaagagggucagaagcaagcauucaguaguaaaccaugagugcguucaaagggaacucaaacuugaugcagcagagugagaagcacugggcugagagagagcugugcagaagugaagagugaacaacgugaaguccuugcuaggaagugauccacuuacagauuucuacuguuccauguccuguuagaagguuuuguuuaucagaucuagccuaaauucuuaaauugaauucauaacucuauucuccuuguuugucagauaauggucuuaauuuccacuuccaauccuuugucucccugaccuagcagcucuucacagagauuagucuaauauauauuuauauucgugaaaguuuauuuuaauggugcuauuaaaaacaaugacaguggcuuacauacauggauacuuuauugauaaaauucucaaagaaauuaaaagauuuuuuuuaaguaaguaauuucugagauagaaauucucuuuuucuagauagaaaaaagaggucuguuuuucuaccaugcaaauuugagaaauggaacucagguugucauacuugacagcaaguaccuuuauccacccaccagucccucacugucaaauucuauauuugcagucugugacuaaaggugauuuccauccuacuaaaaguaaacaagaaaccaaagaccagaauaucuguaaggagaacucauuacagucagggaagacuuguauuaggagugacuuaaagguuaauuaugagggaacuuagcacaacuuaaugagccuuauaaaccacaggcuguuuguaauuucacuuugucucucuugcaccugaauaauucauuuuucacuuuaucugaaugaaauauggaguaauuuuucaguuuaguaagaaaauguuaccaaaaagucgguagaacaauuguacauucuguuuuauauaagccuucaaaucucacuaaaauucucauacuauguaugaggagugcuauuuucauauuaaguaacuaucuauauugucuugauacugauuucuuuuuuuuaucaauaauaauuauuaccucaaagaaagcauaguuagccaaguguagugccacacaaccgggauuccagcaccuuacuuguguuaagaacugaacuguuagacagcaaugaucaaagcaucaguaugucccccaaauccuuguaucuguagguaauuaacaaauguuuaauuaaacuuaaaauccucauuuguaaagaacuuacugguacugugacccuagccaaaauucuauggcuggaaagaggaaaguuuacuacuacaauguguguguguguguguguguguguguguguguauuuauuagauuuuuuuauauauuagauuuuuccccccacaauuucuuuucauauuauaucucauugcacccucuuccuccucuccucuuacucauaccccugcaaaucucuaacuuauuaccccauuccucuuccuccagaaaauaggaagccccccccccuccccgggacaaggcuugauccuagaugacaaacaggcagugagcagcugcugagggauggagaaccauuauuuucuggguugagaauccaacccuaagugaucaacccuaagcucauucacagaauggcgacacucacugaacucuguaggaucucucuuucucaaaaggauuuuuuuuacacauuaucuuuauguaacaaaagauaauuacaguagaaagaucgugaguuugagaaguugguaaaggggggucugagagaagcugaagaagugaaaagaguggaaauaaaauaauuacugcauauuugucuaugagauucucaaguuaauuaaagaaaaaagaagaguuaggggauagccugggccacauacugaugcacugucuaauaucgaugaagaaacauagcuacuggagaaaacauacaaaguuaucuuauuugguuacaauuaaaauauaaaaucacauacuaaaaucuuauauuuuguagucuucaaaaucgauugugacuuugagaaagaaaauaguuugacauugugaggaauguauuagagacauuggggaaaaugcucgacggccauuuuuuuucuguaagcauccaugguauacauauggugagcuacgcaaugccuuagguaguaagaaagaaaaacauaucauguguguucuuuugugauuggguuaccucacuuagaaugauaucuuccagauccauccauuugucuaagaauuucauaaauucauuguuuuuaauagcugcguaaguacuccauuguguaaauuuauacaucuucuguauccauuucucuguugagggacaucuguguucuuuccagcuucuggcuauuauaaauaaggcugcuaugagcauaguggagcaugugcccuucuuauauguuggagcaucuucuggcuacaugcccaggagugaaucuucugguaguacuauguccaauuuucugaggaaccaccaaacugauuuccagagugguuguacaagcuugcaaucccaccagcaaugaaggaguguuccucuuucucagcauccucgccagcaucugcugucaccugaguuuuugaucuuagccauucugacugaaaaguggauauuagcccagaagcucaguauucccaagguacaauuugcaaaacacauaaaacuccagaaggaagaccaaaguguggauacuucaauccuucuuaaaagaggaacaaaauacccauggaaggaguuauacaaagaaaguucggaacagacaccgaaggaaugaccauccagagacugccccaccuggggauccaucccauaaacaaccaccaaacccagacacuauuguggaugccagcaagagcuugcugacaggagccugauauagccgucuccugagacagcucugccaaugccugacaaauacagacguggaugcucaaagccauccauugaacagagcacagaguccccaguuaaggagcuggagaaagugcccaaggagcugaagggguuuguagccccauaggagaaacaacaauaugaacuaaccaguacccccagagcuccuugggacuaaaccaccaaucaaagaaaacacauggugggacuuauggcucuagcugcauauggaccagaggauggccuagucugucaucaaugggaggagaggcccuugguccugagaaugcucuaugccccaguauaggggaaugccagggucaggaagcaggaguguguggguuggugagcagggcaagugggggaaagggauaggggauuuucagaggggaaacuaggaaaggggauaauauuugaaauguaaauaaaguaucuaauaaaaaauugucaaaggaagaaagaaagaaagaaagaaagaaagaaagaaagaaagaaagaaagaaagaaagaaagaaagaaagaaagggagagaaagagagagagagagagggagggagggagggagggagagagagagagagagagagagagagagagagagagagagagagagagagagaaaggaaggaaggaaggaaggaaggaaggaaggaagaggaagaaaacauuaaacccuaagaacuuucuuggccuaagaaugagacuguuuauacauaaaaauacuuggcaaauggcauucagucauuaaauuaucaacagaagggaguggucuggggauaucaauagguuuagggaauauuacuuuuuaaaaaagacuuauuuauuuauuuuauuuaugugaguacacuguaguuaucuucagacacaccagaagagugcauuggaucccauuacagaaggcugugagccaccauguggguugcugagaauugaacucaggaccccugcagaguagucagugcuuuuaaccacugagccaucucuccagccuagaaauauuacuuauaaugugggacuccagacaggaagacuaugaaaugaagcaaugagagacaaaaaacuuucaugcacuuagaaauuugauguuaauagagcaaauguugauuguuagaacagaaaaugguuucuuaaggauucaucacaugguuccuuccauacucuuuuuccuccuucuuucuuccucccucuccuacuuuuucuucuucuuuccauuuuccucuuuucuugcuucaaguuuacuuuuuauuuuauuucucaaucacaacuccccuggcauucuauauuuuuguauuggaacgaucaauauuuggccaacaagguaauuuuaaaauauaaacauaugaauuuguuuggugaggugaaauuuuagaaccgagagcuaagucauaucuuuuuugcacaaagggagaauagugcuuucucagacacuagaaacugggccugaaagaagagagaacuaaggauuaucacaugauuuauuuaagauuuucuucccacauguccccaaccgucuagguuuucuuugcuugauguuuauuuagagagaguauagcaugacucaguaaguccaacuccacaguguccuaagcagucuuaguaaagugaacuucacugucugcucucccugaucuuccuccucucacugcaucucuguucacucuuccuguucagcacagucaccugcaagaauguucucaagauggacugaugggaugggcugugcacacacacacacucacacacacauacacacaaacacacacauacacacacacacauaaacacacauacacacacacauacacacacaaauacacacacacagacacacucacacacacacauacacacacacacaaauacacacacacacacacacacacacacacacacacacacacacacacuccagugaggacuauuuuguuauauaacucaguucuugcuuuuguagggaauuaagguuuaaauucuuuugguauuuuuuuuucucaguuaccugaaugaaugguauuuauuugcaucuucccauauugucugcaaagucuuuuuccuacugauaggagaaaagagaaacaugccagauugaaacaacuggaaaaacagacugcugaauuguaaaugauauagaaugagauuuacacuucaacaauugguuauuacuagaaguauuugcaucugugcauagucaauuauuggcuggcaaagcuacaaaauccuuauauauugugaugaugguuuguauauucuugagccagggaguggcaccauuuggaggugugaccugguuggaaugggugugucacugugagugugggcauaagauccucacccuaguugccuggaagucagucuuccacuagcagccuuuggaugaagauguagaauucucagcucugccugugccaugccugucuggauacugccaugcucccaccuugaugauaauggacugaaccucugaaccuguaagccaacaccaauuaaauguuuuuuuauauaagacuugccuuggucauggugucuguucacagcaguaaaacccuaacuaagacauauaugcuaaauaaauuuuauugagguguaauaaaagaagaaaucugcuugcuaauuugauaagaacaugaugaguuucuguuguuucauuuauuaagauucauaauaggcagcuaacuagaaaaggauaaauuaaugucauauacaaaaucuaucaucaaauacuccacauucuaagcaugggauuauuuauaacaaaaaauucucagaaaauaauaauugguuuauucucuuucacauggaaagaauauuauauaaauauuuuauauuuuuucacauauaaagaauauucccuuuuuaaaaauuaaaauuauagugaacaaauugguuguaggcuauaagcuuaauaaagauauacaccaaagaaaugucucuacauuuauauuuuaguaccuucucauucuuuccauaguacuauaaaauagcauugcuucuuggugaaagucuuacugugcaauugugaaacaaauauugaauuuauuucauagugcauacaaauccagcuaaaaaugcucagaggucugcuccagcccugguuuuuacugcuguuaauugacaagucuaauuguacagcaguaaauuuggagcugaaaauuugcugucauugaauggaagaaauuuaauuaggcuugcuuuagcucucuuauuuuuuucauaauaaaauacaaagaaucuuacaagcaaaugccuuucuuccagacacuaaauagaagacaaugaaguuacagucuagaguaaugcuuggugcaaacaaaauuauuaucucacauaaaaaugaaguaaauggugcccucuucaaaaaucuuguauuguaauaacacuaucucuuuccuaaccuccacuugugcauaguauuuucaggcuuauucuuaagaaaagggggagagauggaacagcaugggauaaaaaauauuaaaguuauuaguauuuaucugccuuaagccuaaagacuaacauauacaccuucucauguuucauaucagcaugaagcuuagcauuuguagcagcuagagcaagaauuucuggucuuucuuccuugcuaauugaaaugagaaaguugguucauccaacguuuuaaucaguguccuauuggcuaugaagacaccacuaccacagcaauucuuguaauuggaguuugcauacauucaaggucuaguccauuaucauuagagcaggaaguaacguggcacacaggauagacauggugcuggagagguagcugagaguucuauggcaggauggccagucagcaggaaaagagauccuggaccuggcuugugccuucaaacccgcaaagcccacuaucaguggcacauuucuuucaacaaggccacacaccuccugaucucugucaaguaugaccacucccuaaaguccaaauauuuaaauaaugauacuaugggggcaauuuccuauucaaacuaccaccuccagaaaucauuguguuaugcaaagugcaguagcaucaccuagcccggguggaaucugccugccuaacucacccucaaaaauuccuugaagauacagagaacgugaugguaaaaagaugugcaggggcuggacgucgucaguauuuuagaaggagaaaguacauuugauauggguccacagagaaccaaguguaaggaaggacuguguguugcauaaacaucacuuaagguaaaauggcaaaauuaguuuuaaauucaccugcacaaaaauaaauaaauaaauaaauaaaagaaacauuuauauuuugggggaaaagacaguagucagguacaguuaauuuaagaccagccuugcauuagaaaucauuuuuaacauuccaaguaucucacaaauuguaaugauuguaauuauuuucuagcugcuaauugcucaaauuauucacugaguuagggaugcaaaaaucucaguucuacaauaaaugauuaaauggccuugaacuuaagugauucaaggacucaaauccuuaacuguagaaugggaaguuagguccaggugaaccacuagagaaagccucuuguacuuuguuuguuuguuuguuuguuuguuuguuuuggguauuuuuguuguuguuguuguuucuuauuuuguucuguuuuacauuuugugcacaccauagagcgcugggugcuuuggauguuagaagccaguuaauagcuguccuuaauaccagaacaaauauaauuuaauaaccaccaaagucucucuguuagggagggagagguuaaaugaauaaguacuugauagggcauuaaaccaacucugacugcccaagcuuuucaaauuuuauaguuuugcuucagguaaguuauacaguagcagaagcugagcauugaaaaugaaugcuauuuacuccugaaucuuccacauuuauguuggccauaugagugcauuucaauaauccaaacccuggagcagguaugggacagcuuaaauuguaaaauauuucauguauauacaguuccagggccuauauuuuuuaaaggacuuaguagauauuaaaauaagaaacauguaagucaccacauauacacuaguauaaguaaauaaaaauuuaaacaaguauuuugauucugagucuaaaaaacacacaaacuccccuaaaauguugguucucugcuuuuaagugauuguacuuuaaagcauggagcacuagacuuugaacuacuugaaaggauagauugcuuucauuacaaauauccuaacagcauuuuauagggccaguacuccaaagacuuuguuaaauuaauauaauucuuuaucaguagaauacauucacuuuaaugaggaacaugauuacuaacuuagaugauguguaguaaaguuucaaaauaauaaaaaugaacauaaaaguguucaaugaaacauuuuguguauaaaguaaaaauuccaccacacuuugaaugcaaacuagauauuauuuaauacuugaagcaaguguuuuuuuuuccuacucucauuucacugcagcugagaaaugagccuaccuccaaucgaauauagcauuuuuagaaaaagauguaguuuugaauucuaacaacagccaaccauucucuuacuuuauuuuaccuuuaauuuuaauaauuacaugucucccacagaagcuagaucuuuuucucacgugaacccugcuucucuugagacauagguccaauaguaaaaacacaaaaagagaaaugguauaaaucagaacaucagauaaaguccugugagaaauccucaggucauaauuucucaccgggcgucaggauuauggagcucaucacagagaaggcauggcuacgacgccuggacuuucaaacaugaaggguaaggguagcgaaugaggaguagcauaguccagguagagagcgcaaugugaacacauaauauuuuucauguguccaauuggggugcugaucacuaagcuuuggagagccaccucuuuuagggcuugaggaaaauuuuaaucuucaggccuaaagaaggcuucaaggguuuuauuuuuauuacuggaauaagagagcaaagggaguguuucagauugauucggcagcuguguuuacacauggauugaaacagauguugcugcuucaacaacuccuuaaagcugaaaaaaguuacagcagcaaacacuaaugccagugcgaguagaugagucacugacaugaagaccaccuccuuuuucuagaggaaccaggaacuggguagaccuggcuugcuacagaugacuguaauaaaaauaugggagucaaacauggugccaaacaccaccaccacauucucaguguagucucuuauguuuuacuuuagauuuucaaagcuauaugauucauacugugguuugaacuaugccauuuggauacagaaggaaaaguaucguuagugaucccauaauuaaguuugcaguuaguuagaaaauagaugcuaauucauguuuuggaaauaugguuuccuaagucauuagggcuucauaacaucuagaaaagguuuuaacauacagucauuuuggaacgauacuuaaauaaauguuaaauuuaggcuauaaagaaaagugaggagaccuguacuugaggcaaaaaugcuuugguuaaauuuuauaguauuguuagccuuaggguaacuucuacuucauaggacagaucaucauaauuacauauaauagaauuuucucccaaaugcauuaaacuguccaaaggagauaaucuuauuuuaacacagagggggaaaagaaaucucucaaggagaauguaaaaaauaaaauucuacuauuuguucuuucuuuacugcccaaggugaguggaaauucuuuacugccgcagaccuuuugggucccugugucugcguggaacggggucucuugacgcgggugggcaaagcguggaugaaugacagacagacacacacgcaggagaguuuguguggaaucugaauguaauuuuacaacucgagcaucagacuuuuuaugcagaggacaauaaggaaguugggugauguugcgcgcgcucaacaggccaggaagaacgacgcugcuacaggauccuucugcacacguuuauucaguccuguuucuucuuucucuauaucucccuuguucauaucuccccuguuuauaucuccccuguuuuuauaucuccccuuguuuauaucucccuuguuuauaucucccccgaacccugggccucucacucuuuuauacucucaguucccauccacgcacagcaggccacgccaccucaccaggcacgcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucucuggcgccuuugggacugccgccacacccgcuccccacagggugacauauucgcaagguacaauugagguaaccggaaucuuacauaaaacagaggaauguaaacacaaaaggucuaaugggaaccacccaggauagaauacauugauaacagcugggaucuacaagggcuccaccuaaaauucacuaaucuuagaagccagggucaagggcuucggguccuugccacaguuccuaauuuagucucuuguauaguccaccuuccccuuaggccauuguaaauacguguguauggguauaacucugcuauaguaucuauucugguuucuccuuuggucugaaacuuccuucuuuuuaagugaugguaaauuccuguguaagggagugacuuagcuuuuacaaucuugcugaauucuaaacccuugaucuuggucaaggacacccuuggacuguuggaacacuggcggaaggcuuuagccaugucagagcacuuauaggaaaauacugaaagagagcacguggauccauacucuagacuagcacgguaauggaacuugggaaugaaaaauuaauauauggguagagaacacuagacuccaggaggagagcuuccuugaaacucuuuugccucaugagugacuuuuaagccuuucugcuuguccaguugacucgaccggagaacguagcacuuuaccugacgucagaccaaaugcacagaccuugagggaccgacuuucccaucagcccggacuuucuacuuccuucauggcucuguauacguagccccagagcacauucauagguucgaagaaacauuccccacuauuuugcagaagaaagcuccccuaaauucucaggugacagagcucugagcagagaugcacuccauacagacucacaauccacauuucucaugggcuuugaaugcuagcugggauauuuugggcuuaaggaauauauuaucuuuucacuuucuccagagggcaaccuuccaauauaauguuauaaauauaagagcaguuauguaauaaagacauaguugugaguuuggaggauauuuuaaaucaccagaaagggcuucuuuucauaagacauucucucagcguccauaguuugagggagaaaacaaugagaaacuuaaauaaaguucccuuaaaacuuaaauaaccuuccacauauuuauaaguggcaggaucuuuggagaugaaauuaagaagaguuaaaaggugguaugggaagacacuuuauuuccauguccaauuaaugccagggccugugaggaaaaaaauguauguauuuacuaccauugaaacaguauccaugggaagagaucacuaucucagugugaauggccauagggaagaacccugccacuguaaggcugccacuucccaguauucguucaugccaucaacucuugucuucuaguggcucaucuuucacuggauuauuuagaugcugguaaugaaacauaaggcaacaaauucacccaagacaucuugcagcuuggauuugaauaaugaucuacauuuuacagaugggcaucacuccuaaggcauccggcgcccacccuggcuucuggggugcuuugucccgcuugcagcauuaagcaugagcgucucuccacucauccagggguccaaaagcugcaggaggccauguccauuuuauucuuugaaugcucugauuuugaaacaaaaguaaauuaaauuuuaauaaauaaaucaauagagugcaucucgaauaaucccggguaaauuguguuucacaugauccuucucaaguauucuuccuuguaaauaccauguuuaagaggaagagacuuagcuggguggugguggcacacgccuuuaaucccagcacuugggaggcagaggcaggcggauuucugaguucgaggccagcugguaaagagugaguuccaggacagccagggcuacacagagaaacccuuucucuaagaaacaaacaaacaaaaaaagaggaacagacuucaucgggacugcucucuaaaggucaguaugccuagguuugugguacacagacccacuuggugcaugcuuaugcauuaucuccauacccugcuaaguauuacucauuuaguauccuucaccaccugacugguagaauuauaaauguaaauauuacagaagaguguuucuaaaaaugcauguaccuucaagaccugaaaauuauaacaucaaauguguuuuuauucccacacaugcaacuaagugaaagcuaagcuugacuucacacaggacaugcacagcacaucuuccaugaggauuguguagaaaucuauuugggugcaguacuaauagaugcaaaaccucuagguaugaaagagacacuauuaauucuugucagaaaaggaagugagaugccuucgaauaaauccaucuuuucauuacuuucuuuuacauggguucuaaacuaagcuacuuacacaauuucuuaagugccauugguaaacgacaggguagauuuucaguuuuguagaguaagaccugugaacaacuucagaccguccggaguuuggauccuuccuuugcacugauguacucugcccuuucaccucacucugcuccucuucuccaacacccccauuuuuuaauucacaaaaggauauaagacauugacuauuucaaguacuaguauauuucaaauauauauauauauauauauauauauauauauauauagagagagagagagagagagagagagagagagagagagagagagagcgccucuggugcauccuuuuuucucuguaauuucccccuguuuaccaauucuuuucuuaugucauauacucugauucuaguuucgccuccccccuugccucugucucucaucaggaaaacacaggcuuccaagagacaacaaucaucauacaugacaaaaugaauaauaagaugaaguaaaaacccauucuguacacagcaaccaaacaggaggcaaagaauuccaagagcaggggcaggagucagagauccacuuguucucacagucaagacucacauaaaaauacuuugugcagauccauguagaaccuuugcuuagcugacucaggguccuuauucuccugguaucuuccauucccucuggcuguuacaaucuuuuugucuccucuucugugggauccccugaagucuguacuuggacaccuucagacacuuucuccaugcaaugccagguugugggucucuguaucuguuccugucugcugccagaugaaucuucuucugucauggcuggauaaggcgcugaucuaugaauacagcauaauaucauuaggaaucauuuuuuuuggaccaguaggguuugguuuuaaacgucccugccagagugcuagccacacugccuauugcuggguaccagagcuacauucacgcacaccccagagucaaacucuucuacaugaaaucccacuucauguccuagccuuggugagcuuuggccaccaccaguucuguugguauuuuccaucugauccugauucucucauucccuugcaacuccacauugucacagacuaccaagccaacuuaucuaaucucaguuucauggcuaccuaagcaguguucaguaugaauuccuucuuguggagugggcagugagucaaaucauagguugauacgcuacuuccacgaguucugugucacaauggcccuaacauauguuucgcaggaagcacaaauuauaggucaaagguuuuguggcuggguuaguucccauguuucucuuucuguagccuucagaguaccuucccucaccaaagagacuagaauauagaaguaaaggcuccauguaggcauuggcucuacucuguguucaaugaguuguguggguguuguccucagugaugaggccccacugucaguuugcauaaacacugacguaacagccuggauuuuggggggauuuccauagagcugcuguuggcccaaaacucauuugaauguagccuagucccuccacugaaagucaccacuggcaacagaagauggacuguuaagaugccauauccaucacuacuaguaguucucauucagagauuccaaaaguuuccauugcaauaguuuuccauaccuuuucccagagucccccaaauccauauaucucugccuucccucucuuucuucacaucagcuccccacaacuugauuccucagcucuacucuccaaccaacccccaauuacccauaaaauccauucuauuuccuccucccaggaagauccauauaucccaccuggaccccuucucuuugccuaaccuuucuggaucuacagaucuacagacuguaacuugguuaucaacuucuuucuuucuuccuuccuuucuuccuuucuuucuuucuuucuuucuuucuuucuuucuuucuuucuuucuuucuuucuuccuuccuuccuuccuuccuuuuccuuuuuguuuuuguuuuuguuuguuuguuuuuugagacaggguuucucuguguagcccuggcuguccuggaacucacucucacucuguagaccaggcuggccuugaacucagaaauccgccugugucugccuccuuagugcugggauuaaaggcaugugccaccacgcccagcugguuaucaauuucuuaaugguugauauucacgaaugacugaauacauacauacauaucuuucuggguuugggucuccucauacaagauguuuuuuuuuuuuuuuuuuuuuuuuuuuaacuuucauccauuugcuuguguucggcuggcuuagaaguuuugguuccagagcugggaguguucuugccaggagccacaacaaauaaacuccccccuggucauuuuggguuucuaaagcccuuaaauaacaggcuaagaaaggaauaacaguauuaagaggggugauagauccagauuaccaugaagaaauuggauuuccuuucuauauuggaggugaggaucaugucuggagugcagaagaugccuuagggugucucuuaguacugccauguccugugauuaaagucaaugggaaacuaaaacagccuaauccaagcagggugacaaagggcgcagacccaucaggaaugaagguaugggucacuccuccagaaaaagagccaagaccugcugaggugcccgcagagagaggguugaagaaauauagaauggguaauagaggaagguaguuauaaauaccaucuaaggccauuuaaccaguugcagaaaugaggaauauaagugguaugagugcuucuguuuuauuuuauuaugaacaaauauuuguguaguuauuugugcuuucuuucaauuucuuuaacaucaauuaagagaauaucaauaagcauuugagauacuaaaaaagaucuucccaaaggaaaauugaccuauucuaaauuuauaaugugcuugugauuguaugagggauaguuauauuauguuaggaauauuuaugaucuggucauuguuucauuuggacaugagauaugauuugucaaguucacaaaggauggauuguuuuggcuguuccugguuaucaacaugacuacaucuggaaugaacuacaacccagaaauggagggcauaccugucauucagauuuaaugcuagaagacacagacuucugacacaguccuucacauaggauaacacaagcuuuucauccagauuuugaggcuuaguggccgugaaaaguuuaagcuacggcaagguaguauaugccuagaaucagagaagaauaagguaagcagaucucugaguuaauggacaaccugggacagagcaaguucuauaucuaggcauggugguacacaccuuuaauuuagacuacaccuucugcuggaggccuccauaaggacauuggaagaaggaagucucuucccuucuuucuuucuuugccugcuuauacuugcuugccacuuauuucuucaggauuccagcuuauacagaacaccauuggaagcagcuagccucaugcgauugaucaaguacuagauucucagaccucucauucacaguugcccauuguaggcuuaguuggacugcagacugcaagucauuacaauaaauucacuuaauauauggaaauuuucuguaaguucucugacucuagagaacccugacuaauuuuuuuuguauugauucuauuuucaguuuuaguucuugagcaguuuuauugguuuccucuaauuacuauuuguauuuucuugaaguucuuuaaaagauuuauuaauuuuucuccauuuuuaaaauuuuuuucuggauuucauuaagagauguauucauuucuucuuugaggaccacuacuaagaucauauaguuaguuuauguguuaguauauccauuauuggcugagguagauuagcuaagcucuaguggagacauauugcccuggcuguuguugcuuguauuuuuaugcugaagucuaggcaucuggguuugggauguuccuaagacuaggugaugauuucugaauuuuuccauuguuggagcaugaugggaugguuguuuaaaggguuggcgacuauuggugacauagcugcugucacugagucccugagggcugucuggagaagcaucuguuuggugacaauucucuccuuugcuuauuauaaaaggugggaaauaggaacgggaauggggcaugaaggggacaguguaaagagcacuguacuuuaacacuguuuccugaugucugagagcauccaugucuuuugggacacaugaagacuggaaugcuagccaacucuuggaaaagcaggcuguuucauuuguuaugcaggaucuguggaaccaucuggggcuaggaauggacaagcccaguugaagcaaucugugaugcuggaccaucuaggaccagcuccuuugaagcuggaacauauaaauuagaggcagaugguuauauuuuucuuagguguacauuugaaaauuuuaggaccauggucuugcuaguugauggaagagaguccuaaguccagggaaagggugagaaguucacauccucaggaguaaguggaaaaggcagguaggaaacuaucuguugauggacagaaguacuuauguggaaucuauuugacccauuagaggugcaaucaaaccaauucccugaaucuuacaagaauuauuauuauuauuacuauuauuauuauugaaucuguuuuuuuuuaaguccagucauuuuccccauccuggucuguccugugacaguucuucaucccaugcccccugccucccuccuccaagaagaugucccuagcccucccccaacccccacaccaccagaccucccgacucccuggggucucaagucucugaggguuaggugccucuucucucacugaagcagaggcaguccucugcuguauaugugucagggaacugagaucaggucauguaugcagccugguugaaggcucagugucugagagaucucagguguccagguuaguugagacugguuuuccuaugagguccuccuuggcuucuuccagcuuuucccuaauucaacccuagggguuccuggucuucuguucauugguugaauauaaguuuuugcaucugacucuuucagcugcuuguuuggucucucagagggcaaccaugcuaggcuccugucuguaagcacaccauagcaucaguaacagugucaggccuuggagccuccccuugaacuggaucccaauuccacuugccacuggaccuccuuucccucagucuguucuccauuuuugucccuucaguucuuccauacagaaacaauucauacagaaacaauucauacagaaauaauucauacagaaacaauucuggucagaguuuuugacugugggauggcaaccccaucccuccacuugaugcccuguauuucugcuggagguggacucuacaaguccccccucccuacuguaggccauuuuuuuuuaaguuuucaaaaagacauaaguuuuagaaugcuaauggcauuacuauuguuuguaaucuguacugaaaucaacauaguguaaaaggcaguagauccacaucuuugagucauaguagaagcucgggaaaugauuugggguuaaaagcaugaacacccuuuaaggugaguccaggaagagcagaaaccuucuauggagcagaacagcaaaagcuuacuugaucuugauuuccaccacaaauacugacaauggcaucaggauauuucucuacccagaaaacuggguauauagagaauaggaagaugucuuuagcacaaugagaagcacuuuuaugucuauacguagaagacaaucaaaaggaauuaggaaucuugauauugugaccgugcuaauaguagucagucccaaccaaugcaagauuaauaacgucuuagaauucuacugaugagugauaaaauucagaaauuuugaagacuuaaccauagugaaggaaagaaaucugaaacuuuuuuuuuaauuuucauauacgguaaguuacuuucuuaucacagcauaagcuuucauacacucagaccuuacauaaacuuuacucuuuuuuuccuaucuauccuuuugccaggagacauugguugauuauagggagcagucauuguaaagugaguuucuuuaaauaaaagaauaguaaaauguuacauuggaaucuauuuugugaguuucaucucucucucucucucucucucucucucucucucucucucucucucugagucugguugcaaguuccgcuguguucugggaaagugagacuugucaucugacuuuuacauaugaugagaacuuagagggccauugaagccuuuguuacugcuauaaagacaaagaaacuaucacuagccuccugaucaacaccauuaaagauauggggaagauaaauuuuaccacaguaagcaggaaguacagaacaauaaauucugaauuuauuaaaaugacagagaauacaggcugucuggacaaccacccuagaauccuucauggucacuggagaccaaggacccaggacagcauaagugcuugucauauccagauuaucugacagauuuuucucauggaguagcagcgugggaggucuggccuaacuuggcuaggcaaguagggcaaucaacucccaagaauccuacuucucaaagguuuggacaguucccuggaagcagugaagguugaaaggguuguuuuucacccaauggccccaccucccaagaaguugugccuaacucuguauagcauaaucuuaaaucuaaagcagaacacagagaaaucacagagauugagaguggaaaguagagaaaguauagaggaggacaguuuagcuauaagauauuugugagaauuuagauaucaagcuuauuuauuuauuuauuuauuuauuuauuuauuuauuuauuuuacucuugagcuguaccaaggccaagccgcuguacuaaaacacaaguccauggaggaugagagagaggaagcugugaaguuggacacugagugugugcuccuacaagcuucagcaggguaucugggagcugaagggaaagaacugcaggcuggaguccaagauagccaggagagagcagaaaaaaaaugaagauauucuuaugggagcagaaggccacagaaguccaagccacagcgauggggagggcacagcuggcuauggagaagcagcagcugaagaauuagacuccagaauuugaagucaaauuuacaagcaaaugaucugauuuacaaggguuagaucaacagcuugguuuggagcagaggcugcugugugcugcugcgugugggcugaguacaagcagcagcuggucuccuccugugccacucaaaccucugugaccuccaccucccaccacuugcaauccuccaaacccuccaucacauucaggucacuuguauuauuguagaauguucccagauaauauugggauucaugguauuguuagucggccacauuugaaaaucuaaaaguuacugaggccagauuugaguggaaaguuuaaaggccacuagauggggaggucuaagauucucugagaaacauaccaaaggggagcaaggcgcuggaugaugaaguucucauaggugagguagaggggagguccaaagccuaaagcccaagauguccaaggauuuagggggaccaaaugaagaaggcacaagucaaacaaugagucauuacagcacaguugggaggcccagagaugagacucuaaaugaaccagaaggugaaaauuaugcucaaaucaaagccucaaucagaggaaaagggcaguuguggguaccacugccucucagaguaucaaagacuuguggaagcauuuacacggacugagaaagauuauuuaucaguagauggcuugggcugcuggugggcaaggguaacaggcuccaggaaagccuaugaucucgucagcaccaauguuagaauuuagugaaagaguaucuuggcagucuaaaccaagugugccacagucagaucacaccacacagcaguucuuauaaacgagauuuauuagagguggaguggggaacaaauggcccccuuaaugugcagacguaagagaaagagaaagacagagaggcgaaaagguagaaagaacacaaaggagcauacaugggguugggagcaccuuuuagagguuuggagacuagugaugacauacuccugggccgaguccuugagggcaggcuggagagcauauuuuucuauagugaagccucauaaaaagucugucaugguagguagggucagucuuccacauccuugacagggcucuaugagccaucagugaaaauauucaguuauccugacuuucuuaacauuucaaucaauuucaauauacaauucucuguuguauauaaaaaauugccuacaauauguaaugauuuaucuuuuuaaaauauuucaaauacauuucaaucaaaauuuaauaacccccucuccucccuccagucccucucaugucccuuccucuaccucuaugcccuucauauuuguaaaaucaauaaggaauuuuaaacuuuauggcgauuaaaggauauguccuaguaucaccuaucuuuauuauuacucuaacucugaaauauagaaaagguuacaguuuaggaauucacggaggagaaaauauaaguugcagcaauugaauuauuucaaagggcuuuucuuaucauuuucaaggauccaucuuguagcuggauugcaugucccuaauuuuucauccauguguuaaagucccaaccuccagcacacaaucauaaugaaagaagagugaauuaaaaugaguuuaguggugagggauuuuaauauaagaagagaccuuguguuuaaaauuauagaaaauaugaccauguggagaauucucaagccaucagagauggcacagagaaaagucuacccugaucacaccguaauguuugacugacaaccucuaaaacuugagcaagauuauuuuuaauagcuuacucaagcuaaacuuugcauuuuuuuaauaaugugaaauaucugaauauuggugccauucauuucugauuucauuuaauuaacuuagaauuuuauuguauuuuuauauaugaguauuauuacccuuugcucauggucauugccauuacucugucucacucuccccucucauaguucucuuucuuuacccugggcagccccuucuauuucaugucauauauauugucuccauaucaagagaaaagcauggcaugugugauugcuugugugugugucugugugugugugugucugugugugugugugugucugugugucuguaugucuauguguguguacacacugccuaauaugaugauuucuaguaucaucuauuuccccgaaaugauauaaaucuguucuuuauggcugauuaaaauuccauuauauaugggccacauguuuugcccauuggucuauuagauauuuuuaacuaucucugguaagugcguucuauuucugauugagaacucuuuccuguaagggauuaugcuucucgguuguuuauuauuuuuuuaaguguccuguuuagacugucacauuuguugagugguguagaagagaacucuuaaaaacugucgugaggacgcugaguugcucuccacaacugauuguuucaggcaggguugaguauggggaagaauucagauuuuguuacggugcuggccaacuggaauuuggccaugcuccagugaguguauggucaacacaauuggaggugguuguuauuuuuagcaggugggggugugguucacagggugagacaaaugggagaggacuaggaaguuauguaaaauucccauaacauuuguucuacuaguguacuagaaaaucuugagggcagguugaugguugaggcugcacuguuuguggccaggugauauuguugauuaccauuuuucuuucaagaacuugcacaauaucuuccugaaaccugaauacuagucagcacgugugagaccagaucaauuucuugagcaccagauaaauuucuucauguccaaugauauaguuaaauggugcauuuggcaauaggguuuugcuguuagguugugaagaguaagcaauggccuuagcaauagacaggugcucugugggcuuccuuugaacaaaaauuaacauaauuuaacacauuucugcuauuggagauuuuacuugguuguguaaauugugaaaugagaaugugguauucuucuucucuucuuugcucugcccuuccaucccucuucacauuuaauucuucuauucuacuauucuacuuucuucuucaucucuuucaaccacuauauuccauuggaaaauuccauuguaaucucccuuggaagauccccgcaacacauuccuuucuggucccuuauuaguugccuaacuucuguggcuauucuaaacaaaacaaacauaucuaaagcuuaaaacuaccaucccuauaucaaagaaagcaggaaaagacuuucugacuagugcauaaguagcauaguuaaccaccuggagcccauugagguaaaaagcuucuguacagcaaagaagaccaccauuccagcauacaaaacgugaggaaagaagaccaccauuccagcauacaaaacaugaggaaaaaagaccaccauuccagcauacaaaacgugaggaaagcuuuaaagacuauacauuuaacaaaagauugguaucagaauauauaaacaagcaagcaagaaaaccaacaaaaaccccuaaagaucaugaaaacaaagaacuuaauuaaaaaacaggauauacaacuaaacagcauucugaaauauauggaaaauauacaaacaagaaacacuuagaauuuuucagcaucguuuacuuaggcgauaauuccaaucaugacaucucugccugcacgagguacuccucacugaagguuccacuccuuucugcuuccauagucaggguuaggagaucauaagcaaaaucacaacaggaaaucucuagcucuaaagucuccauugaauuuggaucuguguuguucuuucuacuauccuguuucaaaauuuaaaaaucuagauuuuuucuguucaagauggcucugccuuuaauuuacaggaaaggagcaguaauuaguuuuccuuuuuguaauaauagcugagggauauucuaucuuacauucuuacauccaaacucacucuuuaucucagcagcaccugaucaaauuacuauuauuuuauuucuacaauaauaaauauguaaauaauaucaauuuaaaacuaaauguagccauuauuaugagcacauuuacacuucuguuuucaugcuguugaaaaaaccacagugacagacaagcuggagguacaguggcaaaauuauucaaacaguaauuucugcuaugaccuucuauuuuccccaaaauucaacuuauauggugcagcugaguaaaucaauaacuugaacaacuuuguaucacaacauauuucuauccaaugagccugaaacuuuaaaaaccuucauaagagcuuucagacacaguacuccaguuacauugagcuccgauuuuacaguguugacucuugugacuauuacagaaaucauagaaacauagucauuuuuauucaacuagaaacagccagagacggaaguucugcaaacccagacaguucaaaugucuuccaucaccacaaaaaauaaguuacagaaaggauugggcaauccaaaagucucuuuuaagaguucaucauugacagacuucaggguuuccaauguaauacaguaugcuaaaaucaauuaguguguccaauuauauuaaaaacuuugaaucagcuuucagauuggaaucauggaauauacuauauuuuuaagagaucagucaagaaguuugaugggcaauauucuaaccagucauuuuaucccuauauagcuaaggagugugcagguacuuuuacaguucucugauuauagcugauguucagucaaauaccucauggaaucucaccaagauuguccgauuucuacuacuuuuauguuauauaguaguaaacaucauucuuuguaccucauaugaugauuaaaauccaucaaacugauauucuauuuuaaaaguacauagcauaagugaagucaaugggaauaugcccauuaauuauuuaacuuagaacaauguuuauauaagauagaaauuauaagagaagagcuuggauaacauugcuauaaccacagauuuuauuaucuucauaauuacagguuguaaaauacuauuuaaaaguuauuguugagaucaccucuaauuguuuuuuauaauaauauuuguuugauuacuaauaauuaacuauugaauauuguaauugauacagauaaaaauuuaaagcauagagaaaaauauacccuuagguaaauagcuuuguuauaaauauauuugcaauauacauacauggcaaauuuauauugcccuauuauacaaagugucuacaguucucugaaagaagacacuaguagaucgaaggacaauaaucucugaguuauaaauggaggaaaauauaaggaaagauucuauuugaucauuagguacugauagaaauuaaaauuuuaagacugaguaauugucaccaguacauccauccauuuccugcuuuugagaacauuuauauaaaaagaacauuuauuagcauuucugagaauuaaauguuuaaauuauccuguacuguuuuuguuuaguaauaucucaauuacuuuuuagauaucauuacuuuucuauaguaaauucuuuguaagaacuuucaaaaugucaaacauaaauaacucaaaauucucugacacaacguuuauaucccgugaucucauguauuuucuucuaaaacacaagaaaaacauacuuugcaaauuaauguaaaauuuaugaaaagauccagcauauuagcaugucacuuuauuuaauguuuauuuaauauauucugaggagcucaagaugcuacaauauuuucagugauuuuggcuauagaucugaaaacacaguagacauaauuauuacaucuugcaaccauaagagaaauccuagguaaaauuauuuacccuaguauacauacaacaggaauccuaaaagaaacaguaucuaguuuagccuuuucagccagucaugguuucauguuuuucucuaggggugaucauuuuucacucaguuccuuuggggagaaaauuuaguugaagucuuugcuuuuuacugucuugguuuuuuuguucuaacagaggaaugggauuuuaaugggaacagagggaauaaagaacauuuccaaccaaccuucucugacaguuauuuuauuuaaagcguacuuugaauugagcauacuucaauucuuuagauuuacaagcaguaaaauuuacacauucaaguuccaacucucagcgcaccugaacaaggggcaguuucauuuacgccccguaaacugguuuugugagaggaugaaaagacaggacuguuuugaaggcagaagugggaaagaugagauugacuuccuggcgcaggcugcccuaaacaaaacuuacuuuugaacauauuaaauaagccguuaguuuugcauggcaucuacaauguucauuuucauauuacguaauuauuuacguuuuguaucuuuuuacuuggaguuuaguuacauaauuuguuuagucacaaaaauaauaauuuacuugagagccuaagagaucaaaaaacucucuagccauuuaauauuuuacuuuaaacaauucuagguaaaggcaauauuugaaguauauaacauuaaacauauauuuguuucuuuuuuuuuuuuccuaaugaguuucuuuucuccuuacaacucuuuucaaguauuacuauacaaugucagugaucuccaguguugcuuuugccaauuauacuucuccuccaaucaaccuggcaacagugguguguucccugcuaucugacccaauguucuguguucccaaaucaacgacacacacaugcagccuuauauuuuauaugccuuaaacaguucaguggcuagcacccuaaaaccuucaugucacuaacaccuccccuccaacauucugaguuauuacuuacaaaaaucuauauuccaucuuugcuacccuagaccaaaucgggaacacucugggaccucucuucaccaccccuuacaugauuggcaugcucucgcuucugcacuucuaagaucuggucuuuacuccucucccagcacagaguucugucuauuucuccucccucguuccccuuaccccuuucucccucagucccuuucccgugaaucuuaaagucccaccucugucucucuguccagccauucgccaccugcaacuuuauuugccaaacaaaaccaacugggaggagggaaccucagcaucuuacauguggauucucaugccauuugggggacucaaguaacauaauacacguguugagcucaauccacaacacuagagcuuccugaagagcaaugagaggacuagacagagaaccauugcacugugcuuccuugggacagucucaucaaugguuauagcagaggagagaaagacucagaaugacagaauccuuuuuggggcauaagcaacuccaauccuucccuaccagcuggauacuaagccaagagacuccaggaaauguuucauaucuaaacuguaccaguugacucuaacuauuccugaagaauuagguccagagauacuaacacccauaacuacuugucucucuuauauaaaauguagugguauuuauauacuacccaugcauguucuuuuaucuuuuaguuauaccuggauuauuuauagcuaauccaauguaugccauuggcacaguauauuuauguaacaaugacaagaacacaucuguauauguucaguacagaagcaauuuuuccaaggauuuuucuaauccagauugguucaccacacaauguagaaucugaauauaacaaguaauguuuacagauucuguuuauaauuuugguacauauggcucuaagugauauuugauggaagauaggcuuagaaaccugauaguaucaauucccaugggaguaaacaguauuugccucucuuucuguuuccagggaauuccgauaucauguaugugagauuguauaaugagaaauaauucaaugguauuuagcaguaagacauauuagugauuaaagaaaaaaguuaacaucaauagauacccuagucaaucauggaagguuuuuagauucccugcuauaguauaauaguuuucaaaguuuaguacucauggaaauaaccuggguguugcacaugauagaaauauauuucaguagguuuggaauauaggaugaaauucaauuccaauaccacacuuugagaagcaaguaacuaaaacauuauugcucagugcagaagcuacugaugcuauucaggucaauugucuucguacaaauuucuacuuguuuuuaucugucaguuauugaaccaaggacacuaacgucucccacuacaagcaaggaugugucuauuuucccuguacuccuccauauuauagugcucuguugucauuuacauauguaauaacuauuucuauuuauguugugcaucaaucccuguauuauuguguaugguuuuauauauuuuuguuuuuuuuuuuuugaagcaccuugcaccuaacacaaagauagcuguuucagccucauauuagucacacuuaacauagcaugucuuucucuauaccuuuaguuuuaaaccacugacauguauaucuaaauuaggauuuaaaaguuaaacuaauauuuuuguaagaauuucauacaugaguauucuaacuauauuauuucuaaccaccuguucccucucacuuuuacucccccaacuccagguuaaagugaccuuuucuucuauaaucaucaucguuaugcacacacaugcacauacaguauggguuuuuuuuaaugaaauugggugcacuacaguuuagugcaugcacauuuagguauauuguuuguauguuuguauaaaaauguauuaaaauuaaauuauuaaauuuaauaauuuaauuauuaaacuuauuuuaaaauugucacuuucucucauugguucaauuucucuauuuuauuucaaguucuaauauucugccaugaucauuguacugguaagauguuccccuaaauuuuguaauugagucuuuaaauuuuucaguucgucuucauuuuagcaugauuuugguugguguuugucuuuauugaauucaguuuaaaggucuuguauuuuuugucauuccacucacccauuuguuuguuuucuuucacuuaaauauguuuauccucuuuacauucuuccagauguuuacagacacccucuuugaauucuuugauuauaguaguucuuuuaaauucuguguuguggguguguuuucauguagguaacugugcuaguuuaaaugaaaauaacccccauaagcucaaguaauuuagauaccugguaccuauugguugaacuguuugagaagaaugaagcuuguggcccuuguugauagaggcauuuagcuaggggugcuugauguuaaaaaaaaaaaaguuaucccacaauucccagugcacucucucugccuccugccgaccuguagaaaugugagcucucagcuguuccugccacggugcccuuguugggcaaucguguacucuaauccuuugccaccacaagcccaauuauuuuauuucuuguauaaguuuccuuaggucaagauguuucauuacaacaauagagcaauaaauaaugcaguaacucuauugaggagcauuuccaaaccacucauaauccuugggaaaggaacaaauggccauucuuuuacaucugugauuuuaggacaggacauguguauccgaauguauuucacugguuguguuucugaugugagauucuagccugcuucuacugagugaaaguuuaguuuuguguuuucugcuaucuaaacuuaguugauuuccugucaggucagucuuccagaugcugccuugaacaugauuugaguaauuccaacucacugauuacuaaggugauaugcgcguccuacauuuuguuuguuuguuuguuugguugguuuuuuuguuguuguuguuuuuuguuuuuguuuuuuuguuguuguuuuugguaugauggcuuugguaaaauccaagaaaaaagccugauaaggcucccaacugggcuugaaaguagaaagacagcaugugguaaggaaccaggaauaauagcuauaaaaaugccuacauguucaucucagacguguuugagucuggagggcagcauguauacagagauggaauguaucagcaagugggccggucaaauuuggauccaaccugggacuggguugagagagagagcaaugaucucaaucuaaucuaugccuggaagggaguauugguaggcagcacaaaguaaggguuggaaaaugcagauccuagcuagacuugcaucuggagaggggugaagugggaagaaggaagagucaaacuaacggagagagcucguagaugcagcuuugaccugauucuacaggggaaacauggauggacaagcacaggauggguccugcgccauccucgucaagaugcagcagugucgauggaacauuguucagaucucguucugcagguucagaguggagggagcuaaauuaugaauuguuaagguaccuucugaauccuuuagcuuuucucaaggcauuucuuccugugcuugauucucuggaguuggaaagugaugcacuugguuuuuugaccuuuacguuacuugguguucucuggacuuagaguuuuguuuuguuucuuucauuuuguaaauuauucucuauuguugcuugaaauugucuauuauuaaacgucuuaccuuuucauguuucaugguucuuuucuuucuuuuuuaaauuuuuuaauguuuuuacacuccauauuuuaucccccccuccauccacccucugacuguuccacaucccauaccuccuccccaguccccugucuccauguggaugcccccaacccccaccccaccuaaccucuggauccuccagucucuugaggguuagguggaucaucucuaaaugaacacagaccuucaagucuucuugacaggccaugaagucuucuacuauauguguauugggagccucauguuucuuuauuuaauucauauuccaguuaagaauaugaguugcucccuaauucucaauauucuggcuuuuuuuucuuuacuuuuuccuuuguauuugaauuuaguaaauuucucucuguguguguauguguguguguauguuucucuguguguugauuauuugagauuugccuccuagaauucaauuuuuucuccuuuuggcuaguccuccuaucuagcguaauacacaucaugagacuaaguccucaauuucagaaauuacuucauuguuuuugagauggaaucucacauuguccagaauggcuaugcacuuguuuuguaucugugauaauuaaucuugucuauuugaugggcuuuagaaucaccaagcuaauaaaccuugaagaaugucugagggaguauguguagauuagguuuguagaggugugaagacccaccacaaacaugaauagcaccuuucuguggacuaaggcugcauaaaugccagacgugauuugagcacugccugucuucuccacuaccugacucaguaugcacagugaccaaccucaaccuccugacaccaggagaucucuacccucagggacuguaccuuaggaaaauacacguauuuaguuuuuuuuuucucuauguuuauacauguauguccagugucuggagagauggaaagagggugucaaguccccugaaacaugucucuagaguuagaaaugguugugagacaccauguugguucugggaagugaaccaagggcuugaacaaggcugacaagugcucuuaacuacuggcacaucucuccagucucuauucuucuuuuucuaguugcuuuuaucagguauuuuauugcaagcaacaagaagcauaacuacuacagaaauuccucauccacaugugucugacuucugcugcugugacuauuaacuuaacucucaugucuggcucugauuugagacacacauuuuucuauagagucauugauucuuuccucuccaaucugcaauacauuuuagaguauaucaaagccaauuuucauucuuguuaugagaccucugaucuucaaaauuuguauugacuacuaaaaugcuaccgcuuuauugcacacuuacaauaucauagugaaaauuaaauacuuuuaaugugcauugcauaucagaauguaugccuuuguuacacuauguuuaaucauuuaaaacuuucaccguugaucuaaaaguuuuauguuucuugcauacuguccugguaugcuuucuauugcuaugguaaaugccaugauccccaaaacagcuuggagaagagaacaugcauuacaucuuacaaauuauugucugauaugaggaaagucaaggcuggggcugaagguagaaaccugauggcugcaacuaaagcagaugccauggaggaaugagguggauucacucucucuggcuugcucagcuugcuuucuuucaccacucaaguccaucuucccagagcuggcacaacccauagagagcgggauacgcacauaucaguccuaaguaagacaaugcuucaucgcuuuucuaccagccaaucuaauaggaacauuuuucccaguugagguuccccuuucccugauuauccuagcauuugucaaguuaacaaaauaguaguaguaguaguaguaguaguaguaguaguaguaguaguagaguaguaguaguaguagaaugaauaauaauaaaauaacuuucacucuugaugcccugucaacuugacucccaaauacaccacucuaaagcauaaccuguuuguuccccaaggucauguuaauaucacaauauaaaccauacuaccauuuugaaaacuccaaagucuuuagcauuucaaacauuuaaaauguuuagucucuuuaaaguaucuaaugucacuuuacaaguuugaugucuccuccuaaaaucuguaaaaucaaaaauuauaucaacauauauaaagaaucauggcacagauauaaaaaucaaagcaaaacaaaacucaagcaguguaagauuaaauuugcaacaaagugucugaguuuauaauauucuggacuucaggaggcuuagccagcucaguuucucuggcuuugucaucuaccgcacacauagccugcuuucuauuccaggcuuucucauuucuacaccugcuaucaucuuugguaaucacuccacaguccugacauuucaguauaguaagucuucacugaaaguaagacugcacuuugaccaguggccucuccuagccuuuccuggugccaagucucagcuauccacaagcugcucaaccauauaauauagaaccuuucaaccauaaaauauagaacggguucuauaauauagaaccuauucaaccacauaauggcuucuaugcuauaaacacuacuaccaccugggagaguccuauacauagucaaaacuggcuacuguauuaauagaaaacagccucagcuucaaucuggaccacaacuucugugugcugaccacaaggaaacacuuccaguuuugucucuuccuaauaacagacccagcacugcauccuguuguggcuuuucaaguccacauuuacaaauagcgucaacaauucuucuagcaucaccaugaucaagugugucacagcaguugucacuuugauacagcuuuccaucccaguuugcugucuauugcugcaggagcauuaccaaaagcaacuugguaaggaaagaguuuauuuuguuuuucaccuugcaguuaauuauuaagagaagucaggacacagacucaaggcagagaccugcauagggcucuagcagaaugaguggccguggagaaaugaugccuacuagcuugcucagccuugcucaagcugcuuucuuacacuauccagcaucaccugcucagggauggaaccaaucacauggagaagaacucugcuacaugaaucauuaauuaagaaaauuaaacaaaauaagcuuuauguguguguguguguguguguguguguaguccaaggucuauauuaucuaaaacauuagaagaagcacauuuaguuaaacuauuaguauguaccuaugaaguagucucaacagcuugguaauauugcucuucuccgaaugaguuaaccugcaaggcaucaaaauaaugggaaguccuuagguuaaagcuuuuguauguuaaacaaguucuauccccucauaaguacucuaauauuaaugugggcuguccccagugagaaagaguuuugucugugagugagcugacagucuaguuagcuccuaucccuauguaauacaguguuugggagcauagagagagaugguguguaagacucuuccagguggcgauaucuauuuacacaacaccugagggacuaaagcacacagauugcuguuugggacucauugugguauaagaaauaaaggggacaaguggguagaacacaaggaucuagaaaucauggacauaucauacacauauggccagaaacaguuuguggcucccuggguaugaaugcaugagagauauguagaaauguguacucugauaggaugaguuuaucauggagggagggagagggguggcaggaagaguacauuuaguaagugaggauuucacaauuucuuccaucucaaagcaaagucaauauuugacuuuuuugucauuugaugcauuuucauugaucucaaaaagaauuugagcuuuuuauggaaaagauagauggaaagaccaaguggacaccuuuguaucugaaacgagauagcauucagaaugaacuggagauaaaaauguuauuacugaccaucuauugauuuaacagaagaaauaguauaugguagguacugcuuugggggauacuggagacuucggaucuuaaggauggacagaauaggagugacuagugcgggagaaagaaaaaaaacagcaagcacacacgguuucucggaggacaguuugugcuggaggugggaaguaaauauuccaagugcuuuuuauaaaguaagaaaaugaaaagaagauccugaagagagaucacugguucaccaaaggaauuaaaagauuuuaugaggcagcaaaagaaaaugccagguuauaaugaguucaaaagaauucaggagcaaaaacagugaagaauauaaaaacacaguguaguucuggguggacugcaagauacaauacaggaaagaucagugagcaagacagacaugucugauuacuuuacaugggagaucuguuuguauuuugaugaugaaaucaauuuuuuuuuaaauuuauuuauuuauuuauuuauuuauuuauuuuuaacuccagauuuuauuccccuccugguccacccuccgacuguucuacaucccauaccccuucccuacccccugucuccaucaggaugucuccaaccccaaccccaccccaccagaaaaaugaguguugcuagcaaugagaucaaaauguuuauuugggaaauggugauggaaaucucucuuuaauuaaaaaauuggccuucauaggaauaaaguucacuuugaagaacaugcaaagaggcaaaguacacuagcaggcugcuguauugacuucuuuguguauaguuuucauguggcauuguggaacuauuuccuuugagcugaaacauuugucuauggaccaaguaggggaauucaucaaacucaggaaguaaaaaaagaaagaaaaaauuauuagauucuggaaguugguuggacuuuacaagaugugagaagccacacaccucauaaaagaaguauacaacagaaguagagucagacugacuagacaaacugccuggugacacagcugccucugagucagacaugcuuuuuuaaguaaccacaguggacagacucauucaccacgcuacaugugaguagaauugugggacucucaucaguacacugucuagacugaguucuuaucuguaaaagcuuaaagaaaagcuuucugugaauguaggaaauaacacucugaggagccauuagguuguucaguaccaggguugcaaaaguuuccgaauacuuucuggccaggguggcugccaaucccuuauaaaccauuuagauaauguauugauaccaguuccaugccagaguuaguaggugauacuuuuauugcuaagcacauggcaucuuuggcuacagggcauggagaaaccaagaagggucugugcuggaagauaauuagucugguauggguuuccuagaagugguaugaaauguaccgucuuccagaggagaguugccacuaacagcucugcuaguuuguagauucuaaauguuagagaaccaacauaccaggcgugggugagaaaugccccuccuagguguuugaacgcaugguucccaguugauaguacugucuggagaucuaggacauaccauaccgccuuguuagaagccugacucuggggaugugcuuugagacuauacaguuaaacuuccuaguuccugauuuugcucuguacuucaugcuugcaguuuggaagaugugaucucuuaguuucccaaugauucugccuuuaguuauccaugcuucugaaaguaauuacugagagcugauugguccaccaugcuagacuuccuguauguuucuuugguuucucauuguuucuuaccugggauaaacuaacaauuuucaaaucuccccaggaaaacuuacauaacauauaaccauggaaaaacuagugaauaucacagucugcuauagacucaccagaaaauaaauaguuaagaugauuauggaaacaagcauauuaagugaauauauaaauuuuaauuuauuuuuauuucuauuuggauguguauaauauauagguaugugugcaugaaggugugugggcauaucuguaugugaguauauggaagccaggggauaauaauggauaucuuccucaaucauuaauuuccuaauuuuugagacagggucucucccuucacaugguacucaauaacucaccuuuguuuacuucugaacuguguaaguuuucuaaagugucuagauauuguacaccagaguuuucacucuaauauucaccucuucucugaaauacaauguguucucuaguauuucuucuuugguuuucaaauuuuguuuuauuuuaucucauuuggggaaaauuuuuguaguacuccaauuuuuauuguaguagaugaggaaauuaauaucauagggcaaugaugaauuagagaugauuuuccugccaaccaaacacauugaaaacaaguaacaucagccugugaaaggcuacuuacuucagcauaugcuuauagaauaaauacucuugacuuaaggagauuaaaaacaaauccugaaaacaaauaggacucaucucuaguucacauuaaguuugauauugaaaaaugcuuacauucagauguguuucugagugucuaacggaauuacauauuucagagaagaaaauguauauacacagcauaacaaaaucacuuuguguuugacauuucucuuauccuuaagucagugguaugcaaucaugcaggaaaaucgaauuuauacccaaguuucgcaggguuaagaaguuucgagggaaauugaacauaagcagcuuacaauguuaacugcagaucaaguagaucuugggaucccugggaguuaagugauuuucacuugacaaguaucaaaucuuacuuuuggcuguuagacuuuuuaaaaacauuauauguaaguuuuaauguuaagagaaguuguguguacuaaccacaaacuuguaaaacaaaauccaccuuacuguaucaaggucagagcuacaucauguacaaauuaaauugcucuuuccugcuacugaaagaacuauaacacuauaaaaaacacuucauucaugcacacagguauauagaugaugauagauauagauauagauuaaauauguguguauaugcacauauguacauaugaaaucauuacuuuauagauucaugauaaugguuucuggaaauauuuucuuugaauuacuaaaugucaauuaaauuaugauaauugcaaaugagucuuugugagauguaaagaauuuuuuuuucugguugucuacucauauacauucaaaacacuagacacugaaguaugggaaacuauuccaaguuaaaugaaaguagaaaauuccagugaucggaaaaccuugugaugaucccugugacucaaagcagugauugaacacauaaaugaaguaaccuuuuuuugugcagggagggcugugccagaggugcugggguguuaaaugugguucauuucgccucugauuuuuuuguccuuauguccuuacuguuuuggcuucaguugggguggcaguggauagaauccuauaagagcaaaggaaaggaguggggggggggcguguaacugcuucuaauauauauuauuaagcugacccacacacaauuaaguagcacucgagccuauagcaauaacuaagagugcaacaagagaucaaaaacaaaagcauuugacuaucuagccccagaugcauuuagaaagggcuaaggaaggagcuguuaauuggccagcacuuucuucuugaucaugaauguauaccugggaagacuccaagacuaucccuuguucaccagucaaagauaccucaagagcugagacacugcccaaacuaacucacccuggagucugccaguuuacuaccuuaggaguuaggguuggagguggggcucagagcgugccaaaagaggcccuagaguugaacacccaucuuuuccauuaaguuggcacacaaucauagcugcauaaaguucacuagugugacaguccuucgggguucagagauauuuugccaugcaucuucugauccucgggaucuuguauucuuuucacccucgucguccauaugauuucugagucuuggaagcaggggauaaaacaccucuccaguuuauggcagaguaucucuuaucuuugcaguucugccagucucugcaugaacuacugcccacuccaguaagaaacuuccccaauaaaagcuuagcucaccacuuaucuauggaauaaacaaguguguuuagaaggcaguuugaaaauauggcuauuuaucaaaaacaguagcagcagcccuccaccccccaccccugucccccaugcccggccuaugaccucuccagcuaaauacucuucaacaguuuugcagaaccagguuugaguuccgucuaacaaaggugacuucacauuccaccagaacauuuguuuucuuucucuuccuuucugaaugccuacuacuuaugguaggcuaaucuaaaagacaauuucacgugacuuuuuuuuaaaaaaucuuuaucuuuuucugacauucaguauaccaucacauggcuaauuagcuaaucaaaccuuaauuuuuuucuuuuguuucuugaagauaaagccucaguagugugcuuccacauaagcccaccaguguucagagauggcugucagagauaacaaggaaaacaguccuguugcugaauaaaaugagcaaucauugaauguuaaggugaacaaucguugaauacuuaaggcugagaacaaaaacacccuggcucuucaucaaaaugaaggaucgaagcuucucucuccgaugagagguagacuucccuagcuaguuucuacaaucaauuucacucagccuggagucaccugauuaggugucucaauugagauauuaacuagaucaaauuugaccguggccauauuaggguuuguuuuguuaauugaugucagagggccauucccuggucaguugcuacuggaguguguaaggaagcuaggauaagcaugagccugugagacagagagcaguguuccucggugguucacuuaaggcugaacuaaaaguaugugcuugaaucccugcuaagacuuuacucaaugacagacugucaccugcaaacuaaaauuaguauuggucacuguuuuucuauuuuuuuuugggggggggggguuguuuguuuguuuuuaaucacagcaccagcaagaaucuagagaucagcuacaucacuguuuuguggggguugauuuucccagacaguuucauuagacaacucucccugaccucaagcuuucuauugccaaaacuggucucaaacuuacaauccuccugucucagcauacagaaugccaggauuacagacaugcaccaccauacccauacagauagguuccaucauuuucuuugcuucuugccauauuuuuagaaugauuuuuaagauugucaguuauuaaucucagcuuccuuucuuuucauggagccucuuuuuaaauauagaauaucugagucaguucuacaggcauugugcugccagggggaugcugauugugcuuacaggaaaggguuccuugccucggcccuuuuuaaugaauaaaaugucaagggaaaggucucagcacucagccaagauuuguugaaagugaaucagacacacacacacacacacacacacacacacacacacacacacacaccacaagcaggaauguugggcaaagcacacaacaaauaaauugauucccagguagacaggggaaaucaagauggugugugagucugccuggacgauaagccugucaugcucgacuuagggaagguuucccuuuucccacagaccuggcugguuugggcuauagcagggguuugaaaaacuagacaaaaaccaagaagaucacugguuaacuccacagcaggucucuaguggaagauuuagaagucuagccuuggaaucuagccaaccccuggggauuggaggauaucagauuuuuuucuuaaagaauaaaaccuugggccuccucugucuuaaauguuuaagugaaaaagacauuaauuuuccuaaguguuccuuucucuaucggccuaucagagagcuuucugauuccuagucuuucacaaagcuuaagauucucauuuugucaauaauauuuguucagagaaacugacacaguagaaagcaaaagaaggaacccaauucucaugcuacaauagaagacucacauacaaaauuagaugugaaguuuccaaguacugaugaaauauuguuuuuaauugaaagggguccuuuuaaugaacuuauguacaaaauaacugacuggauuuggagaaggacucacagaccauggagaguuugagugguagaaaacaggcuuaaaaaaaacaucauuucuugggaaaaaugaacaaggaguugcacagauacacauucuucugccccaugacagggauguuuuucauuccccucacuuucccuggcauuaugaagcacacucaaugucuugccuuaaauauccucucccuaccaugguauuucuguuaucaagagucacacacacacacacacacacacacacacacacacacacacacugccuuauuuucuucguagaauuuaccugagcuaaaguuaucuauuuacaccaugucuuagucaggguuucuauuccuggacaaaacaucaugaccaagaagcaaguuggggaggaaaggguuuauucagcuuacauuuccacauugcuguucaucacugaaagaagucaggacuggaacucaagcaggucagggagcaggaacugauacagaggccauggagggauguucuuuacuggcuugcuuucccuggcuugcucagccugcucucucauagaccaagacuaccagcccagcgaugguuccacccacaaggggccuuucccccugaucacuaauugagaaaaugccuuacaguuguaucucagggaagcauuuccucaacugaagcuccuuucucugugauaacuccagcugugucaaguugacacaaaacuagccaguacacacccuuaacuuuaguacauuuuuuuuugccauacuccauugagaaauuagccaugugagaagugagaacuuguuuuucuucucugccugcugcauuggcaacaaucuuuaguguuugaaaugaugucggagccaaucacuuauugaccaugcugaucaaugaccauuucuccuuucuuaggacuuagaguuggucacguucuucugucaguucacuagaguuuuucuugauccauacucuugcuucauuugauguuuguguuuuaaaaguguaaaauugcuaacugcuuauuucuugagauagaauaaucuuguaucuauuuuaugaauuuggcaaauggugcaccugggcuguuacaugcacaauauaauuuagcauguauuguggauguuuaaaagaaaaugucuacagauuuuguuuuguauucuuuaacauuuuauaauaguuacugucuagcuauaacacugguaagaguuuucaaaugaaugugauugccagaugguugugauuaaacaucuuuuaagaaaucuuuugcuuagcaaaaugguuacuaauauggccucaucauaguuuucuaaauacagaugugaaauuuuauuguaugaacuaagauucugagaaauaacuaauuaauggggguucuaaauaacuaauaucuuccauggguuaagacagauaacaggucugcaagcccaguaauucccucaugcaugugugcagauagauaacaacauucaccacuuugaaacuuacaaacaacacauagcagguguaaguaacagagaagagacuaagaguaaucucuucacuggccccauaaaagagucaaaauuaauauccuaauaaucacagcauuuuuaauugaaggccagcacauuauaauaaacggguauuaaagacacuuuaugcugcuauuaaagacaggauagcugagugcugcuuauaauuguuuuuaagcacaaagaugcucuuuuuaggagugaccagauauuuuccauauacuacauauacaugggagguaauaaaguuaauguauguaauuugcaguauguuaagaaaguaaagacaaaccacucuggaaaucagucuggugauuccucagaaaauuggacauaguacuaccagaggaucccgcaauaccucuccugggcauauauccagaagauguuccaagugguaagaaggacacaugcuccacuauguucauagcagccuuauuuauaauagccagaagcuggaaagaacccagaugcaccucaacagaggaauggauagagaaaaugugguacauuuacacaauggaguacuacucagcuauuaaaaagaaugaauuuaugaaauuccuaggcaaauggauggaccuggagggcaaucauccugagugagguaacccaaucacaaaagaacucacauaauauguacucacugauaaguggauauuagcccagauacuuagaauacccaagauauaaaauacaauuugugaaacucaugaaacuaaagaagaacaaagaccaaaguguggacacuuugccccuucuuagaaugggaaacaaaacaccaauggaaggaguuacagagacaaacuuuggagcugagacgaaaggaugggucaucuagagacugccauauccggggauccaucccauaaucagcuuccaaacgcugacaccauugcauacacuagcaagauuuugcugaaaggacccugauauagcugucucuugugagacuaugucugggccuagcaaacacagaaguggaugcucacaguuagcuauuggauggaucacagggcccccaauggaggagcuagagaaaguacccaaggaacugggggaaucugcaacccuauagguggaacaacaauaugaacuacccauuaccccccagagcucaugucccuagcugcauauguaucagaggauggccuaguuggccauuaguggaaagagaggcccauuggucgugcaaacuuuauaugccucgguauaggggaacgccagggccaagaagugggaguggguggguagcggagugggugggggagaguaugggggacuuuugggauagcacuggaaauguaaaugaagaaaauaccuaauuuaaaaaaagaaaaaagaaaaagaaaguaaagacaaaaggugaaaaggccaauugugacuagagaaagaauuuagcaucagcgacaguuacaauauaagauugucuuggaaaaauaaaaccaaaaguaagaugaaaagacaaugagaaagcaagaaagagaucucacccauaaagaaggccauugaaguaggacauuuauuuuucacuucuagagauuaaguuuuagaacuaggagacaaaggaugacaagauuaguggcugccacgauguuucccuugguagcaaaagauuuauagaucuccaaauacagcagccugauugcuaccaugauaacaauguaucuacacuugaguuuuucuccaccgucaugcuuuuauugggaaccaugugguaaaaaaauuaaacaaacacaaggguaaucuagagcaucuagaguaaugggguugaggaaauagaagccagaacucaggcaaagugaccugggagcaagggccgacccaggggcacuuucuguuguaugccuccuuauuuuuaauauccuagagaaauuauguggaacucuaaacccccaccaaaggucucuaaaauucagugcaaaugauuucacauauaugcauuuuucuuauuaucaaauucuaaaauauucauuugguuuaaaaggguaucugacuagauaacauuucuggaugguagguuuaauacugcuauuugccacugaguugccauacaucaucuugccugcccaaaggaaguuugagugguguccuccuuccuggaaccagacugaaaaauuguucuugauuuuauuuuuauuuuugguggggaacuauuuaaaacuaaggaaugcccccuuuagaucuuaauucccaaagacuauagugaaauaaauauaaauccuagaauucaucaaagagaaagaccaccuuugagauggccgcagccccugguucuuucucccaccuaccuuuugugguucuccccucuugagcacaagggaagcaauaacauuaucauuucaccccuuugcuguuuccaccuuuuaucugagugcauugccaucugcauuggcuauuaagcaauaugugauaaacagagccuuuuuaaaauaaacagaugacaaaucuagucaucaaauauuauaauuuaacaauuuaagaacacugaaaauuaagagaauaaaaacaaauggaaaauuacuuacucagaacaucuuaaaagaucuguuuucauaagugggaggucaaagcugaguaaaccacaucagaggaaauugguuuuuuaaucucauggcgccagauuugccuacugaacaugcaguuuaugacaaaauaauugcccgguaauuauucuaaaagaugaaacaaaaucaaauucaaauugagcaaauuagauuuuucauguggccaaugacacuguaaugaugcaaguagcacuugcuuuuucugagaggucaccuacugcuucauaguuaaguggcaagguuaaaaguugcaaaauuuccuguuauucagucucaagagaagagcauguuuuuagauugcuacugcuauaaaggcaauuuuauauucaagaauggaauaucauuacuucuucagcucuauguauuacauguaacucugauuagugucuauauuuacugaguauuuacuuugugcugggaacuguacaacauuaguuauugcauauuucauuuuauauacaauggucuagcagguacaucuuugucuguauguucaaagaacauuugauauuggagugguuaaaaaucuuucuauugcaucagugcuccauaguuagaaccucauuuaaccuuaauuacuucaaguccaauccccaaauacagccagugacauugauuuucaauguguacauggacaaaggacucuccucuuguauaugacagaaaauaaggcugcaacacauaccuuuaagaagaaacauacagaaugggauguaggagaaguggcuuagggauaaaucagagcacagggcugguguugguugucacuguuaccuuucaacaaaugucacccacaagcagauacaaaaaaugguacauguucaaaaaugauacuauaaauaauuaucagaaauacacucaagugauauagaaauaaaauucauguagaaaggucacuaagugcauuagaaaugggagaucagauccaauuaagauuuuucuaaaggaaaggugaccuuugcgaaacaaaaaauucuugaaaauacuaccuacuauauaaaaugaauauuaaaaauaauauuagcauuuaugcuauacuugcacuuagcgaggaccauuauaauaccugcacuauuacauauaucucuuuauguagguauauuagcaguaauaauaauaaaaaagcuuguguagcaaauuacaaauguauaucacucugggcuuauauguaaaaauuccuguaguuaaauuaauaauugguacuaauuucuccagaacgagauuugucugucaagaaaagucuaggagucuguccuugacaugugugcuguacucccaggcuauaucuggauacucagcucacccacuggcuuucucugcuucuuccccagccuagcuucagguaggccagaaacccacuucaguuauacagccaaugggaaaaguuggcauucucaggucccuuugaaaagcacaaauaguauaaaagcuuaaaaaagaaucugcaccccccauuacccccuccccccaaaagccugccaaucuuaccaaauaaaaacuaccucgauucaugccucgaugaauuugaaagaacuaucauaaauguaauuaaauaacucaaggaguuuaaaaagacauaaacaaaaagcccagugaccuuaaggggagcagcaauaacugccugagcaagggccaaggaaagacaaauauguagcugaaugaaauaacaaagagcucagaauuagggaacugaacucaaaagggagagaaagaugaaagagaacugaagcuaaaauaagaugguguugaaaacucaggaacucaaacuagaaaucuagggggaaggcugaacuucaauaucaaguagaagaauuggaugucucaaggaaagaaaauuaaacauacaaaguaaagaauuguggcacucaaaagaccaaaucuucaaaguguaggcacagauggaagaaaagaaccucucagaucaauggcauaucuucaguggaaucauagaagaaaauguccucagauuagaaacauacccauagguauacaucaaacagaagggaauaggaaagaaacuccccuugcugcauuuuagucagaacacuaaacauacagagguccucaguguucaagagaggacacugaaaguuacaaggugggggacaggaggggggagcauuccugacagaaauuuuaaaaccagaauuuaaaauccagaaaaacauagagugauccucaaagagaggcuggugagaugacucagcaguugggaguccuuucuguucuugcaagaccuggguuugguucauagcaaacucugcaagcaaaugaagcaugcuaauugaaagaauuuaaaaaacaaaaccuaucuuuaccuacaagaaacucaucuuaccuuuacagauaggcacuaucuuaaauacaaaugaagaaaaaaaauagucaaaguaaauaggacuaauagaaauaguaauagaaauagaaaaguaauagaaagcaagcagaggcuacaacccuaaaaucuggaaaaagaagacuucaaacuaaaacuaauaaaaagaaguaaaggauucuuaauucuuaauuauuuuuugugugucuuuucaaaauuuauaugacauacacagaagaauguugacucuuugacacuacuuucagguugcuguuaucaacaaagugcacauucaaagugcacaucaaguuaacuccccaaacaaauauucauuaaaacccucauaauaucugggaaguguagacuguuguguugggcugcauacauggccaguuguggucacauguugcccaugagccacaauugguuaugucuaaagaaagauacacaguaucauaucucauucagaucagccagaaauuggguucugucaucaagcuuuacuaauagucuaaaggaaacagaaggaggcaaaaauaacaagacagccaggguaaacauaaccucugauccagaaaaacagcaauccccagaggaaacuuuuaaguuacaaaacauccaaccuuccagguuacacagaugaauggcuaugugguauccuccacaaagccacaccuuauuaaccugcagaaguucagucuugcuuaaagaaugcagcacuaaacuaagaauugccucaaaguacuucauggauaaggagucuccuuccaacagaccuuauuagguagucuauuugccguauguuauuacauuuccagguagauuagaccaugucacagauuucccucucuguucuccgggacuuucuuuuuaguagucaggaggaaucaaagaguaaaugcuguaauuccucacauuacuucacaaucuuucaaaagaaacuaugugugguagugcaugcuuuugaccuauuuuugaagccacauuagaaggaucacaaauuccaagccagccuguccuacauagcaagcacauauaucaaaaugagggagaaggggacaagaaagaaggagaggacaaggaaggagaaagagaaacauugacacagacacagacacgcauacgcgcgcgcacacacacacacacacagagggagggcuauggagggagagagagacugaucucaaaucagagugcugccugugauugggugaaaauuaaucucaguuuuaaaauuuagcaauccguuacaauaaugcaggaaauaugauguuaccaaaacaauacaaaaggaagauguggacuucugaccuccacacaugaagacacaggugacacuguauauccacugucuuagucaggguuucuauuccugcacaaacaucaugaccaagaagcaaguuggggaggaaaggguuuauuuggcuuacacuuccaugcuucucuucaucaccaaagaagucaggacuggaacucaagcaggucaggaagcaggagcugaugcagaggccauggagggauguucuuuacugacuugccucaccuggcuugcucagccugcucucuuauagaacccucucucuuaagaucaccagcccagagauggucccacccacaagggaccuuucccccuugaucacuaauugagaaaaugccuuacaguuggaucucaugaaggcauuuccucaacugaagcuccuuucucugugauaacuccagcugugucaaguugacacaaaacuagccaguacacccacucucacacaugcacagaaauaaagauaucugaauuguuucagauuauucagcuguaaguuaauuaaacuuaugccaggaaugucucuuuggcuuugcuuuucacucauugucucuuagucuuuggacuucuuggugacuccucuuuccuauuccaguuccuucugccuuguuuucuccccacaacuuuuacauggagguucgagugcuccucauuaucuacagugaucugcuuuucauuagaccuauacaacuggugcuaauugguuuuacguaaguuauaaaaaugaucagccugcaaaguuuagucagacccauacauguuaucauggucaugcuuucuggaaugcagauaacucuguagguagauggccugcuuacaccacuaagaaccaguuagcuuuugauuacaugauaguguuucuuuuauaguuuuguaucaugcagaguucucaugcaugcauuuuacaaaauaauauuuauuauaaaacuacuuuuauuguaugcuacaaacauaaaaacggaccauaagacauuguuucacuuuuuuuuuucaaggacgagcaguuucccaaucugccaucugcaaagcagaugccuugggaaaacauaaagucuaagagacaauguccaguuaguguagauuucauuauaguuuuaaaggucugagaaucaggaacauggaagaccauacgccaagucaacagccaagcagaaagcaaaguuaguuuuuuccucuauucaaguucccacaccacaccgaggaccauuuauuuacucaucccaccuauuauacacauuccugugucccuaaagucacccucccagauauauacacuaauaaaguguggcaccuacgcaaacuuuccugcuuaaacaggugaauaaaaaaugaacaccugccuccacaaaaagaguaaauaugcuaaccagaguaguacagggaagagccaagugggaugaagcaggugguuucucacgguuucacuacuuuccauuauaaacuggauuagaaaucaaaagucugagagaaaugugaucaccucagcagacucaaagcugcuuugucaaugacccauuugacucagguggcagauucugcaggagcagcagaaccuagagacuagcagccaggaggcuacaguucagugaaaagcuggauuuaagacucuggcuccaaauauuaaaaggauaugaagagggaugaaggugaacauaugaauuccuaaauuaauggcagccaaacaaagcaacaaccagggaacauaccugaaaacuucuuuuagccagcuagcugaggauugagccaccaugauauugucuuuuaaaauauaugaccucguaugguaagauacagguaaaagccacguauagguauaucucuacccuaugagccuucuuucaguuaucaaggcagcaaugccaaauauaaauaugugugaacuugcuccuauuaaacagcgaaaacuauaaaaaaagcauguguacuggaauguuauugagcuauuaaaaucuauuugugaugaaaauuagguuuggugucacaugauuauaaucccugcuagcugauaaacugaagcaaaaugccuggacaagagaaugagcuugaagcuagccugggcagucuaaagagaucuugucuuuaaaagcaaaaugaguucuugagauauagcuuagugauagaccacgaaggccuaaguucaagucccagagcuguuauuauuaauuaauuaguuaauuaauuaaugccauuauagcauauccauaguacauuaugugguaaaagaggaauuagaaaaaaaaaucuuguacuuaggcacucugaaggagucuccuuccagcagaacuuauuaguuuguuuggccgcaguauguuggggaagaucauuaggagucucuucucuaagaaccuucugguagaacugagaaaccaagccugcagagcaguaacucaaaguagaaguaggaaacccucaucucacaggcagagaugagaacugguguaccggagggacgagcaaaaacaugcaaagaaagcaucaguggcaaaaaugagguuaaaggugcugacaggaccccaucaucaggaccuguuuaugucuuauaagucugcuuuaaacuucaucuuaaacaccauuagaaugaagaagccugaaccaaaaaguaucccgugucuagagguuggagugucacauaucugcacgaauucuugaacaucuguguucaccaagguugccugcaggggucuuugaacaguaacuuuuccucacucuaguuucuaaugucauauauuggugcuuuguugggaaaauauacauuucguaucccaagugaucuauagaaacacacauccugaaagaugaucaacacugaaguucaaaaucucuugcccaaugcugacugcauaaaacaagggaauccuagacauggauauacaaauccaugagaagggaccuauuuuuauguauagauuuuaugaaacacgggcuauaucagagaccugauuggacuagagguuauggucuaauacuuggacuacacaacaccccugcaaagccaguucuuugagauucuucuaagccccugaagcaugcccucuucaucauaaaacaggacccuuuugaaaugaggaucgucugaccuacuaaauggcagagugggucaaagaauuguuuucagcgccaguuccaggauagaauggcaugaaauauuaaagcaauauuuggaagcauagugcagcuugguuugaaaaagggguuuccaguuuguaugacugaucuccaggaaaaagaacuguaguuccuauagcuugcuuugaagggagaaaaaaaaaaaaagguacuaaaagagaugggaagggaucaggaagucagagaaaagcuuucuuucuaagguugauuuugagcuucucauuggugugguauuuucugaaugccaagaugcuaaagaugaauuuucuaguauuggaaucaugucuuacagacuacaaguguuaaugaauuugugaaccaauucuaaggguuaauaguaaguacuagcagaaagacagauaaugcaugaucuuacaucuacuuccuagaaggagacaagcacagggauagaagggagaaggagugagaacaauggagaaagaugaauucacagcuaagaaguuacugcaaacgauguagaaguugcuaagagcuacuacgcacuguagugauauguaguucggagcaguauggugauacauucaggugcaucaacuaugaacuggauauuugacaaagaagaaaagacuuugaagguuuucaccauaaagaaaugguaaaugcucaaaauaguuuuaucugauugaaacauuacaugauuuauugaacguuuuaugguagguauucuguuaccuguacaauucuauguuuuuuacauaucauuuaaaguaaaauuuuaaaaagugaguuucaaguaggugacuuagaagcaaugucacuuuuccacucaagaaagaacaggugucaagaagugcuugcugacaggagcuggauacagcagucuccugagagacuuugccaguacagaugcagaugcucccagccauccaucggauugagcacagggaccccaaugggggaguuaggggaaggacugaaggagcugaaggggccuaaucugguaucaaagagaggggaagcccuugguccugugaaggcuugaugcuccaguguaggggaaugccaggacagagaggcaggaguggguaguagggugggggagcauccucauagaaacagguuaaugggggauuggauagagggguugcaaauggaauaccggaaaaggggauugaagagguuagcucaggacuuuagaaaauuccaccggaccccucgccuccuggaagagaaaagucauaaagaacauagauacccauccucucuggaauggaggggcuaauuacauuucucagacacagggaggaggggcugacaaccggccaccugaggguagcagaggcccagagcucauagacacauuccaagaccuuggccaccuaucccauucccuaaagaucaaucaguuuaaaagucacacuguucugccaaccacauugugccuaacggcugcugccuugagaaccguguaaaggcucaccagacaggcugugcuuggucguucucucuccaugugcagggugaccccccaacauguugaaacaauaaauuccucuugcuuuuugcaucaauuuccagcucuaugucauucacucagggaguccccauaaguuaaggcucaccagagucuuacaggauaaauguaaaugaauaaaauauccaauuaaaaaaaaagaguggguguuuuacuuaaauaaaugaagaauaaucaaaugaugcaacaaauaccuagaagauauuuggugggggacuggugugguuauaaaugaugcaggacugccaaaguuaguuucucugucuuaucauuugaauguaaggaaauuucauauuuaaacuaagaagauauaguaauauaccaaaguaaaaugagguagcucugugugugugugugugugugugugugugugcgcgcgcgcacgcgcgcgcaauauuuccugguguuucaugggcuauaugcucugauuuaagaccuggcaggaaucauaggaaucauagugaaugcuggcacugacagcccaguuaugaaagacugcuggccuccaggggcaccauaagcauauucuaggaagaaagaaaaaagucauaaaggaaugccugcuccugucuacagcauccccuagggaauaugagccagacuauacuugggcucugugucaaaucugauugcugugacuauagcucaagcugguaaauagagcuucuacagugaauaaagacagugauuaagaacuagugauauaggagagagagaucggaugaaagcacaaagaaaaagagguuaaucccugaauuaaaacaaaaauucaaagggaaugaacauaaaaagcacugaaauaaaagagucaauagugcaugaaaaacggcauuugguagcacauuuauuaauagaaacaaacaucugaaaguggaaaggaaaggggggcaggguaaaagaaaaaugucuuucacuggguugccuaaagacagacagaacuccaaucuaaaccauucugaaaaggacucagcaaaaggaccagugacauugggggagcccaggugacccuguacuuacuagaggaauuaguagaaagcuccccagagucccaggaagcaaaacacaggcuuacucauggaaacaccagacauuuuauuuaagaaucuuugacagagagucagagacacaauuuugaguucauuccagaaaucaacaaguaucuucuugccaaaaaguaaacggcuucucucccaagacaagagguguacagcucagcaucaaauguagagaccugugggaacugaagccaacaaagcccucgagaaagggagagcucugagaucauuugaaguuucagaggaccuugaaagagaagucaggaauguauacagcugcauaguauaaaacagaguacacugugguauagaauaaaggaauaguauuuuguuuuaaaaugucuaaguauucuuagugugaaaauugcaaggaaaacaagcaaacaaaaucuuuccuuucugcagacaguggugaucaaggaaucagauggaccauggcaauuuguaucuuuggaguuugaguaaccacaaacuaauaugaugcuauuaucagaucaugauuauauugaaaaagaguaguucucugaacuuacuaugcacauacuaacuuccauuuacaaacugacaaguuccuaaacuuuaccuggaguugguaaaagaauuuauacaaaguaauauaauuauuccaguuuuaagaauguauauauucuauacuuuucaaaguuuuaauccagauaauuauaaguuuuugaaggguucaugaucuacacuuugcaucuugagggaaagagaaacgaauugguguaaagauuaguuuauacaaauuuuuuucucugauuauuuggaguggagguuguuugguacuuuucuuuggguuugucuacaucaaguaauaaaacaguuauagcuaaucuacacaagugaaacuguuagauggauauaguauagcacuugaacagaagaauagcaaagaaaagugaacccagaguaacucuauuaauccauaauucaccaaggagccccacugugaucuucagacccagaaaucaccaugguccaacugacuccuugaucaccacugucugcagaaagaaaagauguuuuuucuauagucccuacaaguuuucccagcaaagguaauuguccaauaugaaccaggauccagcugaagaauacagcaugaacaaggguguguuuuauucaauacaugggggggggggaggggaaaagggaggggaggggaaaagagaggagagaggggaggggaagggaagggagaggaagggaagggaggggagaggagaggacaggagaggacaggacaggacaggacaggacaggacaggacaggacaggacaggagaaaggagaaugagacaagaguuuuauccacauaauuaaaaccaacauuuaggauaaugccccuuaaaaaggaaguuucuauaaaccaugaaagccuaauuauauuccagaauuuuacauauuagacauucuacauagacacacauacccccccacacacacauacauacauauguaauaguuaaugagcuauauuuugaaauuuagagaaguuuauguguccggguaguuaacuacaaaugacaguaaucuacagacaagaccuaguauugcaggaguuuuggcuaagaacacuaauuccugaucuguuaucauaaauuaauagaauaacaaaaaauugauaauuaucacacuuuauaaguuuuauuucaaaaggauuaagucaaagguuugcuuuauuuuuaaacuauuucuaacuuagccauaccaucaacuuuucacuaauuuacucuugacuuuuuaauuugguaucgucaacuuuauucuuuuaaccaaggacuauauggagugaagaucuucuauugagcugacugguucugucuuccaacuuuacaucacgauguaaugugagagagacaauauacugcaauagccagcaaauggagagaguugccaaggggugagcuaccacccagguagcuggcuuuaucacacaguacuagccaaguauucaguccucucuuauaguuugcucaauguuauuucuauuuuaaaguugagaugaauacuaguuaaaauaauauccugaacaccacaagugcagagacuuacaguagaauuacuagucucugaggaaucuucucauuugccuuaguuucucauuucucucccaaguauccggacaugaaucuaucauuugcaaaucacaauucuaaguguuucguauuuuaaaguuuacuuccauuuuuuuuuaaagcaugcauuagagcaguauugaaaaauaggaguauuuuuucuaaauauuuuccucuaccaaaucugagcgagcauuauuuuuacccaggauucuguucuuuucuuuaaagcuuaagucuuugucaucuuucacauucuguaaggccauuuagaauaagugaaaaguuucgauuacucuauauggcuacaauuucccuuuuucuacacauucauuguugucguugcuauauagcaucucggcuuaggggcuuugaaaaauagauuggagugauugauagaucaaaacauguugaauuuucaccugaauuucaguuuuggggaauaaaugaaacaauuccugucaaagaaaugucaacuuggcucuaggaggcaaacauuccuaacaauuucugugcaugguaggggucaauaaauaacugccccauuguuuaguaauuaacccuaguagcagugaagaauuagagguagaacauauaaagagaagaaucaacaagacaaaaugcuuaggaaacaggaaaguggaacacagagcagaagcaauauuguuuucugccaaagggccaaauccuuuuuauuuuuauuuaacuaaagcacacaagagggagagagggagggagggagggagggagggagggagggagggagagagagagagagagagagagagagagagagagagagagagagagagagagaaugggaaagaaaaacagacaaagaguggguaaaacugacuacaaguguacuaacuuugaaacagaagaaaauccaaagcucaauuuuacccaguuuacccaguuauuuucugccagcuccauugguuuacauugucuacaugagcauaugcuaaacuuauagauaaaacaaauaaacaaaaaguuucucuugguucauauuuuguguuuacaguuacugacacaggaccuuacacuuaucagaaacucugucguucacccauucauucacacgacacaugaaacacuuauuaaguguucugcccagauguuaaugguaugucagugaagaaagaaaauaucacuauacuguuugcaaauucugccugcagggagcauaauaguacaucauaaaacaaagucaucacauguucauaccaugaagccaacaaccugcaggagaacgcacaugcugcaacuuccugggugacuaaacuugagcaagcugcauauuagccauuucgugccucaguuacuuuuuucuuuaguaaaaugguaauaugaguuaauagaugugcucauguguaugagugaguaaaagcucucagaucaguauuuggccauaauaagaacaauguaagugugagcuauuguuugaugggagaaccugaucuacauuuaaaaugguaauaaauagcucucaguuaaaagggauagaugccagagaaaucaagacaaugaaacccaauauaaaaauaugaaugaauagugaauguaucauuugcuugguguugacuguagaccgcaggucagugacuaagcuuguugcuuauuggaugugucucuguccccauuugcucaucucugaagaaacggugacagauggccuucuccacagccacucucuuaggauuggcagaaauagcaguuauugugugcuggcugcugucacugugaccuggucauauacagccugauugguauaucacaggaaagcaccuuagcauaguuuagcaugacucucaucagaauuucuucaaacuguuaaauguguucugacuucaugguuaucuacaggaguccauguaacuagauuuccuuaaauguauucuggauugucauucugguauuuuuacaaaucuaaguuugcuaucuuggguaauuuuugucuguaacuuuaaguaaaacuggccuuuaaaaauaucuucucuaauauauuguuaacaaaauuauaguuggcuucauauauugauuuaacaacuuauccuuaucuuucuguuuuguaaaaugauuccauuuuuuaaagugucauagcaauccccauuuauugaauuacuaauuugaguacuucagucuucucuaagccuaaugcuugcucucagucguuuuucuugaauuccauuucuuuaacaaaucccauuaugauggauccucacuccaccccccauaggccaaugugcuuuucucaacucacgcaaaccacaaucgcuuauuuuaucaagaauuuuuauauuucuuuauaaauacucacuaggcauuccuaauuuuaauauacauuaaguuagccauuauuuguacuucuguuauuaaccuagauuuauuuucuaucuugacuguuuuauugauauaaguagacauugggauauucuaaucaacucaaauuuaagcucucaaguucaaugacuuugucuacuucuacuucuauuuucuuuguugcuuuuguuguuugguuuauuugcuucuuuuuuuguuuuuuuccuuuagcuuuguucauuguucguugaugaucuucuuggguuaaucaaauaauuaauuuccuggaaacuguaccucuaagcgucuuuuaaguacuguuguuuguccauauaccauaaacuuugacaaauaguauuugcaauaucacuuuauuauaaauauuaagacguuuuguuuuguuuuguuuuguuuuguuuuguuuuguuuuguuuuguuuuguuuuguuugagacaggguuucucuguguagcucuugcuguccuggaacucacucuguagaccaggcuggccucgaacucagaaauccgccugucucugccucccaagugcugggauuaaaggcgugcacuagcacgccugacaagauauucuuuguaauuacuucucaacuuucucuguagucuaagguuaaauaaauaauucuuagaaauaauauauguguguuuucucuuucaauuuauuuauuuauucacuuuacaucccaaucacuggcccccuccucacacacacacacacacacacacacacacauccuccugcacaccuccucccauucuccuaugagaagauggaguccucuaccccuuauccugcccugccacaucaauucucugaaaagcuagacacauccucuccuacugaggcccuacaaggcagccuagguaagggagcaggguccacagacaggcaacagcucuaggggcagccauugcuccaguuguugggggacccacaugaagaucgaggugcacauuaacuacauauaugugggaagccuagguuccagccugucucugcuuuuccguugagguucaaucucuggaagcccccaagguuguugacucugcuggucuccucuggagauccuauccccuccguggcccucaaaucuuccccauauuucuauauaagacuccugagcuuagcuuuaggccucugcaucuauuucagccagcugcucaguggagcuuuagccauaaacuauuaaaauacaguggauuaccauucuccaugacguucaucuuuaucuuaaggauaucagccauauuuaauucugaaaauuaagcuuaaugcucuaaucccugauaagggagaguugcuucuaauaccaacgaugugcuugauuauuaaauacugcuaacuacugaguucacuaccagguuagugaaacaaaauugucagauaaaugugaaauguauaaauuaauaaauacagcaggaucuuuauuaaugagguuauuuauaaaagggaggcaucaagucaaaggcuauauuuuucucacaggacuaucuugaugcauuuaaauauaaaucauaaaaauaaauguuuucccagaaacaaauauuaacuuuuuuaaaaauacuaacauuuuauuaaugucacucuguuggucagaauaugcuacaggcuuuuuaauuuuuuuauucauuccuugagaauuucaaacagaauauuuuaccauauccuuuuccacccucuagcuucuccuaaauuccucuguccauccacucaacuucauaucgcuguuucuuaaaaaggaaacuuuuacaacugaaagggaauuagaguugguuucaugauuaaaauagucguacuauuucucuuacauuguaguuauaauuuccucuuuuguuucuaaacuuaccuucuauuuuucucucuuccccaggaaaaauuaugacaucaacauccaaaggcauucuucgcccauuucuaaucgucugcaucauccugggcugcuucauggcaugucugcucauuuauaucaagcccaccaacagcugggucuucaguccaauggagucugcaaguucugugcugaaaaugaaaaauuucuucuccacaaaaacugauuauuuuaacgaaacuaccauucugguuuggguauggccauuugggcagaccuuugaccuuacauccugccaagcaauguucaauauccaagggugccaucucacaacagaccgcucauuguacaacaaaucccaugcgguccugauucaccauagagacaucagcugggaucugacuaacuuaccucagcaggccaggccacccuuucagaaauggauuuggaugaauuuagagucacccacucacaccccccaaaagaguggcauugaacacuuguucaaccugacucuaacuuaucgccgugauucagauauccaagugccuuauggcuucuugacggugagcacaaaucccuuuguguuugaagugccaagcaaggagaaguuggugugcuggguugugaguaacuggaacccugagcaugccagggucaaguauuacaacgagcucagcaagaguauugaaauccacaccuauggccaagcauucggagaauacgugaacgauaaaaaucugauucccaccauaucuacuuguaaauuuuaucuuucauuugaaaacucaauucacaaagauuacaucacagaaaagcucuacaaugcauuuuuggcugguucaguaccuguuguccuggguccaucuagggaaaacuaugagaauuauauuccagcugauucauucauucauguggaagauuuuaacucucccagugaguuagcaaaauaucugaaggaaguugacaaaaacaauaaguuguaccuuaguuacuuuaacuggagaaaggauuuuacuguaaaccuaccacgguuuugggaaucacaugcaugccuggcaugcgaccauguaaaaaggcaucaagaauauaagucuguugguaauuuagagaaaugguuuuggaauuaaaguguccaucauugucacagugaaaaagauuaaugagacauaauucaaguuuucaggauaagaagaaacacgcugcauuuggggcaccguuuaauuuuccugcccucccuugaggaccauguauauuuuggugaaauuuuuaagagaucagaauuagcaaucacucaauuugguuuuaaauuauccuguauauaugugauaacgagcacuggaaauaauuuauuugucacucucauuuauaaacauuguuuuuacauuuuauaguugacuguaaaguaaauuuaugauuuacuuguuucuacaucaaucagaucuuuaaucuauuugggagauaaaaauacauauccuaaaauaugagggacuuuuugccaaguauuauaaaguauagauucuagcuuguauaaugcuaacaaagaagaauuauugaaucacuuaauucuuaaucucuuugacuucaaaguugaacacuacugacaacugauagaguuuuuacuuguaccacauuugugaaggggagcuaauugauguagcaaauaagaaagauaugaagcagaaauguuauuagacuucacauucauuuuuauuaaguuguuuagcaaauguagauucccaauauuuuaaguuaaagaaaacaagaauuuucagauaaacaauuuauaugguuuuagggagauuugauuguuuguuuuguggguuuagucccuaauaauaccuaagagaaucuuuugauaguucccuuucaaaucaugaagauaaccacuauuuuaaaaauaaauaauuuccucuuauaacaauaaaaaaaugauaucuucaaauacaaauaaauguauaaauuauaccauuuauagaacgcuaguuacuucauucauuugaaauauuuuuuccaaagcauccauauuuaaguuuuauuuuacuguauuuguuaauaaauagaaguaaaacuugaaagaucuaucugaucauuuaaaagaguuuaaaauucuuaccaaugggucagauaugucacaaaacacaauaaagugggaaccuacaaggaauacagugcugacacagaguaagauuucaauauguauuuuuuaaauaaauuaucaguauuaaaaaaguaauggguaaauuuuuguuuuugauaaaggaacaguucuagccaagagcuauuaauuaaaauuuaucauuuuuauaccauuuaagauaauauccauacauagaauauguuguuauuauauucagggcuuuacacaaccaauguaaauuuauugcacugaauuugggagcauguuaucuaugaacuuucaucugccugcaaaauucucuucuguaaguguagaggagauaacugggcauaugcaaauacaauagauuagggaaaaaaugugauucugaagacucugacagaaaauuuuucuucaaaguguuucuaaagccugcauucuauucuguucaaaaccuacagaaaaaaaaauaauguucugaugacauuuauuuggaucuuuuguggcucuuuauauuucucuauuauguauugcaauuagccaaacucaggcuaauucuccucaucuacagagaagauucauuucaguuugacaagcaggaaguaugugcucaaugagacauaagcucccuuagcauggaaucauuugagcaaagaaagaccacagaauuaaacgaagaguaugaucucauauuuuuuuaaagacauaguuacacaggugauauuguugauccccaacugccacagagguaaagaugaaaauguguugucacugcagggugacaauggagacuuaguuaaaaaaaaaaaauacuaaacaauacuaguaaauuuacuccauucuuuaccuacucaacauguguuugaauggcaagcuuugucuacucacuugauccaacauauauuuuucucuagauuaucuuuuuuccacacaucguuuuuacauguauaccaagaaaucauauauauacauagauacucucauaaaggcucuaaucauauauuuauuugcuuaaaagucaaauucaugcauuuacuuaugauuuuuuugauccaaaaaugguagagagcuaagcauggauugcuaaauuuagaauaugcucucagugaaagcuggaaagcauuugauguugcuuucauccaccauugcuauauuggaugcuaagagaccugaaggcaguugccucuuuuguuggcuaugaauuugagcucauucuuggacuggaaguacaauuaaaugccaauaguguaagccaagccaagguauuaaguauuucacaagugcaucuacauauuuagaaccugaugccaagccacagaacgucugaacuuuacguccauaguuagagcgagcuuuuuaacuagaauauacaacaauauucauaagucaaccucuucuuuucugugaacuaacucguuauuuauuuaugacauauuuauuccugauauguugagagacaggcaugucaaccccacacguagugaugauagaaauuagaauuuaaggauccuauugcuaugacucucauuucucucugcccuauccauaccuuauuguacaaauauaucucaauuccuauaaaugugaauauccucuggcauuauuuagucccuguaggcuaguauguucugggaggacuuuaguuuuuggaaauauauugaacagaauuugagauguugacacucuuucugauauuguuuuagcuguugaacuuuagcagaaggaaugagcuucacuaugugugaguggaaaauguaccacugacaagauaugcuauuggcugcucuguuaauaaauccugugacucauacuuucuguaagcauaucucuuaugaaagauugauugauucaaccaaauuggcuugcugcugguauaauaaaagcagauaauaugccuagagauccaggauggcucuaaacagaucaugagcaaguuaucaccuaaaagugcagaaaguccuuaucaccagugcucugaguauuuaauugcuauuuaguucaggccuuauuaauaggaauacaaaaauaauuauuuuaagccuuacugaagagaaauauacugacuuaucuaguuagcugcauuguauuuuagagagugaagaucuugauagccauauauuuuaggacagccaucaccuaaugaaguagaaaguauaaaagauacucucacugggaaaccagcaucaguuuacaagauuucuauuuacugugagaagcucaguccuagaguguacaaagcuugaaccagaacuguugagguagaaauggacagaauacuugaggaauuauucacucacucuuuaaacuuuugucuuuaauuggagauuaaauaaagaaugaauaaaaacaggaaauaagcuacucagauuuucuuuuuuauugaacuuuuuucagaguagacuucauggcugcuacucaccaagaaagcguuuuugugaguuaauguuucaaaacauuuuaguucuccacauuuuuauuucaugcuuuaugaugucagcuccccucaacucaaagcucaagagaaggagguuuguuaaaaauugcaaucaaggucuagauauaagagauuucagaagcuaaaggauaagcauuuguucauacaggagggguuauuaaugguugccuaguaaauaauuaccucaaugaaauuaguggacaugaaagauacauuuaauguaaucgaaauaacaguuucuucauucgaaauggggauaaucucuucuguucaaauugcuucuagauucagagaacagacagguuaaguccuucuuaucauauguuuaaaaaaaaacaaaagaaauaaauauuaugaaagauuaaacuagauuugaaacuucuuagaauucuauuuuaauauuaaccauucaccaacuguuaaccuaauaaagaugaaauuaggacauaaagagaauugaaaaaugaagcaucaggauaggcaaauguguauuaccaaacuguggggagagaaacagauuuacccuucauucuugccaauuugauuuguuguauagugaacauacugcaaacaucaucucaaucaagugguuuuugcugugggcaucucucuucuggagucuuuauggcacugugaaaauggcuaagcucugcuacuauccaaaguaugguccuguguaauuaauauucaauccauccauauuuauaagcaguuaauagagucuaaaugguagacacacuguugaacuagaaauaugaguaagucuacccuagacuaucauugcaacaaauugaagccuugagaaacucacuugaccucucuggauaaccuuguuaguaagaauuccuucagcacaacugcuuuauaauaugaggccuaaguugauaugugcauauauuugaguucccuugucuauccaaaaauauuuuugaaaguuaguacuccaaauaaaauucccuuucuuuucucuagaacaauaaagaacagguucuuuacugaaacuuacaauauaguaaguguucaauuaacgaaucuuucuccuuuauauuuuucuuccucuuaggucucuugcaacauacaguuucuuacacuuaguuaucuacagaaaacaaccauauauugaaccccauucuaaaacaauucacauuuuuuauacuauauguauucuuacuauaauaaucuaaaacuauuuauugaugcaaacucaggaauucaguggaagcaugucgaguuccuucaucaacaggaauauagaguuugaguguauaugauugacuauauuuagaaaacuuauucuuuugacucaaggcuaauuuauuuccauucauuuaacacacuuuggguauauuuucauuuaaaaguaaauuccauaccacuacuguuuuaaagcauuacucaaggcacuguuccuaagccauguaaucuagaguuugcagagauaauuauuaauaauacugacagcugguccauuuuccauguaauuggaacauuuuuauuuaaggaaacaaaacaaaaccacaaaaaaacaaacaaacaagaaaagcaaaaacaaacaaacaaaaaaacaaaacaaaacgauaaaggaagaagacagaaaccauggcauuacuacaaaguaauccuaugccucccagagguucucugacucacaucugcuuugagaaauuccuacaucaauggcauaagaauuauuuacaucauuugaaagaucgucauaauacauaggaugaccuaggucuguauuuuuaaggaguccauagacaauucaaacauguugcuaguuuuggaagucuggguccugucuauuaaauagaaguaauucuauacucaaacaauacaggcaugagauauugccuuuccuuagcucacuuggauucuccuuaaauauauugguagguguuacuauauuucaaaguccaagauguuccucaaucuuaguugugucuuguacaguggugcugcucuucagcuaugauuuagggaaaacuaucauuuccugaaaauuauuuuucacaaucuuucuuagauuuuuaaaugcacuuuuuuuuucaguuuuaaguacaaaaaacaaagguaggcaauuauuagguucucuugcagccaucaaaauugcacauauuugaucaauuucuuucccgagucucagaagcuuauugauagguaggauauggcaacauguuauaacacuuuggauuguccacaaucaugaguucaauauuaaaugugagcuauucacucacuagcucacucucugugccugaucucaucucuguuguuaucaugauuuguauguguacaguagggguagccuauuuugaaaacaaaugaauucaucucuaaaaccuuagacaauuauauguauguguauccugugauguucuaccacugagauauaugccuuuggucauuaaaaaaaagagaaaauaagagaaauuuagaauacauaaaaauuucagcucugacaucuauugcuauuaggcuggcagcuuagcucguaagaauugcugaaaauuuaaacaagccaaagggugaauauucaauagaagagaaacaaacauaguguggaagauugcauugacaucacugaaaucagaauggcuacuccucgauagaagggauuuacacaaaccuagugaugaagccugcgguaacaucuacugaaauuagaaaguacugggaggcaagugggggugguggcacugaugaucucacuaaccacauagagcguuuccuaaaauaagcagacuuaaucuucacuguuacgagaaaucaguaaauuaauauuaauuuagcuugcuagccauuuauacagcugaaguccauggacagaaucacagaaagauucucagagaucauuuucuagugaggaaauugcccuuagaaauauccaucaacuugacuaaauauuucaugucaacuguuggcuuaggcacagaagcagcugaugauagauuacaagagaauagagucucccuuuaccuuuccuuaagauuuaauuaaaaaaagggaagaguucaaaaaugugacgauauaaacucauuaaacagaaauuaaauuguucagugaugcagaaaucgagcaaugaaaauaaguuuaggaggcugugauuaagacucgacaaauucuaugauacauaagauuuugacaugaacauucucaacugcauacauauaauuuuuuaguugaauggccccaaaaagaaacauuuaaggaaaauuuccacauguuaaaaaaaggauaguaacuaaaauagcauauuaauuauuuuaaauuauguuucuuuaaaaaaugcuagaaaugucauauuuucauuaugacaucaaaauacuucaaaauuugaauugguuuacugaauucucagacaaccaaauguuuuuaaauuauucgaacauguaaaguacaugaccuaauagacuuggaguuucauugcaaaaaacauacaaguucuacuagaaaaaaaguuuuacaggugauuucuauacgauauaaagugguagaaacguguuacuguuucuaaacaggccaccauucucuucgauuaaugagguuauagcagcuagacaaucagacuuggaaaaaugauuugcaaaaucucaguuaacauccaagacccaguacuacuaauuauguaagaaauaggagcugguuacaaugcaccccucaucucaaacuggucucaauaacucccuucaguucaugguuaagaaaauccuagagaagccuuucauguuacugugagaucagcaaagguauacucauguggguucacauaugaugugaacaauggacaauauaagacccaaaucaagaauauccacuugucuacauaaaaguggaggacaucuacauuauaagaaaacaugauugguaacagauucuaaugucauguuuuuuguuuuuguuuuuuuuauaaaauaaccaagggacuaggauuauguuuuuccuccuuuuuucuuucuaucucuuaaaaucagguaugauaggagucagggauuacagaguaugacaauguaaaaaaauuaauauuuuuguagacuccuaaagaauaaaaaaacauugaauaugcuuuuaaaauguaauuaucuucucaguaguuaugaggcuuauucugcauguauaccagcaugggauaaaggaguacuuuuuaaugauaaagagcuuaaaagucuaaguauagaccuagguuuaccaagauucagaaagaagaaagcaucaagaagaaacaagaaaaugugaaacagacucauaaucaaaguccauccguuuagcucccagcaccuauaguguaauuugcuagcauuucugagccacagauuucucaucuguuaucaaaaggugauaggcaguacauuagauacaccuaagaaagucuucauaauagcauugaucugaaacccugguuuaaguguuggacugccauauauucugaacuuuuccuucguguucucuucuagggggcuuuguucaaugagugguagggaaggguaagggggaaauuugauacuguuuuaagugcugcuaaagaagaaaguuguagagaaguaucacaaaggaagaacggagaaugugucuaccaucuugauuccauugaaggccgccauacaggccauagccaaugcuugcccugagugguuuaaauaauuucauaaaggauuuuauacucaaugaauugagggcaaagcaaucacacuggaacaaaaaugugccaauuuuuccaauaugcaaauuguaaugaucgguaauucauaaaacuacuuugagagcaauugaauauuuuaguauuguaauuugcacuaugauauuacgauguucaggcaaacuaaaauacucugaaaucuaaugccaaauguacaguucauagguucaugguacuucguauaaguguuucauugcauugcgacaguuguuuaauagcauuaacuuucccuggguguguuguuaugaugcagaucuaacaggguuauuguaagcacacuaauuagucaucugggguuuuauagauaaaaucauacauugaucagaaaucacuuuucuacuuauuuuuuuguagaguauuuuuccacacuugaaaaaacaugauuauuuuauaucaaacaucaguuuuccuuuaaaaucuuauuuuaguagccaaugcauguuugaaauaagauguuaaauauuaugugccaauaguaagauuguguuuguaagugaaaaaugcaugcuauaaugaaucauacagcuuugguggcauauucuacugccaccuuauaugcaagcuuucucuuaaccugugugcaugguccacaugcuuucaagaguccuuuuuuaauauuuacaaagugacaugugauuuuuagugcugaugagccagugagccaagaugcaauccuguucugcuuucauuuuucuucuuuacauuauguuguaaauuuucucagaaaacuuuuucuuggaguuguuggcaauaaacuacaacaaaugaaagaauuggcugguaaaucuuacagacaacuuaccguuacaaagcaugaagaugugagaagaucauuuuacaagcuucauuauaugaacacaauacucuggcaucuuuuuuguguaguuaagaagagcuuaucguuucugaaacacugccaaagucaguacuacugccaaaagggagggacaccugcauuacacuaaacugaauaauaacagacuauccagacuguauagacugccaaucaguacaguaaagugggagggauauacccacucuuuuguuucuuauuaauuagagaaauguauaaggaauaugaauuuuggcaacagagacauggcuuuacaugcugauaacucauggaaauauuugaaauaaaacucauuccauucuugaaaaaaauaugcccaggcauuuuguuuguuucagaaauguacuuguguuuuugaaagcucuaauuucaaacaaguaauauauguagaccaacuguuccuucuacaaauaaugucauuuauuguaacacauaauggguagaacauagcuuucagucaguuauucgaaucaccaguauaaauauucauaauguuugaaggugauuucacugugagguuaugaaagcaauggaaacccuaguuauuuguuuggguuuuuaugugucuauuuauagaaaaaugcuucuuuuaagucuaauuuuaacaacaucaacuaaguuaaucuaaugcuaagaaaauugacucuacuuacuauuucaagucacaguccugaaacugagucuugcugcaauccaaaaauaaaacauugauucaaacgaagagcagccuacucugccauggaaagggcagcuacagcagucaugauaucauagaugugagcaggguaaagaauuccuacaccauccaugacauuguaggugugugaaaggacuacaccauucaugauacuguagguguguaacacucagccaauauuugaucugggcucucaguuucauauugcaugcaucccuucauuuaauuaacuuguaaauaacaacacuucguggcagcuaagcaaauauuuuaauaagccaugaaagacaagauauaagaacucuguacuuucagguauuuagaaaaaaaaaauguacuugccauaaguuaaagcagaguugccauuugaaauuuccuucccuuaaaaauaugcuguaacaccauguguucauuguugucuuuucagccuuauaaauauaugaugugacuacuacaucuuugugaaauuuuguuuaacaauuaaugguuuuaacaaucugaacaacaauucaaggcagaaguaaaugcauaaggaauuugagccuguuuguaagaagucuacuccuuauguuauauuuacuauauucaauguaaauaccucacugauaaaacacuggagcuagugaauguguaaauaauuauguucuauuugggccuaaugcauuccuguaaugugaauauuuaaaauaaaagaauucaauuuaaaugcacaa

SEQ ID NO: 1811 - RNA, 22388 nt, Mus musculus
uaggaggcgggaccugggagggguagcggugcggccgcaagagcugucagcccugguaggauucacgguucuuucucuuauccgguggguccacgcggaggcagggucccagaccccggugagcaauugugaggccccggaacugagacccacagggacuccgcagcuaaccccugcgcgcucgcccgccagccaaucgugggccgccugccugcgacgcccuuugaccccgggccucuaggaauccagucgcgcucagcccagcagcccgguuccgcgccgguccccgccgcuagguuaguguccgcaccgcgccugagcccguccuugucugccuggaugcccgaguuggcccugaggugguucaucaccacucgguccugagccccgaaccugcgagcggaggccccuggcggucgcccggccgucuccuagcccagcuuacgaccccgaaggccgccaggacaagugcguccuccuccggggucuuuguucuguucuccuuuaacuggccgggcucugccuuuuccacugucccuucaggguggccgucuccuuuucugucugcggaggaacaaguuggcgaggaccggagcuuaaaacuuuuguuuuguuguugucaaagacauaaacggauaauauagugggagaaguacugaaaauggcuuacaaggaggcuuucgugagcguuguugugggucuggaaugagcuuagaaagacaaaugagagugguuggucugaucgcauugcaaugugugggcugcagcuuggaagaaaaaaaaaaugcagaacuacuguagguuuuggugaaacuauuucagguuaguuacacuuacaaagcugcugcucuuauuccuauaauaagcaaugaguugaguauguggucagaaaauaaacacaaugagcuagcugccuucuccuuaagugugagcuacagcggaaggcgagggaaccauuguuaagucaccuuccacagugaaaaaaugucauuguaguaugacuucucuacuugaggccgcucagggcaggcuggagccaggaaccuaagguccaguacaguguuuugccuuuguagggugcucagcuguuuacuagcccaaaaucuuggaaaaaguucucugcucaguuucaucaccuguaacaugaaguucuguuucauagacgguugugaagauaaaaauggaaaaugagauuaugccggacagaacuuguguacaaaagauuacccacacuuugaccugagcaagauucugaaaguuuuagauguguguucugagcguuagcuguaucuaacuguagguacuuccucuagcauaaaauuagaagaaaauagcaucaacagaaugaaauaaaacaggaagaaucuuuauaauuuaauuauaacuuuaaaauggaaucugcauuuuccugagcuauauaauaugagcaaaugcauuuaaaacaauccacaacauucggcuucaggguuauuuagaucucuuagcugcuugaggaguauguaguacuauucauucgaaaucacuugacuuucacaacauaaaauuagcaugguuucagaagaacuaguuuucuaacucgggguagugcaaacuucccuuugagugaggacacauuguuaguagucaguagccugagcuucuugcuuuaagaagcuacacaccugcaguugacuggaaguuugguaguuguuuuucucacaagggacuuaugaaaccucuuucuuuaguuagagcuaaguaaaguaguuucuuugucugucuccugcaagagcacugcuuguuuuaugcuucaggggcaauguguugucacaaaauuuaagaugcucuauuguuuagauggucuucaaaauuauugaaucuucaugaauuuucuuuuacaguguuguuuauacaccucacacaaaucauaaauuuucuuuuacaguguuguuuauacaccucacacaaauauggucugcauauguauaauagaauauguuacagauauauuugcugaauaccuaccauuguaagaaaaaggagggccaaaacuuaaguaagcugaauaauaaucagagguauauaauauuuuuugggaucuaguagaguauaaauacacuaggguguauauauauauauauauauauacccuauacacacacaaucacacacacacacacaaucacacacacauauauauauauauauauauauauauauauauauauauaugcuguaguauauauauauucaaaaacuuguacacagauaaguugguauaguguacaguguaagaauugccaacauuaaagaagagcaggguugcuucaauagaguuuucuacucaggagucuuuaggagagacgugaggagagaauccagacuuuugcuuugacuugaaccuugaaugguauuuuagagaauaaggcauaugcuguauuuguuuguuuguuuucugcagguuggacuaagggucaaaccuagaacccaaggaauuguucaugcuacacauauguucuaacuacugaauuacaugcucaaucccauaugcuggauugguuguauuucaucuaucaaucaauuaauugauaggcagagccacaauauguaucccuggcuagccuggaaguuccagaguggccuggaaacucagagauacucugucucacagauucuuggauuaaagugugucaucacauacacccuccacccccugcuaguucuggauuauuuuccugauacccauauuuuccucaugaauaauugcucauggcucauaacuacuuaguaguacauugucagaugugaaguaagccuucauccugacaggaacccuaugagugagauaacuggagcagauaaaagaaauauagaaauguuaggcuauacaaggaaaaauagaaauguggacuucuuguaacuauagagcucaagaaauguuuaaauaauauuuuuuacuuauuugaaaauuucauguguauuuauaucucagucuuaccuacccacuacucaccacuccaacauuguccagaauuuggccaucacauaucccaacuuuauguccucuacaauuaaugauugauuucuauuuacugcugcaugauaacucauggguguggggucaucuccugugguaugagcaaccuaaggguggccacauccccaaggauaugugacucucccucucugcaagcagucaucaacuacugguaguacucagcuggauuuggggccuugagaacacuguuccaugcuuauucuuguguaguucgucaaaguuacuaugaguucaugugugcagcagccuggucaugcucaggucauuucacagcaccccuuuccaccuccagcucuuaaguucccacuguucuucuucagcagcguuccauauuccaguguuguaggggcaugguggugguacagacaugccaucuacagccaagugcucucaguugcugauucacagcaacuugaacaguaaggaaucucauuaacuacuaucaacugcaauaggaagcuucuccgacuuagagcaacauaaaucaauggauaaaaaaauauuuagacguacacacacacacacacacacacacacacucacacacucacacacaccuaccuuuaguguuuuuuauguuucuuucacauuuauuuaaaaucuugaauacuauuuggugauuaauuuaaauacuucucuuuuuuauuuucuauugccaacauuaccuugcaucgcccacacaguaaguuuaucuaaaaacaaaaauguucacauuaauaaagaaucuuggugagcuauccauccucacacaaguguaucauuagcauguuucucaaaugccaaccucaauuguuuuucaguugcauacccugaccaguccauuucacaccagccuacugaguuaguauuucuaaaguuaauccuauaguuacaucuaaaucuauagcucucccuuauuuauucauucacccauucucucuguguguuuauucagcauucaauaccaaugcuuaauuacuuauaaaguacuuaaccccaaacacacaguucuuuuuuaagaguuauauuuuaaguuuagaagaaugagaagagauuacuauguuuuuuuuuuuucacuuagagauagcaacuguacaugcuucaagcauauuuccaguuuguguuugauuaaaauagucaaagucauaucuuaaaauauuuuuuucugcuucauggcucaucaaaaauuaucaucuucuuuaaucaaagggaaggaaggauaugguauuacauuuauaguuuggaaaauccaggacagcaaguuacagcagcaaaccaaagugguuauguucuucuaucacaacuuccuucacaacugcugugcaaugacuagcucugucacauuugcacagcagagcauucauuuccuguuguuaugcagugcugagcuugaagcucuauauagacuucaaggacuauauagaacugauccuuccugaaauaagcagagguuauguucaggucucauaugcacucuauacuugccuaauggcauuccuuuuuuuuuuuuuuucuuucauuaaaacaaauuuucaccauuaaaaaaauguugccaaaauagugaaaacaauucaaguccuauauucuuacuugcaguguuaaucauaucuacaauguaauugcauuguguuauuauauaugugaacagccgucucuaagcaaguuggauagauugguuaggaauuuccugggaacccaaauucauugauguuuaaguuuaucugagaaauugaauacaauucacauguuuccuccagugaauuuuuaaucaucuuuagaugguaauaaucacuaucaauauugucaaaauagucaguauucuguguuuagagauuaaugauaugaaaaaaaaucuguacaucauugccacagauauaaaugccuuugucaguaggcaucuguggguacuugaaucauggauauagaacuccaauugacuauauacacucugcauaguggaugaauacacacacacacacacacacguaugugcauguguuagcuuuccucucugguggugucuagaugcuguaugcucugaguagguagagcucaggagagcaaaccaacccacagcaccauuaauucauucaugaucugguguauguauauaguugaauuuugggaugccuuuaagaaacaugaaaugaggaaauuugcaggaaaauugagguauuuggaauguauuaaauaauguaacucaauucaaaagucaugccuucugucucauaugcauaucuuuaagguaugcuuguugguauauauguauguaaagaggugggaaaauggauauacguuauggaacuucagagaaaaauucaggagugggaaagguguugaauaggagguaaggauaguaggacucaggaagcaugacaguggaaaggaagcuggggugucaggggcugggggacaagaaaggaggagacccaccaaaaccaaaucugcuugaaagggccaucagcaaaccuaagacauuuaaaauguaaaauuuaaaacuuuugauaaaaguuugaaaaaaauauucaugaugaugaauggagaucucaucuccuacugagucugcaucuuaaccguguugaauuaggggcuauguuucugacucauggguuuuuuauuauuggcauguacauaugauauuucccagucaguaguucuuguauauauguguuugcuguguuuguguauguauguguguguguaugcgcgcgcauaugugagugugucugcgugcauguuuuuuuauuugacaguauuuaauaaugauuauaauacauuuuauuuuuuaauuguagugacuguguuuuagauaucauuuuaaauaccuuagaaaauguugauaucaauuacuaaugauccuuuucucaaugaauuacagaaaaacauuuacuaguuuggaguuuaaaguaugucaucauggcaaaauuucgaagaaggaccugcauccuuuugucacuuuuuauucuauuuauuuuuucucugaugaugggcuuaaagaugcuguggccaaacgcagcauccuuuggaccuccuuuuggacuugaccuccuuccagaacuucauccacuaaaugcgcauucgggaaacaaagcugacuuccaaaggagugauagaaucaacauggaaacaaacaccaaggcuuuaaaaggcgcuggcaugacugugcugccagccaaagccucugaggugaaccuggaagaacuaccuccucugaauuacuuuuuacaugcauuuuauuacaguugguauggaaauccacaguuugaugguaaauauauacacuggaaucauccgguccuggaacacugggacccucggauagccaagaacuauccacaaggacaacauaguccuccagacgacauuggcuccaguuuuuauccugaguuaggaaguuacagcucucgagacccuucugucauagaaacucacaugaaacaaaugcgcucagccucaauugguugguaauuauuuuauuuuauuuauuuauguguauauaaauaauucugguggacaauuaaaucauuaauaaauaucauucuuuuauuaauuacaguaauagguaauaccccuugauuaaaaugcauguguguccuuuccaaguuuuuuauguugugguguuugucauuuguuuuuguugauuuuugggggguaccagggauugaacugaugaauucacaugugcuagggcaaccccuccacaccugaccuguagcuucuuuugugcuguauugugaggaagggucuuuaggacugaagccugguccuccuguuuuagcccuagugcuuggaaggcugaaggcugaaggucgugaguucagugcaggggacuuuuguccccugccuucaguuugucaucaucuucauuuccuuauuuacugcugacccugaccccacucuagcaacuggaucugauuucugucccugggaagugcuugggauuguuccuuuaugacacacagcagaaugaguuagcuauccuguuugcuugucuuaguuugcauagcacaguauuuugugauucgccuaugugguaagaauaucaguuuuugucauuuuuacaggggauuacauuucaucauaugauugaggguguuugcuucuucagccgugcauuggacguuccaccguguuuuugcuuuucuguagccuguggcugggcuuugugacuugagcucccccucccccguugcaaauccuuugucaguuucauuuuuauuuaauguaauaugguuuuuaauguuccauuuugccuuuccauuuguccuguuuaugcuccucuccuaacuuuguauaugccuuaucugacauugaauaucugaauuauuucuuccuguagucucuuuggccuaguauauacgguccuuguucuuacuucuuguuuaauaugguggagcauugcaguguguaccuuuaacacaacuggugaaaagugaucaguuauucucuucucaccaaugccccucauucaacucugcccuuugugugauuuccagguacagggcuuuagauaaucauaaaauccuacaaugacaauauauaaucuggugccuggaaaaugguuuagaaucucuaagggccagugucagaagauuucacauagccagggcuguugucuuuuugaguuccacuaauaaagccugaaacuuucuuucuuguguucuuuucauugugcuugcuuauacuuuauucauuguucuuugauacaugcuguuugagcucaggaaaguuguuucuugagugacauugcuuugucuuggcuguugagaaugcugaugcuggcucacuuaaguaccugcauaaagugcagcagagacaugugagcauugagaaccagggcuugauagugcugcuuccuggaacugcuucacucccucaggcauucccaaggaaacuggcuuccaggauuacuuuuauuacuagcucaaucauccuucugcuacgaccucccuucuuaaggaguaggucuuugccuucaugccauuacuuuuugccuauacuugauguuggucggcuaugacgucaguagcuguuagaaacguuugcauaauuauuauaaauagaaucucgguuugaacugugguagaaugcuacuuuuaacauucacaugcuuuguggcuuuugacacauacuguuucccuugugugugauuauauucacugguuuuucugagaggaaaauuucuuuccugagcuauaugcugagaaaguguuuauuguugcucuugaugcuguugucacaguugggcuacugggcugcuuaaauguugaucacuucucucccagcauuucuuuucaccaacauccuuauccaggugcagcucauuuauucaauagccauuguuucccuguaucccuaaccaccaucaguucuuuauucugugcuacauccuuuugcuguuguuuggauggaggacaaagacagccuuuuccacaucagcucuaaugaaauguugucuugguccucuauuuagaauucgucuguacauaguuucacuaugacaaaauuuaaguguuaaauucuggcucucaggcaauuucuuucucuuuaucggcuaaguauuccaccugugcauuuaauguauauuagucaaauguauuccccauccccucccuccuaguuccuucccuauccuccgaaccaccaccacuuuuuguuuucaaccuuauguacucuguuucuaaacuaagucauuguguccaauuagggccgcucauauaugcuuucuaggacuaucuacuggaacauggguaaccucuuugggaccacaucccucuagaaaacuuauacuccuccaacagccuuaacauugccucagcuaaugguucuggauuuuagcugacuugauuuuaagacauuucuuaucuugauuucuuaauuugcauaaacuuuccuuuauacaacauuauuauuucuuccccuaacuuaaaauauguguuaguucauugagauauccaugcugucucucuacuauaccauuuuuuauauuugaagcuuugaaguauuuaucuuauuuucucuauaguuagcgauuucucuguagacugguguuucucauaccuauauuguaauuucuuagcauagaaauaauuagauacuauaggaaaacacuccaaucauguugcuuuuauaaaaucuuauaaaugauauuuauguauaaaaacagcauagggaugguuauagaaguauuauucauaauugccaaaaauuaaaaagcuacuaguguguccuguaauaggaaaguggauaaacauccacacaguggcuaugcagcaguaaaaaaucuaugaguuacugagucauaaaaaacaaggaugaccuaaaauacaagcaguuacacgaaugaguccaguuagagagagcucuguaccuugagauucaagcuauaugacaucccggcaaagagagaauuauagagagugaagaaucaguuauugcugggggguaaauggaagggggaaggggugaauaggcagaaggacuaauguuuauaggaaacgaaucugucugauacuauagugguuagcucauaaccuuaugcuuuucuuuuucuuucuuguguguguguguguguguguguguguguguguguguguguguguguguguuucaagacaggguuucucuguauagcccuggcuguccuggaccucacuuuguagaccaggcuggccucaaacucagaaauccgccugccucugccucccaagugcugggauuaaagacaugugccaccaugcccagcaaccuuaugcuuuucuuaaaauccaccaaauuucacagcacuaauaaaagcugcagucaauaguaauaauaauaugaugauacuguucaucaaauauaguaaauacugcauaugaaugaaaggugugaauguggagaacuggggaagaugguuggaacuguaggagauaauauauagggacuacaugcuuucuugcugagagccuucauuauucuaaaauguguacuacauuaauaucagaagauaccaauugcuuaaaauaguucauaaauauuagauaccauaaccaaauaagugcaucauuuuuuuuaaugugcuuagucaugucgccagcucucuccaccggcaucacuguugauaacgcccugcugcucuuguuccuucuuaugcuucucgauuaggaguucuggcccugucuugguacccaccugauucaagggaugacaauggcgaagcuacugaucacuuggugccaaccauuuuggauaaagcucauaaauauaaucugaagguauauaauuuacuuuaaaaguauaugugucauugcuaauccucuuauccucaugauaguaauaauauuuuauguacucauuuuaauuaaaauuugauauauguagaaauauuuuaaaacaauacugcaucuuaaagguuuguuuugauaauuuaaauuucagaaccuauauaagauacuccuuacuauuuuacugaccauguuuuauacucauuuauuagauuuuguuguauuuuuaaacaggaacucccaauguagcucuugcuuggaaccuauagaccagguugacuuggaacucagagucauccugccuucucccucucagugcugugauuaaagacauguacuaauuugucuaccccguacuaugugguuuaauaagaaaaggaggguuucuuugugaacagaguauagaaauuagugaaauuaaugucugaguauccccuaaauuccaaaaacuacuaugcuuaacaguauaaccuuacaucuuuauaaauugguuagaaaauuucugacaauucuuugaauuuuaaauuuuauauaguucauucuguuaauguucauccuauugucuaucagauccauccccuugucccacccacucaguccccccaacacacacacgcccuguuuaauuauccuggcaaguccacuucuugguguucuuggauguuuggccuucaacuggaguuugauuggccuaguuaggugcauacucuuaaugaaaacugauggcaccucucccagaagcuaacaguuuauguguaggacuugauguccagcuccccucuccaugccucaauuguauucaguuugagcuugcacagaucucauugaugcugacauaacugcuaugcauucguauuuguaccuacccuguuuuagccagaaaguacuguuuccuuuagucaucugugcuucugauucuuagacuuuuucuaucucuucuucugcauugauucuuucuucuaguagagagaugugugauguugaugucccauggaaggcuaagcauuuuacagcuucuuauucucuggaucuugaccaguucacauauacugcagaaacaauagucucugaggguuacagaugaacuaaucuauggguauaaugauaagucauuaggaauuuggcuuaauauuauaucuacuuagcaaaauaauaguaguaaguucuccuucagagacuaugguuuauuuugccauaaauucuuggcccuauaaaggcucuaguauggguuucaucuaaaagagugggccuuaaaucagaagguaguugguucucucaaucuuuuuuuuuuuuuuuuuuuuuggaucauucuuuugaauuccuugucugguauuuuauucugguuucucauuuugaaaaucuaacacuguggaacugaauauuugagaggagucauguugccuuaacuuuuccugguccuuguuucuuugucaguauuuguauaucugguuuuaggccauugugaguguuuauuauaucuccuuuuuuguuugcauugaaauuugaaauuccuuuggaaagucuuggacuagcuuuuagcaggguuaaggugccuuuccccuaauagcucccguauugggcaugcaauacagcucaugugcgcagggagcaucaguuauaauauccagcacagcuucaauaacagaacauugcaggaaaaacuucacugauggguagaccuacuaggaaaacucauuaaguuuaaggaccauagagaauaaaggcacaaggauaguguuugcuaggauauuacuuacuaaggggaggaauggaaagauaauaaguugaguaugaacaagaauucauguaaaauaguaaguagcagggaggaaguaggaaauuuguuagggaaaacagacccuaaagauuacugacauuagaaaauugcaauucaaauuagaggaagugguagggaaagagaagaaaauaaaaugaaguguaaaugagagagaaaguauguggguuguagguuagagaaauauaugaggagacaauagaaauaggcguuaaaucaaauaaauaagagcaaauaucuauauaagggugaaaguuuuuuaaaaauuaaauaaaaaaaaaccucuaauuaaaauuucuuccuugauuagaaaacaucaaggaaagcccucuucugcccaagaagucuugugcauuugaauuugcugguaggagagcuguuuaccuuugugugcaguucaaaccugauuacgcagggguuacccaaugaaacccugaauaauggcuguaccagcccauuccugucucucuuugcaaauaaaacuuuuaguccuacugagggucagccugccugugccagugcucuuaaucugacauuccuuguuucagaguuuuaguucaaaggaacucccaugagggguucugggauucucugggucuccucucuugggguuggauuuuggagacaugaguauguaguuuucuauacuucccagcaacguauuugcuugcaguuuccccuuguaccaacaaaauaugugguauuuuagguuagaggcaguggguaacuucccaguaucugcuucacaguuuguuggucuaccuuuuuuguuucuccuuucuuucuuuuuauuuuucuagaaguuuacuuuucugucauuuauagauccaaacuagggucaaggaaggauuuuuuauuuuuaccuuuuuaucauuuaaacuccagcauagauuucuguagcccuaaagaaagccuugagauaguaucucucaaugaacugucauuuggcgccugcagauagucaagucaucaaguucuggaacuacaacugagguugaauaagucguugauuuauuucaugcagaguaaauccagggccccugaucuguccagucugugccccaauucuguggggagagguaauaaaauuggacauuuuagcuuuaaugaaguuuuuaaagguaaaguuguuaaaaucugaugauacaugaaaauagaccccuuuuauuucuacuaaaagcucuuauauagaagaagaauguaaugaagaccucaguaaacaucaacuacauacuugaucucuccauuuaucagauuugauauuuaauaaucaguaaaagauuauauuugauaaaauuuuuuugcugauauucagauuuuuuagugcuuaauacuaauugcucaccucaguagcuuuucaacuuaccaaacguacuuugaaaauaguuuguugauuauccuauauuaauuguuucugauuuuggggguuggauugauuuuaaaguucucuauuuggaagguuaaaaaaaguuguccuucucuuuuguuaaugcuugauuagaaaaagaguuucuaggcauggcuuugccuuauguuuaagcuauuaauuuuaauuauauaauaugcuaauagcauuacuuacuaaaugcuuuguaaugguaauuuugauuauuuaaacuaaaagucauuuuaguugaguguuuuuaauuauaaauaagcaaagcuaauaaaaauguuugaagaauuagugacuuguuuugcauuacuguugaugcaaauauaaucuaagugguggcuauuuuuuuccacagaugaaauuuuuaauauauaaauuuguauuauuuacuagaacauacauuuguaacacuuggaacugucauuccauuaggguagauaugucacaguuauaaagucaaaacugaaucauuucugcucacugugucuucucuguguaacauccuaagauuaaaaaaaaaaaacaaaaaaacaaaaaaacugugaaacaccugcuuuuagcagacaugguggagccaauuggaagacucuaccacuucucgaauugggaguuucuuguccaguugauguuagguuuucugcuggccuuuuuuggcucaugaaucaugagaaaaauagaaauguugcgugcuuucaugcuucuauuuuguuuauuugcuauuuuaauaugagaagacaccuacccuucucuugugacccuagugacaaaaaccaugaaacuuacuuaaacuucauucacagccuagagcaaugucaucacacuaauacagacuuuauuugcauugaauaaauaaaauguacaguuaaaaauuguggggacauuuguuauaaagcaucaucacaucagaucucaaagaaaccaaagauccuaucacaauaaauucagcuggagggaucaauuuguuuuccuaggaguauaaggaaaauaaaaacuucaguuguugauuuucuuauauugcaauaaauuuaacauuuuauuuuaaaguaacagguuuuuguaacguuuauauaaaccauauguuuuauacuaaugguuuauaagcagucauguuucuugaaugaguaguauaaauucauagugagaaauuagcaaauuuuaucuaaaugagaucuaagcagugguauagaguuuaauuuagcuguuauuucauuuugcauugaaaucauuaauauaugcuugcauauauucauacaguagcuauuauguaccagauucugguuuugguuuggauugguuugguuuuuguuuuuggggguuuuuuuuguuuuuguuuuuguuuuuuuuuuuuuuuuuuuuuguuuuuuuuuuuuuuuugguauaugaacaguacucauccauccacacuuacagucuuagguguaagauagaggcaaagacacaaccauaucuacauaaaacacaaaugaaauagauuuugcaucuuauguuaagagaauuugcagucuucuaagagacaaaacaaaacacaaguaaguuguagaaagagaaaauuacaaaauauuugauacugccaguuguaggaggacuuagcaucacucaugacauaaugggugcuaccaggugaaggcaguggguggcagaauuaaggaagaaguauacaguaggauguucacaugggaaaguacuuuagcuacaggguucuaaagaguuugguaaagacaaaaucaguaguguggaaucaaguucuuacauguuucacauucucuaaaaguaaugcaaacauugaguuuuauaugugaaauucuguuauuuuagauuuuauuuuaauguuaguauaauauauuuuucugaaaggaggagaaaaacugugaccaaauccugucauuaauucaagauauauaauuaauaguugagaaguuauaaguguauaacaauuuacugaagugccuugaucugcauuuaauggaagaaggugaucuuuuauggucugcagcuccagaagcaaauugcaaggaugacuuggccugaguuuguuacugacagacccguccauaagugugcucuccuaaggacagaaugauugauuugcuaaauaccuuuacuugaaaauuaauuaaugaaaacuacauuugcuuuaauuacacaauuuuuaaaaaggaagauuuaagcuacaguaacguggcuuuucaccaucaggcauugugacacuuauaauguaaaacucaaacaauaauuucauuucauuggcaauaaaauguacucucucuggauaaaucauugaauuucagaauaauuuuuaugauuaucauuuaaaguacuuuauuccuuauaccguauauaucuuacuagcuagagauaauauaacaacauuguuuauuaguuaacauaauuucauaaaguugauuuuuuuuuaauuagguauuuuccucguuuacauuuucaaugcuaucccaaaggucccccauacccacccccacaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccggguauugguuaguucauauuguuguuccaccuauaggguugcaguucccuuuagcuccuuggguaauuucucuagcuccuccauuaggggccgugugacccauccaauagcugacugugaucauccacuucuguguuugcuaggcuccggcauaguaaauucaagaagaacgaagaccaaaguguggacacuuuacccuuucuuagaaaugggaacaaaaaauccauagaaggaguuacagagacaaaauuuggagcugugacgaaaggauggaccaucuagugauugccauaugcagggauccaucccauaaucagcuuccaaaugcugacaccauugcauacacuagcaagauuucgcugaaaggacccagauauaguucucucuugugagacauaaaguugauuuuuuacagcugaaauuuuuaggcagaaauuuuaaguaucugguugugauauuugaaagaaagcuuuuguuacugcuuucuacuauuacaauagugacuuauggaccuuagcaguauuaaaaugaaaauuucugugcucugugaagcuuucagauguaauugucuaaguguuuuuuuuuuuuauauaaacuauccuuugaauaauaaaagaauaaaugcauauucacaggaugccuuuuuaaggauauuaaacuaugauuuaaucgaaugcucuauuguuucucuuugguauaaauguaauggucaaauaaaaaagaaaacaauucauguuauuauaggggaggagguacaggaugugaaacaguuagagggcagaccgagaugggggaaaagacuaaacuguaaaaaaaaagauuaaagaauuaaaaaaauaaaacauaaauaaauaaauaaauaaacaaacaguauaguauaguauaguauaguauagucuuuuacaaucuacuucagaaagaaugccauccuauaaaagcuuucagucaacuaccucacauuguagcuaacaaacucagggcgauuggcaacuugcuccuccuaagccaacuuacaauuuuauuacgaaacaggaagagcaacaauaucaaccaaccagaccucccagagcucccagggacuaagccaccaaccaaauguacacauggagcgacccauggcuccagcugcauauguagcagaggauggccuuaucuggcaucagugggaggggagccccuugguccuguggaggcuggaugaaccaguguaggggaaugcuagggugcugcgggaggagaggguggaaugugggggagcacccucauagaagcaggggaauggaggagaggguagaagguuuaaaugggaaggcggauaacacuuaaaauguaaauaaauaaauaaugaauaaaauaaaaaaugcauuccuaauaaaaaagaaggaaaagaaaauggauucaaugaguacccagugcaguaaugagggcuaagugagcccauguguaugacaugcuugacuuacauauagucauggaaacuuucaguagguuuuaucuaguaagauagaguuaguauccacuggcuucaguaaauauucaccuuaauguuguugacuugauaacuuauuacuuauguaaaauguacuaccauagauaaugcuuuuaaaauugauauuguuuuucuuuuuuaggucacuuuucacauagagccauauagcaaucgagaugaucaaaacaugcaucaaaauaucaaguauauuauagacaagugaguuucuucaacguucauaguuauacugugugagcuggugguaaucacuguucugaguacauuuaaaugauaacugagaauugguuuaugagcugucauuucugauaauuuuaccacaaguaaacugaagauaauucacaagguucuuauaguucacuuuuugaugaaugaagggugguacauucacuauuuuguaugcuuuucaggcuauuuaugauuuccauuuauacucauuuuagguuucuauuuuuaaaaucuuaugaauauauauuuugucuuuuaaaagaagguucugaugagaugugaagugaguugauacagcaguauuugcauauauguuuccauuugcauaugcaguggcuaaagaauuuuguaauuaguuucauucugguaaaguauuuuucugauaagauucucuaagguauguuaucgucuuauaaagaaucaucucaacaacaaauggacaccugucacagauaagauaaaccaguuucuuuguuccugcagaucauaguaguuucucuauggauuuagucaccauuugcuuucuuugagauaauugagauaauuaacuuccugucugguaauauagcgagggucucauaauguauaaaauuaaaaauauguuugcauuauuauacuuauaaaacugacucccugaagauugauaaccauaugcuuaaaccucauagaucaguuucauuuuggugaauaguuuuauuguggcauauucuaugaauguucaucuuacuuuuuaauguaucuuuauuguagauauggaaaccauccagccuuuuauagauacaagaccaggacugggcauucucugcccauguuuuaugucuaugauucuuacaucacaaagccuacaauaugggccaaucuguuaacacccuccggaucucagaguguucgcaguucuccuuaugauggauuguuuauugcacuucuaguagaagaaaagcauaaaaaugauauucuucagagugguuuugaugguauuuacacauauuuugccacaaauggcuuuacauauggcucaucucaucagaauuggaauaaccugaaauccuuuugugaaaagaacaacuugauguuuaucccaaguguaggcccaggauacauagauacaagcauccgaccauggaacacucagaacacccggaacagagucaaugggaaguauuaugaaguuggucuaagugcugcacuccagacccaccccaguuuaauuuccaucaccucuuucaaugaguggcaugaaggaacucaaauugaaaaggcuguccccaaaagaacugcuaacacgauauaccuggauuaccggccucauaagccaagucuuuaucuagaacuaacucgaaaguggucugaaaaauucaguaaggaaagaaugacguaugcauuggaucaacagcagccugcuucauaauguaucccuuacaguuuaucacgucuacuagcuuaagucaacaugcuguguuuuuguuauggaaagaaaacucaaaaucaaucuguguuugcaauuauaaccuuuaucaguuauuucauuuuuacuuuuuaaaagauucguuuuccuacaauggauaauaccauacagagaaaacaucugacaagaaagauugugucuguaacauuccugaugaugugguauucugaauuucuagcuacauugaaaucuuaaugggauagccuuuuaguuuuuuguuucacaguagaaaaaaaaaugauuauauuaucaucacaaaaaguagcuaacguccaaguaagucauacuuauauacuggguccaaagacauagaaguauguacaugcuaaguacaucuggcaacaaaaguucaggcuaacgaacaguaaccagaugugcuucauuucuggucucuucagugaaguuuguuaauaauauucagauuccggcuggcuuccccuggugaucaaacucacuucucaaguuucuugugaacacaaacuuguuuaaguaacaagcuauuuuauuacauuucucuauuucuguuagccauggucuguucucgaauggcuuugugcagagcauccaucagugucaucauuugaagacuugggugccuguggcucuaagugcuuuucuauguuuaaugcccugccugguguguccugcugaauuaaagacuagaaacaauauauaguuuauuaaguguuaaugacugguacacgccuuuaaucccagcacuugggaggcagaggcagguggguuucugaguacgaggccaacuuagucuacaaagugaguuccaggacagccagagcuauacagagaaacucugucucgaaaacccagaaaaauacauacauauauacauacauacauacauacauacauacauacauacauacauguuaaugacugcucuuaucuaugaggaaaaccauuguuucucagugguuaaaauaaauguucaccagaaacuacugaacugacugaaaaaggauaacauuaauccucaagaguguuuuccuuuuaauauuuucauuuaauuuuacuguaagacagaaaaaaauugcuuaucacuucaaaacuagagauaaauaguuuuaaaguaacauauuuuucaguuauguccucauauuuggaugucuuacacuuuugguuuaaaaagaaacuguuagugauauaguuacaaauugaaaaguucuaugcuaaaaauaaauuuuuguaaaagugaaaauaggagaaauugacugaauucaauauuuauaauuaaaauagaaaaaccaccuagucuauauaauuuuacacaacuguuauuucuuaguacuacagagaggaccaguugaguaacacuaacaaauauugcaugccagccuucauagcauaaagacauuuagaaaccaguaaguucugggauguauuuuaaaauacacagcagagaggaagcaguuuuaggguaagagugacugcucuguggggaaaguucuugcugugcaagccugaagaccugagucugaacaccuagaacucaaacagauacgagcucacgagcaugcauguucuaguccacggcuucuccagugagcgagagaaaguggacacaguacagagcccagaagugcaugagccaguuagccugccguacacaacagcacuaagacauaugucucaaacauggugggcagcagaggucggcaggcaagguugcucugacauucagacccaugucaugucauagucagucucccucuuacucuggaauguuugaacauacuuacacacagagcuuuuuuaaaacgcauguuuaaaauaauucuuuuagcauaaaaucuuuuucaagagauauacuaaccuuauuaaauuaaaauuuucuauuuaucagaauauuauugggccauuaaaaauuaugaaaauaauagucugauuuuuccagauaaauuguaagaauaauuuaauauaguaguauuuuaauauuacacaucuccauugggauaaggagaaauauaaccuauagaucuuuuuuuuuugcuuugcuacuagauuaaagcugaauuuuaauacauagacuuuuacagcauaugcuguuuucuucauaccuuauguuacauuuucuauuugaguccaccaugacaaaaagugaauguuaugaaacaauucugagacagaauaagucuacgcaaauaaggucuagcaacuguccauaagaguucaacuuucucaguggacagcucacucuagcucuugcuguucccaguacaucuacccgaucaauagucagucagaacuuaaaauuagacagacguuaucuuuauuuuuuuaaagaauugcugucuaaggaaugacugaaauaucuuuucauaagacuuauuaguugauaauuauauaaaggaccauagccaccccucugguuuccacaaccaaauauucagccaacuaaggcucaaaauacuugggaacaaaacuccacuuguauauaucaagcauguuuagugugucuccaucccuuaagccauacaguauaaccaccacuuagauuuuucuagguauuacaaauaaguugagaggguuuaaaguguaccugaagaucauuguggaauuauauucaaauccuguuccacguuuuaaaacgaccuaagcauauucagccauuuuuaccuuuggguccugaagccaguucuacacagauaucaagggauggcuauauucacaauauugcuagugauuguuagaggagccucuuuuuccaggugucucugcugucugacuggaaacacagcuggaauugcaaugaucacaagucaaucuaaucaaaugauccuguucuuauuuuuauaaaucugaauauuaggauucaguaaacuuaaagagguacaguaugaauuaaaucaguuuuuuaauaagccuuuuguuuuguggauuaacccaucuaauuguuuagagaacuagauccuuauuucuucuuucaagauguaauuguaaaagacugcccuuauuaguguuugaauuguauauuaacuugcuuauuuauguguguaaaguggaaaauguuuuauuuuauuauaugguguuaauuuugucuaauaaaagcauaaaugaauacuguucauaac

SEQ ID NO: 1812 - RNA, 1688 nt, Mus musculus
ugcuaggauuaaaggccaccacugcccucgagauucaaauaucuuaauccugaaucccaacccauucccacccagccaacccagaaaguuucaucccaggcauucauaagccucauggugaauuaccacucugauaugugagcuuaggcauuuagauugcaucuuuugauagauacaggugcccaacagguccaaaacucgguaaaaauuuaguauucagaauacaucagaaaucauugucauaacagugaugcugaaagccaagacccuggguaaaacugccuagaaagugagugcagcaggaagaaacuauuguuugucacugugacuaugacuuacaaaaugagaaugguagcucacaguagcuuccugucaaauacaaugaucuacuugcaaacauguucaauuuacucuuuuuuuuuuacauuauccuagauuguuguucuaugagaaagcucccguguagugaaauugggaucccucucucuccccuccuuucagccuguuaggaagcgcaggacuugacauucucaagagcgcauccuuggucacuaauuuuaacuccaaugguuccacugguuuccagucaaaucaacuaaaacucagcaccuagcuuaaauuuaaaaucguguuggucauacaacaugggcaauaccuuccaucuugggguucucugaccuaacuugugacacucaaacuugaauugccaugcuacugcugaguauuuaguaagcauacagcacuagcauuaaaggcaggaaaggaaaagcuaugagaccauaaauagggaaaggugccccuuauucgaaguugaaacuccucaucggguuaaaaauaaauaaauaaauaaucucaguacaaccaacauuugcuaugaagacugccgacacaaaggcaacauuccuuccuauaaagguaucuuagguuaaacuagcaguggaucuuugccuaagguucaagccugugcccuucguccuuuccuagacauuagacuauuaacuuuguuuccaauuaaguuaucuuaacucuaguaaccccggaauauggggcuuuaccguagcaauccuaaucuuguuggguagucuucaggaaccacccuaugaucucccuuaaacucaacaauccuucagagacauuaguccuucaaagacaauguccucaaaggucgccaaaaugcuguacauaaacauuaaggacaaugaagcgugacucuccuuauagcucugaggcauaguggcuccucuuaaaauccgucgucuugguguguccacggauucucaaaccaaacccucggggcuguuguggacgacagccucgggaaggugacaaagcgaagccaucugaacugccuuaggaaguguguaaaacgccacuggugucucucuacgaugcuaacuuccauuagugagcgcucacgcgucacggugcuccccccgauggcgcgcgcuaaccgcugcucccgaacccccucgccagcucgggguuccgcuuaaaaaaguaacgggcucacggcugaaaacccgacaugaagaggugcccaaugagcacaagacaaacccuaggcugccugaccgcagaccgcccagcacagagcaggggaaggcacgacgcggcucaaaagaaacaggcagaaagcgacggaguucaucuuucccgcuggaucccgcaggaccaaccgguccgccuuc

SEQ ID NO: 1813 - RNA, 1018 nt, Mus musculus
cuaugcugguaaugggcuucuuuauugucaaucccucucaauauauuuuguuugacaucauuauagguuuaacuuguucgugaccuucaucuuaacaauucuaacuuugugcacuccgcagccuuucuggaaucauuauuacuacggggaguaugcgcgaagugugugaaggcccacacgugccaugguguaaaauagaggucacaaaucaaacucugggcaucaggcuugcauuacaagagcuuuuagccgacuaaggcaucucacuaacuccuacucuuuuuuuaauuaagcaauuauuuccaggauuuguaagaauacuucagggccauuuuucucaaaaggucacucuuuuuaugggcaacaaucuuggacagcgaauccgcuuaucuuucacacaggaccuguguugauacagaguaagucacugugcgcuuaggucgcacgcgccggcagcuccucguuuggcgacgcgaauuucacucucagaaggaucagucaaccggcuaaccucaaaagcuacuuccgcuucccuuccuacuagcaguggcgcggcagugacgcauuuccgcccacgggggcguggcaguagucgcgccgccgcggguugaugacgcaacgugaauuccuucaccacgugugugucugcuugccggcuuucgggggucuucuugccgucguggguuuucggccgucaccccgcggccccguggccgcggccggagacuauggagcaccucucuguggagcugguauccgggccgcugcggcuaaucgccgccaagaacgagaagagcagcggcgagcugaacagguuccuggccaagucggugagcgugggcgaagggaggcgggcccgggucgcggagcgccgagucccgggaaagggccuuuguuuuucggggucagcuuccauuuccucgcccccugcccggcgcucaggcccugguggaguucaugcccuucaggaaucggcgcgguugguuuuucugcgaggcugcuucuguccgccucccca

SEQ ID NO: 1814 - RNA, 2020 nt, Mus musculus
cacuuccgcuccugagccgcagcagcuuccgugggcaacauggcggcaucccgcuugccucccgcagcccugacgcugaagcagguacugcugaucucucagccccgcggagguguccuguguggucgcgcucccccugcgaccuggcucgccgcggccaccgcgggccucggccgacagccucagccucccgagggcggagcugcuaggcgugccccgcccucgcaagccgcccgcccgccgguccgcaaggauucucucuuguucuguuugcuagcgaggaccaaagggcuauuucugcuugcugaguggagccggcugguuugugguaacuugucuuucuccuucccuugagcaguucaugagaaggcagcaaguucuccuccucuacagaaagauuuugcgagcgauuaggcaaguuccaagugauucugaccgaaaauaccuucaggauugggccagggaagaauuuaaaagaaacaaaagugccacagaagaggugagagcaagaccacgcuggggccacggcuccuuugucccauuguaucacugagcuugugaaguuuagcgaacaccuuggaauaugccacagagaauuugcucacugcccacuggguauuuuacauuuguuuugcagcacaucuggcuuuguauuguguagccuagcguccagcuuuccacuucacacuacuguuuuuuuuugggggggggggguggauggggggagugccuuuuggugacaggauugaauguagugccuugggcauugguaagcccacagcuacaaccuguaacagccacuguugguucuugacuguaccagauacaauaauagaacuuugccgugguuaagcugguaaaacaaugacuagauuguccuuuccuccacaggauacaauccgaaugaugauaacccaaggcaauaugcagcuaaaggaacuagaaaggacgcuugccuuagccaacucguaacuggaagauuuuucauguguuuugcacaggcuccgagccacugucauagagcacccaaaaaggugauaaucacucugaucaagaauauaagugaagcguguuaauauuuccacuacaguccguggcuguaauaauuaaacgugaacuaaugucaagaugagagguuggaauccucaauugcucagagggaaggugaaauggcagccccuuugaaaaacagacgacuaguuagcaauucuuagaaaggcaaugaggacagggcugguaaagauagcuccucaugaagacucuugcugccaaggacagaaguuuggucccugugacacucauaucguggaaaaaaaaaaaaaaccacuccagaaaguugcccuccgaccuccacacaggcacuguggcacacaaaccaaaaugaguguauguugugaugugaucacaagcuguuacaaagucagaugcaggacuggcaguguacugcccuagaaaagugauucucuugcugugggucaugaccccuuuggggccaaacaacucuuucacgggggucuaguauuagguauuuaugauucauaacagcaauauuacaguuaugaaguaacaaaauuuuuacaguugugggucaccauaaaauuagagcuguauuaaagggucacagcauuaggaagguuaagaacuggcuagaaacagcgcuagaucuugcuugaauaaccugcuuuguccuucagaguucugaagugacuuucuucaggugugacaugguuugauaaccauaagacugaggucucgcggagcuuuaguggaaauagcuaagaacaccaagaagagggagcacugggugggcaguucagcuccugcaccuaacauccucaugaaaugaugaaucagagcacugacugcucucccaaagguccagaguucaaaucccggcaaccacaugguggcucacaaccgucuguaaugagaucuggugcccucuucuguugugucugaagacaguuacaguguaccuauaaauacaauaaacaaaucuuuaaaaaaaaaaaaaaagaau

SEQ ID NO: 1815 - RNA, 40407 nt, Mus musculus
ucgugugaagagacaauuuauuuagacagguauguaauuuguuauauaaaugcaaagaucuaaacauauaaauugaucauucaaauggacauuucaucauuuacauguguggcaguguacauuaaaugguacuuuaaguaauauagauuucugguuuuguuuuugagauuucugcaugcauggaggaaggaaggucaaaacauacaggaguuauggaggccgggagagagcuucagauuccguagaacuugaguuuaauaauaauguuucaaagcucauaaucaaguuguauaaacacuugaauauauguauaugcauauauuauuauauagaggacucaagaaugcuucccugggugauuacaauccuugugcaaaacaaucucccuucccuagcuuuguaacaacucccagggaaacaaggucucccaagaacauuuaaaauacagauuccuagccgacuucccagacuuugauucaggaagcaugaguuagggaugggaaucugucguauuaaacguccuaggugaugcuuagggccagaacaaugaaaucgggcaguacuuuguggguugcugauuguuccuuacacacgugccccaggcaagucccuuucucacuagaugaacagacauucagggcugaucucuccaggugagccccuucacugcacugcuuuaagggggggcggggggcucauuaaagggcuauguccagaaucagcaccugcguuguguucuaagggcucaaagaggcugaagcacuugcccaauguaugugggaagguccuagacuuuacugacaccaaaggaaaauaggacuuuuaaagaagaaggaaaaaaauaggcaugauggcacacaccuuuaguucuacaauucagaaggcagaggcaagcaggccucuggaguuugaggagagccuggucuauauaguuccaaggccagccagggcuauauacugagaccacaucucaaaagaggguaaauucaguuuacauacugauuuaucuucauuugcauaaaacuagaacugcguaauugagagauuuggcuaaacagucaagggugguuguaccagcuuguggcccaacugaagacaggcugaggcaggaagaucuguugagcccagaaauccaagaucagccuggaaugccauuaagagaccccacuucaagagguuauuuuuaaaacuucuuuuuauuaaaugaaccuaacauaaccaauaaaacagugauguauauauauguauauaguaaacaucaucuugaauuucaacaagagaccauucugcucccagaaaacuaagcuauggguacgggguacgucaagccaucggcacacaaacaugcuuucaaguuggcaguuaacaucccugaagacuguguuacaaaugaaguccuagcaacagcaaaacagugugcuugauuacaaacuacacccagccuguguuuguugagugcauaccauacgucaaucaugacaguuccauugauuugauaaauucuguuucagacucaguugacaaauaacccauacuuaauaguacugcugugauauuuagccauuuucuauuuaaugauccaaaauauauuauguucacaaaauaacacgugguaucuauuaaucagcuuuuauuucuacuccuucaaaagcacucuguacaggucacucacacuaaccuccauuaugacaaguaauucggcacaacucuuacauagaagcuguacuugacucagagagcaaaagucugccugcucuacacaucuucaaguucucaauuccuaaaaccaaacacauguucuacugaagccaccguaguuaggaguuugaccuuucaguuuauagucccauuugagcauagacacagaucuacagugcaguaagcuaaccccccaaaucuaagauaaaauacaaaacaaaugugaggacauuucgcaauucuagucacauucagacaucuucaagaggucagugucacaccaggcucgaggcaggaaucaguguuguaacuaaagagugcauuuaugaucaggaacaugggcccuaugucacaggaguguuccugccuaucccucaaagaaucacaugcucuugaagugauaggcuuuuaaggcacauuucaacaacaaaaacucaugauauaaccagcuuaaaaauggaagcgccacuuagacaugcuaauuuuaugugauuuaccagacaggcaagugucuuauuuugaaacuacagucuuauuaaaaacuuaauucuuugucuauucaaagagaaauucuuuguuuaaaaaaaaaaaaaaacuauuaagaaaggaugcuggggauacuagauugguagagugcuugccuucacaugcacaaagcucuggguccaguucucagcacuguucaagccaagcacgguguugcauuccuauaauccuagcacuuagggaaagucgaggcugagcggucagaaacuggagagcauccuuagcuaccuggcaagucugaggccagccugaguuaccucugagccccacucaaaaagagaaaacuaugcuuuuucucacucucuagugucuuugugugggugcacagugguguuagacucuuaaaaguggccaaccaccauccacucuguuggcagaggccgucggggaauaguccugaagauuagaacuccaggcuccuaccaucucauucaagucucuucauagaaaucauaaggaaggagccaugguuccaugaugacuagaaaucuccuuaauaaugugcagacuacugggaggcucaaucuuacauuucaaucaucgucuccaguuuuaguuaccagcuccaaaaguguaagaccuggccagacauggugguguucaccuuugaucacuuggggaagcagaggcaggugaaucucugaguucaaggacaguccggucuacauagugaguuccaggacagccagggcuacauagagauacgcugucucaaauaauaaagaauuuggggaaaaggaagcaagaagaugggaagaagaugcguaaaagaagugagcuucaggagcaagcugcuuuagacacaaagcuagaaccagcuuugacaucccuaagggacucugcuuuaaaaagaaccuuugcuaaugccaugcacgccugacaguacuaacccuuagaaugguuugaaauagggcuagauuuaggacucuuaguucccuaccuaucuauaaaagcacacacauaguuaacugacuaacauacgucucuaggccuccuuuuuuucccaccggccacaggcuuucugugucuucugucuugcagagcaagcugguggcaagcugaucuugguaggaacaggcaaaggacaugagguauguuguuacagaugaaagaacgagucagguaacaaauggagccaccaaggacuaaacuccuguggucauggagcauuaaaaccugguccugaacaaggucucugaacauagcgcaucaacacaccauucccaggaggugaacacacacaagcacacgugcaucucuuaucugagugaccucugccuacaucugggaacccucuuggcuuguguguuuuagaccccucggcagguacaguauugcuucuacgguuucccccccacacaaaucaaugcuaucuguuccaaucuccucagacgacauccauauuucucuacacugguuggcaucauuuuagaaaucuggucccaaagguucacaagauacugcaccaaaaagaaaucacccgucugcacaaggugacugcaaagguguguugagguaaagaguuucauaaagacugggcgagucggaaggcaaugccauagggcacaaauguguggguaagcuugguaauaguauuuccuacaaaauuccuguuuuguuuuggggggggcauuuguuugguugguuuugagacaggguuucucuguguagcccucgcuguccuggaacucacucugucgaucaggcugaccucaaacucacagagauccaucugcugggauuaaaggcaugcaccaccacuguccagcuacaacauuccuauuacacuuccuauaaauagagacguucuuauugcucuggccuggagcuuccagcccugaccuguugcugcuccacugaaaaacgauuuccccuuugacaacuggcagcaaagagucccaaauuuacaaaaaaagucucuagcaauauaauggaucaauuuccgauugccauauggacuguagaguaugcguguccuugucaucaaguacagaaaagaguuuagaaaagucaucuuaucaaaguucaccucaaugaggaaaaaaaacaugaaaauaugcaaaauauguacaguuccuggcaguccucacaggggguuuucuaucaacauaaaaguuuacacuuacguagugacaguacaguggcucucacuguuauuguacagguuuuugcuucaaagugcucauuuuauuuuaaagaguaagguuuuuuuuuuucccuuaacacauacgagucagggccccagcccuccuguagugcaguauaguuuaacagccuccucacugaggucuggacucaggcuccugacaguuccccuacagcagcacucuaggggucccauugggaguagcuccugucuucuuggguagccgacucugggccuuucgagauuucaccaucuucauccucaccucgaagacuucauggauggccuuccggaagcaguggaaauuauagucaaucagcccugcagaggaagacaaaggcucuuaaugcaagaaacaaucucugucguucgcagcauccaucaccaguagggggcagcaaaggaccaaccagcaccuaacaggcccaggcugcagggauagcagauagucaugugagguaggugugcccuguagaguguuccagaaacuuccagaguauuuccaaaaagaaaucacccaucugcacaaggugacugcaaagguguguugagguaaagaguuucauaaagauugggcgagucagaaggcauugccauagggcacaaauguguggguaagcuugguaauaguauuuccuacaaaauuccuguuuuguuuuggggggcauuuguuugguuaguuguuugguugguuuugagacaggguuucucaaaaugauccauggcucaaaaugaucugaaaaaccacugaaaugcacuuacuuaauuauucagauuaaaggcuaaugguaauuuaugauaaaccaagaacugucaagauggcucagcuggugugucugcuauggaagucugaugaccuaaauuccauccugacacacacacccaaaaaagggcugucuucauaagccugacaaccuaaauuccccagaaucuagauaggaguucaaggcuagguagugagacccugccucaaaaauaauuaaauaaauaagguagaaaaaaacagaaagacauccaaaaacaugaacacacauuaaacaugaacugagggauuagauguugguggcacaugccuuuaaucccagcacugggaaggcugaggcaggcagaucuuugaggccagccuggucuacagccaaggcuauccagagaaacgcugucucaaaaaagcauucaacaacaacaaaacacacacacacacagagacaacaaaacaacaacagaaacacaagaugaaacuuuaaaaugugcccacuucgccacauuucuuagucauagcaccaaauuaaacucaacaacuaguucacuuacuacuauauucuacaaaacccgccugucaucugagaguguguuucaggaaaaacuuaaccaaagaucuacaugaucaguuucuaccuaaacuuaguuccacacagucagauguuaaaauuaauacuaaaggucaaagaagcaaccagauuugugcggagcauuuaauuuuagaaacucuguaguggaaaaccuagcagugcuuuaaugaagggaggcuuuuaaugaagggaggcuaagcuucccuuggaaacagacacagcacucagggucugagcugggaggacaagguggcguuucuauguaggacucuuuccagugugcacaaguucauuccacccagacgucucagaccgaaugcaaagggaaacuggguggacacuuggggauuauuuacuauuuuagcaacuuuuuuccaggugauuguaaaauucguucaaaauaaacaaguucccuagauuagcucugaugauccuaaacguuagacccugcugccaacugaggaugcaaaucuguguggcccuuguucuccuucacuuccaaaaaucuacaggaaauaccaaccaacaaaaaaaaugugggaaggauuaauaaugugaaugcgugcauacacacugagcucuacagagaggagccucaguagccaucuguagaucacaauuuaguuacaucgcucccucccuuuccucccuccacaccccuccccaaucuccguccaauccauggcucuuuuuuuuuacuaauucuuauuccauguauauaugcauauguuccuaaacauggccugcccaguccauauaaugcuaccuguaugcacauauucagggcugacugcuuggcacuggacaaccuccccuggucccuagcuagacaucuuuaccccuaccugaacuagugcugucaguuugugacaaaggaacuuauauuuuucaggucugaguaaaaucaucuguauaaugagagaauaaaacaaaauacagcccuguuugccuuccuuuguugacaggggaugcucaguacuggggauugaaccugcggcauaaugcaugagaggcaagccucuacaacuguguacuggcccagcccugcugucuaucuucccaaaggaagcccacaauugucccuuucauucaagaagauggaaauaauggaugaaagaugaacacuccuaaagguuuugaggacaagugauacagaagucaguuuagucaucagaaaaugcagacucacaaggaggcuagaaaugcaaauuuaaaugaaaacuaacuuuuuaaaacaguaaaauucaauauugauaagaauauagcaaaaaaagaaaagaaaaagaaaaaaggaauaaagaaagaaaaagaaaaaaagaggcggggcuggagagauaguucaguggcuaaaaacacugacuguucuuccagagguccugaguucaauucccagcaacuacaugguggcucacaaccaucuguaaugggaucugaugcccucuucugaagacagcuacagugugaucauauaaaaaauaauucuuuuuaaaaagagagagagagauuacagcaaaaugggcauauuaaccauaaagucugaaagauacuuuguuaccauucacuggaagccaccaaaauaugccuacccuuuugagcugaggcauucuacuauugcuucuggggcagugggggcuggggacaguuugcuggucagucagccagcuuagccaaaaauggugagcuccaguuuuagugaggaacucugucucaaggaaacaaggcacaaaaugcuaaagacaucugggcucuaucugcucuuaugcauccacacaaaggcacucauauaacacaugcauauagcauauauaacacucugauaugccacauacaacacacuaauacaccacaccuaacaugcaaauaccacagcaaguauaacgcaaauacaccacauacaacacacuaauauaccauguagcacauacauauauuacaccuaccacauguaaauacuauauacagcaugcuaguauauauagcacaugcauauacccacauauacuacgagaauauagcaucugucaggagccaucauagaacaagcuaauaacuuccugagaugagacugcuuuggauuaauaaauaauucaugacaggcuugcucucauaagcaaggcccaggagaaaaccauuuuaggaaagauuccugcuauuaauaugcuuuuccuguuauuaaacacacauaacaauaacuagguauuagcccacccuuuugaacacaucucugcagaacuacgaagauguacugucucuuagugaugcuauguagacaaauagaugaauucuuaauucuuaaugaugauccuauaagaauuccuaaaaucauaucaguauuuauuaagcucuuuuauagugggacugcuauuaguuccuuucugauagucaaaacugcaaugagaacucugguagucucugucaccaguuaauugcuucuacuacucagagcccauuccaaaaguuuuuaaaaucauucaccauaggucauaaaaagggaacuaugguuuauuauaggugcuagagcagaagauaaaauauugacugaguuuaucuauacaaaacucacuaauaacuuaguuaugguuuuuuaacucuccaugacccuguggagcugugacaggugaugaaugguuagccagauaauuacuccuaauggauaugcagguaaacauucucugcuguaaacucauuugauuugugauuugaauuuauguguaaacuugugaugaacuuuuuaccauaugaucauguauucugaaagauagaguagccuguauuucccuugccccgcuuaggaucuuucugcuuuuccccuuuuucuuagagagcuuucauaggaaacuuuuuccaacuuagaaaugaacacuaaauucacuuuucaaaguguuccuuuuucuuccugugacuucaaguggcaggcugaaaguuggagccaugcaauuccugcugagauagaacaaaggguacuuuacuuugcuguuuuagaaugaggugcuaggugccaagagagagcaguuucuggucucagaggaacacagaaggcaggucacuuacaguagcaaaguaacuuaagacuuagauauaaacuuuuuauuauuauacagcaacccuagguaucucguaagacaaaggcuuacccuccuucuacacucuucccccucugcugccucaagaguaacccacaacaaaaaagaccacaccggggcuagucccggcacauacacaacacaugccuauacugcauauaguauacucauacacaacauacaagacacacauauaccacauaugaauauacuacauacaacacacgcacauuccacauaugagacacacauauaccacguauaacacaagaauacaccucauacaauacacauauacacuacagagagaaagagagagagcacccuuuguuauaaugaaacugaaaaaaagaacucuaaaacuacuccaacagugcagccagcuuuguugcgacugagaggaaaagagggcaaaaaaagaggaaaagagggcaagaaaaaagucccagagauguaacaugacuuaccucagauguaaaguuucauuuuguccuuuauaauuuccuuauuucauuuuauuuauuuauuuugguuuuucaagauaggguuucuuuauguugccuugacugaccuggaacuagcccuguagacuaggcuggccucgaacucacagagcuccacuugccucugccucccaagugcugggauuaaaggcguguacccuuuaaucagcuguguuccuuaacauuaaaacacugucaucaugagcguuauugcacacaggauaagggaagccauucuagcaucuguucccacugccuuccacuggcuagccuuugcuccccacucuggcuuagcuuugcuuauguagcacuagugauagaggccggaugucugaccaucuggacaagcccugagccaccccagaccugugagcaguaguaaacuacacccuggcuaccagcccuagccacacaugcaucauucacaaaauaaagggggaggggggaaucuguuaauugcuuuugcuuaaaacauacacucacacccaucaccaacaacuaauuugacccuuacaggagggugucaucaggaaucagucacaccuucacuaugugggucaccaucccuguuauuccaggacuuaagaguaugugaacacuaagcagaaggcaugugccaucugcggcuacugcuuccuuaaucaggagggcaaugaucacauggcuggccuaacaccuucugugugacccaggcacaggucccccuggaagcacaggcuaagaaaucccguuccugccaccaacagucagguaacgggggggggggggcgcgggggggagaauucugguucuccuaccaccucaacucaaucguaacugcacaccugggggacagacagauccagauacucauccaugcagggcaugcaugccuugggccugcccaucaagggccacguaacuaaagcugaggcuuccagcugucuacacacauucaacaggcgacagaugcaauucuuuuaaacccuaccaaaaauuaccuuuucuuucaaagcuuuccucucugacgaagcaaacgagcgccaagaacuuugugaccucuuuuaaauaaagaacuguuguauuauucagcuuuauaauggcuguugaguccuugucauacggggcuccugcuccaucuucuuugagacuaaauggaaacaaaaaccaaaauguauuugaccuucaagaaagaguuaugaauggcaacccagagacagacaacugcccccaacccccgacacacagaaaacaaucacccucaugagacauguguagucaaaucaaaugccuaauaaggcaugugcaguaccuucgggcagacacggguaacucuguccaucucuuaccaacagagugguuacuauggcaaccaggcaccacucaaggugccugaggaacacaagggcagauagagaagaguacucaucccuccaaagccaaaggcaccuuguugugacacaacagugaggcugccaaaagcaaggugaaagacuuccaaagaguccagacagacaggagaggcaaaggcugagaugaggacaggcaaaauguaggcaacgcuaacaucacagccugagggaccaaaacaggacccaccgaagacacuagugggacugguuuuguaucuuucccucacaaagagugucuuugaaccuuuucucuuuaacugaagcuauguacauuuucuagugcauugcccaaauucaugugucuagaaauuugacucaauuggaacuacccuaaaccuuaucaauuucaccccaaaauuacuggggaauaaacagcugacccuaccuagcucugaucacacacuagaugccagaaaaauccucuaagccagacagauacuggggaaugguaaaccggcuaauaauaauaauaaauaacaacaacaacaacaacuugagcaaaguuaaugacagagguaaacuggaaucuaaaaucuaguuaugauaaauaucaaagccaaugcuuuaaucuugcaaaauuaaaaagggugggaggugggggugugcaaacucaaagaggagccuguguggggauuuuagcuuuggaaaguacuuuaagcuggcaccuacauacuuaaaaggaguuuaaguuucaauugugugagcccagauguccaagggcagcacagacaauuuaacaagaucuuaucucaaaaaagaaaggaaaaaaaauaaauaaaaaauaaaaaaggcacaagcacauagcacugcucuccugccagcucuugugacagccugggcuuucucacucucucuggaucccccuccugccagcucuuagccugcaugcccucugugacaccuugggcuuucucacucucucuggaucccccuccccucugccaugcaccuacuugcugaucuccccugugacagaacaugacagguuaccuggacccuaauuggaaaaggcaugggggcuggugagauggcucagcgguuaagaacaccgacugcucuucugaauguccugaguucaaaucccagcaaccacaugguggcucacaaccaucuguaaugagaucugaugcccucuucugguguaucugaggacagcuacaguguacuuacauauaauaauaaauaaaucuuuaaaaaaagaaaaaaagaaaaaggcauaucccuucuagccgucuccuuccgccaggaagcugccaauaccuaccacucgcauguccuguuuuacuuucaaacuguaauaaaaugguccucaaauauuaaaaaacuauggaaguuaaguuuuugaaagcaaccaaugaacccacuacagccugucaaagauucauacuaggauuugacucuggacccugggcaugcuagggaagaagaugucuaucacugagugcagucacagcacuaaaacccuagcccgugaauuaaaacacauuaaccuccacaacacuauuucagacaucgcuuauuuauauugagaugggagcuugcuauauugcccacauggcuuugaacucucccucuuucugccucagacaaucuccugacagcuggaguuacagacauguaccacauacugggccuagcuauuuguuuuaacacagaauuucucuugcuaaguaauucucuaagaaaaauaaguggcaacacuuaaacuuuuuuuuuuuuuuuuuuugguuuuucaaggcaggguuucucuguauagcccuggcuguccugaaacucacuuuguagaccgccuggccuugaacucagaaaucugccugccaaugccucccgagugcugggauuaaaggcaaauauauagauucuaaauauuguuuguuacuaaauaaugcuaauacuaauagcauggguaaauucucagauaacauuacaugaaaaaauggcaaaauacaaaauuauuugugggcuggagagauggcucagugguuaacgguuaagagcacugaaugcucuuccagagguccugaguucaguucccagcaaccacaugguggcucacaaccaucuguaaugagaucuggugcccucuucuggugugucugaagacagcugcaguguacucauauaaaugaaauaaauaaaucuuuaaaaaagaaaagaagaaagaaagaaagaaagaaagaaagaaagaaagaaagaaagaaagaaagaaagaaaggaaggaaggaaggaaggaaggaaggaagggagagagagagagagagaauauuauuuguagugaucucauuacccuaagaauuaaaaacagaaauagaaauaaaguccauaggaauggcgacaguggggcugagagcugacucagcaguucuggguacuuacucuuucuaaggacugagguuuggguuccagcacccacauggaggcucacagccaucagaaacuccaguuccaagggacccaacaacccucuucuaaacucugaggguaccaggcaugcacagggugcauacacacacaugcagacaaagcauuauuaaauaaaguuucugaaaguacaaacagugacugucucuagacaguaagacuauagagccgucuuggcuuuuguuuuuaguuuagaucuaacccaggcuucaugcaggccggaagagugaccaucccugagcucccauccccgaucccaaacuaguuuauuuuuuaugcuugucauaaacaggugcuguuuugacaaccgcaacaaaguaaaccaucaaacaaauacaaguaccaaaagaauuacaaguagaaauuugugacguagcagggccaugguggcucacgccuuuaaucccagcacucgggaggcagaggcaggcggauuucugaggccagccuggucuacagagugaguuccaggacagccuauacagagaaacccugucccggggaaaaaaaaauccaauaaauaaauaaauaaauuugggacguuuuaugacuacaauggucguagagcucacuuucucaucgacaagcaaugaaaacacacaaagguggagugugugugugugugugugugugugugugugugugcaugucuguguauacacgugcaugugaguguguauguuuaccuguaugccaaacuucuaacucugcagaacccacagcugagagaguccugcaacaucuaagcuaaucaccuguaagggcaguaagaugucugucccaaggcuaccugcuuccugggcugccuacaagggcucuacccacauccaaacuccuaccuugccgguuaacugagcagacucacagcugcuucaauaagcugagugucuuaggguuucuacuaaugucaucaaacacauguccaaagccacuugaggacuugcacuuccauaucacuguucauuaugaaaagaggucaaggcagggacucaaacagggcugggcccucccacaucaaacacuaauuaagaacaugcccagcuggguaguggugccacaugggaggaagaggcaggaggaucucuuugaguuugagucuagcuugaucuacaggacagccagggcuaaacagaaaaacccugacuccaaggaaggaaggaaggaaggaagggagggagggagggagggagggagggagggagagagagagagagagagagagagagagagagggagagagagagagagggagagagagggagaaagagagagagagaagcaaagaaacaaagaauuggaaggaaggaaggaaggaaggaaggaaggaaggaaggaaggaaggaaggaagaaagaaagggaaaaaaauggggaaggaaaagcaaggccaggccaggcccuauagucuugccuacaacccaucuuaugguuuuauuuucucaguugagucaaguugacacaaagcuaaccagcaguucucccugaauccugcgaguucuccaaacaccagcaucccaccauagaaaaacgaucucugacaaagccagcucccucucugguuugguuuaguggguaaaaguaacccugauugacaucacuuacccaaacaucucacuacucaugucuaauuaccauauggcguaauaaugauguucaugcauaucauuuaaaacaugccagauaucuguguugcucacuguaugguuaccacagugauugagacuguaaucagacuuacucagcucucaagaaucauucaauaccguccacuuaaaaaauaacagacuaccauggcuuccgauucuugaggaaggucuacuuauaaagcuagaugccuaugucugauaacaauaauaaauuaugugauguacaacugauccaggaucuaucagggcaggagcauuaugaaccuacuaacaguguuuucauccuuacugucuaggagguaaguauaugugaacacauggguuuucaugugcaugggucacauaacacaguuaacagaaaaccugacugggugggcaaagaauuuucagaugguggaagacagaaauggcuaagcuugaaacuucuagaggcugacagagcagaaugucagguggggugacacacagagagaagagugugugaaacacagggucugagcauagcuaacgacaggcugacauuagggaacaacucgcuuacucacacgccgacuguacaaacaugaucagcagccucucaggcaugcagagcgcuucuguguuuagcaauacaacuuuccccacucgauacuguuaucuuaagcauuuaggaaguuuugguuucuaugaauguuaaggccauaauacauaaaaacuggcagaaguuauuugcccgguuuuauaauucucugcccacccagacaaucaacaucaaauuuuaaacaauacugagcagguguuuucuguaacaagcaggaaaauggaaacauuuuuggcggcuuguggaucuauuuuuacccccuggacugcacugggugcaggguuucuagcagggucaggaucauuuaaaccaagguucaaagucuaguuuuuucucacugacagcaaaagcgugucuuagaaaugccuccauucaaaaguccauuucuuuaucugcaaacaaguauagauaguaugguuccugucccauggaacagcugagaauuaagauaugcacaacaaagcuuuaaccacaauuaauagacauuugcucaacaauuacuuuuuauuaucagcauguuaaauagccuauguauagaucucagaugcuuaaaacaaaaguauaaaagucaagcgaauacaaaaauucuacagaagcgaugagaagaaaagcuggcagguggucauucuaaccucacccuucucccugggcuaucuccagcccugggaaggacagcacaacuauagcuuuaagaauggaaaagaggaaagcauggucagaguauccaaagacagacagacaaacaaacugcuucaauggcaauagaaaagacuguguuacuuacccauaaauacaagagaugucgaucaccacgucaaucaugucacagcagagcucguacgucugcauguccaccggcgugcugucgguugcaauauaaaucuuacugaccacgucaaacagaaacgcuuucucaauuccagaauucugaaaggggaagaaaauaaaaaagacaugccuugggcuggggcgauggcucagugguuaagagcacugacuguucucccagagguccugaguucaauucccagcacccucaugguggcucacaaugggguccgaugcccucuucuggugugucugaagacagcuagaguaugcucauauacauaaaauaaauauuucuuuaauuaaagagagagagggaagccucaaaguaacagcaaguucagacugcaucaugauuacauuuuuuaaaaaaaaaaaagauauucuaccccacaggaaaggguugggaggcacagagggacagcauaggaacauggaggcugggagaguucaucauaugccucuaggaaaugucacagugaaguucuccuacuugcacagucaauaggugacaauuuuaaaagauuuauuuauuguguauauagcuuucagaaugcaugcaugccuacaggccagaaagaggguaccagaucacauuacagauggcugugagccaccaugugguugcugagaauugaacucaggaccucuggaagagcagcuaguacucuuaaccacggagccaucucuccaacccaacaauuuuauaauaaagugauuuucuuuagagauuuaaaaaaaugauaaggaauuccagcuauacaguuuuacugcucuuuaaacuuacugccauaaauuuuaugauggacuugaaaaagaaacugaaggcaggauuagccuaaguuauuugucugagguaaaccacuuaggccguguucccuaaccccggcuuaucaggcucaccacagacaugguguuaaaccugugguauucaaacacagaccucugggcuggcgagauggcucagugguuaagagcgccgacugcucuucugaagguccagaguucaaaucccagcaaccacaugguggcucacaaccauccguaacgaaaucugauucccucuucugaaguaucugaggacagcuacaguguacuuacauauaaugaauaaauaaaucuaaaaaaaaaaguuucauaguuuaaaaaaaaaaaaaaaaaccacagaccucaccgacagaaacaaggguuuuuauuguuuuuguuuuuuuuuugguuuuguuuuguuuuuuaagauuucuuuauuauuauacauaaauacacuguagcugucuucauuugcaccagaaaggggcaucaaaucucauuacggguuguugugagccaccaugugguugcugggauuugaacucaggaccuuuggaaaagcagucaaugcucuuacccgcuaagccaucucaccagcccccagaaccaagggguuuuaaagacaucuucuuacauuuauuuaugucuuuuuguguggcugggguuguuaggucugcaagagcacacaaguggaagucagaagacaacucugagggagggagggagggagggagggagggagggagggagggagggagggaggaaggaaggaagggaguugguucucuccuuguagcauguggugccaggguuugauuucugagacucggcaacaggugcccuugcugugccaacuugccggacccuaaccaggcuuuuugcuccauagcuaaagugagguuucauuaauacugauguuuguuucccacuugaacaagcaguccaagggcacugagaauuaaaauuuaaaggcucuaagacauuauguaggagucaucuucaagaacaauacuaacguggccugaaaugcaggcagguacacaacuuuugacucucgccauguugcucucgaauucugcaaaugacccaagcaggaagaaaccgucuacuuacugagauaaagauguucagcagauucuccagcgucgggagcugugggaucaguuucugaaccacuuugcuaaaggcuucaaauauugaaugaucauauaugcuugucagguaaaagcugaaagagaagacagcauuucacuaggcucccucugagcaguugucucaggcuccuucacuagcaccaggaaucuucuguaugacuaacacacaagcacuagaauucacaaugaccuuguucaaaaccaaguauguccugacaggcagccuccucgcucccuagagccagaacuaccagccauuccucacugccuggcaagcuucagaguuuggccaccauuauccacgugagcauccuuacgagcuaaagcgucucuacucaacugucucuacgugagccucuauugaacugaggagcuucuaaaucauugacacugaagccugucauuuuuuucaucuucuaauuuuuaaaaucaaugaugcauguacuaucuaccuacccuaccccacaaaacagauggaagaaauuuuccugaauuccuauccuaaugauuugaagucucaucuguuacaaaucccauccuguuagcaagaacuacgacugagcaccaguuagcauccuggguuagagucuuggguuuugcuguuucucauacgagaugagaaguuuagcuuugacaacuuguugaauacaaaaguaaaacaaacacuaccuuucaccaaaaguugacauuuaccaagugcaaaacaucuuugacccuaucccagcgagaaacagcuaagaggguaaacugccauccauggggucugugcccaaccaguuuuagccuguggugacugcaaccaaaacccacuuccuccaaccucuccuaggacuaggacccugagagcucuuacuuaccucaggugaauuuuuucuaauccagcaucagcgaggucaucguuugcccucuggugaaugucucucuggguuucaauuuuguggucaucugacagaccaucuacuuuaugaauaaacaccucaaaguugauaucaguguucaccuuguaggcccuggucacugugagauggagccgggccagcgcuuccauauagucauccuggaacaaaguucaugccuucagcuuuuucuuuccagaaccuuccauacacacucgucaccucgaaacacauagcuaugaucuccaaaaauauuuuucccaaacucccaacacccacacacaaaaaaauauucuggcuucacagacuucaaguauauacaccuaaguuuguuaacacagaagcuaagaaagaaaaugcagcugguuuggguggucacaguauaggcuguugauagcuauaaagucuggagcugaaguuccaggagacaggaugccucccagcuucccagggcucucaaagacugugauggagaccacagaugaaaaaauggcugagaagaaggguaagaaaggaguuuaacacuaauccaggggagucagcgaaacuccgcuggcuuuuguaacgaaaccacaugggaaaucagcucagcaugcuugucugucugucuguccucuccagggcugcugggugccacauugcagcuguguggcaucuuccucuggacucccacaaacaaugaaggccccagagccuucacuucuggcccuguacagagaauuugagacuccuggucagagcaauuguuucaagcaccacaauacuauuuucuccuccuuccuaccucuauauaauaaaaaaauaauaaacaccugugcaacuaacuaucuuucuguuuagcggucaaucagugucaggaaugguggcucacaguggagagucugaggcaggaggauugcuuugaauuacaggccaaccugggauagucuuugagauucugucucaaaacaaacaaacagggcuggagagauggcucagcacugacuuccagagguccugaguucaaaucccugcaaucacacgguggcucacaaccaucuguaaugggaucugaggcccucuuauaugucugaagauagcugaaguauacccacauaaauaauucuaaacaaauagaauuggcgaugugcucaaugcuaacccuugccuaguauucaugggguucugagauuugaauccuggugacuauuuuuuuuugggggggggggggguuaagacaggguuucucuguauagcccuggcuguccugaaacucacuuuguagaccaggcugaucucaaacucagaaauccaccuggcucugccucugcugggauuaaaggcaugcgccaccacgccuggcuucuucuuuuuuuuuuuuuaaaucuuuuaaaugagaaaaaaaacaaaaaacgaugcuggguagugguagcacggcuuuaauuccagcacauaggagguagaagcaggcagauaucucugagucuguggccagccuggucuacagagugaggaccacaugggcuauacaaagaacugcuaucuggggaaggaagagagggagggagggagggagggagggaagggagggaagggagggaagggagggagggagggagggagggagggaagggagggagggaagggagggaggaaaggaggggagggagggaggggagggagagagggagggagggagggagggagggagggagggagggagggaggaacgaacggaggaaggaaggaagggaaggaggaaagcaaaaaacaaaaaagaaaagagaaaaugagcugaaugaugaauaccaaagcuccuuuguccucuuccuccuaagugcuuaugugagcauaucuaucuauauauuauguauuucacuccucucucuacacugcagucaacaccuguauccaaacacuguuuacccuguuuuaaaagugaagagaacuaucagcuuggaguugcucuugguugaaggucguccccccaccuaaggcaggcacaugguaccugcaaagauaaaagucuaagguccaacauguucuguacagaggaacguguaugcugggguaugagcagacucuaaagaugaucagacagggcagagggauacuggcaguccuugcuaacaaccaaccaguagacuuugaggaagucugaaauagaauacuauaccauguuagccaaagcucauaucccucucuacaggaguaauaauacugaaucaggcacaucacgcuggaaauacaacagagcaugugccuuggcaaucacuggccuaggugacucugauauuauaaacuuggcagaacagaccaggaaaauguaaaccagaaagguuucuuuuauuaaaacuuuccaaagcuuguuuuaaaaacaaaaaucacagaaaugucaaguuauaggcuagcaagaugguggaguguuaauccuaucaagcuugaugcccugaguucaauccacaagauccauauggaagaagagugccccgcaccccucaggcugaccucugaccuccacagaaauaucauggcaugugcccugaauaaauaaguguuaaaaaaaauguggcuggagagaugucucagcgguuaagagcacugacugcucuuccagagcagagguucuggguucaacucccacaugguggcucacaaccaccuggaaugggauaugaugcccucuccugguguguuugaagauagguacaguguauucauauaaauaaaauaaacagggcuggugagauggcucagcggguaagagcacugacuguucuucugaagguccugaguucaaaucccaaaaaccacaugguggcucacaaccauccauaaugagaucugacacccucuucuggugcaucugaagauagcaauacaguguacuuaaauauaauaaauaaauaaaucuuugggccaagcgagcagggcuggagugaguggggcuuaccggaacaagcagaggacugacccaacaaccacaugaaggcucacagccaucuguacagcuauaguguguacucauauacauaaaauaagucuuuuuuuaaaauccuuuaaaaaauaaauucaucuuuuaaaaaaaugaguagaugucuuuuuucauucaguguuaugccuaggaaacucauucugaaauuuuccuuuauagcugguucaucacaugucacauuuaugaccuguugauggaaauuccaaacauguccaaugaccugucaguacagggaugagucucaugaacacacacagcuugccucaagggcugcugugaggucacagcugaguauggacagugucuucccaguguaguccaggaagcuccugcuucgggcacccucacaacaucacaacacaugguuacucagaucucuggacuacugcuagucugaaagguauagacaggcuucauuuuuauaauaaaaaaaaaaaaauagagcaaagaaauaagaagagccaggcaugguggcgcacaccucuagucccaggccccagugcuuagaagaagcaagaggaucucugugaguuugaggccagccugggcuacagagugaauuccaguauagccaaggauacauagugagaucuugucucaaaaaacaaacauauacauauacagauaaguagguagguagguagauggauggagagagagagagagagagagagagagagaagagaaugacaccuguaggaaggacucuaaaugacuuuauaacauuuacccaacuauccuaccucugauauguuuccaaaccuggaaaauacacaaagcccagaaaacaaaaauaagcauguuuguuuguuuguuuguuuguuuuugugggauaggauuuauuuuucauuuauuuauucuccaaacuccaucaauaaaaaugaaaccuuugucuguaaaugaguuaaaauaucaaacaggggaacaggaaacuaagaggagacaaaaaauaauaaugaguccuuucucacccuggagcucugaacagugguuaacaaagaaagaacaaagaaacacacuggauaucggaccagggaggaagcauuaaacccuccaguaacuauccaguagcucccagucuauaaaggucuagaaaggcggcuggauaaccugcaaggauaagaagcacaacugagguggccugggggcugggcacuagggagagugaaacaucccaggagccucugaaggcagaaagaucccgugcuuuccaugggggguggauacacgggagauacauuuguaaccccuucaaguccuuacuugaaaggagugcacucuauagcauguaaacaugucucaaacauauugugccuuauaucuuuaaggaaaaaagcucacuuuaagggccaggucagggcuggagagauagcucagugguuaagagaaccggcuacuuuucugaagguccugaguucaaaucccagcaaccacaugguagcucacaaccaucuguaaugggauccaaugaccucuucuagugugucugaagacagauacagcguaaucauauauuaaauaaaucuuuuuuuuuuuaaaggccugauuacacuaucacaccuaggcaggcucucugccauagccuuggcuguccuggaauucacuauguagaccaggcuggccucaaacucacaagagagacaccugccucuaccucccaguugcugggauuaaaggugugucagcacaccuggcucacaguaacagaugaaauaauauacagucuuaaugacugaaaugaugaacugcaggggugggagaggaggcucagcacuuagagcacacacugcucuugcaggggacuuggguucaauucccagcacccuacgggguggcucaguaccaccugcaacuucagaaccaggggaccugacacccucucauccucuucuggucuucuuuggguaccugcacucaugugcauucacacgcacacucacacacacacacacacacacuuaaaaauaaguaaauaaauccgggacuggcagggugguucaggacagaguaugccuacguucccuaaaagacccuaaacaccuuaaaugccauuaaaaggaagaaagcgugggguccaacaguacaagccugugaucccagcugucuggccaggaaagguacaaaauaacaaguuugcagccagccuggucaagguucaagaguguggcacugugguagaacacuugccuaacauaugcaaggcucugcguucaccccaaguaccaucaucacuaaacagaggauuacaggccgggcagugguggcgcacgccuuuaaucccagcgcuugggaggcagaggcaggcagauuucugaguuugaggucagccuggucuacagagugaauuccaggacagccagggcugcacagagaaacccugucuugaaaaaacagaggauuacagaugcuuucccccaacauuacuuuuuuuuuucuuuuuccugugcaaguguguguacacacgcauaugucuauguaugaaucuggugugugcgugugcacaguguauauacacauaagcacgcgugugugcacauacucucgcucuaucacacuaauaggauucugagacaagagucucucaucgagucuggagcucugcuaacacuagcaaaccccacugaccucccugucucuguuuucccuacacuacagcaccaggcuucccagcuuuugugugacaccugggcuuuuguauguacccugaucccaggggggcagggagggaaaugauauguucaugccuguaaucucaacuuucccuaagaggcugggugcugagaguccagccuggcuacaaguucccacgccagccugagcaacaguuguuagacccugucucaaaaaauaagagguagggggaaggggaaaaggaaaaaggaaaaagggagggaagaaggaagagaaaaaaaaaaaaaaaacccagaagggucuucuaaagcauuauuagacuuuucugcaaccugcaguaaacuuuuuuuaaaaagaaagagaaaagaaaaaagaaaaagaaacacauuuacuaaccuaacugaaaagccugcuucaugauuagguaaaauugccuauccaaaaacaagcaacuauggacuugaaagauggcaguguguaaaaggaccugcugcucuugccggugaccagagucuaguuccuagcaucuacguggggcgguucacagccaccuaaaacucugcuuccaggggagcaaacaccucagguugcugcaagaaccuguacucaaauacauagacccacacguggacacgugauuagaaauaaacaauaaauaaaaauaaguaacuaaaccuaaccuauuuggggcuaaaugacagucauaucauaaaugcccuaggcaguuugcacuggaccugcuacagaggacaguaugguauccaaguauuuacuaagccaucaucuuaaugaucuuuagcucugguuggaauccacuuucucacaggcagcuacuuaaauagcugcaaaaacacccugggaggcauuaggggaagacagggaucccugucguguacugggcacacauuggcuguucccugggcucccugauuuacagugccaacaaacagacaggaaggagggcaaggcagacaggccagaaaacacaguaguacaagugggaggaucaggaaagcagcucccaacagacccaggcauaccaaggguccaggcacaagcuucggguugaccuagacaaagagugaacccaccacaggugcgcgucgcucacucccuguacagacuuccccugaaggaagaaugaauccuaaugugcucagagcccuguucccagagccagacacagagugaagccuccuggagccaaugcuuugcucaagauguuacuucuguauuacacauacccugcaaggcugaccaggcuacaguagccacucaucucuggaaaaaucucuaaacccccauucuagacuggguuuggcauucuuuggagagccuguuuacuuuagacccaggaaaacuuccaggcuacaccagagucucagggcccuccaaggccccaaccccacacgcccuucccagcauggucagccugaucuuccuccccuuuccacugagcgaggggcaaggucccaguuagaggagaucgugagaucaacuaauggcuggagaacggggcuccucaccagccauuuccuuuauagcuaauuugaaggaggacuuacacaguaguuaauaaacuacuaaaaauaauucuuaugacagaaaacuagguaauguuggagguacaacuugggaagauuuuaaauucuugaguaaaugcuaugacacaaccuguauccccaaccuagcuaugagaacacauuucucaguuugcacagccacaggagcaaaaacacaaaaguggagcugauuauccaaacacaagaugugaacuguggaaaaaaauaugaaguauccaucuuccuaggagauaccuaccucacauuuuaauagucaucuacaaaauucauaauaauucauaaauaauuauagugacauauaaugauauuauauauauuauaauuauauuaguaguaguauaugauauaauacuaauaauuugauucaagagcuaaagaaauggcucauugguugcucuuucagaagacccugguucaauucucagcaccuacauggcagcucacaauuguccaguucaaggugauccaauggccucuucuggccuuugcaggcaccagauacacaagcugaucacagauauacauguaggcaaaacacccauacacauaauaaaaucaaguaauacuuugauccagaagaaaaaguuccacuucuaaguguaucuacuuagaaaguaaaauuauacaauguacccaaguaaacuuuguugcagaaaaccugucauuccacauaucuucugggaucugggaucugagguuaaauguguuugggcuaugaccagacaggagccuuuucucugaugcaaagucuguggacucuaagaaaucuuguuugauagaaaggccuacagcagauguaaaaacacaaaccaccccacccccacccggccagcagaaugacucagcagcuacagguacuuggcucaggccucacaaccugaucuugauccucugaucccacagaugcaggggagugcccucuaacagccccaccacccacccccacccacacacacaauuuuacaaaaaccacacugaaaacagguaugaggagguagaugcugcccacgcugagacgcuacguaccugggagucgaugacgaagaucagugccccgguuccccggaagaucaucucauagucaaagguagggucaaaaaagucaaucugcccugggaagucccaaaucuggaaguugacgaaggagcuguuggagacgucuucccggcagauccuguuggugcucuccaagaacagcgucucgcucggggacauuuugugaaagacgacuuucuggauagacgacuugccgcuccuccugagacccaugagcaggauucugggcuucaccucagugcugaaggggucgcugaaguccagaacugcagaaaccccagaacaggagaaggugagcuggucauggcagcuaaccagaguuucccuccaccucagacggucuaugacucagaugccacucuuccaaacagugccaccugaaccaccaaccagggagagggauagcauggggacaucaggacccugaaaacugcccuaacccaugcccaccaucuuaagcagggacucuggaacacaaacagcagagcuuccuggagcuugcagccugaaaaagaacucaggucuucagccaugccuuccucuguguggccaucagaguaucuauacacuaacgagguacucuuggcaaccugcuggcuacuguccucaugggccucaaagucuggaacacaggcacagacccagaggccucuuuuucggauugugagagcacaugagauuuggacagaucugcccucuucaucuaguaagaaaacuacaaaguuacuaacauuaaaauuaaauggggcuggagagauggcuuaguggcuguuguuguuguuguuguuuuuccagacaggguuucucuguauagcccuggcuguccuggaacucucccugaagauacagaccaggcuagucucaaacuuacagaaaucugccugccucugccuccugagcacuagaaugaaaggcaugcgccauccaccaccaaugcccagcaaguggcugcuccuccagaggccugguucccagcacucaugccugguggcuucacugcaccagcuccugggcauccaacuguuucuucuagacucuauggacaagcacucacacacacacacacacacacacacacacacacacacauauuaucuaugcauacuuuaaaagauaaaauuuucuuuacuaaaaaaauaagaccagcuuuuaaaaugcauaagauauaauugauaaugauaauaaauauuucucagagcuguugugguaguugaaugaaaucaaggaccucaaauaaaauaauacucaagcagguaugguggcacacaccuaucauuccaacccgugggaggcuaagucagaagaaucgcaaggucaggaccagccugagcucacugcaugaagccucagucaggaugcugggccaacugguagugauucauaugcaaagaccuuuaccugagacugcauaggguugacucaaaauggaccaagcaccucaacuuagaagcuaaaacugagcucuuaggaggaaaccuaaguagacaucauggagaccuugauguggucucuguguccuggagaucaggaccuguuucuuagcuguaagcauagaggaaagagguguacaaacugcacaucaaaauuguaaaaagauggcgcuagagagauggcucagaaguuaaguguccuugaggcuccugcagaggaccagaauucaguucccagcaccuaggucaggaaguucaggcaccuguaacuccaacuccaggggacauggcgcccccuucuggccuccuuggauaucuccacauacauaaacacacacacacaaagaauauaaaaagaaaacaacuuguuugguugguuggcuucccccauccacccccacgccaauauuucaaaucagaguuucucuggguagcccuggcuaucuugggaacuugcucuauagcccaugcugccauaccuaccucuaaaccucucaagugcugggauuaaaggugugugugccaucaugccuggcugugagacccugucucaacaacaacaacaaacccaaaacauaugccaaacaaaaaccuguacauggauguucacuucacagccaaaaccagacacaacugaguuaauacccaucaacccauuaaugaguacauagaacgugacauauuuauauaauggaaugagccaugaaaaaagaguagagugcugauucaagcuacaacagggauaaacuuaaaaccaccgagcuacauacuauaaagggguauguagauauacaguauacaaagcaauuuaggaauuauuuuacugacauuucuucauuugcaggagggcaugguaugcauauggaagucagaggacucaguucucuccuucuuccauguggguccagguagcagaccaaaucccacuauaagcaacaacucacccccaccaggcaccucccccacaccaugcaccuccccacaucgaccaccucuuccaaccaagcacaccuccaucacccccacccccaggcaccacaccuagugucuucucuaguucaacaaguggcugaugcuauacgauacaagcugugauccacaggaggaaauacaccuaaaggguccuuccucaccagugaucaggaaauuagaccagggacucaaagucacacuagugccuucccaaacagaaucccuaaaaagggugugcauuauaaauaguagagggagaaauaaauacacacauauggaacgccaagccugaaacacaacacgguuaagagaaaucuuuaagcaacacaaagacggggcagugauggcgcacuuuagucccacuugggaggcagaggcaagcggauuucugagcucgaggcuaaccugguccacagagugaguuccaggacagccagggcuacacagagaaacacagagaaaacaacaaaacaaaaccaaaaacaaggcuggauuucacaguaaacucagcagaucccacaguaaagccugaccaccuccuugcccuguucugcaaaguggcuucaugucaacuacacagccuucuaacaaagacaauguaguccuaauuuauaauagggcacauugccauugcuuaaaaaaauaauuagcacacgccuuuaaucccagcacucgggaggcagaggcagguggauuucugaguucgaggccagccuggucuacagagugaguuccaggacagccagggcuacacagagaaacccuguuucaaaaaaccaaaaacaaauaacaaaaacaaaaaacaaaauaagauaaccuugaacucccuguagaguggaucacggucucaaacuucugauccuccugacugcugguauuacaggcuugcaccaccaugccaggcuucuguggugcuauggcuuaaacccaggacuuccugcuuccuaggcaagcaagcacucuaccaacccuuucuguccuuuccaaaaucugcuuaagaaaccccuagggccugaaugacacgguaggcagagcaccagaauaugugaugugaugugggguccugaguucauauccuuuuccaagugcacacacggaaggcagcucugaggucacacacacacacacacacacacacacacacacacacacaccagccuucccaccuucauaacacuccagagagaucccaugaaggcagucaccucaaccucuuagagaaggccucuucucucuaccaacaguuccugagugcccaauagagcggcacgagacuggugaggauaagcgaugaaggcuggaaagugcucuauacaguacaauaccagaagcuagcacaccagcacacacagggagcccagagagggcucuaaaaaguggcaaagagccuuggaggauguuguugacacgggaugaaacauguacaaggguauugcucuucaugaccugaaugacugacuucccaugugcagcagggcuacagauacaaaaagagaaccaucccugugaacaagagggguacagagacugucgaagguacacaguaacaacacuuaagaagcuaaaaggucaaucaagccauagagaggaagugugaaggauggaggaaucguggagagaaaguuacagugauggaaggccaggguguaucccgaagacaagagaaaccacagccaggagucccugaugcuacucucucucagcacuauucucagccacagcugggucuccucccucccggcuacucaggcccuccagaaggaccgugcaggguccugccucacuucuucucuaccugaaaggcuccccgagacuuuccuuacucaguccugcuacaccauaucuccuccucugacccaagccauacccuaucgcuuccuagccagaaccuaggucuuuuaaauagcccucacuacacaauucucauacuuggcacauuuguccuguugcuuuccuugugugcugucugucucucucagacauguagccuaaggcauguagcagcccuccaguaaauacaguaaaugcagugacuaaauuagcuggcaaggucucaacagguauggaugagaacucccagaaagaugugucugcaaagacugacugguuagaguggcagugcuggcgggcaguuggaaugcucugcuccagagccuaauuacaccuucuccuggaguaucauuagcccccuuaacacccauuacuugcccacuucugugacugguaauaaaaaccuuucggaauacaucaauuucgccuauuagcuuccaucaacccaaaagcuaagaauggcaucagauagcaucugaggcauaaacaagauucccccaccuuauugaaacucuucucucugaugccccgacaauguauuuuuaagaucucuugcuuuguaacucuuuguucuguuauuauaaaacuuuccuauguuagaacagucuauucgaggagaccaaaaucuauguuccuuugccauaaccaaucauaguugcucuagaauaagccacuugaggugagagcuguuuuauaugacaacacaggcuagccuaucaccaauucggugauaucacacccagaaggugaucgcuaagaauacaggacaugucuacacccacauuuaggaaguucccuucagaacuccaacucccaaggcagggucuguggaggacucagauacccagcacucuagggguuggggagacagugcuugcagugcaugaucaaggacccaaaauggcccuuagaacguguaacaggccuggcagagagacagacacuuuuaucagucaauaugauuauuagacuacucaaacaacggaccccaaagaaaagggaauuucccaggacucucaugcuggagaaggaaaggggaccagccagacugugaacuugagucuaggagauuucauucaauucuaacaccuugucagaccaccuuacaggaugagacagaagcccagacagggauggaucuaugauagguggggccugucuccaucauccuaaccuuggguggggcuguacauacauacauaccuuuggacccuuauuuagauuuuuaaaucacauuucaauacucaaaaaagacagauuugggagcucagcuggaccauugucccucuucacaccauggccacaaggaauacaucauuuucugccucccacuuuucauuuggcucuuuuaauuggcuuauuggugaugggggagcacggguugugacucaaagaugguaacccucaugaaguagugggugugaauggggcauuguggugcacacuuuuaaucccaggacacaggaggcagaggcaggugaguuggaggccagccuggucuacauagaguuccagaauagccagaguacauagaccuagucucaacaaacaaacaaacaaacaaacaaacaaacaaaaaccugggguaugguggccagcaauuauaagcucauggguagggggauggagacugaucccugugcucacagcccaggcagccucaucuguuuuccaggccaagugagagacucugucucaaaagacaagacacaccugaagaacaauacucauggcugaccuccggccucuauacacaugaacaugcaugcucacacaugaacacacacacacaaauucaugucuggagcucaucuguuaagagcacuuaauugcucuuacagaccagguuuaauucugaacaaucacaugguugcucacagccaucuauaacucuaguuccaggggauccaacgcuuucuucugguuucuaugagcagcagcgcacacuauauacauucaggcaaaacacucacacacacaaaaauaaaaccuggaaaagaaaaaagaaaaaaaaaaacagaaaacaaaagaaugaaaacaaaggauaaaaacuggaugucuaacugggguucuuggaacugaguaaaguggcucagucccucuguucagguaaaauuaaccagggucagauuuuaacacagcagaauuugccaucugccaccugucccugauccugcccaaauucccacauagcccagcugaugagccagacugaugaagaccccagugggccuguuggccucugucaagggacagcaauuagaggagaaggucaccuccuugggauauuaucaguccuuaaaauuucaaaauuauccaggagccagcagagccccacccaaaccugagcagcuuugcaaaaaaagaugggcuugugccaugagcagagggcugaccugugggcaaugcucagagccaugaacugacggaaaugagagcagaguggcagggugcacguccucacacagcugaacccuuccucagugcugccgaggcuccuggaaccuuccugaugcuacaacccuuuaauccaacaccacaguuccucacuuuguggugaccccaaccauacacuuauuuucauugcuauuucuuuuuccuuuuuuuuuuuuuuucucgaaacaagguuccucuguauagcccuggcuguccuggaacucacucuguagaucaggcuggccucgaacucagaaauccgccugccucugucucacacgugcugggauuaaaggugugcaccaccaccacccagcuucauugcuauuucuaacuguaauuuugcugcucuuaugaauuauaauauagggggcugggggggauggcucagugguuaagagcacugacugcucuuccuaagguccugaguucaaaucccagcaaccacaugguggcucacuaccauccauaaugagaucugaugcccucuucugaggugucuaaagacagcuauaguguacuuacauauaauaaauaaauaaaaucuuugaaaaaagaauuauaauguaaauaucugauaugcaagauaucuaauaugugaccccagugaaagaaucuuucagccugcgcugggcggugguggugcacgccuuuaaucccagcacuugggaggcggauuucugaguucgaggccagccugguguacaaagugaguuccaggacagccagggcuauacagagaaacgcugucucgaaaacaaacaaacaaagaaacaaaaagaaucuuucagcccccagaauggucacagccacagguugagaaccuacugguuuagggguucucccuggggaaacaggaaguucuccucugcaugaacucuggcucaugacagugaauccuuugaggccaggcuauucaacaagacaagauccaagucaacuagaacuacauaguaagaccuugucucaaaaacuugagauuaaaaaaaauccuaugcagaaacaaaaucuuauauaaaauucucucaauucauacuagggggaacuaacuaaaaaggcaugauugaauguauaaauauuuaauauauauuauucaccuaugucucuaauauguuguacuuuaccaauguuuccuauaaggaggaagaguucuuaggaacuuuuuaaaacugcacgagagaaacucggggcugcuuuucagaaaccucuuuuacacacugagaauacaagugccaaucuuucucagaccuauaaggagauucgaaucagcuucucggaguggaaacccuaucugacucacagcaaaagugggggggugggggugggggcuuguuaccaaaaaaccuuauaagguuuaacagaggagacagaauucuucauuuuuuaauuuuuaaagggguaggugacugcggccaugaguuugagccccacaauguacuuacagcaugaugcaauacugugcaucuguauccaaugggcuacuuaugugcaacaggaggcugugacugagagcucuggaggcuccagggcccagcacuaacaagucaugcugucuuaaauaaggaagagggcagggacugacucgcaacagugucugggaauggcaugugagcucuagugcacuuauuuuguuuuuugguuccucgagacaggguuucucuguauaguccuggcuguccuggaacucacuuuguagacaagauggccucgaacucagaaauccgccugccucugccucccgagugcugggauuaaaggcgugcagcaccaccgcccggcucuagugcacuuauuaaaaagaacagacagacagacagacagacacacagaagaauaaagaaguagaaacaaagaagagguggcuuaggaagccaagcugcccugcacagcuguggggaugggguaauaccugggacagaggcgcagaaaccuuugaaauuucaaacucagagccuggcacuaucuagcacuugcuuaugcuucccugugcucccgcugcacugccccaugccuguucuaauaaaacaggggccaagaagaguugaacuauuuuugauaacaagaguaaaugguggaaaaugcuucuuaaaaaaaaaaaaaaaaaacaggggcgauaucuaauagaagcacagccuggggugugguucaggccuugaacuggugauccuugugccccagucuuuggggcgcugagauuacaggcugggaucaccacacccugcuuauuaaugacuaacaggugggacuugguggcuucugcagcuggauauccucuggggagugucagcagcucacccaguggugacucuagucacaaugcaaacugucauuuccucggauuccaaggagcacaggccacuauaaaaacacagaccagauucagggacacuguggugaguagccaucuucaaguuuccccuaaaaauugagcacuuuagggaaaaccuuuuacuuucugauuaaaugauggcaacgggacuaucuuuuaauuucuuugucauuuuuuuuaggcacaguaauuuacuuuagcaaauuuaaagucuaggugucaaaaauuaaucaucaucuacaugucaaaaauuaauuauuaugggcuggcgagauggcaaagcgguuaagagcacugacugcucuuccagagguccugaguucaauucccaguaaccacaugguggcucacaaccaucuaugaugaguuccgaagcccucuucuggcaugcaaauguacaugcagauagugcacuuacauacauaaaauaaauaaauguuuaaaauaauuaaucguaguuuauagcacaauuguggguuuacauggggugcugauugaaaccaggaauaauuggucuguaggguaugauaauguguauuugcguguugguguuaugcacauguaucugggugccaggugaagcuuguaugccuaccucauucuaucuuccucuuucugcugaaggagcugucugaaccugaagcuuaccaacucgcuuguaguaagcuucagggucccucuugucuuccuucccuccccaggguugagauuacaggcacauagccuccaaaauggaugcugagacucugaauucaggucuucaugccugcguagccagcacuuuacccacugugccccgugucucugguccuuguuuuuguuuuuaaugguuuaaaaacaaaggacaaaugguuguccccucaggaguuuuaucugggggcagcaucuaaagaugagacucgcuuuacugucaucaacuucauucagugaaaaaaggguuaagaaguggagucaguccugauagaaacuaagcugcuuugaaaacaccccugcuguucaugaauauggagugggagccaaaggagacagacaacauuuaagucucaccuuagucgcacuacauuuucaagcuuccugguaaaauucacagggugcucagguuaaaaaugagauuagcagccucuacacaacacagagucgagggccagugggaacuguacuuucucuucaguccugcacagcuccugacagauugccuuaacaaaugccagacaaauugcuuguccuaucuuaucccacucccagcaccagaggucacugaccuaacggggaaaauuccagaccuccauuaaauacagacacuaaacaucaucugucaggaaaggggaggggagaaagagcucacccaucuccauccuuucucagauuaaagucccuguuuuucacacuacaucucuuaaacuugagaacagauaaaugcauacuuuaccaaaauuuaaauaggaguauguacuacagaaauggauggcucggcaguuacagcacuugaugcucuuccugagcaccuauguuggauauccauaaacuccucuaacuccaguuccaggagaucugacgcccucuucuggcucuucugggaaccuacauccaugcagcacacacucaaacaagcacacccacacgaaugcacgcacauaaaucuuaaaacaaaaccagcuagccuucagaaggacacaaagcaggaagucuaaauucuuggcuuccccccgucccagucccagaucccugggaauggaaucggcagauuguuucaggaagugcuggcuguggaaaggcagauuuucugauuguuucugcuucaaggccuaaacuggagaacagagaccaaaagggaaaguguucaaaagauaaaagaucagagaaacuaacagaccaccuguguagcgcaaaaagcagagcaaagcuaggcuucugcaguguuugccagagcagaaauuaacaugcaagaucccuaccgcaugacuacacuguauccuuuuauagcaagauuccaggauucugccugauucgggaacucccaauggggcuggggggugggcgguuauuaccgaagucaucaaaacauagcugcaggcagguuagccuuuagauuaacugcacugcgagccucccauucugggcucuggaaaagccuuuguuucaggaauucuuccccuccggcagggguuuacuucaaaucaaauuucaaaagagcccccaggcccuccaauaaaaagacuacagaaaauagguucugccccuuccuugcaaacucucuggcccccaggacaguaucaaauaacuggcuuuccccucuagaauaggaucuucuuucucucuuuaaacuaccacaauagggagcuacugugcaccuaucuuugcaaaugccuugccaauacaaucccacucagccuuucccugggcggaucuaccaaaugcuauauaauaguaaaguaccugagcaauuuaauuuuuuugggaaaaaaaaaaaguggcugaacgaucgaccgugggacuaauuaagggaagugcggaugaguggagcgcagaggugcacacacaaguuuaaauaacggggagccagcacuaguccucucuggagaaaagccaggaaaugaggcgacuugaaaagcuguuuuucaucugccagacuuaagucuuaguuaacuguauucccuuucugauucacugaaguaccugccagacgcaaaaucaaaacugucuuccgagaaaggcuuuguagagagaauuuuaaguuccguucgauagauucucaauaaaaguucuuaaaacuccugucacggguacuuucauuccucgguuucuuuagugugagacacuaaagagauuaauccuuucucugggauauuuacaacucggagaacguuaacagccccguucaacugaccuuuuaaagugaccuuccgcuuuuguggggaaaaaaaauuuuuuuaaauuaaagaaaaacauucuggaauccuaaacucaacuucuuuguugugucccgggaaugaaaugcaagcagcccccaauccgaaaggcuaacuucagcuccuucggcaacaacaaacaguuggcuucagcggccaaggauugcucgccaggcgcccacccccgggugcgacacgagaugcauucagggugucuggggaccuagaaccccgcggucucccgggagacgcggauaccaccugcagcgcgggccccgccccagcgccccggucccacgccgcagacccucccgcggccacggcggggaagaaugacacgcgcagcugugggcgacccagccggcacgcugccgccagcugcuucuuuuagcucgacauccgacccugcuccccgccgccgucugcagcccggccgcuccccucccccaccgcagcgccccggacccgcgcgucccgcaucccccccacccccaacacacacacacacaucgcucccagggcggggaccgcgagcgcucggccgguuggcucaccucccuccuccggcccgcuguccagcucggcguccgaggacucgggcccauccucguagcccgccagccccaccagcucauccuccuccucguccucgccgccguccucacccugcggcugcggcuugcccagcacuuggcucaucacgcccacgcuugccuccaaggucccgcgugggccgaguggcccgcagcgcccuggggccgcgccuggugagcaaggggguggcaguggagcccagcccccucccugccgcugcugcccgagaagccagccggagcgcggcaguucuccccgggagcgcgagggagugacugcgugacccgagucaccugacgcuugucacacacacacacacacacacacacacacacacacacacacacacacacgcagcaccaccgggcgcgcgcucgccggccgcagccaccgcuugcucggccacacacguucucccccuagagagaauucggguguccagagcgcacuggccaccgcccucggggacuucugcucgcuuucucugcaagcguggcccggggaccacccggacccugccgccugcuuucugcagugccccuggcuugugcugcggucuucaggcuuucuacccacacccuacccaccuccaccccacccaccuccaccccacccca

SEQ ID NO: 1816 - RNA, 2122 nt, Mus musculus
cagaagccuguuucagcuccccucacccugccccacaaguccucagccuugccucugcacaccacccguucugucuuugcguaacauugagaacucaguccuccaugacaccuugugucuggauacucacacccgaguuuaucauauuaaauacaaauuuuguauaaagagggaguaucaaugaaaacuugaaucaaaaaauaagacaugccagagaugugguuuuuuuuuauugauggacuuggucuccuaaaaggcuguuuuauuaguuccucacaucuugagggauagguuuuuuuguugauugauuuaguuuugguuuuugcagggcuugauauugagaccagggcucuagcacagagcugcauccccagcuccagggcagggcauugguugcauuugcuauaaucuugacaccauccuagaacagcuguuguuauuuaugcagcccaaccucugagaaucauguguauuccgugucugguuuccuuuuccuuuuuuuuuuuuuaaguaaaauuaaauuugacugauguauaaacaaugucggguuuagguagguaaggaaggguguguuucuuguuggagguugcugcugugauuuuacaauuugcugucuuauuguccaaugguuuaccauuuugaaccacuuacaccauguccuuacaaaugccuuuuccugucaccugggagagguguuacgucaaugcauucuagaaugaguaagcuacacuuagcagcuuaaauguaauuacaaucugaaauuuauuuuccuuuaccagcuuaauucuaaggaagcuugaauaugggaccugugcaguacagguguuaaaguuauguuuccuuuuuccuaaaugccugagaccagcgguguuucagauuuuagauuaaaaaaauguuuugaaauauuugcauauauauuauguaaucuauauuuuauacauauauauguauauacaaacagggagggggaagauagagauggaacccagcuagagcuauaaaaaucccuuuguguaucacaugggccugcccuaugcacacagcuugaaggacggugugcucaguguuuuagugugucugagaguuaacugaccugugugcacaggaggccaguugugcaguucucaccuaggucgugccacucacaguuggauuucuggagcauuuuggucagucaaccuggacugcgaacuaguaaguugcuguguauucugugacuguagcuaauauuuagcuugccucaaauuuuuugagcugauauuuagucuuaacaaauucuccuuauuggaugaacugcacaggaaguuuuucuuuucaaccacgucucucuaugacauaaacguugggguacuuaggguaaaguagacacugcauguguuuaugaaggugcaaacagaaagaagggugucaagugcuacaguugcauugcuguugcuguuuguaaacugugccgucucagcguuugggugaguaaauguuugcaaccacuggagaagaguaaaggcccuguguguggugcuacauccuccuaggauuuaguucacacagacuaugccaggauggaggggcaccugaaaacugcccugggaguuuuggaggaagggcuucuaaaauacuuaaaaauacgugaaucacuucagucuguuuaaacggaaaaaaauauuugauaccaggucuuuauauauauauauaaauauauauaaaagaauaguugucucaagaggaauaaaaucuggaguguaaaaaaaauguuaaaaaaaaagaauacuugucucacuuuauaauauuuuuuaaaggaaaaaagaaaacguuuccaauagcuuuuguguucugugagcucucacuuuuuaccugaagcagucuucuguagcaugucccacagcaucagaguaacuugauggugacuaucauuuuugugcccauuaucaggcuccagucaucugugagaggggauaaacuaccuugcuacuaacuuaggccuuuugugaucuaaugacauagcugagggugguguguucggguauauaagagguuaguauauucaaaaacaaucucugcuauugugguuauaauuauuuuuguaguguuuuaauagaugcacauuaaaguuuguaaaaaaaau

SEQ ID NO: 1817 - RNA, 45179 nt, Mus musculus
cugacaaaccgaaaccagaaugauaaaauguaccugaauuugcuucuacacugacuuucucagccccagaugggccguggccagcuugacagacaagcauucucccuucagugggguuccugcugcaacaaguaauuuuuuuaaaccacaucauaaucauuuugggcugagguaagaaagagauuucaaaauauauuauuguaguuguuccaauguggauucaugugaggaaguuuugguuuggggugcaguccuggcuacccaugagagugagcugcaguguuuuaaaucccugguacccagaccgacuaagucugaguuucuucucauugcuggugacugauuggguguagauucaaucagagaagucucaccacacuaagucuuagcaggaucagcaagcucccggagaggugguuccuggugaguuugcuuuguuuuuguuguguguugcauuguaaguuuuucugccuggggacuguaaauaggaaggaaguuacagaaagacaccaaugguaagggcaggacugggucaucugaacucacugagggcaugucgugguggugagguuuacgguugccguguuggaaugauuuuacccuuccuguuauaacaccgucauuucacaccauuuguuggggacccugggucuguauuuaaaguuucauucuaccauucgccuaaagucaaucaaaauggggaagugagcauauauuuggugagauaucauaggguaaggagucagcuuugcggucgguacguucaccauauacagcaaacuaagaguuaauacaaaaugguugaggugacccaauugcagacgcagggcuuccuaagaggugaucaguaagcugcagugccaagucucagagaggagccugcggcacuguguucaaaugcauccccaggacugcucugcaaccaaagagauuguuaucuaaucgcuucuguaaugugggugagcauuucagauaucgcuguagucauggaagguguugcuggcuguguagacugggaaggaagacucuggagacagggcauagagagagagagucucuauaccuuucuggaaccauaugaaacagaaaauacaucucuauggggguucuucucuaagggggugcuuuccugaauuauugagaugguaggagaaaaaaacuacauauauucuagccaacucuacccagugugucaucaggcccuuuggguaguggaacuccuugggggauuaucaagccagauccccucacaaccuggcucugggaguuauaauccuagugcagccugguccuuagaaaucuucacuaaccgggcaugguagcauuugccugugaugaugaagcuggaggauccgugugagcuccaggccagccagggcccucuuacaagagucaggcucuaaaaucaaaacagggcugcccaagauggcuccacuauaaagacacuugucacuaagccuagcaacuugaguuuuaucccuauagucacguaauggaaggagacaauccauuccccaaacuguccuuugaccucuguacaagcacuguggggugugcccuacccuuauguggucucugucucugucucugucucucucucucucucucacacacacacacacacacacucucucucucucuuauucucucucucucucacacacacacacauguuuaaacauuaaaacaaaaguaacucuccaagaaugauauaaaauaggaaaagaauuuuuaauaauugugggguuuuuuugagauuauaacauaucauuucccccuucaccuuucuccuccuaaaccuucccaacccacauugcucucuuucaaacuuauggcuucucuuccuuuaguuguuguuccacacaugcauacgugcauaagcacacacacacuuaaaugcaugaauacaaccuucucagacugaauaaugguacuuguauguaugguuucagaacugaccguuuggugauggauacgauuggugugcucuucccuggggaagacuauuucuuaguugucuauaguucucugugaggcacugaagucuccugggcucccacccccauccaugucagugagggaacaaaucuuuuggguucagacuccaucuuagagagucugaccuaagguugaacucaaguuaaguaauaggcuacccccaaacaaggccugugucuagcaccaguuuccagguuauuccccaacaaaucuacacccccagguuacaagcccacuucuaacauuucacuucuuaacaaccacaaaucaggaggaaaacagaaguuagguuuaugguuuggcucccagcaccagucaauuauguuaaggccauaaugggcccccaaucagaaguguaucaggcuaaaugacccuuucuugccucucuacaugcuuggcugaaacuaggcucagggcuccaccuuccugcugugucaggguuggcagagacccuacuucaauuacauugaaauccgcuucuugguggucuuuugggguucacggcuguuuccuggcauaauuguucacaugucuguuguugcucuaguucagcuccuuauugggcaguuguguuggcgcaaccuuaugagugugacuucugccaauacuagaagacauaucacagcaaauucccugcuguucuggcucuuacagucuuugugugcccucgucuucuaugauauaucacaacugaacaggagucacauuggagguuuauccgugggacugggcuacacaacucuacauuuugauuaguuuuaauuuucuauaauggucugucuguugcaaagagaaguuuucguagugggaggugaugacuauauuuauguggguagacccugaagaaggaucaagauuuuuuuuuuaauugaggcagggucuuuuguagcccagacuagccuuaagcuuuccauauacccaaaaucuacugagccuucuggcucagcuucucaauuucuggaauuauaguaugggaccacaacucccaguguaugcuguacggagaggcaagcccucugcagcuuagcuacauccccaugccuuaaggaaagguuucaaaagauaauuauauuuacauuuuauuuugauuuguaugaguuugggccuacaugucugucuauguaucacaugcaucccugguaccuuuggagaccagaagagacaucagguccccuggauuugaguuaugggcagugccaagcugucauuuggcacugggaaccaagcccagguccucugaaagagcagccagugcucuuagccacccagcaucucagcggcccugcaucugcauuacaucuuaguuagaaccgacuuuucuuauucaccuccauuaaccucaauaauaaaagcagaccccuuguacaugaagaacauagggaaaauuuuguucuucugguauuuaaaagguaccuuaaaacguguuaaaggaccgaggagggaguugaguugguagagugcugcucagcaggcaugaggcuuuagguucuauccucagcagugaugagcaggcacgguggcacaugucuguggucccagcacuugagagguaggggcagauauucaaggucauccuugacuauaaaggaaauuugaggccagccugggcuacaugaaaccccaaguuuaaacaagcaaaaccuuucaaauagauauauuaacucuuucaagccauuccgcuauuugugagauuucauuguuuuggccaagagauggcaccugcuuuuccauccaagcuaacaaucacacacauauauacuguuggccaucacuggaaggagagugggcagggagucagcucuuagcagaguucuugccucgcuugcaaaaagcccuggguuccauaccuagccacgaacaaagcuggguaaggugaugcaggacuguaaccgagguaaggugaugcaggaccgugacccagguaaggugaugcaggaccaugacccagguaaggugaugcaggaccgugacccagguaaggugaugcaggauugugacccagguaaggugaugcaggacuguaauccuaguaccccugggccagaaucagaaguugaagguuauccucugcuagggaggaaacucagagccagccugaaccuacagacccugucuguaaauagauuaaugaauuaacgacuugaauagaaaucuuuucauuaaaauacaugagcuuugauaacauuauuaaacauguucuugugauguuuucaaaucagaguagaaaugaagacauuugaagaguaauguuugguucuuaggacuucucuucacgacuuuaaaggcaggaauuguuaagauuuuucucauccagugcucugagauugcagcugcaccauuccugucauuacauuaagucccucuuauuuacuugggggaauugucccuuuuuuuuuuuuuaacuguauauucugaaaugaaacuguaauuuuccuuucugcugcuccaaguccucagugaaauaagaagaggaccuugcccaggucagcccaggcaacgggcuuuauacgggcagcguccaggaaugaggaacuggguggcuuaagguucuguucugucuuucagaaggaggacguguauuucgaguuguauaagcuguguaucugcugaggcugucuccgagacccugcugguagagagcugcuuggcaggcgcucgugaggcccuggguuugaucccuagcacagaaugaacugggugcagugguacauggagcuagucccagcacucagcaggugaaggaaggaaaauuagaaauucaaggucacccuuggcuacauaggaauucaaggccagccccgguacucaagaccugucuaaauaaauagagugagaaguuucuccguagccuacuuuggcuuggaaaucagcuagauuacaaaaucauucauauuuuccaaauacuccuugucuccuaaguugauguuucuuuuuuuuuuaagauuuauuuauuuauuauauguaaguacacuguagcugucaucagacacuccagaagagggagucagaucucauuaugggugguugugagccaccaugugguugccgggauuugaacuccggaccuucggaagagcagucgggugcucuuacccgcugagccaucucaccagcccaauguuucuuaauaauguagaaauacuagcugaacaaacuaaccaaaacaaaacauuuuugaugagaccgaguugugaguguucugacucgacccaagccaggagagacaccgcaguauggauuuaggcuucuccgcagcagggugggucagcgucaggagacugaccacagaacuaccuugcagaagccucuuuguuguuacacagaaggcacuuuucagcaagucaauuuccacaugccaaaaucucuucucugcuuuaggaguugucugaaggaacccuuaccuaagcaauucucagucauccuagacuuccugguuagccauacaaaggcucugugaaucagcagcuccauaaaccucagauaacaaucacugacuauuuacggaagguuacuucaaagccgagguggccucacuccagaauucaugccagauaccauggcucugcuaauacucagcugcaucaugucacauguaacccuggguggccuugaccuucugaccauccuaccccuaccucccaugugcuaguauuacugaugugugccacaucacgcuugacuaauaauagcauuucuguucuuaggguuugcaugggauagacuuucccagccuuuaacuuuaauauaauugcgguuauauucaagguaacaugccuucuaugcacuauauagaguugggucuuucuuugugauuguuggcuaacagccucugcuuuguguuugucgacuguuaguuugcuuauugaguuagcucuuacugugaccuagcucaugcuauguccuagccuugaacuugcuguccuugugccuuuaccugccuaguacugggacuauggguauuuaccaccacagcuggcucaauugcuggcuuuuaauucaaaacauugaauauauauguguuaggcugggacccccugcucaucccuugcacaagcugggaaacuccaucugcccuccuucccccaacucugccagcaccgagaaaacuaaccugucaucacuccucaguucugaguuugcagcaacccacccaagagcgccuauccagggcucagauucugaacaucaccccagcucguagcaggcacgucaucacuccuuaccuaagcuccguaaaacccccuugcuuucaccuggaugugagacaucucugaccuccaccugugagaugggugaacccacuccagagaugcuuccuaauaaaucugccuuuaucuauuuuuaaucuggucaaaucuagccuauaucugugucaccaagggagaaaaaaugccuaucaauguguauuugauuaaucauguucugaguggugcauccacuaucuugcugggguuuguugauugcuuugucuuuaugcucucuguccuuugaccuuucuguuuguccuacuugcugcuuaguuugcuuuuuuccuuagucuaucuccuuagcuuuuaugcaaauguuuagaagauuuuuuuuuauaauauguuuacaauauguauucuugcuggguguuguggcacaggccuggaauccccgcacuuaggaacuuagggcaggaggaccuguaucuaguguuacuggccagccugaauuauauagugauagcauguccccaaaacaaacaaaacaaaaaaaaccccaaaggucuggguauguagcucaucgguagugugccugccuaguguguguaaaguccugauuguauugccuagaacaacaagaagacaaagacaaagcuggauguguuggcacacagcauaucuguaauccuagcaccaaggaggcagaaucggugugugaguuuaaggccaccuaggauuguuagcaagaucuugucaaaagagaggaagaagagucgggaagcagagagagagauaaaagauggcuagauaaauagagggacauaugauaauaaaacagagcaacacacuaguuguaaaaucucagugauucuuuuuacgguugguucauuugccuaagacagagucucguguagcucuaacagccucacgcuugcuugaggcuggcccuggacuccugcucuucccgccucugccuccucguaaguguugggauuguggguucauaauaucacaaucagccuuuuaccuuugaucuuugaaaagucucagaguagaaauguugggcaaaaaagccaaacuucuaauuugauguaucaaauuuugaauuuuucaauguuaauuauauaaugaaauuuuauaagaauaaaaaaaaugcacuuaaauuugaccugcuuacuguuucaaagcucacuuccgagacuccucacuuaugaaccaggcuggacuccugacucuuccugucagcacaucaagcuaauuacuuccucaaguuuccacauggcccaaccuggauuuuugauuagcuugaacccaaccuucuucuggaaaauucuuccuguuguucaggccucggcuugaaggucacuuccccaguaaagcagucccugucucccaggcuggucucuuucccuagaggaagugcugcuggaaagcaccucacagaggcuaaaagccuagucauacuggaaccaugggauuucccauuccaaaaaagcagaugucauuaauagacugugaccuuuguaauuauucugagaaggcauguucccugucagagacaagaagcaacaagcauaucugaaaaucagaaaugaaaagccuguuuuaagccacaaauggugucauaggccuggaaucccagugcuugggaacuggaaacaagaaaaucaggcauucaaacucauccucagauccauaaggcuagccugggcuacacgagacucugucugaauguguguguuuguguagggggaguguuugggucuagacaauuauauuugcuugcuuugcauaccauguaauuguugagguccaggaauugccucacaaaccacacagacacugaucucagucagacagggauaauuacugaacaugugcccuaggacugauuaaccagggacaugaucuagauuggggaacuggaccgugaccccaaguuaagguccuacaaggauuuuaagccccaaagccacaaacaccugugucaaguuauuccaccaaccaagauuuagggauagggauuucuucaggaaugugucuuuguuguacauuuaucuugcucccauugguuggaguacucaacuguagcaggggacuugccuugucuaauaauaauccauguucuaacuugucaaugaggaugugacuugucuaacauucaugucuuaacuugccaaccaggaugucaguuacccacguacaugucuuuuucugccaaguaggaugucaguuccuagagaggucuugggaacuuaaacuuuucgaggccugcaaucaaaauggaagucuuauuucaaauaguuuaucucucucgcauugggguccaucccaggcgcagcuuauaccauaaaagcuuagacauagguauaggaagugcugcugugugguugguuuggauccaagcuuauuguagguaacuauacaaagcaguucgacugacuucuaucaugguuucuuuucaggaacacagaacauaacagaguauguaaucaaucuuggcauuagggaguuuccuaguaacagcagaaacaugggaaaguuuccuuaaauggcaggcuagccagguaacaguuaccuaggccuuaacauuuucccuaggccuuaacagugauaacagaaauauacuuccucaauguccuacgagugguaaaagacgcugacugugauggcucauuacugugaucucacacuuaguagagugguucacgccuauaaccccacacuugagaggcacaggcaggaagaucacaggaauuucaaggccagucuggucuacauagugaauuuuagacuagccaguucuagacuauauaaugagaaaaauguuucaaaaacaagacaaaggaaaauaaaaaugagaugagagaauucugauccuauguuaccuggacccaugacuacuucaggaacacacacaccaggaaguccacacacacaaagcaucacacagucacacugcacacguuagcuagccacgauaaaacucccuuagacugucuccucucgacaaccagucucaguggguggcuuucaaaugcaguacugaagacucugcucugacuacaggcacagagcuuuguaaguuggguuagcaaaccaagaauacaugaauucuggcuuggucccugucuuugacuagacaagaaaagaaaggggaaaaaaggaucucgauguucuuuaaaggcuaccaccugaacaucaccccaaacugaagggugauacccaggagacacugcauuaaaguuggcugagauguggucugaacagucagucaaccgcugguacaagcuuguuccuccaagaccagcaggacacuucuuccccaaccuucagcagcaccuggcuuaucaguaaaacaugguccucagccucuucuuuugcuuugauugauacuuugaauuuauugucaucagugcugagaauacugcccaaauaugugauacaaaauggcagaaguguuuaaagccacaucagaaaugguggaaauugugcucuaaccccaagccaaaacucauuucuuccucuuccucuuccuccuccuccuccuccccuccuccuuuccucuuccucguucccuucuuucuucuucuuuuucuucuucaucacaaucaaagcucaagucagcaacuaaaacaucaauuuuauuuuuaccauuucugauuuuuuuuuuauuuucaaugaccuuuggaaacuaaccacacgaagaacaaaauuggcaaaugucuugaaaucuguaaaacauuaaguucccucuacucucaaacucucauuuauuaguguacuauucaaucuuuuaaaaaaaauaagaaaaggggguuggagagauggcucagcgguuaagagcacugacugcucuuccagagguccugaguucaaaucccagcaacuacaugguggcucacaaccaucuguaaugggagccaacgcccucuucuggugugucugaagacagcuacaguguacugacauauaauaaauaaauaaaucuuaaaaaaaaauaagaaaagaagcccuaucucaacacauaccccaaaagaaagaaagaaagagagagagagagagagagagagagagagagagagagaaagagagaaagagagaaagaaagaaagggagagagagagagagagagagagagagagagagagagagagagaaagagagaaagagagaaagaaagaaagggagagagagagagagagagagagagagagagagagagagccagguagugguggcacaugccuuuaaucccagcacuugggaggcagaggcagguggauuucugaguucgaggccaaccuggucuacagagugaguuccaggacagccagggcuacacagagaaacccugucucgaaaaaccgaaagaaagaaaggaaggaagggaagauuauuuuuuuaaaaauggagaaaauguuccaaauauucaaggugggcucaguguugggaucauguauaagauguguuuucuuucuccuuucugagucuuucacaguguguauguuuuuacuuaugucuuuguguaagaaaccaaaaguaauaauacuaguaauugaggugaggaaugaaggcacguagaggaucaauggcgcagaagagucgguucugugguuaagagagcacgcuguucuagaggauccaaguucaguucccagcguccaggcagcucacaacugcgccuccggcaggaucagccacugcuagcuucugaggacaccuacauacccacacgcacacacgauugcacacacacacuuaaaaauaauacacuuuagcugagcauaguguuacaccccuucaaucccagcacuucugaggcagaggcagguggaccucugugagauuggggccagccuggucuauuggggccagagagauauaguaagaaccuucucaggaagcaacaacaacaaccaccuuuguaaaggagacuggaaagacugauucuuauaacuaucuacccacccacauccauucucaagauagcucuuuuuuauuauuuuucauguauguuauauauaggaguacacuguugcuguccucagacacaccagaagagggccucagaucccauuacagaugguugugagccacuucgugguugcugggaauugaacucagaaccucugagagagcagucugugcucuuaaccacugaaccaucucuccagcccccucaagauaguaacuguucuggucaugaacguuuccaagaugagguuuuaucuuuguuucucucagcucugguuaucagaaaacccuugccuuccuuuaugggggaguuugguccagcuaaugcuggcauuuccuuuccaggguuuuccacucucagcuuugcuuuuggaggcauuucuucugguucuccaucucugucuucaauggaagccacugcuaccgaagcgguaucuggagcaggagccgcaacaauggccucuggcuuacuugaucaggucugguggcuuaggcagaugcuuccucuaguuucugaccaucuauggucacucuagacuuggagauuuugugggcuuuguugggaggucuacagcuucuucagcugaucaguuuucaacccuguucugggaacuuauuccuccacgauuccaaugguucugguuugcugcaccaucucagccagcuucucaccgaauuuccugucugccacuucaugcgcuucuaccugccuuaaagcucugacacggacucaaaacagcaaugcuacaaaucaaacauguaaacacaauacaauccaaacauauauuaaucucauacaugcugaaggaugaugggagagaaaugcuauaaaucuuuauuuucacuaauuuaaaccauuacguuucuguaagagcagaagauuuuaugcacagcaaaaaaaacgcuucaauuuaugacuugugauuguuuauaaacugggcagugguguucgaggaaguguuuguuguccugagggcauguguaauccagugcgcaugcucuucuuugagaacuaaggcugcugagagcuguacugcguggagcgcaugagcugagcacuauuagaaguaucuugugcagccacugagccccuguguuaucuuuucagaauguaaagaaaaacuucucucuaauaaagacuagccauugcacuggcuccucccaaaaaaaaaaaaaaaaaaaaaaaaaaaaaaaaaaaaaaaaaguaucuuguauucacccagcggugguuucaguaagaguggcccccagagguucauaaguuugaaugcuuagggaguggcauuauuugaaagaauugggagguguggccuuguuggaggacgugugucaccuggguaggcuuuaagguuucagaagcacuagccagaccuaguuuuucucucuuucugcuguaaggccccugaaacuggggagacuuccgcucaaguccugggaugagcuggccagcaccccaguaacucgagagaaaaacacaccugaugcaaaaccgcaagaggcuuuaucgaccccgagcgguaacaguaaggggcuuuuaaaggaaaaagugagguguugggaggaguugggaggaguuuggcuacagcucuucucuggcagguguccuugguaaaauuacaaggcaugaggaguggggagugaguuauagcucuucuuuguggaguuuuucuccguguccuuagcacaggaagccaggcaagcgccuagcuaggucuuuuuacaauuauugcaucucugguuguaagguauagaaacaaaaaggcuuuuugcuggcuauagagaacaaagagcuucuuucuggcuguauuuuuagagaucagggaaaacaagcuugggggaacgucuaggggcuuuaccuuucagggagaaacgcuuuaagucggggucucacacugcuuauagaucuggaugcagaacucucagcuaccucuccaacacuaugucugucugcgugcugccacucuccccaccaugauaauaauagccuaagccucagaaacuguaagccagccccguuuuuuuguuuuuguuuuuuuuuuuaaaugaguucuuucuuucauaagaguugcugugguugugaggucuccucacagcuauagaacagcgacuaagacacccugguuuugucauauuuuucacaaccaccaguccaguuauaggacuggcagauguuuauaaugugugaaaauaauaaggcagggcuggagagacagcucagugcuucaaagcacuggcaacucucccggaggaccuacauccaauucucagcacccacaagguagcucacaaucgcuuggaacuccaguuccaggggaucuaacacucucuucugaccugccugggcacauaaguggugcacagacauacacacaaauaaaauacucauauacauaaaacaaaaauaauguuuaaaaaaggaaagaauaugggacuaaaagaugacuuggguacaugccaacugacaacauggcuucagucccaggaacccguaaugcacugguucuacugaugcuaccaccuuuuaauaaagcuccuauguuguggggacccccaaccauaacauuuucauggcuacuuuguaacuguaaucuugcuacuguuauaaaucguaaauaucuguguuuuccaauggucuuaagguaaccccugugaaagggucguuggacucuccucccaaaguaguuguaacccacgaguugacaaucucugcaguaauggaaggagagaaccaccuuccacagguuauccucugaccuccacacuguggcaugugugugcucucccauacccacacauacaaauaaaauauaauuaauaauaauaacaaaaaagaggacuaaacgagguggaacaugauuuuacucucagcacucaagaggcagaagcagguggaucucuguguguucaaagccagccuagucucuuaagugaguuccaggccagucacagcuauguagugacauuguuucaaaaacaagcaagcaaacaaaacaaaaacaaaaacaaaagcacauagaucugugugaguucaggacuguccugaucuagagaguaccuuccaggcuagccaacguuaauaagaagacccugucucauaaaggcaaaagguaaagaaggggggggggggguuuauugaaauuuuaagccuuuggaagcauccuucauaagaaaucucuggugcugggcuggagugauggcucaguggauaagagcacuggcugcucuuccugugagggcuaggguucgguucccagccaccacaucagacagaucggaggcuaucugauaccuucugcucuccccugcauugacaugcucccaucuacaaacaucuccgcguguaaaguaaaauauuaaaaaaaaauggaaucuucugugccaacuucgaaacaaacacaacuaggagcaguuucucagaaagcaccaauuuguaucacaucagaaaucuguucuuuugauguaagucaaaguagccacuuagaaacaaucaauuuaaaaaaaaaaaaaagaacacagaguacuucuaaaaagauuuauuagcaauauggauuuccuuuuuuaacuuaaugacucaccagaauaauccucuaaaccuggaagucuuccuacugugcaagguggucagucagucgcugcucugcuuccuugcguggaaccuaaagucgcugcugugucgaccugcuacuuaggaaccacucacugagaacccaacuuuccuauuccuggugccuaacuaugauuugggaguuagcuguggagcgggggggggggguggggggggacccuuuccugugcuaaacuucuaugacugagccugcuuccuggagaucagcagugaucgagcaggggugguagcaggaaacuggacccuugaguggccagccuaauuccauaacuacagcaacaagggcugaugcuuccagcucugugagcacggcuagagcucuugcauguaucacucacacacacaaaagaagagacucugggaaagaaagucauuauuaauuaauaguuauuauuacuuguucuugugagacacugccuuaggcagucaggcuaaccuugaacugcugauccuccugcuuucaccucucaaguguuaggauugcaggcauaugccacuauauacuuaucuaccuacauaccugucugucuguaugucugugucugucuguccauauguauguaucaucuaucuaucuaucuaucuaucuaucuaucuaucuaucuaucuaucuaucuaucuaucuacagcccuacuuugcuaucuguccaccuaccugccucccugccugcaucugucuauuuugacagucuccugcagcacaugcuggccucuguacuugcuaucguacccaagacuguccaugaacucuugcuucuccuuccuccaucuuccaagagcuaggaacacacgugugcagagucacaccuagcuaguuuucguuuuuucuuuuaaaaauccguuuacaaagcugcauguucucuuaugacacuuucauacacacuuaugugguaugaaaccuaacauaacuuagauuagagguugguccuacucucacucugcccugucugucccauaccugucugcaagcagccccugcuuaagccccuccccuugcaguuucccuuuccacucauaucacaugccucugguauucucccaccccuuucucugaaggccucugucaccgucuccuauuucucuggcuucuauucacauucauucacacacacacacacacacacacacacacacacacacacacauacacacacagggagagagagagagagagagagagagagagagagagagagagagucuguauaugacagagaacaugcaauauuuuuuuuucuagaacuggauugccucacuugauauaguauuguuuaguucuauccacuugucuggaaauuuaauauuaaaaaauauuuauuuugugaauacaaguacaaguguauuccacaugcaguuauaugcacugugugccugucugguguucacggaggucaagagaagaugucagaugcccuggaacuggaguuacagaugguugugagcugccauguagauucugggaaccaaacguggguccucugcaagugcacuuaaacugcugagcugucucuccagccacucauuguucuucacuguucauagauagauagauagauagauagauagauagauagauagauagauaccacacuuucaucuguggauggacaguuacauuguuuccaguuccccacuauugccaguagagcagcagugaucauggacuugcacaugucuguagucggauguggagacaugcccaggcaugauacaucugaguaaugugguuguucuagucucagaucguaaagaacguuuacacugacuucucuagagguuccaacaguucacacucucacaucaguaaauagggguuccccuccuccacaucccucccagcacuuguuaucaucuauuuucuugauaacagucauucugacaggucagaugacauuuuaagguaguuuuauuugcauuucuaugaugacuaagguuguuggauacuuuaaaaaauauuuauuggacauuucuacuucuuucuuuugagaugcuuuguucagcucuuuagcccacuuuuucaguggguucuuuguuguuguuguuuuuuuuuuaagauuuauuuauuuuguuauuuuaugaguaugaguacuuuggcuagauauaugugugcccaccuggugccuggugcccucagaggucagaggaaguucguguaggaucccuuggaacuagaguuacagauggcugugagcugcccuguggcuguuguaacaauucuuuaaucucaaucggggguuucuacuccaccuuugaucauucaguucccagauaaaauauacacgacuuuauaucuaccagauaucuacccucuaugcuauuaugucuguuucccugacuauaacccugagauaugacuuggcauaugcagccuggaccacucuuccuccaaccggccagcccuccuggccaguucucaugaucccuuacuuguuggugucuucuccacucuccaucuucucuuuccucuccucuugugguccuccucagacuccaagacagggaacagaaacacugcccaccucucuucugcccagcuauaaacuguaggcaucuuuauucaaccaagaguuuuaaauuaaggaacaaaguuauauaucaucacuugguauaguguggauucccuagucccugggaggcaaccagucuuugggggccaguauuuagcauuacaauucauagcaacaaccaaaccucaacaaacucuaggguccucugcaugagugauaaguguccuuaacaacugagucaacucuccaguccugguuccuugauuuuuuuaaucaguguuuugugauucuuuuuuuuuauuauuuuggauauuaauccuauauuggauggauaaagaggugcuacugaugcauaagaaauuacuucuaaaaaugcuggcugcaggacaggaaaggguggaagugggacaagucugcuugggcagaacucuacaugcuucugucugaagucugggcucugcacuuuguggacauggcagagguaaucauguggucgcagaguuuggguucucuucuggucacuucagcaggaugaugaguuaugaucaaguuuuccaaggguucaagagcacagaggccuuuaucuuucacaaggcuuuggccugaacugucucagccucuuguuggcugaauucuauugauuaagaguccugggagccagucgagaugggauaugccugcaaucccagcaccguugaggccagagagaauugcuagauuucuagaaguucaagaccucccuugaaguaaugcuccccugaucuuuacccuguguagcuucaccuagacuccaaaacuuacugaccagaguagaaagaaaacuuacaugacaggaaguggaauguuccucugccagcuuauuuuuuuaauacccccacuccccaccuccacuuaggaagucccaccccucagccucuccugccccuuccccaucucugcuggaaacaacgcccccugcucauccacuuuccccuucccugguuucauuuucacuucuggacacaaccucggcauuuuccauuuacuguaaucccagcacucuggaggcugaggcaggaggcuugcugugaguuucaagccagccugagcuacagaguaaauuaaguuagucugggcuacaaagcaagacuggacucaaaguuuuuuaaaaaucccauuuauagacacugaguauguaaaaacaaaguauuugaaaaaaguagaggaacccuauuauuauuaacaacacggagaugauucauuuggaaaacaaaauaaaauuugaaagucaagaaugcuagccuguaaaccuagcaggaggaucaggcauuuaguuuauccauagguacauaugguguugaaggccagccugaacuacaugagacuaagugggacuuacagaaguuugccaccaaccucaccaaugaggucacauaugaaacacacacacacauaugcauacaugugcacgcacacacaauuuguuuauggugaggauguggauuuuugagacagggucucacauaacuccggcuggucucaaacuccuaugaugguuuguuuugacuggcacuuugauaggaucuaaaaucaccuaaaagaugggacuccuaguguacggccauaauggcccaggguuacgaaggaagguuucagggaacuucaacacuggauacuucaaacaucagaaggcaggaguuggcuacccccucccauccuggccccauaaagccagcuaacccaccagcaacccuaggaaugauuuaucacccugagacuuaucagguuucaguccuugguugaccauauaagguuugucccucccagcugggacucuacaaccccuaaguauguagauggagcaucauccaacaucccugccuuggccaaaggggcacagucacauaacccuugccuuagagacccuggccaccuccccaggagcauuaauaucugcuuuacaccccccccacacccccagcaaaugaaccagugcccugaagcuguucccagguguggguugcgcacacacuugucacugucacugaccaagcuccugcacuaugcucacccacgccuggcuaaguuucuugccgacauucaggccagcucagugcacaaggggccugacuaccauaacagagaggcagacacagguagcauccuagcauggcugugggggguuucuuaacuaucuuauuaugcgggaagacacaucuuaauugggccugggacuauuccuuagacgggauccugaacuguguagagggguugcuagguaguaacaaguaugcgucgcucucuuuuucugagacuuaaggcugggaacaagcaaaagaaacuuauucuauguacuaccauuucguuuucagaaacuaaacucaaggucccaggcccuaggggagcugaggacuucccuauagcggaacagcuugugauauaaacaguugucugaguccagacaucucagggacaacuuguaagugaaaguauaacaacauaaaaacagaauucuaggccuuuaggcccaggcuugggaauguggccuuuguaaagguaugcuaaucauaaaacacauagcgacauuccuccacccacccgcuuccuggguucaaagagugcucauucaaagaaagucacccagaaccugcaaugcaaaugugcuauuguuaggggcucuuagaagcaguccugagaguuaacaauuaccagguauuccuugugacucuuguaacuuuacacuuccuugugacucuuaacugguaucuuugguaucuuccaacaacgcccuccccacuuccuuaaguugugguuucuucuuuuaaauacccccuuacccagcuacucggggcgccacgguccucuaccccugugugguguaugaccaugggcccgagagcgcucuugaauaaaaauccucuuacaauuugcagcaagacccguuucuugugggugauuuuggggugucgccucuccugagucagaacgugggggagcccucacauugugggucuuucauaaggagacaguugucugaauccagccaucccaaggacaacuucuucaucuugcuggcaggaugaaacaaguucaaguuuccaggccuaggaaugaacaccuagcccacuucuccaauguuuuugguuuuuugguuuuuuuuaacaaaauaaagacuauagaaauugcuguugucuaaaccagggugcauaaguuguaaaaaugcauaaccaaucgccuguucugcccuaauuaauuacaugcagcuggccugcuccuuuguccccuucucacucugagcgccagacauaaugucuaagagaaugaauuaaggaccucgaagccagguaucuuggauacggauacuaccuugcuuaacccauacuguuaaaauacaauuggagcucccccuccccccagccucccccuugcuuuguguucccaugcuuuaaaaauguuguacacucucccuuuagggauacaguugagauucccaaauugcgcgccuucuugaguacucagaaaauaaagcuuucauuuuaaaguuuccuuggcuuaaacccugaucccaacaaaugugaucagcugcuucaacuuccagcugccuugacuuccccugcacgacgggccagaccuucaaccaggaacugaaguaaacccuucuuccuuaugcugcccuacuagagucuucuaucauaacaacagaacaaagccuaagacaccuccaucuguguuguggaucaggacgugaacucuccacugcugcuccagcaccaugcccuccugccuguugccuuguucccugcccugauggugauggagcccugugccucuggagcuguaagaccccaaucccuuccuucuaaaaguuucauggcauuguaucacagcaauaggaaagaaacuaacucaguuucuuauugggaugacuuuaaacuccugguccuucuuccucugucucccaagagcagacauucuguagaugccuguccaacuagcuuuuguuuccuuuaaaauuuacuuuguuauuauuuucauguguaugaguguuugccuauauguaaguauguguaccgugcucaugccugguuucugaaaacgccauguccagacuggaacuggagagcaacugaacccagguccuuugcaggagcaacaagugcucucuaaaauuguuggaccaucuguggguauucuuucuucugcacucagugugugugugugugugugugugugugugugugcucacacaugugagcaccuaugcaauauuggggaugccugaggaggcuaggggcaucagagcccuuguagcugaaguuauggggguuguaagccaucuaaaaugggugcugggaaccaagccuggguccucuuaacugcucagccaucuauucagcccugccuccaucugaauauuuuaugaugaauauuucaugggacuuugcuccuugaaaauauaauagaacuagaaaaagcuaaagauugauacuaaccauuaucaaggacagagagaauuguuuggugguaaaaauaaaaagucuuccaggaggauggauggcuuaguguuuaagaugguguuuguucucccaggagacaggaguuugguucccaacuccuguaacuccagauccagguauccaaugucuuuggccucucaaggcaccugcacacauguauacaaaaaacccucacauaauaaacgcaacacacacacaguuaaaagcaaaauaggagcuggagagauggcucagcuguuaagaacacuggcugcucuuuuagaggacacaaguuuaauuuccagcaccuacauagaggauccagucccaggggaucugauggcccuccuggcuucuuuacauacuacaugcauguggugcacaagcauacaugcaggcaaacacucacacacaaaauaaaaauaaauaguuuuaaaauaagagguaaaucuuuaaaaaaauuccaacugcaauaacauaaguuagugaagaacauuaugaaauaugaaagaaagaaacagagagacagagacagaaagacauacacagagagagagaccguuaacuguauguaacauacauacagucauaguucauuaugaagagaagucaggacaggaaccuggaggcaggaacuggagcagaagccauggaggaaugcugcuuacuggguugcuacucauggcuugcuuagccucuuuucuuauaugucugucuuagucagcauugcugugaaagauaccaugaccacaacaacucuuacgaaagaaagcauuuaauugggauuggccuacaguuuuagagacuuaguuuauuaucaucacauugggcagcaugucagcacacaagcagacauagugcuggagauguagcugagagcucuacgcccagauucacaggcagcaugaagaaagagauacuaggucuggcuugggauuuugaaacaucaaagcccaccccccccagugacacacuuccucaaugauccacaucuacuccaaagaggccacuccuccuaauccuucucaauuagugccccuccuuauugacuaagcauucaaauauuugagccucuggaagucauucuuauucaaaccaccacagugucucagaaccuccugcucagaaauggcauugaccccaguggacaggcucuucucacaucagucacaugugagaacugccucacuuucuugaugugacgcgcccucuucccagaugacccugguuuaugucaaucugacaaauagcuaaccaccaccauaccuaguaugcgugaagucuaggacccaguaccaagcauggcacaagguauggugcuagggcagagucgggagcauagccacccuccaaacccugugcaagucggcauggccuuacacaccugauaucccagcacuggggagauagaggaaggaagaucaggaguucaaggugauccuuagcuaaccugagcuaaccugggauacaugagauccugucucaauaaauaaaauaauaaaagguucuggggccaggugcuucucaauggcagucacacccucuauuuuuaauauaauuacuuuaaaaagcauauaaaguaaugaguuuuagaugaugcuuucauucaugugaacuguuguucucauuuucuauaauuauccucauuuucuauaauuuucuucaaacacauuuucagucaguucccuugacacaguuuccagagaagugcuugccagaguugauuugagaaucuacauauggcuccucuuuuuaaaacauuuuuucacauucaugugugagcaucuauguacaugcaaguaagcacacacaugugccacagcguucacaugaaggucaggggaccccuugaaccccuggagucucagggauggaacccuggucacaggcuuucuagcaaaucccuucaugguugagccauuucacuguccagcuuucacacgaauagaauccaaacaagacagguaucacaugacaucauacucuuuccaauucugaauauugacugggaaagugccaggcacugugcuggguaccuggagaugcaacuaaaaggugguuuguaauguuaagaaacaucagacaauaagaaacacuuucugagccuggugugguggcccacaccuuugaucccaacacuugggaggcagaggcaggcagauugcugaguucaaggccagccuggucuacagagugaguuccaggacagccagggcuacauggcuacacacacuuguaaucccaacuuuggaagagaaacuaagcuacacagaaagacagaugcugucuucaaaagaaucaaucaauugaucucucaagaggcaaacaaaacauuuaaaaauaaaacuuuuuuuuuuuuuuacuuuuaagguuuaaauuuuuaauuuuugagaauuucauggagacuguauguauucacaguauuuaccuccccuccccucuaacuucucagguucaugucucuucuucacuuuuauuguuguuacacauauguaacuuuauuaauuauuuaguuaguuagucuugguuuuucgagacaggguuucucuuuguagcccuggcuguccuggaauuuacucuguagugugaaugcuggccucgaacucagaaaucugccugccucugccucccaagugcugggauuaaaagcgugcgccaccacugcccggcuacauaacuuauugaguucauuuaguguggcuugaauguacuuggauuugauaacccuucagguguuggggauugggucuaacucugaagguccuuguccucaauugguuuuuaaccaaucaauaaagaugccagcggccaauggcugagcaaagaaagauggggugugucccuuggguuugugagggcuaggacacuggagagaggaagagagaagagaaucccugugacugggugugggggaggggggcgaaugagauuuaggagcugcuggagagaaagccaacuagccaugugagaauugaguggguggccacuggccacuuccccaaucggccugggguagcagcaagagguguagaacugcucagcuuuuaagcuaaucccagcauuucaaaauugggcuaaagugugugugucuuucaucggaagaauuccugggccgguggcugggagcacgugacccaccacccacacccaccgugagcacuaagugguguagcccaaauucaccgcaacaaucagggaacucauuuacgcaaagaacugguguuuccucccagagcagcaguugcuugccuuuggugauaucuuacugaaccagucaucaccaugguucauaguuugacaguuagguaggaucacagacuuuuccucucccuucggagcuugcauaacaucuucagaaaguuccuugaaaaggaagcguccaggccaguucuagcucaaguccagcaccuccuguguccagaauauggagugucuucaacaaucccgucuugccuuggguguuuacuuaacucuuuuuuucuugaguucuuugcauauucuagguauuaaucuucugucagcuuuaugcagcuagcaaagguucucucccgcucugaggcucgcucuucucuucacugcucccugugcuguacaggcgcuuuuaaguuuuaugaaggcucauuugucaauugucaucuuuaauuccugaacagacagaguccgacuuauaaauuccuuuucugcccauguuuucuucuagaagucuuaggguuucuagucagguuucacauuaaagucuucaauucacuuagaguugauuuuugugcagaguaacagauauagauauaacuucauuuuucuucaaaauauggacacuccauuuucccagcaucauuuguugaagauguucucuuucccccagugugcauuuuuuuggcuucuaucauacaccaguuggugagcuacaggucuaacucagugguagaguauuugucuagcaugcacgaagcccugaguuugaucuccaguaugaagaaaaccuaacaaaaguauauuuaagucagguguguuaguucauaccuucaauuucacucccacuggaggccaagucaggaggauugcuguaaguuugagagcagucaggacuacauuguaagccugugucucacaauuggaaaauaaauguguauggcuguuuugccuacauguguacaugaaugugcaucuugugugcaucccuggcacacacaaaagagggguccaguccccuggugguugugagccacuauguggguccugggaacugaagccaggucccugccagagcagucagugcucuuaaccuuugagucaucucucugucuuaauuucugucccuuagugcaacguccaugaccaaggcaacucuuccagaagaaagcauuuauuuggggguuuauuuacacauuuagaagguuaguccaggaacaucauggcagaaaguguggaaggcagcaggcagacauggggcugagagcuuucauccugacgauagugcugaugcaaguuagacagucaauagugaaucauuaaaaauuucuguuguuguuuugagauggggucuuacuguguguuuuaguuaggguuaggucaugcaacaaaacagcaugaccaaaagcagguugggaaggaaagggcuuauucaguuuacacuucuacauugcuguucaucauugaaggaagacaggacaggaacucaaccagggcugaagccugaaggcaggagcugaugccgaggccauggaggggugcugcuuacuggcuugcucagcauggcuugcucagccugcuuucuuucuuucuuucuuucuuucuuuuuuuuaaaaaagauuuauuuauuauauguaaguacacuguagcugucuucagacacaccagaagagggcaucagaucucauuacagaugguugugagccaccaugugguugcugggauaugaacucaggaccucuggaagagcaaucagugcucuuaaccgcugagccaucucuccagcccucagccugcuuucuuauagaacccaggaccaccaggccagggaugguaccacccacaaugggcuagcccuuccuacauuggucacuaaucaagaaaaggacccuauagcccaauauaauggaggcauuuucucaaccgaguuucccuccuuucaaacaauucuaguuugugucaaauuugcauaaacuagucagcacacuauguaauguguaauggugaacugggaacucccuguguagaccaggcuggccuugaauuccuagacagccaccugccucugcuucccaggugcuaagaauaaaggugaacaccaccaugucagccaugaaaggacugacaacaugacucagcaauugcugggcagccugaguuuuaucccugggacuagaaagagaacuggcugcuucaaguuggccugugaucuccacacacuuuccaugguacacacaucaccacccccacuccugauacacauauaaggaaacaaacaaauggaauaauuuugaaugggguuaguaaaaagacgacucggaugugguggugcaugccuguaauacuaccacuuggaaaauagagacagaaaggucaggaguucaaagccagccugagauaugugagagccuagcucaaaacaaaacaaaacaaaaaaagaauccccgagggcuagagggauggcucagcaguuaagagcacugacugcucucuuccagagguucugaguucaauucccagcaaccacaugguggcucacaaccaucuguaaugagaucugaugcccucuucugguguaucugaagacagcuacaguguacucacauacauaaaauaaauaaauaaauaaucuuuaaaaaagaaaaaagaauacccaacauaaaauuaaauagaaaaaggggaaauauagcugggugucaugugcaaacuuguaaguccuaacauuacaaggcaaaggcaaaaggguuggcaugaguuugaggucaucucaggguaccuaucaagucuacaggcgacagggcuaccuacugagaaccuguuucaaaaccaggaaaucaaaaaguaacauguaaaucacagacaaauaagguuacaagaggggauguccuguacgguuacucugaagacccgagaagaugcuauagagguccaaaguaaacaaggacaugugauaacgggaaagagggagaagccaaacaaacagccuagaaaaacugucccaguucaugugacacuaggaagagccaggguaggaagucuggaaggauucucagagguacaacuccaggaagacacaacuaaguucagaagccucaugggaaccagguagugugguugguccuacauaauuugaggggcugagagcaugccacaaguugaaguuauucuggaccauagagugaaaccauagucugaaaaaaaaaauggugggcaaugcgugaaacggguggguuaggagagcaccaggauagaagaggcuggagaauggcugacagcgucuucccuugucuuaggcaugacccguuccaaggagacuuuggguuggccugccacugcuguauucuaaaagcacuucauccugacaucaguucuuaaguuucccaacacaguguaagucuggaauauucaugggcugcucaccaagugaagaacgauuacaaaguaacuucugaauagagacugugacucagccagucucaccucacuccacucucggacuuucaaggguccacguaaauccugccaacacagcaugccagucacugcucagucucagccacaccucagauucacguugaugacaaaguguaagucuggcaggaugggucacaugcacgcucugcuucuuccugccagcaaccucauggccaaggccuuccugcccugucugccuacuuugguauuaaaagcagccacaccccaguaggagagcacaucccaccagcuggcugcggggagggagacgugagugacaacccacuggacuuugccaggaagggaaagggcaggugcuggccaagaaguguugcaauucaggaaauuucuggccuugggcaagcugccgacaucccuugcugugcaguagccuggcuucuaguuuguuuaacucuuacuggaaacaaacaugugacgagugacccaguucuuucccaguggaauuucuuuccucggugugcccucggaggauucuugacaacuaaaagucaccacucacugccccuuuagcuucacuuugacuuuaaauuucaaauauguaauuucaagauuccaguuuggguguagucucucucucacucucuccuccccucacucuuuuucccuccuuccuguuuuucuuuuuaagaagaguuggcauuuauugagaaacguagcuaaccauuguaccacaugccuguaauuccaauacucaggaggaaggucagggauucaacaucacuaucugcuacgaaggccagccuggacaaccugaggaggugggggggggggggggggagaaggagaaggaggaggagaggaagagaaaggaggaggaggaaauaaaaaaaguggggaggggggaagacaccaaacaaacacaaacucaaaaaaccagagugagauggauuagcagguaagggugccugccuuagucaggguuuguauuccugcacaaaacaucaugaccaagaaacauguuggggaggaaaggguuuauucaacuuauacuuccacauugcuguucaccaaagaaauccaggacaggaacucacacagggcaggagcugaugcagaggccauggaggggugcugcuuacuggcuugcugucccuggcuugcucaguucuagaacuaccagcccagggauggcaccacaggggguuaggcccuccuccuugaucacuaauugagaaaaugccuuacagcuggaucucauggaggccuuuccccaagggaggcuccuuucugagauaacuccuguuugugucaaguugacacacaaagccagccaguacacccccacacacacccacacacacaaacacacacacacacacacacacacacaccccuacucccuguuuaaaauguuuaaaugaugugguuacaggcuucucaggacugagucaucauucuguugccaguguuguuuuauuugggggaggcagggggauuuuauuguuguuguuuuaaagauuuacuuuuaauuaugugugaaucugaguguggguaugggcagauagauaccuguauagaccagcaaagggugucagauucccuggaacugaaguuagaggcaguuaugagcuguccaaaaagaugcuaagaaccaaacucagguccucuguaagagcagcucaggccccugacuguccuagaguggagagaucagacaggcugagagcagggaacacuacucagaggucuuuggcaaaaagcuuacuaacaucucuucuuucaguaucacuuccacggaaagggaaccauaacuauauuuucucacaaaauguuugucauaaaaaauauggaacaaauuaaauaagaauuuaguaauucuuugggguuuguguuuuauuguuuuguuuugagauugggucucacuacguagcucgggcuggccuugaacuugaaauccuccugccucagccucucagaugcuggaaacacaggugugcagagccauuccuaaagcauaaagauuguauuauuucguguguacacaugcaugugugucugugcguguguguguguguggaggccaggggacauugcuggguaucacuccuugccuuuugccuuuagucaggaucucucuuacguugucugcugcagcauaagccaagcuggcuggccaggcgcugcugggagccuccugccuucaccucucgccucugaaggaaccuugugauucuaagcacuggcugccucggcagcuuuaccuguguucuggggauccaaguccuguuuucacauuugcuucaaaaacuguuacccacaagagccaauucuccggucccaauuauuucuauuuaucgcuccuuuuuuuuuuuuuuuuuuuuuuggcauugcuggggauugaacccuugauguaguaauuauuuaaucucagucggggguuucuaucacaccuuugaucauucaauucccagauaaaagauacaagacuauguauuuacacaaagcuuuuuaaagcacuaaaccugggcagauagcuccccucuaaguucuuaugucuacucccugccaguaacccugagaucugacuagccauguuccaucugggcugcucuuaacuccaguuggccagcccucauggccaugucuucacaacucaccuaaauacccccauggcaucuucuccucuuuccaccuuuccucuuuuccuuucuggucucuccagacccgaagcccaggaacccaaacaccaccuacuucucuucugcccagcuguguucaaccaaaaguuuuaaauuaaggagcaaggucacauagcaguucuugaugugugugagguauuugugcccaaaaguacauaggccuaaaacagugauuucagaaccugguuuaggguagcuuuccucccaggucuguuugagagaagaacacauuaauaacagagcauaggcaagcauucaccgagagcccagcacauaaggcagaggcuggaagaucaaaauaaguuugguuuacauacugaauuccaugucagcuggaacuacaggagcuaggcaugguggcacacaccuuuaaucccaagaaugaggggagagacagguaaaucuucaugaauugaagaccagcugagccaacauagcauguugcaggauagccaggccuguaugagccaggucucaaacauccaaaaccaaacguaccacuaccccucaaaacagaaacaagacaaggggcuggggagaagaccuaguggucaagagcccuagcugcuguugcuaaagaccugaauucaguuuccaguggcacacaacugccugucauggcaguuccaggggaucagugcccucuucuggcuucuuggcaccccaguuucaccccagccucuuaaaaugaggcucgaauccugguuucucacccaacuuccagccugugcuuaaagugcacacacucagcgaugcacagaacagcagccaucuggagcuacuacccuggacaagagguaaacucccuacagcaugagagagggauggucuugggugaugggggaagauuugguacccuaacaaagggaugggguggcaaaagucacuaggaagcuagucagaugugagcaggcuuggaggaugcuggggcagggccucucaauggucagcagucuaugaaagaaaagguuacuagggaauggucagaaaaucugggucaucuucugacuauggauggaaaaguggccuccaaacugacccaaucucccgagcuaccuggaaaauuauuaauagagagccaucugauguccaugaagcucugaaccuuauaagauuguuguguagccagaggccuucugguaaaacccaacacgagucuaugaggggccucucugggcuccuuucuguaaaagccaaacagaccuaucgaucacuuagacucugaccugaaaggaagggguuuguucucaugagaagagaaacuaguacagacucggucugaugugcugguuggggcaguguggucucuuuggacauuguccccugguaucuuugaaaguguacugugugcgcuucucagugggugaccuuagccugucuuccccaccacauucugugucugaguucuuuccagagauuaccagggaccgggggaggggaugggagagagauuccaguaacaaaaucacaucacauauuaucaguaagcacggaggacauauuaaagauguguaaauauaagugcagcuccgugguaccggacuugugugagguccuggcuaucagcccuucccucaccccacccccacggacaaguuaaacucaacaaauccaccucagugccaauguuugcaugggacaaagaaaacaggcaaggaaggucaaccugcucuccgguguccuggaagaacccagucuucggccucaggggagugacucaguaaauagacaguacagcuuuuguccucagaagcuucuaggcuuucucaggaaugcuaaggaaaggacuguagcuacugcauuugauaaugaugggauagggguugcauuacugcucaacaugacuacuuaagugucuugugcccaaggccaaagagauaggcuggcucagugguuaagagcauuugccgcucuucuagagaauuugagcuugauucuagaaccuauaucaggaguaaaauauaaaaauaagaucuuuaaaaaaaaaaaguguccugguaccaugaaugccauguuuaacccagcagaucucaagugugcuauaguguucaguacacaugaaguuuuagugagugaacauuuauaaaaugguagugcgugucuuuaaucccaguacucagaacacggaggaaggcagcucucugagaauucaagggcagcuggcuccaucuacagagcaaauuccaagcuagucuacccagagcuacacagugagaucuuuucucaaaacaaaaggaaugaagaaggaagggaugaaggaaggaaggaaggaaggaaggaaggaaggaaggaaggaaggaaggaaggaaggaaggacggacugauucauucauuccaugguucuuacugaacguguaggaaauaccugcauguacuuucucuccauuacccccuuaauuaacuuuuaucauguaaggcugguucccccaaaauauugaaacagaaaauacaugggaagcuuuuuuuauuuguuuuggagacuauuuguuuacuuuaccauccuaugaccaccgugugcccuguguauauaugccuggugcccacagaguucagaagagggcaucggacccccuggaacuggaaugucagauaguugugagccuccauguggaugcugagaacuggaccugaacccagguccucugcaagaacagcagaugcucuaaaccauuaagccaucucuccaaacuuaccccacccccacccaaacccuuuuaaagacauuuacuuguuugcuuuuauuuucuuucuuuccuuuuauccuuucuuuuucuuagaaaaaggcucacuauguauguuuggcuagaauagaacucacccuguuacccagacuagcuuugaacucaugagcaaucuuccuuaucucaacuucucaagaguuaagauuguuuuuaaaauugacacagagucucauauaauccaggcaggacuugaucucacuaggagacuaaggauggccuugaauuccuggucuucuuaccaaauauugagauuauacauguuggcuacuuggucaagaucuugaaauauauuuuaaaauuuguuuuuaaauuuacuuuuaucauuuuaauuauguauaugugugugugccugcauacuccugaggugggugucuaaggaggccgacaaugccaaguaccccuagaacuugagucacaaccacuugugggcugcuugaugugggugcuaggagcugaacuugaguuuucuuuauuuucuccuaugaauaugagggguuugccuaaauguaugucugugcacccugugcgugucuggugccagcagagaccaaaagagagugucagauccccuggaacccugggugaggacgguugugagcugccauguggacucagggaauggacccaggucuucucaagagccgucaaggcucuucagaacuucugagcugccucuucaucccucagucuuuguuguuguuguuguuguuuuguuuuguuuuguuuugaagaacuacaacuguucuuaaccacugagccaccgcuccaguuucuuugaguauauuuuuaaauaaagcauuuaaaauaccacauuuuuccaccaguggggauuaacuaaagcaacaaagcauccuaaagaauguauuauauugugguuccauuuucuauuucgucccucgggguguccaggcacugcuguauaccagguagggaggauggagccagaaugggugggacugggggagaaauagucuucccugaagauuucagugugacagauuuucaguguuauagcuucuuuagaaaacagcucucuuagacaauagucaacgaaacagcuuguguucauacacuuacucggggugaaacucugccugcucugccgugguugccuuucccuggagcucagcugaauugacuugacguggaaaacaguggacaaucuuagcuuagaaucaacacaaucguuggguguggaaucuagcauccuaaauucaccaaguauucuauguuagaaaucuucagguggcagauccugguggauucugcuaccugaacuaauagccucccacccucaccuuacaucuugguugccuuguuccugcagcugaaaaggaagucuccuccuccugccuucccauuuccucucuuggaucuggaaggcccagcgauuggcuucuugucgucuuuauuauuuaaucaauuaggaggaaauuccucuacaccuacccuagcaacagucaguucugccucggucuggccucuccaggccuucugcgcagccuuuacacuaagaucaccucucaaugucuuacccauaauucuuuucacucauuuccugagagaagcaucauccuuucucuuucaggguuggccucugcaaagaauagcuuccuaagacaacugacugagagcaacguucuuaggcuuuacguucuagaaaaaguuugauucugcccuuacgcuugguaguuugggagaagcacucuucuauguugguacccacuucccuuuggaaugccgaagucauuuuuguauugucuucuaacuuccaaguucugugaugauacuacccagguuuuaaugcuucaugugagaccuguuucucucugaaaggguuuuaauguucaucucuuuucugaacauuauguuucuugguauaggaauauuuccaacuagugugcucacaauuugugugccuucagccuagagauucauguuccucacccacuacacucuugauacgcugagauaauucauuagagcucauuacagcuaggaucuugaauguccccccagagaccuguguguugaaggauugguccucagccuauggugcuauugggaaguggaaucucuagggguagggcccuagucgaaagaaggcagauuaugggggcaagcucuuaaggugguaauguccccccccccuccggcuucugcugacauguauucuugcucugaugcuuugugccaccauaggugaccagggacugaaaccaugagccaaaugaaccuuucuucuguacaggaguguuuucucugagcauguuuugucaccaugacaagaguuaacacaaaggagcuccugcugcuguuuccaugccuuacaauuccuuuuguuacuauucagccuucagugacccagcugggcaugguagaguauaccuauaaugacagcaguugggaggcugaggcaggaggaucaugaguuugaggccagcuuggacuauauagugaauucuaggccagcuggggcuucauaaagagaccugucuuuuaaaaaaugagaagagagagagagagagacagagacacagacacagacacagacagauggacucugauuauagacuuuguauaaaaaguaugaauuguuaaccuagugggagccacaaaagaaugaauaauuugacuaggcuuagagaaccaggacauugugacucagagaacuuuauaguuaaagaacaggagaaguaaaggaaauauagucagguaugguggugugccagaaugccagcacuuggagggcugacacuggaggauuaaacauuccagggucagccugagcuagacuguuucaaaaaccauaggucgguauagagaucugauaguagugagaucucauaucaaacaagaaaauauuagcaucaauauuuaaaucaaucacguuguacaccugcacauauuaagaauaacuguaacacacuaacuuacuaguuaagcuaagcucuagcuguucucuccugaaucucagugauaauuacaucauuuuagauacugcauuuguagcacugagucaucaccaauacugaaacuugacuuggcagaaugccgacaugagcaguuccuucggggucccuugaaggaggcuucauuuggucuuuagcucuauaagacacuuuguuggucucucuuuggguucaguuggacuuacguuguuguuuaagacagggucucauauacccaggcugguauugaacucauuacgaagccaaggaugaccuagaacucgugauucuccugcuugcuuuuaucucccaaguggcuaggcaugugccacaauacccagcucuuguggguuuuuuuuuaaaugauacaacagaaaauuuauuaauuuacuaguuuauguuuuacuuauugcaauuggugggggaggggucuucaugucaugcugcaacuguguaggucagagagcaacuugguggcauggcuugucuccuaccuuuacaugcuaugccagggauugaacucaaguuguuaggguugcagcagcaggcagcagguaccuucgaccaccaagccaucucgcuggcccugguuuuguuuucugaguuacuuuucuccaagguuuagguaauggggagaaacgauugaacugaauauucuaauaccaggaaaauaaaguugcuucauuuuaauuucuuucuguggcaggagagauugaguccaggcaacuacuuuacuacuuaaaucagugguucucaaccucccuaaugcuucagucccuuaauacaauuccucauguugugguuaccccagccauaaaguuauuuuuguugcuacuucauaacuguaauuuugauaguuaugaacugaauguaaauauguuuuccagugaucuuuggugaccccugugaaagggccauuugacacgugugcacaugcgugcauacacacacacacacacacacacaccaaagggguugcuacccauagguugaaugccgcugacucaaauccucagucaugguuucauacguuugaaacagguucuccuagaguacaagcuggcuguaaacuugcugcucgcucagacugacuaaaaccucuugacagaaaguucagguguccaguaguuguucaguccacaaggcuggaugucuccguuggcccucaguguaugcuggaaucuuaagaagucggcuccagugccagcgaaggaauggacuugcuagcaaggugagagcaagcaggcagaaagcagaggcuucucccuccuuggcuacucuugguugucaacuugacuucaucuggaaggaacuaaacugcaagacuggaggcgccccugugagggaucuagccuagcguuucuucuugcucuucuucaucagcuguggcuacguacucuccucacggguugcugaaucaaauucaauucacagggcggaagacuugcuugcugaguuuuauuuccgcuuuuuggaaauggugucauucuuuagcacugucugacuuggaaccuuaugugcagaucggcuuagucucaaacuuucagggcaucuccuggcuuugccuccaaaggacuacacgaaguccccacagcugacuaucaaagaugggaauuaaaggcuuuguaagcucuuuuccaguuuuggauucccauucauccaacggacaugaucaccuaccaugaacuguuacaaacauaaaaaucagucaagucuacagagauaaagcccagcaauuaaucaugaugaaauauauauaaaguuaucacucuguauaguuagguauuacucuguauagucagcaugaucaaccuugcuaucaguaauuaaauauuuuaggcaccauuugcuacuaccuagcuuaagaguuauugggaacagcccuauaagacuaagagagaguaaggcuguggcuuccuaaaauugucaaucaacugucaucuagggaugauggcucggaccccuaaugccagcauuugggaaguggagacaguaggaucaagaguucaaggucauacguggcuauauaguaagcuccaagcuaguuaggcccucgaagaaauaagaugaaaacaaacccaauaacgaaguaugacagacaacacaguugauaaccaucagagcugugcuuugugguguuuauuuuuguuguuguuuuggaucuuuucaagacacuauguagaucuagauguuccauucacugcuguucagacuggccucgaguucucagagaugcacuugccgcugucuccugaguacugggauuaaagucaugugccaccaagccaucugugcuucuaagggaggaagugccuaucucagcacugaggccagccuuuccagcaugauggcucacacuuuuaagcccaccaacaggaaggcaaaggcaggaagaucuccaugaguucaaggcuagucugguuucugguuuacauugugaauuccaggccagggaagacuauauagcaagacccuguguaagauuaaaaacauuuguuuuuuacuuauuguuacuagacauuuugaggagucaccuuugggugucacacacuaccagggaaauugaagcucucacucaggguucuuagucucacuaauaagguaguuuagaacagaagcucaaggaguuuauuaguuuuguuuuuuucccaagacuguaaggcaggcaugguguaaaucucagcagcugucuggagagaaaagauggagaagagggagagaaaaacgucuuuuuguaaggggccacaaggagaaagggguuagacagcuucagaggaaagugaacaaucccagagugcccgggaaagcauuccggaguccagaaucugaaaguaaaagagaugaaaaggaaguuaccaaaaggucauuuuucuacucuggcaagugguggguuccaaacuuugacuaggagauagcugucucuugaugagccucaacagagucccgaucaagggaacugcaugcaacgacuaccacuucagaagugcucacccugacaucauuuacaagaagggcugaaaucgcccggcuugguagcgcaugccuuuaaucccagcacuugggaggcagaggcaggcggauuuuugaguuugaggccagccuggucuacaaagugaguuccaggacagccagggcuauacagagaaacccugucucaaaaaaaaaaaaaaaaaaaaaaggucugaacugaaaucaggaauggauauuccugacuuucaccaucaucuguucacuaucaaagaaucaauguacugggaguggcuguguagaaagaaguaagaugucagggcucccuucugggaucucuagccugagaacaaagacauucccuacugcuggccaaagacaauggaacuauucccugccucuaaccuccuagcucauucccaucuucuguucuccucacagugugugugugucuauguguguguguguguguguguguguguguaguggaagcagguuugcggcagaauguguuuggaagucagagggccacuuugugguuuuggcugucuuucauuuuuagguggcuuacagggaugggacucaggcugcuaggcuuauauagcaagcauuuuaauuacucacugauccaucuagaugcccugcucuuuuuauuaugaggcagagucucauuaaauucccuacacuagaaauuucccauccucuacuucugccucuccaggagcuaguguuacaggucuugaccuugccauaccuagaccagaguucagauucuucuguuaauuuuuuaaugauuugugucuaauucuuuagucucuuguaugccuuacuguaaaaugauuaaaaaaaaauuauuggacaauggugacaugggccuuuaaucccagcacuagggaggcagagacugguguaucucuguguucgaggccagccuggucuacagaucgaguacagaguacagccugggcuacacaaagaguaacgccaucucgaagaaagaaaaaagaggaaacuaaauaaauaaagccccaaucauuaaagaaguauguuucaaacaagaugaauuacagaaauugguucugagguccuauuugguaacuggugucuacaguucuuuucuguauuaaacugugaguagagaauucuguuaacccaguuagcuagcaacuguagcagagcuguuuucucugggugggacaaaggccaauugguuggcagcagcaucaaguuucaggggcaaugugagaucucaagagacucccagagaucuuuagcuauaaaggcaguaaaaaauuaaaggcccauuuucggcauuauagaguacuucugaugagcugaagaauccuucaguaaacccuuuuuuauuuucaccaccaggguuaauuggcagcgucggaaaaccgaaugagaaaccacauagccaaauuucacuguagguuaaauggaggcagaucuucaccagugcuguaaauccuuagugaaauaaauccuuaguguucuccgaaaucucuuaaaauuuuuauguagggcugaaaucgaaaaccuacaaagcaguccuuucuggaggucagaagcuuccuaguuccuccaccgccucucuccuccuccuccccugccccacccccaggcuaccccaaaggaucgcugccagggaggugaggcagaagucgaacuucauuguucacgggacacucucgguaagagcccguugggcgcgccugcgcaacgugcgcucuuugugaagggcugcagcaggcugcuuguuugugucuugccucggggcgcggaggcgggaccgagggaguggccuggcaggcgcacgcggauugggccgccgcagggaggugggcgggcacggggcggggccucggguaacaacacuggccgcgguggccagcgcuauuuguugcugcgccgccucgcccgagucaugguccuugcuccgaaccuuccagcagcagccuccgccgccgccccgugacuccugcuccccgccuuucugccgaguccccgcgccaugaccgucgucuccgucccacagcgagaucucgcucugagcggccgcuuagcgccgcucggguuccucggggcccucccgauggugaacccggccccgccgcccuugccgcgccuuccggacccgcgcgcgcugccacccacccucuuccugccgcacuuccucgggggggacgggccgugccuggcgcccgcgccucgcaccaccgcgccguccggcugcaccuuggccccggcggcugccccgcgggcggcgcccaagaagcggcggaagaaaaaggugcgggccagcccggccgggcagcugcccagccgcuuccaccaguuccagcagcaccggccgagccuggaggguggucgcagcccggcgccggggccaaucgucgcgcaggaggagcgaggucuggcggccacugcccugcuccacagacagcccccacucgcgaaggagguagggccggugggggcggggcggcuguuuacucgggagggaaguuuccgugacgcucgcucgagugguggggcggaagcgggaggggggcugggcggcugcgcuggcgccgcccauuggcuccggagccagccaaugggagcggcggcuacggcccagcaacagccugcauuuagaagcuuggcggcgcuccaggggguuucggcguucggggcucagggaccugcggagggcugacgucagcccgcuacgugcagcgcucuggggcgcucaugaaggcggugcugggugggggcggaggcgcaggcgcaggcgcggugcccaguggggcaccgggcgggcgggacccacgcacagccagauccgcugagucggacugcuguugggaaguuggcaggagucuccgucugaugcccgacgcgaaggugucccgggcccugugcaggccggcacgagcuugccucgcuggagggggcuucuaagcagcgcccugaaugaguuuuuagaaguuauaaaauggacuccucgguuaacggaucuggauaacugggauacaguuuugucgaggcuaaaggauuugagaguugucuuagcaugaaaaacaaaagccgaaaccaccuuuuucauacagcuugaagaauucuuuguugguagugacacgaaaagcagccauuguacugaaauuguacuugaucaagaugugcccaugaagaggaauaagaauuuagauccugaagugguuuuuuguuugguuugguuugguuuuuaguuuuucagacaggcacuugcauuagcuuagaacucacuguacauuggagaagauucuauuuuucagaggcaguuuugaacgggaaagacaguaugaccuuguacuugggucucaguuuuuguguccuuacuauaucaugcaagcaucagaggggcagugaucuaaggguguuuucauuuggugcacauuucuguagauuaugcugggaaaguuacuacagugcaaaaguuuguggccuguuaggauucgggcuguagccccggcuggccuggaauuuaccuuucugcuucugccuuacagaccuuuuggcugagcuuagaaggucguccaugaaguugcugaaucugaaaggcagacgggaacuuuuuuucuaaccuauagaggacacuuguuccuuacuguuguuuacaguuagaaaagauggacauugaguuuuuuuuaagugauauuuuucugaauguaaguuugauauaugcuauaauuaacagcaucaauucaauagcaacauaagaggcgugcacauuugaacauccaguaguaagcacaucccacacauaacguauuuauuuaaaaccggauuaaauucuagaggacuuuaaaagcaaguuuguaaaauauauguaaagauaacuuuuaucuugaaaauugcucacuuuuguguuccuuuguagguuuuaaaaucaaagaugggaaaaucggagaaaauugcccuuccccacagccagcuugugcaugguauacacuugugugaacaaccaaagauaaacagacagaaaagcaaauacaacuugccacuaaccaagaucaccucugcaaaaaggaaugaaagugacuuuuggcaggauucugcuuccuccgaucgaaugcagaagcaggaaaaaaagucuuuuaaaaauacugagaacauuaaaaguaaccauuugaagaaaucagcauuucuaacagaagugagccaaaaggaaaauuacgccggagcaaaguucagugacccaccuuccccuaguguccucccaaagccuccgagucacuggaugggaaguaccgccgagaaccccagccagagccgggagcugauggcagugcacuugaaaacgcuccucaaggugcagaccuaggcuugcgucugcagugugugguaaacaucgauuuccccagaccuuuggacucgaaaggaaacggauacagcagugaaaacuugcccuguugcagcauccgacacaaugagcuuaagucacacaagcagcuuguauuauauuuuauauuuuguaaauacuguauaccauguauuauguguacauuguucauacuugagaggacauuauaguuuuguuaugaaaguauguauuuugcccugcagcuguggugguguuuuguauauauacaguggagauagucuaagugggugcuaaggcacauggaagacuguuuauuugcacagguaccgaaauuuuuuuaagaacagcugucaaaucucaaaagugaagauguaacugugaacaauuuccuuauguacuacugaaggugaaauucggcacaaucacuguaaucauggagucuguguugcucuaaauugacaacuugacuuuuaaucugcaauuccuagaaagcuucccguuuuuaccaaacuucauuucuggauauugguauauugccauuauggagauuuaaaacaccucuaauuuuaaauaccaacaaaauugguuguaaucaaauuuuaaaucaauaauaauaauuuggccuccccccuuuuaagguagucuuggcuuuuugugugugccugcugucugaaugaguguguaagcaggugacugugucauuggacuuggaacauuuguugucuucgugucuuugacuaugcuaaaauaacaaccuugcuacaaaauuuaauaacuuaaccuaccucugagagaaagaauuucccaucuuggaaauagaaaugugaacaaaagugaagcugguuguuauaaauaugaaaauuaauuaugacaguaucuugagcucacucagcucuggaguugaaauaaccuagaacuucugcuuucgcuccaguguggggguuacugguguacaccaccaccccggggcaucagagguacuggggaucaaacagggcucugggcaugcuaggcaagcaagcacugugccaguagacuguaucucuagcucuagaauacacaauuccucauuuuuau

SEQ ID NO: 1818 - RNA, 6237 nt, Mus musculus
cguggucgaauccacugucuccuguuaugugagauacguuucgacccggagcuccgccauuaaaaaaccucuuguuguuacaucaagguguuguguucuauucgugauucuugggugcacgccgaaucgggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccaccuguguuaccaguuuugguauucuguauucuggcagcugccacugcggaccguaaggacccuaguggcugugggaagacgacggucuauuuccccacaggcugcacccuuggaagacauuccgagggagacccuggagugcccgggguacggaacagucaggaggaccuggcuguugucuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuagacggacguuugggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaagggccagggucgcauccagaccaacaaccguacaucaugguaugggaggacuuggcacgcuacccacccccguggguucgcccauuccucccgccucuccgcccuggcaccaagauucuagccauccgagaaaauggugaaaaagagaaaccgaaaccaccgcucgggagagaugaugaucgcagcacaccagugacgaaaccccccaagaucuauccagagauuaaagaacccccugaguggcccgacaccccucaacccccaccauaugcuccccagccccaaccuuuagcucccucgggaccccugccucaggccccggccggaggagggggucccuccacaggaacaaggagucggcgaggagucaccccugaggggccugcggauucaaccguggcgcucccccucagggcuauuggggcucccccugccgauccaaauagucuacagccccuacaguauuggccuuuuuccucuucugaccuuuauaacuggaaagcuaaucaccccccuuuuucagaaaacccugcaagacucacuggguugguugaaucauuaauguauucacaccagccgaccugggaugacugccagcagcuucugcagauucuauucacaaccgaggagagagagaggauucuccucgaggcucggaaaaacguccgagacgaggcugggcgcccuguccaaacuccagcugagauagaugaaggauuuccgcuaacccagccccgaugggauuauaauacggcaucagguagggaacgacuguccaauuauugccggguccuaguggcgggucucagaggugcugcccggcagcccacaaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguaagagaggcagagaaaguguaucauaggagagaaacagaagaugaaaaguuagagagagagaaaagagagaaaagagaagaggaggauaggagagacaggaggcaagaaaagguuuugacuaggauccuggccgcaguaggagaaagagauaauggaagaagagguagacagucagggaaccugggagacaaaaggcagcagggaccaaggagauccagagaaggcgggcagcgucuggagaggaaccaaugcgcguauugcaaggaaaugggccacuggaagagcgacuguccgaaaaaaaaaaacaagagguaaaggugcuuucucuuggggaagaugaagacuagggggaacggggcucggcuccccuccccgagccuaggguaacuuuagaaguggaggggaccccuguggacuuucuaguugacacgggagcugaauuuucaguacucaaaacaccucuaggaaaaguaaagaaaaaugaaaaaaccuuggugaucggggccacgggacaaaaaucguauccauggaccacaucccgaguaguagacauagggcgaaaucgaguaacucauucgauucuagucauuccagaguguccuaugccuuuauuggggagagacuuacuaaccaaguuaaaagcacaaauaacuuucaccucucaucgaccggauguuuucuggggaauaaaagcgccccagacucuagagcugucuuuacaacuaggagaggaauaucgacuuuaccaaaauaaaguaaagcccccugagggauuacaggacugguugaaucgauacccucaggcgugggcagagacgggaggaguggggauggcaaaacugguccccccuguggugauugaacuuaaguccggggccaccccuauagggguccgacgauaucccaugagcagagaagcucaagaggguauacgcccccaaaucaacgaacugcuccaacaagggauuuuggucccaugcaaauccccuuggaacacuccucuacuuccaguaaaaaaaccaggaaccagggacuaccguccaguacaggaccuuagagaagucaacaagagaguucaggacauacaccccacggugccaaauccuuauaaccuccucagcaccuugccaccuggucggacaugguacacaguccuggaucucaaagacgcuuuuuucuguuugagguuacaccccaacagccagcccuuguucgcuuucgaauggcgagacuccgagaguggacaagccggacagcucacauggacgaggcugccucagggauucaagaacucgcccacuuuguucgaugaagcccuacaccgagaucuugcucuuuuccgagccaauaacccacaggugacucuucugcaauauguagaugaccugcuccuagcuacagaaacacgcgaggaccgugaaauugggacccaaaaccuccugggcgaguuagguaagcugggguaucgggccucugcuaaaaaggcucaguuaugccagauagaagugaccuaccuaggauaugucuugagagauggacaacgguggcucacagaagccagaaaacaagcuguuaugcagaucccgaccccaaccacugcucgccagguaagagaguuccuggggaccgccggguuuugcagacucuggauucccggauuugccacacuggcagcucccuuguauccacuaaccaaagagaaaggggaauucaccuggaucagagaacaucagcuagccuuugaaacucucaaaaaggcacugcugcaggcuccggcauuggcccugccagauuuaaacaaaccuuucacccuauacauugauaaaagaaauggaguggcaaggggaguccuuacccagguuuugggaccauggaagugcccgguagccuacuuaucaaagaaacuggacgcuguggccaguggacggcccuccugccugcgagcgauagcagccacggcugugcuaguaagagaugcugacaaacugacuaugggccagaauguuacuauaguggccccacacucucuugagagcaucaucaggcaaccaccggaccgcuggaugaccaacgcccgaaugacacacuaccagagucuauugcugacagagcgaguaaguuuuacacccccagccauucucaaccccgccuccuuacuaccugaagcugacaaggccccugcacauaagugugaagaaauacuggcagaagagacuggaauccggccagaccucacagaccaaccuuggccaggggcgaugacuugguucacggacggaagcagcuuugugguagaagguaagcggaaggcuggggcggcaguaguggaugaaaaggcugucauaugggccagcagucugccggaggguacaucagcucaaaaagcggaacuaaucgcauuaauucaagccuuaaggcuggcagaaggaagggcucuuaaagucuauaccgacagccgguacgcuuuugccacggcucauguucacggagcaauauaccaacaccguggacugcugaagucugccggcaaagauaucaaaaauaaagaagaaauucucagcuuauuagaagcuguucauuugccccguaggguggcaauuauccauugcccaggacaccagaagggaacugggcccguugaaaagggaaaucaaauggcagaccaagaagcuaaaaaagcagcccaagggccaaugacucugguggugagaacccaacagcccgcugcugaggaaauaaauaaaagaacccucacagaagaagaggggcgagauuacuuagcuaacauacaccaucugacucauuuaggaacuaaaaaauuacuaaaauugguuaguaagucccccuauuacauuccuggauuaaaaggaauuguggaagagauaguaaaaaacugccgugcuugugcacuuaccaacgcugggucuagcaggcuccaggaaggaaaacgacugcgaggagacagaccuggagccuacuaggaaacugacuucacugagguaaaaccggcuagguauggaaauaaauaucuccuaguuuuuauagacaccuuuucaggaugggucgaagcguuucccaccaagaaagaaacggcuaauguaguggucaagaagauacuugaagaaauccuuccccgcuuugggauaccuaagguaauggggucagacaacggaccugccuucgucucccagguaagucagggauuggccagacaacuggggacaaauuggaaauuacauugugcauacagaccccagaguucaggacagguagaaaggaugaacagaacgcuaaaggagacucugacuaaaauagccuuagaauccggcggaagcgauuggacagccguucucccuuaugccuuguucaggguucggaauacaccuggaccccuuggccuaacuccauuuaaauuaauguauggggcgcccccacccauuuuuaugaccguaggggauaagaaucgcccggaugugucuuucucuccuucuucuagucuuuugguucgauuaaaagcucucaaaauaguaagaaaagaggucugggaacagcuaaaagaaaccuauguugcuggugacacacaggugccgcaucaguuugaaguaggagacgcaguccuggugaggagacaccgagcgggaaaccuagaaccgagguggaagggacccuacuuggugcuacugacaacgcccaccgcggucaaaguggaaggaauccccacuuggguccacgcaucccacgucaagagagcacccccuggagucagccaugaugaguggacuuuggagaagacuacuaauccuuuuaaguugcgccugcuucguaggagcgaucccaaaagacuucaacccccacaguccuguucaacaaacgugggagguacucaaugagggggguagggcuguauggacaaucgccgagguacacccucuguggacuugguggccugaucuuuucccugacaucuguaaguuggcuauaggagccccuccuggaugggacuuggagggguacucugacauucagagggcaccuuuaacacccccuccguacguagaaaaacauucgagagacccauggggugguugcucuaaccaaagggauagaaggaugcuucgaacccaucccuucuaugucugccccgggccccaccgaagucagucccucaauccaacguguggagguaaggcugacuucuuuuguaagagcugggguugcgagacuucagguacagcccgcugaaagcccuccucgagcugggacuauauuagaguaaca

SEQ ID NO: 1819 - RNA, 794 nt, Mus musculus
cacccuuccucucuccuugguagaaauugcuggacgcuucuguacguuucgcaguuugucuucgcugaccggugagacuucgagcaguuaggaugccgcguggaagccgaagccgcacuucccgggugacuccuccggucagccgggccccucagaugagggcugcuccccaaagagcaccugcagcucagccuccagcagcagcugcaacaucugcaguuggcucaccugccgcugcgccccggcagccaggccugauggcccagauggcuaccaccgcggccgguguggcugugggcucugcaguggggcacacccugggucacgccaucacugggggcuucagcggagguggcagugcugagcccgcaaagcccgacaucacuuaccaggagccucagggagcccagcugcagaaccagcagucuuuuggaccuugcucucuagagaucaagcaguuucuggagugugcucagaaccagagcgaugucaagcucugugagggcuucaacgaggugcugcggcagugcaggauugcaaaugguuuaauguaaucaagaaauucaagcugaagagaugugacauugguucuguauaauugauaguacaaguguggacccuuauauuucuaacaguucauugcuuuggaauggccauggaugcuuacugaggcuuguauguaguguugguuacugggcaaguguuuggccuccuugggcuguguugugauugugaguuaaaaaaaauaaauugguuauucugaaaaaaaaaaaaaagacuucaaaacccacuuc

SEQ ID NO: 1820 - RNA, 21785 nt, Mus musculus
uguuauugacgccauauuggggccggcggcggguggcagaguuguuccguggagaagagagggucgagugcauugcuuagcucuguacggccgggcuaccucgcagcucccgcgcguggccgccacucacgagcuuccgucugcaccggcgugucggagaucgcgucugggucgcgccacuggccggguccacuuccgaagggagcgggucuccgcgcaggagccccggcgcgcucagcccgagcgcacggcgggggcggcccggccucucgggagcggccccgagccggcggcgcgacccucgcgccucgcccgccugcccugucgcggcuccgccgucccgggccccacacccaccgggcaccucggagggcccguuugcccccguccuucccggccccgcccgagccgagccucggccgcccgccaccauggcgugcggagccacucugaaaaggacucuggauuucgacccgcugcugagccccgcaucuccgaagcggaggcggugcgcgccuuugucggcgccggcuucggcugccgccuccccugccgccgccaccgccgccgccgccgccucggccgcggccgccucgccgcagaaguaucuccggauggagccuucccccuucggcgacgucucuucccggcucaccacaggugggccucggccccggggcugccggggugggcugcggccgggagcuugggugcggacacaaagggaaggaagggccugaaccgagguggggguggugucggcagguuggguggguacgagucggguuggccggcauugugggggucccucauugugaggcagaucauuuggggcuagaucccuagaaucguuuccuuauguagagccccagcggaaaugaucagagagggugauauuauucauaagucaggcgagagaagggucacauuucacccgaaucuccgggucucuugggcugaaucgauugguugcagcuauuaacucagugacugagugguuugaggcgagaaggcagccccuccuccauuuuagacuuggcugguuuuaguauagaaggggugggguuuggagggggauggaugucacuggggcgaguuguaggccugucauuaaucacccacaagaacgccacuuuggcugagucaagaccuguuucccuagcagggucaacaacaaagcaaauguucuucccgaguacuguaaugugaucucacuaugcguccaguccuuaagagauccugaacuuuuaaugaaaaggaagguguacuucaaauugagacugacuaguuuauuuguaaaugcuuuaguuaucccaaugaaguauguugggagaaaacaaccuagccucgagaguaacgaauaaaucaagauuccaguggacuucagacuugaagucuugaaacauuuucucaaagugucugccggauggaccuuugauugcuuuuguauacuaaauguguaccuagggauuuuuuuucccccucugcauuuggaaaucuuugugugccuucggcacaaucuuaggguaaacuuuaauggacuugaaguguaagucuguuucuuuuguguguggcaugcaagagugugugagccuguguguguaagcccuuagugauaucauccuuaaagccuuugcuuagcuuaaauuuuuuuuuucucaguaauucauuuuaaaaagaugggaacuauagaguucuguauuugguaacaucuauaugaaauugacuguaccauguguguuuuuuuaaaugucacauuuaaauauucauacccaaauccauggagaaccucaguuaccuagucuggcucuuaaauuuuugauauaacguagccaaaagcuguuuuaugaguugcagucacuuuucguagaaauuccaagacguuuauuuaaggaucauaccuaagcugcccucccccacauauguguauaaaggcacuccugaccgaguuguuagaggaauggcucucaaucugugggccgcgacccccgggggaacgcuccgauauuugcauuaugauuuauaacaguagcaaaauuacauuaugaaguagcaacaauaaucauaggguugggaucaucacugcaugagguacugugcuaaagggugggcuuaucaggagcgcugagaacccccugcuuuagucauuacuguaaaacaagggaacaaaguggagaauggauuccuuuuuuuuuuuuuuuuuuuuuuuuuuugguuuuucgagacaggguuucucuguguagcccuggcuauccugaaacucacuuugcagaccaggcugcccuugaacucagaaauccaccugucucugccucccaagugcugggauuaaaggcgggcgccaccuccgccgggcuggagaaugaauucuuggggcagacauuuuuuguuuuuaaugaaaugcuaaauuugaacauugaaaugguguccuaucuacuaauggagccauuuuaaaauagcuguaacuagcaauaaauuucauuggagcuagugauaaguuugagaguuacaauauaucccuaugcaguuaaaauaaucuugaauacuaacacagcagggagcuaugacacguuucuuuacuuaagggagguuguucagaaacgguaaugaucucccagucugccaugucagugcuguagugcagaguguuuaagagucuccacaucucaaucaguauacuguaaaauaacugggaguauuuuuagucuuuuagccagcugaucuaguuugaccacaucuugaaaccuaaaaucaaaucagcuggguggugguggggcacgccuuuaaucccagcacuugggaggcagagacaggcggauuucugaguuccaggccagccuggucuacagagugaguucuaggacagccaaggcuacacagagaaacccugucucacaaugagagagagagagagagagagagagagagagagagagagagagagagagagagagggagagggagagggagagggagagggagagggagggagagagggagagagagagagagggagagagagggagagagagggagagagagagagagggagagagagagagggagagagagagagagagagacagagagagagagagagacagagagagagacagagagagagagagacagggagagagagacagggagagagagagacagggagagagagagagacagggagagagagagacagggagagacagagagagagagagagagacagggagagagacagggagagacagagagagagagagagacagggagagagacagggagagacagagagagagagagagacagagagagagagagacagggagagagacagggagagacagagagagagagacagagagagagagagagagaaagagaggagagagaguugccaguugauguuuuuagaguuugcuaaauauuaaguugguauuucaguucauuugaaaauguaaaagauuagcuucuugaaaaaugagggaagauuguuaaaguuuaaauuugcuaaaauguacauauuugcugcuguaauuuuuaaucacacaguaaaugugugguugaaccuuuuuaagcuaaaacuaaugaagaccuagaaguuuauacagaguauguacuauaugcgauuugucuuuaucauuauucuauuucagguacuucauguuuucuucugauaguguucuugaaguggcauauuaguagcuucaagaacuugggcacuguucuaaaugcuguuguuauuuuagacauuccaggaaagugauuccaaacuuaauaugacuacuuuuauuuaaaucaauauuuuucaaacuugaaauuuaauacuaaagaagaggacuaguugauggaagucuagcucacauucuuacccuugagaccugaaacucuuuauuauguuaauuaacagaggcuucuguucuguucuugccccucuucauguauccuaucucaaacaugauuuuuaguguaccugaguuacuaauucauaacuguacucuaagguagguuugucaaccuauggccauguguuuguacagucugggagguaagaauuuuuuuuagcuacauuuuuaaaugucugaaaaagaacaaaaaaugaucauuucaucauguugagaauucaaaaaauucaaaugucagugccaugaaaaauagucauuuggcuacaguugugccugcccuccuuuaaaguuuaaaguccacugcagguuaucuuaguaagcuuguggagagaguguguucccagaauucacauuuauugucuggucuuuuacaaaagaaaaagaaaaaaaaagguauguguacacugguuugguuuaggauuuuaauucaaugaugcuuaaaauaacguuuuaguguaucaaaggaugguggguggugaaugaggguggguugggagagagaagcauuuuaaugagaaugggggaaugaaaguguccaggguauggggguugggggggcuagauccuugacuagccaggaacuccuggcaugcuuuuacaucucgagugcugggauuaaaggcuaugugccacccugcccuauuuuaaguaagauuuuaaggauguauuuuuucuaaguaccuaacucuucccagauccaucuuacccaccuuuuucugcuucucaauuuuguguugucucucucccccuuccuuccuccuaaaauaacuuuaagucccaauuuguguugccuauauauacucauagauuuggggucauccauuagagcauggcugaccuacuaagaguuuuaagaaaauugacuguucuucccucagaugccaucaccuguccucagcuaagaauggggucuuguguauuacuguggaugggcagccacuauugcuguaaauucgugaguguuucagcaugucauguccagaagacacuggcucuuacaguuuuucugccucaaucuacccucuaaauuuguaucucuguauuuauuuauuuauuuagaggguaguucuauaucauguccauauaacacauaguagugagcucaccccuggagcccauaaaugcuccagccauggguuguugccuaggauuacagugucaagcauguauuucugucuuggagcaagcaaaaaucauaaacccaaccagaaagcuggacauuuaccccgugacauuugugccacuauugcacucaugggccuguuauggcaaaccgaucauuuuuguagcucaagagaggucacaauuagauaagccuuguuggaugacuuucauaguagccugccaaacaccugggacuguggaagcuagcuaagaguaccagcuugauccauguccugugacuaugugauggccucagcaauagaauccuaaccaucaagagugggagcgcaaccuaaaacauuaacaguagucuguaucauuuuggaggucucuaggauaccccagacaaacagcuuaagggguuguauuccaaugcuggcacugggcuuuuuacuuggcaaccugaguuauuuuuuaguugucugucugucagucuauuauuauauaaccaaaagauuguccuggcauuuucaagaaagaagauguuuugauauuaagugccauuguuaagagguugccagaacugucagucaaaucuaacacauuguuuucauauuuauacuaugaaucaguggucuugugaguggccuucuguggaugcugacuuugugagucagggaguuaccauuaauguguacauuguagcuugcuugguaccauuaaguuuguuuuaggaacugaguuggaugaagaguuaaauuccauuguaagaacucauuguauuuguuggaaacuuuccauuaaaaaauggaaacuacagcuuaugaauggagaauagauuguucacuagacauugauacaugccuccaaauggagacaccagcugguuuaaaggaaauacaaaugguucuaggcaaacaaaugauaugucuguuggagaaggcaguaucuaacuucagaugccauuuuauugagccagaagugucuuuuaauauuuguggcuauuuagacagcuguuaaauuacuucuagcuucucagugcauuuggcaaauaaauguuuuuaguaguggucuuugugcuauggauuguaaaccugauauuuagaaauguguagcuccaguuaaaauugugcauuuaagaagccuguuaguuggaauugacauguuggcuuagugauaguagaaugcuugucuaaucaccgaucucccuaaauuugauccuaauacugggugggggggggcaagaaaaaagccuuaggcuuauggccauuaaagaacaccccagugcauuauucauuuuagcuuucuaagguggggguggggggggguggaucccugaagccuaacagaaacaagcuaaccucauguagagaugcuucuagcaggucaguuaccaaggaaauggucaucugcuuuugaauggcuuuguucuuuuguuacuuggguauguuuuuccuauuguuaagauaggucaggaaaagagggguaguaauacuuuugaaagguugaaaauaacagauucagggcugauuagauggcucagccaguaaaaauguuuacuaccaagcccaagggcccuugaguuuguucacugggaccuacguggugggaagaaaaaacaacuccaaaagguuucugugacuucaccugugcacuguggcaaguggauuguaacuguggaugcauaaacacagggcagugaugaaguauaaaagaauaauucaaagagucuaguacucacaguguuuuacuauuugaaaagaaacaugacaaaugugaagugagagaaaguggagucugggcuccuugcagaguuguuuggugaacuagaugggaucgggcaugggaacuacacuaguuaaucagaguucuguggucuuuguuguccauguguuuaacaguguccaauacuguugaccuuaauacugcccagugcuauuaaucuaucugcaaaaguuucucugugcauaugugcaaauuugauaaauuuugauuugaugucuuugauaagacuaucaacuuuaaaaagaugaagagaagggaaauacuccagccuauuucaacauuuguggcaucugcagaugacugcucuauacuuugauugcugaauauagcaauuuuagaacucaauuuaucccaacuuucuauacauagcugagagauccacuaagagccuaaaauaggucucugaauauuuagggcaggugugggucaaagcugauaccaacuuuaaaaauggcuucagaauuaauaaacauaguuggcuaauguauuaccacaaagcuuuaaaauguugaauuuauuuguugggauauucacuuggcauuucccaguuucuuagaagugcugcagcuagggaagcaauggaauugcaguucuguaucuuuuuuuagacuguucugugacccuguaguuauaauauuuuaugagcaaaguauuaauucaacugaguuguaacaacuacuacagugaaaaauuuaaacaguguuucuggguacuuaacggguuuuuuuuaaagaacuauuucuguguaugagugcuuaugagugugcauuaacacacauacaguuaaagagggcaucacacacccuagaacuggaguuagggauguuuaugaguagcugcugggaauggaaccucagcccucugcaagagccccaggguauuacuucuuaauguuccuucccucauacuccuccugggugauaaguaagggcuucuagcauuauaauauuuuagauagucuuauuugggggaauuuugccauugucagaaaugugcucacuugucaaauuauuuugguaugugugcacuggccuuuagcauucauuuuuguuaauacaacaccucaagaauuaagaaugaaaauagauuagggaugaguuuaggagaacuguugcucucuuuuuguuacuaauuaauuaauuuauuuauuuauugagacagggucccuacauagcucuuacuauccuugaacucccuauguagauccaauugugcugggguuaggucacaaugcccaaccuuuuuuguuuuuaaaaugagauagugcugggugugguagcacuugcguugacaaaggauggucaccugaguuugaggcuagcuuggaaugcauauugagauccugcuucaaguacugugagcagcacaaaacuaccuuagccacugaauaaaauguagucgaauucucaacuauuaucccagucccuaaaugauguuaucugguagaacuuuucuaagugauguaauuggaaguauagauaauagaagcuaugacaggacagaguaaauggguguugacuguaccaaccuucagugacuuagugugaaauaguacauuacugguauugugaugugcagcaacacuuucauacugguuuagauuaauaccuuaaaacagcaacagaacacucccuugaacauagaugccuaucuuaagacuguuaguguggugggaacuuaagucagucuggauaaaaguaguguagaauauugguguggaaaauuugggaggaggucuuuaugagcuucaaaguuguuuaccuccugaacugaaauauaucagaccaauuuagugguuuucaacuugugcugccaggaucuugugcaagucagaucacuugacuacauaacauuguuaacuaugugcuguugguauuagaacauuugaggacaaguauagcuugggugacuuaguugcauccuagcagauacacaacaguauaggcaaugacauuaggaauucuugaauucuuuaguugacaguaugaaguguuggcaagacagguguagcugguaauaaugugaaaugguaaggaacacucuggaaaacugugguacuuucuuuacuguuaccaaacagagcugagaauggccucagacuagaacuuggauuuaguaguuucauuggaaacagucugaaaggccaauacaggaacuggagaaaugaauuaucaccagccaacaauaagaagaaacugauagaugcagugugcacgaauuccaagcaugucuaguacagugaagacaaaaaguuacuguccuauacugcuugggaaugaugacaggaaaaaaauguauuugucauagcaugguacaauuaaaaaauguuugcacuguuuguguuugugaaguccacuuauacaggaggcuaaauguagugauaccaugugaguauuggcuucuugaagacuggagagacaaagguaggugugugugugauauaaagagacauaagaguagugaaaguugugguuuuauauuacauuucacuugauaaaucauaacuuaaaaauauacuauacuguuguguaucugcuaggauguaacuaagucaccuaagcuauacuugucuucaauuuuuugguuugccuguggagacuggcuuacuguguauccuggaacucacuggguagacugccuuuuucacacaagugcugggaauaaagguuuugcaccacuaugcuguguuggauuggggcuuaaaguaaauaguuuuacugaauuuuagucuuggcuuuguuucaagcauucucuuuaugguacaguuuaguuuggccuucauuaauuucguaguaaaguuuagaacuagauacagugauucucaaccuuuagguggugacccauuugggggcugggucacauaccagauaucucacauaucagguauuuacauuccaauuaaugacaggagcagaauuacaguuauguaguaguaacaaaauaaucuuaugauagcagguuaccagaccaugaagcauauauuaaagggucacaacauuaggaagguugagaaccacucauagaagaagacagauuaauuugaggagcaacagcuuuguaguggucauguaaaagucacaaagaggugguagaugugaaagucaagcuauuccaagcuagugucguacauuuugaagcuucuggcuguaaauaaacuuuaccauguuuugaauggcauuugucauucauucaaaauaucauuaacuuaaaaucuucaggauauuguuauaagaagaguuauuucguuuuuuaaaugaagauacugugcuuguuggcaacaagauauuccucagguuuaucagauaccucugaugaaugcuaggaaacuaacuauucauauuaaggcaaaccuacaugaccauaauuuuauuucauacugacagcuguuuacuuaaguggaaaaagacugaaauugaccaucucaacuguauugaaaaaggguaaacaguuaaaacucacacagcuauccauaaguuaaucauauguaauuuuguauuugaacuauacauucacaugcauuguggauauguguguguacauaaacacaaaccuuuuuaaaugacagaauuaaugauaucuugacugaauuaauucaucauuugcguuuuucuuuuaguuacaauggaauuggguaucuaaaguguuuaaagucaaaggagggguggaaagauggccuggagguuaagagcaccuguuacucuugcagggaugccggguucucaacuuucugaagguugccuagcaacuguccuuagcaccaguuccaagaggucacaugcccucuucuggcucccacaagcauugcgugcauaugaugcaguuaaauacauauaggcaaaagucagacacauacuaaaaauaaaaaccuaaaaacaacgauccuuuaaaauuuugaauauuuagagaaagaaaagagacuacugaagauuaaaaaugaaaaguaccaguuauuaauuauugagcaggauuguuacugaguugaauaugggaauucacucuuugugcaguuuuuauugcaugucuucacuuuugcuuucaauugggauuaauaauaaacuuguuggaauuuaguuccacaucgagcuaaagaaguuacugagaaaaucuguagauacagggauaaggggaguggaaaccuuggggguggggggugcauuuccuacagaucaaauggucccuuauuuuucguuacaaauugugguaaagugaacuaauucuguuggcucaaaaaugacaugcuggguauaauuuuaugcuucaguggcuauguaaaggauaacugcauuguaggacagugguccuuguguauugcuguaucauauuauuuccuaugagcuuuucuccccaagaugcagaaugcuuuguuguuaauguuagaacgaacaguuucaucaugcuucauauuaaugacaauuugauucaugauaaaauuuuaauucucuuguccuuuguccuuuuagacuuaugcuugaauguacauaaucuuuucucauuacuggaaauacugguuaaguaguucuauaugaaauagauacaugggcucugaguuuacucugaguaaaaugauugaagaaaguuagauuaccugaccacuguuuuugaguaaaaagcuuaaauuuaguuuuuacaaauagaauuugacuuuguugaauuccagauggcauguauauauuuuuuuuaagauuuauuucauuuuauguguauauguguaucugggaguauauguccccuacugugccuggagaggccagaagaggguuggauaugcuacuucugaaaagcuugugcucaaccaauggguucauagggaaacaguucuuuguuauuuggaaaaaauauuuuugauuuuuuuuuucuuuaguaugaaaauuuugauuuuuuuccaaauuuuuccuuuuuccuuuuagaacaaauucuguacaacauaaaacaggaauauaaacgcaugcagaagagaagacauuuagaagcuaguuuucagcaggcagauccagguuguacuuccgauucacagccacaugcauuucucaucaguggaccagcaucaccagguaauaacccuuaauaagaaguauuacauuagaaaugauggagaaaugcaaacugcccacaacgacuuaaagcaccugcuuuuuccaagauuaaaguaguuacacaaaguaauguguacuauuuuaaaaguuuucacuaccuguauucucaccaaccacaggcagccaccuuuagcaucccuaaaguggacauaacuuggauuuaaaaaaauaacuaguguuuacuauaugcuuuaaaaauacccauuuauuuuugugcuuuuauaugcauguauuauguacaacauaaaccauuuauaugucugguacucauggagaccaaaagaggaugucagauccucugaaacuagaguuacagauggucaugagcccugucauguaggugaugagaacuaaacccgaguccucugcaaaaacaagugccuuugacugugauacuaucuuuccugucccacccaccacaugcuuuucuguuagauaauagugccccaacacugccaucuugugaauuuccuauaauuauugaucuagcaguuauauucaaaaguucuucugauagaaccauuauacaaaugucuaucuauguacuuguagacauuggucacauugggcuagauuccuuaauguguggacuucuuuuuuucuguuguuuuuuuaaaauuguguaucaauuuaaaacucauuuacccuuuagagagaauggucuacuuuucuaagucugacuuaguaaugcugaaguuacuuggccagaaaagagccaucuuuuaauaaccugucaaaauacuuuuuacuugagaagcacuuguuuggggcuggagagaugcucagugguuaagagcaaugacugcuccucugaaaguccugaguucaaaucccagcaaccacaugguggcucacaaucauccauaaugaagucugacucccucuucuggugugucugaggacagcuacaguguacuuacauauaacaauaaauaaaucuuuuuaaaaagggggugguggugcuggugagguggcucagcaguuaagagcaccgaagguucugaguucaaaucccagcaaccacaugguggcucacaacccucuguaaggagaucugacauccuccucuggugucugaaaacagcuacaguguacuuaacauauaauaauaaaucuuuaaaacagaagcacuucuuuuccugguacaaugcaaaacagaaacauaaaauccaagauguaagguaaucaauuaaaacuugauagggaaauuguucaaugcuaaauauuggaaugcugccaguugggggguggagcuaggugugccaaaggagugauucuuacuaaaauuauaauaaugaucuuuucuacuaauacuaguuuaauucuuagggauuugccagucuuaacaagacuuggaauuucaagguuaggcuagccuugguaguuggguuaauuugggugagucaguguggauaaaggcaagauuagaaaacugacaugagugugcuuguauccauauguagcacuugacagcacggaugcagugaauagcuaccacaauccuggguuauccgaaagauaaugaucuuuaagccacgaauguuuaagaucaaaauaccuuaaauagaggaugaaugucuuuuucuaugaaguaugucacuacuugauaauaucaguggcuguuaauauuaacagucuuucagaacucgaaaccauaaaauacaggugaauuuuuuucccucuucagauuguccuagcaguuaucauuaacaaaaaacaaacugagauuuuuuuaaaaagcauacaauucaaaguaauaaacaugaucagagcuuuuuccuuuaagaggucccagaaaugaauguuucugaaauuugguucaugaaucaacuuguuaguauccuaaaguuuguaauacagauccgugcuuacuuagugucuuaacaguuaccauggagagaguuucucuuagaaaccuuuuaguuacagagcacauaaggaauauuccugcuaacuuaaaacugacaaacacuggcgcuggagcugguuuuggaacguugguuuucuugaguuuugaguguuugaacuuaggugaauuaaauuacauuagcaaaagugggggcuauggucacuauucaaaauuuagaauaauuauguuccuuuaguaagugauaaauaucugcauuacagauuucucccugcggcaacucuuuuuaaaaguauaauucucuauuuuucuuuuuuagauauaauucucuuuuaaaaggaaacuaagggguuuggaacaugaauauugaaguuguagaacaaucggauaggacuuacuguauggucuuaaaauauaagcaauaagcauuaacaauaaaauaagugucuuuauagcauaaucauguuacucuaguaacuaaauguucugaacaggcaugugcuggaauggagucugaaagguuugugaugggcacugacauugcaaggauuuuguugugaacuuuucuccacucgacuuuaggcuuuuccucuagauaacaucccuucuuccagaaucgcagucugacagaguuaauacuuggcccuguuuaucauagauaauaaguuuaaaugacauggggaaguucucaaugaaaccuucauucaggagguauacugucaugguucuaaaucaggugaucuuuuauucauguuguacauagggacuucaucugcaacauccucaccauuaaaaaaagaacagcccuuauuuacucuaaggcagguuggaaugaucugugaacguuuguugaaagaacgggaagagaaaguucgagaagaauaugaagaaauacugaauacaaaacuugcagguaaccaaugaguuuauuuuagaauaucccaguguucuagucacuguucuauugcugugaagagacaccaugaacaaggcaacucuuaugaaagaaggcauuuaauugggagcuugcuucuagugucagagcauggcgccaugcagauagauacauccuaauuucacaucucccccaccucaccccuaguggcacacuucuaccaaugaggccacaccucauaaucuaauucuuucagaguuauacucccugcugacuugcauucuaauauaugaaacucugggguccauucuuauucagaucacaccuagaaacgcacuguaagaauuauuucccacagguguuuuuacacugguauauucuuucuauacauugguauaagucuugguauaugugcaccagggaauuucaguaaaaaaggaaauuaacauucuuaaagcccauaucucaccuucaugauaccagggaugagcuagcuguauagaucagcuacaguauuaauuaaauuuuuaguuuguauccuguggaaaacacuuauuugagcuguuuacaauuacuauuuaagcuauggaaagguuucacauugcuuuauauuuuugauacauuagauagcauauuuugcaagucauguaauuuacacauaccucuauuuauagaacaauaugaugcuuuugugaaguuuacgcaugaucagauaaugcggcgauauggagaacagccugcuaguuguaaguauuugaccuuugaacuauaaacugaaaaagaccauguuuucauauuuaagaagagaguugauaaaaaguaugaagagaaaguuaguuuaaaacagaaguaaaauguuacaaguuaacuaucuaggggugguauuaggaaagaaugaucuuguuuguugucauuuugccccauucucuauacuaauacuccuuuucuccuccagauguuucaugaaucgcgcuuuuugcauuugugggcugccuuguucuuuguugaguuguugcaggaggucccaacuaugacaugcagcaaugccaguacccaucugugaauacagguuauuucaagcuuucgucaguggcaaccacucuuaggcagcagcaauugguuuuggaaauuuccgugaugucauuaccaccugaauguggaccuuugcuacuuguauuaagaccaguggccucguuuugcuguaucauuacaauuuggcuucuuuauauuaauguuugaaagggauuaaaccuggcauucuagaacaugcccuucacugguuauguaaauaaaacuguagaaugacacgucagaugaaguuagugugauuuuaauugugcacuacaaccaagcuguaaccaguuauuaauaacuuagaauguaaucccaggacauuuaagcaguuagucuacaguacuucugugagauaguggaagaggaggaagaggagggcauuucuguauuucaggacuuuucuugggguuucagaauggguuuauaugauuuucuuuauuauuuuuugguaguuuuauuuauucuaucagucuuuuuaacaaauguuuauugcugcaccuccuccccaguguauuauuguuuuacuacccuuguagcacuggaguuuaguuggaaaaauaaaacauuuacuucuauucugccuguuuccgaauuguacacauggguaguauuggaauaaaguaguguuuaaauguuaaguauuuucuagaaaucaacacaaaguuaguuuucuggcauuauuuaccuuuuaaaugcuguuuucagaaauuaugauucaaaacugcuucuguaacuugcuguauaacagcauguucuauaacaagaucuaaaacagcuguagaccuuuccuuugaauccaguuuugauuuuuuugaacaaugugauagaugaacacauggucgcucuaguugaugugauaaaguaaccccacacaaagcaguuuaggguauuaaguguuuauuuuacuuuaccucaaaaucccagguugcagucuaucacuguggggaaaucaaaacugcaggaacuuguagccacaaguaagagcagagagccaucaguaaauguuuaaguacuaaguuuaguggaugguuccacccacuucugguuggcucucuuccugauugguuaaggcaauucagucacucacagacaugcuuacaggcuaaacugaucuagacaagccuuguuaagauuuagaaaauccuagguacuguugagaugaaaaaguuaacaucuuaagggcuggagagaggcucagaagagcucagguugcuuuuuuggaagacccuuguuugguucccagaaccuauauaacagcucaccaacugaugccuuuucugaacuccaugcacacaguacacacauauauacucaggcaagcacacauacauaaaacauuaaauaauaucacagugaaugacuaaauuaaauguauacaaaguagugagaaagcugaaaguacuaaccacacauuugucaucuugguaguugagacaggauuagagguuaaaggccacccccucagucuugcucagugaauuauuuucaauuuuaaaaaaaaaaaaaagauuuuauuuguauacgcuuaugugccugaggccauaagacagccaguuguugagcugcccauguugaggcuaggaaccaaaaucccuuaaguccucugcaagaguggcaaacauucuuaacugcugagcuaccucucuggcucccuuugaauuuuaauagcauacuuccugucauuagacuaaucuuaaaacacaauauuucauuuuuaacuuacuaauaaccucauuuaaaaauaagcacccagagugugcucuguggcuuucacaagauugucaggcaguuccaaauccauuaguacacaagaaacacaaguuauagaauggggcagcuggauguaaagugaacuaaucucacacuuagauuucagccucaaugcuauugguacuuugggauguaucuguacauucuagaguguuaaugguaucucuccccuuucccauuaugucaacaaaaaucuucacguuaucuuucaaauauagcccucaacuuguuaggaaaacacucaucacagaaguugaaagauuagugucauuuccuacuugauuuuuucaaguagaaagugcuaagcuguguugggaaguugucuaaacacauaugcuucucucuaaccucagcgcuggccacuugagguagaugcugucuacauuuguauuucucuguuuucuaaaugcuuuuagcaccccaaccccuccucucuucccccacaaggauucaaccaagauuacaacuuucuggaaagacuaaguugaguauuucuuugugcuaccauuaacaugaccuguccuuuuugaaguuauaaacuagaaugcagauuuaaaaguuuuaauacuuguauguguccacauggaugugcaagugcccacagaggccaaagagggugguagaucccuuggagcuagguaguuuugaaaaaucugaugugguugcuacaaacccacuucuggucuuuuagaagaacagcaaguuccucacuugugaacuuuauuaauguuuaguuuuaguguugggguaagccuuuugguuaagacuguaaagugauguuauggaguccguauuauaaaguauuagcauauggcuuuuucccccgcuuacuggucaguuugauacuuggcucggucaauuaaccaaguuaccuaagauuaccgcauuguuuacucuauucauauaugagcuucaaagucuucaguuggcuucuaagauacuugccugauuccuuucacuuuuaauguucucuugaauuuuuaccuacaaauaagcauaaaccucaacgcuggaguuugaucuccuugccucucuucagugcugacguuggugaucucuaaacaagauucugcucaccuuacuguguagcauuucaccagaaucucuccugauuguuauagccaaagccaaacucaguuuugcugcuguuucuuucaauuagccuuccauaacuacaauaaaauacucagguuuaucuagucaggaaguuuauuucaauugcauuuugaaggcguaugaucaguugaggcagaagacaugacuagaguccaguuuagagcuaaacuguuagcucaucagccaggaagcaaaagaauaaagaggacuguuggauccucccauuuuccuugcggccacacucgcagacuucccauuauaccuuaguucuuagagaucccaccaccgagcaguagccauagcagcccacugauagcaaugcuucuaguuuauaagcagaagggauuuuaaggaucuaaaugugcaucuaauuguaguuaaucaacagugacaccaaccccgcugcucuuggucagcuaacuagugguugcuuugcugcaucaggccucacuguucucacacguguugaucauugaaaggcuuuacccuuuugcuucugaccgaagaaaacaaagcuucacuaccugcacucuuguccuacucauucaauuccuauuauuugaacccccugauccauccuagcugucucugucuugguguccccauccuaggauauugguuacugcuguugccugccuaguggggucacccauaaguccuccuggguaguuuuuuucauuccuauacuuuugcucaagugaggucugcuuugcuacauaaaggacaaggaaaacacugaucuuguuucuaaaauaucuaguaagugccaggcaccucaaugaaggauugaguuuuuauaggauaccaaguaauuacacacaaucaguuuaaugguucaguccuacagguccuuuugauaguaugagaagucaaugugcacacacgcacaaaugcaggcaaugccuaggaaaagaaaacaugccucagacaagauaaaaauaugccaguauuaacaccaguuccucuguauuuuauaugcacaaaauguuguguuguuuaaagaccuguuuucucgucugggcauaauguaaauuccuuauaaucuuagcacuucgggauggggggcauggagaaaggaucauaaucuugcauauaccuugcaacacaagucagaggcuuuuaaauuuuuuucuggacauggacucucugaaucauuugugaacaauuuugguacaauucucuugagaguugaacauuaaauaaugaguuuuaugugucugauucuuaaguucuugucaugaaagauacgauauuauuucacuggaccuuuacauuucugaguuuuguaaguuaggggagcaguuugugaaggcccuuacugguuguaagucuccguggcuguucauaugaauguuuauuaaguauaaagccaaauagcuuugggccugguaaguugccaagauuauaagaaauggagaggcugaggugauuuuagagccuuucuagcaaggaaaacaccugaaagauguuuacagugucuaacuuuacagugugcuggcguuuggggugcugcugagagcuaugcguaagaaguucuagcauuuacacacuagacaagcaagaaugaagcaauguauacugauaacauauaaaggcuuuaugcauuuguuagucuuugaaguacuccaaaaacguuuugauacaaauaugcaaguuggacauggaacucuucuugucuucacucucuugcuguuuaacagccuccccauguaagccuugcaacauggucagucuucuguuucguagguuuuauaaagccuaaaaguucuaauucagaaacagcucgaauaaaucgagcacuagaggaucuagcuaaggaaaauuaggguguuuuguuuugcuuuguuuuuuuaguuugacaaaaagauuaaaaugaaauuucaaaguugaaauaguaacugguaaauugaaauaagugguugaaauaaauacuacuaaauuauauaacccuauuggaagauguuaaaugcaaucagaauagaagguucaaauggaguuguguguuacagugcacaccuauuguaaucccagcacuugagacagaggcaguuugaggccagucaggugagguuacaugauaccaugucucacaaaaaugucaaaugaaucacaaacagauggaaaaguguugaacacuaucgcccccuugccaaacuucuagaaguauguuuuaaaaguugauaauucaauaaugacaauuuccuuaguaaaaacuggaauaaauugagaauagaauagacuaaauucagaguacuuagaaauuaagguuguuuuaagaugguaugguuaagcaauacauauuuaugaauuuuuagaugugcuuucuuuaaauuuuuauuuuuuaacguguguguguguguguguguguguguguguguugggccuugaauucaaggcccuuuguuuaagcaaauguucuuuguuuuaagcaaaugaccuagccagucaagaaacaagaacauuaaaauacuguuacugggucacuguagaacugguuuuaaaaggauacugaauaacuucacucauuucuucugagacuguagaauuugcauccauuuucucagcagcugucacaacuguugcaaaagccuuuugaguauacaagagagaagaaaauacaacuuguugcuaggcaucuuguucuguacccgugagauaguuuuggaacuagucagguuuuaggacuugcuguagauaucugacacaucuuucacaacagauuucaaauugaagaugacuaaugacauuaauaaguuuugccaguuauucauuaaaaauaauaaaacugacucuacauuuguguuagaggauuaaagcauaacuauucaaaauuuuaaaagcagagaaaucccuguucccucuaacguuaaucuuuuacuccaagaaaaugcauuucucuuggaagacucuaauucagcauguccuuugauguugagaugucaguuaggacuuuugacagcuaugcacuuguccccugccuugccauauauuccagaauagaauuucuccuguugugugagggguguccaccacaccuguauucuggcuugcucugagcugaucugaauccuuucuuuggcuucuguuuuuaaaaaacacaggaucagaauaggagcuuacuuaggacuucugaagcauaacaacauuugugcuuuacaaacgaaacagagacggggggg

SEQ ID NO: 1821 - RNA, 21785 nt, Mus musculus
cccccccgucucuguuucguuuguaaagcacaaauguuguuaugcuucagaaguccuaaguaagcuccuauucugauccuguguuuuuuaaaaacagaagccaaagaaaggauucagaucagcucagagcaagccagaauacaggugugguggacaccccucacacaacaggagaaauucuauucuggaauauauggcaaggcaggggacaagugcauagcugucaaaaguccuaacugacaucucaacaucaaaggacaugcugaauuagagucuuccaagagaaaugcauuuucuuggaguaaaagauuaacguuagagggaacagggauuucucugcuuuuaaaauuuugaauaguuaugcuuuaauccucuaacacaaauguagagucaguuuuauuauuuuuaaugaauaacuggcaaaacuuauuaaugucauuagucaucuucaauuugaaaucuguugugaaagaugugucagauaucuacagcaaguccuaaaaccugacuaguuccaaaacuaucucacggguacagaacaagaugccuagcaacaaguuguauuuucuucucucuuguauacucaaaaggcuuuugcaacaguugugacagcugcugagaaaauggaugcaaauucuacagucucagaagaaaugagugaaguuauucaguauccuuuuaaaaccaguucuacagugacccaguaacaguauuuuaauguucuuguuucuugacuggcuaggucauuugcuuaaaacaaagaacauuugcuuaaacaaagggccuugaauucaaggcccaacacacacacacacacacacacacacacacacguuaaaaaauaaaaauuuaaagaaagcacaucuaaaaauucauaaauauguauugcuuaaccauaccaucuuaaaacaaccuuaauuucuaaguacucugaauuuagucuauucuauucucaauuuauuccaguuuuuacuaaggaaauugucauuauugaauuaucaacuuuuaaaacauacuucuagaaguuuggcaagggggcgauaguguucaacacuuuuccaucuguuugugauucauuugacauuuuugugagacaugguaucauguaaccucaccugacuggccucaaacugccucugucucaagugcugggauuacaauaggugugcacuguaacacacaacuccauuugaaccuucuauucugauugcauuuaacaucuuccaauaggguuauauaauuuaguaguauuuauuucaaccacuuauuucaauuuaccaguuacuauuucaacuuugaaauuucauuuuaaucuuuuugucaaacuaaaaaaacaaagcaaaacaaaacacccuaauuuuccuuagcuagauccucuagugcucgauuuauucgagcuguuucugaauuagaacuuuuaggcuuuauaaaaccuacgaaacagaagacugaccauguugcaaggcuuacauggggaggcuguuaaacagcaagagagugaagacaagaagaguuccauguccaacuugcauauuuguaucaaaacguuuuuggaguacuucaaagacuaacaaaugcauaaagccuuuauauguuaucaguauacauugcuucauucuugcuugucuaguguguaaaugcuagaacuucuuacgcauagcucucagcagcaccccaaacgccagcacacuguaaaguuagacacuguaaacaucuuucagguguuuuccuugcuagaaaggcucuaaaaucaccucagccucuccauuucuuauaaucuuggcaacuuaccaggcccaaagcuauuuggcuuuauacuuaauaaacauucauaugaacagccacggagacuuacaaccaguaagggccuucacaaacugcuccccuaacuuacaaaacucagaaauguaaagguccagugaaauaauaucguaucuuucaugacaagaacuuaagaaucagacacauaaaacucauuauuuaauguucaacucucaagagaauuguaccaaaauuguucacaaaugauucagagaguccauguccagaaaaaaauuuaaaagccucugacuuguguugcaagguauaugcaagauuaugauccuuucuccaugccccccaucccgaagugcuaagauuauaaggaauuuacauuaugcccagacgagaaaacaggucuuuaaacaacacaacauuuugugcauauaaaauacagaggaacugguguuaauacuggcauauuuuuaucuugucugaggcauguuuucuuuuccuaggcauugccugcauuugugcgugugugcacauugacuucucauacuaucaaaaggaccuguaggacugaaccauuaaacugauuguguguaauuacuugguauccuauaaaaacucaauccuucauugaggugccuggcacuuacuagauauuuuagaaacaagaucaguguuuuccuuguccuuuauguagcaaagcagaccucacuugagcaaaaguauaggaaugaaaaaaacuacccaggaggacuuaugggugaccccacuaggcaggcaacagcaguaaccaauauccuaggauggggacaccaagacagagacagcuaggauggaucaggggguucaaauaauaggaauugaaugaguaggacaagagugcagguagugaagcuuuguuuucuucggucagaagcaaaaggguaaagccuuucaaugaucaacacgugugagaacagugaggccugaugcagcaaagcaaccacuaguuagcugaccaagagcagcgggguuggugucacuguugauuaacuacaauuagaugcacauuuagauccuuaaaaucccuucugcuuauaaacuagaagcauugcuaucagugggcugcuauggcuacugcucgguggugggaucucuaagaacuaagguauaaugggaagucugcgaguguggccgcaaggaaaaugggaggauccaacaguccucuuuauucuuuugcuuccuggcugaugagcuaacaguuuagcucuaaacuggacucuagucaugucuucugccucaacugaucauacgccuucaaaaugcaauugaaauaaacuuccugacuagauaaaccugaguauuuuauuguaguuauggaaggcuaauugaaagaaacagcagcaaaacugaguuuggcuuuggcuauaacaaucaggagagauucuggugaaaugcuacacaguaaggugagcagaaucuuguuuagagaucaccaacgucagcacugaagagaggcaaggagaucaaacuccagcguugagguuuaugcuuauuuguagguaaaaauucaagagaacauuaaaagugaaaggaaucaggcaaguaucuuagaagccaacugaagacuuugaagcucauauaugaauagaguaaacaaugcgguaaucuuagguaacuugguuaauugaccgagccaaguaucaaacugaccaguaagcgggggaaaaagccauaugcuaauacuuuauaauacggacuccauaacaucacuuuacagucuuaaccaaaaggcuuaccccaacacuaaaacuaaacauuaauaaaguucacaagugaggaacuugcuguucuucuaaaagaccagaaguggguuuguagcaaccacaucagauuuuucaaaacuaccuagcuccaagggaucuaccacccucuuuggccucugugggcacuugcacauccauguggacacauacaaguauuaaaacuuuuaaaucugcauucuaguuuauaacuucaaaaaggacaggucauguuaaugguagcacaaagaaauacucaacuuagucuuuccagaaaguuguaaucuugguugaauccuugugggggaagagaggagggguuggggugcuaaaagcauuuagaaaacagagaaauacaaauguagacagcaucuaccucaaguggccagcgcugagguuagagagaagcauauguguuuagacaacuucccaacacagcuuagcacuuucuacuugaaaaaaucaaguaggaaaugacacuaaucuuucaacuucugugaugaguguuuuccuaacaaguugagggcuauauuugaaagauaacgugaagauuuuuguugacauaaugggaaaggggagagauaccauuaacacucuagaauguacagauacaucccaaaguaccaauagcauugaggcugaaaucuaagugugagauuaguucacuuuacauccagcugccccauucuauaacuuguguuucuuguguacuaauggauuuggaacugccugacaaucuugugaaagccacagagcacacucugggugcuuauuuuuaaaugagguuauuaguaaguuaaaaaugaaauauuguguuuuaagauuagucuaaugacaggaaguaugcuauuaaaauucaaagggagccagagagguagcucagcaguuaagaauguuugccacucuugcagaggacuuaagggauuuugguuccuagccucaacaugggcagcucaacaacuggcugucuuauggccucaggcacauaagcguauacaaauaaaaucuuuuuuuuuuuuuuaaaauugaaaauaauucacugagcaagacugaggggguggccuuuaaccucuaauccugucucaacuaccaagaugacaaaugugugguuaguacuuucagcuuucucacuacuuuguauacauuuaauuuagucauucacugugauauuauuuaauguuuuauguaugugugcuugccugaguauauauguguguacugugugcauggaguucagaaaaggcaucaguuggugagcuguuauauagguucugggaaccaaacaagggucuuccaaaaaagcaaccugagcucuucugagccucucuccagcccuuaagauguuaacuuuuucaucucaacaguaccuaggauuuucuaaaucuuaacaaggcuugucuagaucaguuuagccuguaagcaugucugugagugacugaauugccuuaaccaaucaggaagagagccaaccagaaguggguggaaccauccacuaaacuuaguacuuaaacauuuacugauggcucucugcucuuacuuguggcuacaaguuccugcaguuuugauuuccccacagugauagacugcaaccugggauuuugagguaaaguaaaauaaacacuuaauacccuaaacugcuuugugugggguuacuuuaucacaucaacuagagcgaccauguguucaucuaucacauuguucaaaaaaaucaaaacuggauucaaaggaaaggucuacagcuguuuuagaucuuguuauagaacaugcuguuauacagcaaguuacagaagcaguuuugaaucauaauuucugaaaacagcauuuaaaagguaaauaaugccagaaaacuaacuuuguguugauuucuagaaaauacuuaacauuuaaacacuacuuuauuccaauacuacccauguguacaauucggaaacaggcagaauagaaguaaauguuuuauuuuuccaacuaaacuccagugcuacaaggguaguaaaacaauaauacacuggggaggaggugcagcaauaaacauuuguuaaaaagacugauagaauaaauaaaacuaccaaaaaauaauaaagaaaaucauauaaacccauucugaaaccccaagaaaaguccugaaauacagaaaugcccuccucuuccuccucuuccacuaucucacagaaguacuguagacuaacugcuuaaauguccugggauuacauucuaaguuauuaauaacugguuacagcuugguuguagugcacaauuaaaaucacacuaacuucaucugacgugucauucuacaguuuuauuuacauaaccagugaagggcauguucuagaaugccagguuuaaucccuuucaaacauuaauauaaagaagccaaauuguaaugauacagcaaaacgaggccacuggucuuaauacaaguagcaaagguccacauucaggugguaaugacaucacggaaauuuccaaaaccaauugcugcugccuaagagugguugccacugacgaaagcuugaaauaaccuguauucacagauggguacuggcauugcugcaugucauaguugggaccuccugcaacaacucaacaaagaacaaggcagcccacaaaugcaaaaagcgcgauucaugaaacaucuggaggagaaaaggaguauuaguauagagaauggggcaaaaugacaacaaacaagaucauucuuuccuaauaccaccccuagauaguuaacuuguaacauuuuacuucuguuuuaaacuaacuuucucuucauacuuuuuaucaacucucuucuuaaauaugaaaacauggucuuuuucaguuuauaguucaaaggucaaauacuuacaacuagcaggcuguucuccauaucgccgcauuaucugaucaugcguaaacuucacaaaagcaucauauuguucuauaaauagagguauguguaaauuacaugacuugcaaaauaugcuaucuaauguaucaaaaauauaaagcaaugugaaaccuuuccauagcuuaaauaguaauuguaaacagcucaaauaaguguuuuccacaggauacaaacuaaaaauuuaauuaauacuguagcugaucuauacagcuagcucaucccugguaucaugaaggugagauaugggcuuuaagaauguuaauuuccuuuuuuacugaaauucccuggugcacauauaccaagacuuauaccaauguauagaaagaauauaccaguguaaaaacaccugugggaaauaauucuuacagugcguuucuaggugugaucugaauaagaauggaccccagaguuucauauauuagaaugcaagucagcagggaguauaacucugaaagaauuagauuaugagguguggccucauugguagaagugugccacuaggggugaggugggggagaugugaaauuaggauguaucuaucugcauggcgccaugcucugacacuagaagcaagcucccaauuaaaugccuucuuucauaagaguugccuuguucauggugucucuucacagcaauagaacagugacuagaacacugggauauucuaaaauaaacucauugguuaccugcaaguuuuguauucaguauuucuucauauucuucucgaacuuucucuucccguucuuucaacaaacguucacagaucauuccaaccugccuuagaguaaauaagggcuguucuuuuuuuaauggugaggauguugcagaugaagucccuauguacaacaugaauaaaagaucaccugauuuagaaccaugacaguauaccuccugaaugaagguuucauugagaacuuccccaugucauuuaaacuuauuaucuaugauaaacagggccaaguauuaacucugucagacugcgauucuggaagaagggauguuaucuagaggaaaagccuaaagucgaguggagaaaaguucacaacaaaauccuugcaaugucagugcccaucacaaaccuuucagacuccauuccagcacaugccuguucagaacauuuaguuacuagaguaacaugauuaugcuauaaagacacuuauuuuauuguuaaugcuuauugcuuauauuuuaagaccauacaguaaguccuauccgauuguucuacaacuucaauauucauguuccaaaccccuuaguuuccuuuuaaaagagaauuauaucuaaaaaagaaaaauagagaauuauacuuuuaaaaagaguugccgcagggagaaaucuguaaugcagauauuuaucacuuacuaaaggaacauaauuauucuaaauuuugaauagugaccauagcccccacuuuugcuaauguaauuuaauucaccuaaguucaaacacucaaaacucaagaaaaccaacguuccaaaaccagcuccagcgccaguguuugucaguuuuaaguuagcaggaauauuccuuaugugcucuguaacuaaaagguuucuaagagaaacucucuccaugguaacuguuaagacacuaaguaagcacggaucuguauuacaaacuuuaggauacuaacaaguugauucaugaaccaaauuucagaaacauucauuucugggaccucuuaaaggaaaaagcucugaucauguuuauuacuuugaauuguaugcuuuuuaaaaaaaucucaguuuguuuuuuguuaaugauaacugcuaggacaaucugaagagggaaaaaaauucaccuguauuuuaugguuucgaguucugaaagacuguuaauauuaacagccacugauauuaucaaguagugacauacuucauagaaaaagacauucauccucuauuuaagguauuuugaucuuaaacauucguggcuuaaagaucauuaucuuucggauaacccaggauugugguagcuauucacugcauccgugcugucaagugcuacauauggauacaagcacacucaugucaguuuucuaaucuugccuuuauccacacugacucacccaaauuaacccaacuaccaaggcuagccuaaccuugaaauuccaagucuuguuaagacuggcaaaucccuaagaauuaaacuaguauuaguagaaaagaucauuauuauaauuuuaguaagaaucacuccuuuggcacaccuagcuccaccccccaacuggcagcauuccaauauuuagcauugaacaauuucccuaucaaguuuuaauugauuaccuuacaucuuggauuuuauguuucuguuuugcauuguaccaggaaaagaagugcuucuguuuuaaagauuuauuauuauauguuaaguacacuguagcuguuuucagacaccagaggaggaugucagaucuccuuacagaggguugugagccaccaugugguugcugggauuugaacucagaaccuucggugcucuuaacugcugagccaccucaccagcaccaccacccccuuuuuaaaaagauuuauuuauuguuauauguaaguacacuguagcuguccucagacacaccagaagagggagucagacuucauuauggaugauugugagccaccaugugguugcugggauuugaacucaggacuuucagaggagcagucauugcucuuaaccacugagcaucucuccagccccaaacaagugcuucucaaguaaaaaguauuuugacagguuauuaaaagauggcucuuuucuggccaaguaacuucagcauuacuaagucagacuuagaaaaguagaccauucucucuaaaggguaaaugaguuuuaaauugauacacaauuuuaaaaaaacaacagaaaaaaagaaguccacacauuaaggaaucuagcccaaugugaccaaugucuacaaguacauagauagacauuuguauaaugguucuaucagaagaacuuuugaauauaacugcuagaucaauaauuauaggaaauucacaagauggcaguguuggggcacuauuaucuaacagaaaagcauguggugggugggacaggaaagauaguaucacagucaaaggcacuuguuuuugcagaggacucggguuuaguucucaucaccuacaugacagggcucaugaccaucuguaacucuaguuucagaggaucugacauccucuuuuggucuccaugaguaccagacauauaaaugguuuauguuguacauaauacaugcauauaaaagcacaaaaauaaauggguauuuuuaaagcauauaguaaacacuaguuauuuuuuuaaauccaaguuauguccacuuuagggaugcuaaagguggcugccugugguuggugagaauacagguagugaaaacuuuuaaaauaguacacauuacuuuguguaacuacuuuaaucuuggaaaaagcaggugcuuuaagucguugugggcaguuugcauuucuccaucauuucuaauguaauacuucuuauuaaggguuauuaccuggugaugcugguccacugaugagaaaugcauguggcugugaaucggaaguacaaccuggaucugccugcugaaaacuagcuucuaaaugucuucucuucugcaugcguuuauauuccuguuuuauguuguacagaauuuguucuaaaaggaaaaaggaaaaauuuggaaaaaaaucaaaauuuucauacuaaagaaaaaaaaaaucaaaaauauuuuuuccaaauaacaaagaacuguuucccuaugaacccauugguugagcacaagcuuuucagaaguagcauauccaacccucuucuggccucuccaggcacaguaggggacauauacucccagauacacauauacacauaaaaugaaauaaaucuuaaaaaaaauauauacaugccaucuggaauucaacaaagucaaauucuauuuguaaaaacuaaauuuaagcuuuuuacucaaaaacaguggucagguaaucuaacuuucuucaaucauuuuacucagaguaaacucagagcccauguaucuauuucauauagaacuacuuaaccaguauuuccaguaaugagaaaagauuauguacauucaagcauaagucuaaaaggacaaaggacaagagaauuaaaauuuuaucaugaaucaaauugucauuaauaugaagcaugaugaaacuguucguucuaacauuaacaacaaagcauucugcaucuuggggagaaaagcucauaggaaauaauaugauacagcaauacacaaggaccacuguccuacaaugcaguuauccuuuacauagccacugaagcauaaaauuauacccagcaugucauuuuugagccaacagaauuaguucacuuuaccacaauuuguaacgaaaaauaagggaccauuugaucuguaggaaaugcaccccccacccccaagguuuccacuccccuuaucccuguaucuacagauuuucucaguaacuucuuuagcucgauguggaacuaaauuccaacaaguuuauuauuaaucccaauugaaagcaaaagugaagacaugcaauaaaaacugcacaaagagugaauucccauauucaacucaguaacaauccugcucaauaauuaauaacugguacuuuucauuuuuaaucuucaguagucucuuuucuuucucuaaauauucaaaauuuuaaaggaucguuguuuuuagguuuuuauuuuuaguaugugucugacuuuugccuauauguauuuaacugcaucauaugcacgcaaugcuugugggagccagaagagggcaugugaccucuuggaacuggugcuaaggacaguugcuaggcaaccuucagaaaguugagaacccggcaucccugcaagaguaacaggugcucuuaaccuccaggccaucuuuccaccccuccuuugacuuuaaacacuuuagauacccaauuccauuguaacuaaaagaaaaacgcaaaugaugaauuaauucagucaagauaucauuaauucugucauuuaaaaagguuuguguuuauguacacacacauauccacaaugcaugugaauguauaguucaaauacaaaauuacauaugauuaacuuauggauagcugugugaguuuuaacuguuuacccuuuuucaauacaguugagauggucaauuucagucuuuuuccacuuaaguaaacagcugucaguaugaaauaaaauuauggucauguagguuugccuuaauaugaauaguuaguuuccuagcauucaucagagguaucugauaaaccugaggaauaucuuguugccaacaagcacaguaucuucauuuaaaaaacgaaauaacucuucuuauaacaauauccugaagauuuuaaguuaaugauauuuugaaugaaugacaaaugccauucaaaacaugguaaaguuuauuuacagccagaagcuucaaaauguacgacacuagcuuggaauagcuugacuuucacaucuaccaccucuuugugacuuuuacaugaccacuacaaagcuguugcuccucaaauuaaucugucuucuucuaugagugguucucaaccuuccuaauguugugacccuuuaauauaugcuucauggucugguaaccugcuaucauaagauuauuuuguuacuacuacauaacuguaauucugcuccugucauuaauuggaauguaaauaccugauaugugagauaucugguaugugacccagcccccaaaugggucaccaccuaaagguugagaaucacuguaucuaguucuaaacuuuacuacgaaauuaaugaaggccaaacuaaacuguaccauaaagagaaugcuugaaacaaagccaagacuaaaauucaguaaaacuauuuacuuuaagccccaauccaacacagcauaguggugcaaaaccuuuauucccagcacuugugugaaaaaggcagucuacccagugaguuccaggauacacaguaagccagucuccacaggcaaaccaaaaaauugaagacaaguauagcuuaggugacuuaguuacauccuagcagauacacaacaguauaguauauuuuuaaguuaugauuuaucaagugaaauguaauauaaaaccacaacuuucacuacucuuaugucucuuuauaucacacacacaccuaccuuugucucuccagucuucaagaagccaauacucacaugguaucacuacauuuagccuccuguauaaguggacuucacaaacacaaacagugcaaacauuuuuuaauuguaccaugcuaugacaaauacauuuuuuuccugucaucauucccaagcaguauaggacaguaacuuuuugucuucacuguacuagacaugcuuggaauucgugcacacugcaucuaucaguuucuucuuauuguuggcuggugauaauucauuucuccaguuccuguauuggccuuucagacuguuuccaaugaaacuacuaaauccaaguucuagucugaggccauucucagcucuguuugguaacaguaaagaaaguaccacaguuuuccagaguguuccuuaccauuucacauuauuaccagcuacaccugucuugccaacacuucauacugucaacuaaagaauucaagaauuccuaaugucauugccuauacuguuguguaucugcuaggaugcaacuaagucacccaagcuauacuuguccucaaauguucuaauaccaacagcacauaguuaacaauguuauguagucaagugaucugacuugcacaagauccuggcagcacaaguugaaaaccacuaaauuggucugauauauuucaguucaggagguaaacaacuuugaagcucauaaagaccuccucccaaauuuuccacaccaauauucuacacuacuuuuauccagacugacuuaaguucccaccacacuaacagucuuaagauaggcaucuauguucaagggaguguucuguugcuguuuuaagguauuaaucuaaaccaguaugaaaguguugcugcacaucacaauaccaguaauguacuauuucacacuaagucacugaagguugguacagucaacacccauuuacucuguccugucauagcuucuauuaucuauacuuccaauuacaucacuuagaaaaguucuaccagauaacaucauuuagggacugggauaauaguugagaauucgacuacauuuuauucaguggcuaagguaguuuugugcugcucacaguacuugaagcaggaucucaauaugcauuccaagcuagccucaaacucaggugaccauccuuugucaacgcaagugcuaccacacccagcacuaucucauuuuaaaaacaaaaaagguugggcauugugaccuaaccccagcacaauuggaucuacauagggaguucaaggauaguaagagcuauguagggacccugucucaauaaauaaauaaauuaauuaauuaguaacaaaaagagagcaacaguucuccuaaacucaucccuaaucuauuuucauucuuaauucuugagguguuguauuaacaaaaaugaaugcuaaaggccagugcacacauaccaaaauaauuugacaagugagcacauuucugacaauggcaaaauucccccaaauaagacuaucuaaaauauuauaaugcuagaagcccuuacuuaucacccaggaggaguaugagggaaggaacauuaagaaguaauacccuggggcucuugcagagggcugagguuccauucccagcagcuacucauaaacaucccuaacuccaguucuagggugugugaugcccucuuuaacuguauguguguuaaugcacacucauaagcacucauacacagaaauaguucuuuaaaaaaaacccguuaaguacccagaaacacuguuuaaauuuuucacuguaguaguuguuacaacucaguugaauuaauacuuugcucauaaaauauuauaacuacagggucacagaacagucuaaaaaaagauacagaacugcaauuccauugcuucccuagcugcagcacuucuaagaaacugggaaaugccaagugaauaucccaacaaauaaauucaacauuuuaaagcuuugugguaauacauuagccaacuauguuuauuaauucugaagccauuuuuaaaguugguaucagcuuugacccacaccugcccuaaauauucagagaccuauuuuaggcucuuaguggaucucucagcuauguauagaaaguugggauaaauugaguucuaaaauugcuauauucagcaaucaaaguauagagcagucaucugcagaugccacaaauguugaaauaggcuggaguauuucccuucucuucaucuuuuuaaaguugauagucuuaucaaagacaucaaaucaaaauuuaucaaauuugcacauaugcacagagaaacuuuugcagauagauuaauagcacugggcaguauuaaggucaacaguauuggacacuguuaaacacauggacaacaaagaccacagaacucugauuaacuaguguaguucccaugcccgaucccaucuaguucaccaaacaacucugcaaggagcccagacuccacuuucucucacuucacauuugucauguuucuuuucaaauaguaaaacacugugaguacuagacucuuugaauuauucuuuuauacuucaucacugcccuguguuuaugcauccacaguuacaauccacuugccacagugcacaggugaagucacagaaaccuuuuggaguuguuuuuucuucccaccacguaggucccagugaacaaacucaagggcccuugggcuugguaguaaacauuuuuacuggcugagccaucuaaucagcccugaaucuguuauuuucaaccuuucaaaaguauuacuaccccucuuuuccugaccuaucuuaacaauaggaaaaacauacccaaguaacaaaagaacaaagccauucaaaagcagaugaccauuuccuugguaacugaccugcuagaagcaucucuacaugagguuagcuuguuucuguuaggcuucagggauccacccccccccacccccaccuuagaaagcuaaaaugaauaaugcacugggguguucuuuaauggccauaagccuaaggcuuuuuucuugcccccccccacccaguauuaggaucaaauuuagggagaucggugauuagacaagcauucuacuaucacuaagccaacaugucaauuccaacuaacaggcuucuuaaaugcacaauuuuaacuggagcuacacauuucuaaauaucagguuuacaauccauagcacaaagaccacuacuaaaaacauuuauuugccaaaugcacugagaagcuagaaguaauuuaacagcugucuaaauagccacaaauauuaaaagacacuucuggcucaauaaaauggcaucugaaguuagauacugccuucuccaacagacauaucauuuguuugccuagaaccauuuguauuuccuuuaaaccagcuggugucuccauuuggaggcauguaucaaugucuagugaacaaucuauucuccauucauaagcuguaguuuccauuuuuuaauggaaaguuuccaacaaauacaaugaguucuuacaauggaauuuaacucuucauccaacucaguuccuaaaacaaacuuaaugguaccaagcaagcuacaauguacacauuaaugguaacucccugacucacaaagucagcauccacagaaggccacucacaagaccacugauucauaguauaaauaugaaaacaauguguuagauuugacugacaguucuggcaaccucuuaacaauggcacuuaauaucaaaacaucuucuuucuugaaaaugccaggacaaucuuuugguuauauaauaauagacugacagacagacaacuaaaaaauaacucagguugccaaguaaaaagcccagugccagcauuggaauacaaccccuuaagcuguuugucugggguauccuagagaccuccaaaaugauacagacuacuguuaauguuuuagguugcgcucccacucuugaugguuaggauucuauugcugaggccaucacauagucacaggacauggaucaagcugguacucuuagcuagcuuccacagucccagguguuuggcaggcuacuaugaaagucauccaacaaggcuuaucuaauugugaccucucuugagcuacaaaaaugaucgguuugccauaacaggcccaugagugcaauaguggcacaaaugucacgggguaaauguccagcuuucugguuggguuuaugauuuuugcuugcuccaagacagaaauacaugcuugacacuguaauccuaggcaacaacccauggcuggagcauuuaugggcuccaggggugagcucacuacuauguguuauauggacaugauauagaacuacccucuaaauaaauaaauaaauacagagauacaaauuuagaggguagauugaggcagaaaaacuguaagagccagugucuucuggacaugacaugcugaaacacucacgaauuuacagcaauaguggcugcccauccacaguaauacacaagaccccauucuuagcugaggacaggugauggcaucugagggaagaacagucaauuuucuuaaaacucuuaguaggucagccaugcucuaauggaugaccccaaaucuaugaguauauauaggcaacacaaauugggacuuaaaguuauuuuaggaggaaggaagggggagagagacaacacaaaauugagaagcagaaaaagguggguaagauggaucugggaagaguuagguacuuagaaaaaauacauccuuaaaaucuuacuuaaaauagggcaggguggcacauagccuuuaaucccagcacucgagauguaaaagcaugccaggaguuccuggcuagucaaggaucuagcccccccaacccccauacccuggacacuuucauucccccauucucauuaaaaugcuucucucucccaacccacccucauucaccacccaccauccuuugauacacuaaaacguuauuuuaagcaucauugaauuaaaauccuaaaccaaaccaguguacacauaccuuuuuuuuucuuuuucuuuuguaaaagaccagacaauaaaugugaauucugggaacacacucucuccacaagcuuacuaagauaaccugcaguggacuuuaaacuuuaaaggagggcaggcacaacuguagccaaaugacuauuuuucauggcacugacauuugaauuuuuugaauucucaacaugaugaaaugaucauuuuuuguucuuuuucagacauuuaaaaauguagcuaaaaaaaauucuuaccucccagacuguacaaacacauggccauagguugacaaaccuaccuuagaguacaguuaugaauuaguaacucagguacacuaaaaaucauguuugagauaggauacaugaagaggggcaagaacagaacagaagccucuguuaauuaacauaauaaagaguuucaggucucaaggguaagaaugugagcuagacuuccaucaacuaguccucuucuuuaguauuaaauuucaaguuugaaaaauauugauuuaaauaaaaguagucauauuaaguuuggaaucacuuuccuggaaugucuaaaauaacaacagcauuuagaacagugcccaaguucuugaagcuacuaauaugccacuucaagaacacuaucagaagaaaacaugaaguaccugaaauagaauaaugauaaagacaaaucgcauauaguacauacucuguauaaacuucuaggucuucauuaguuuuagcuuaaaaagguucaaccacacauuuacugugugauuaaaaauuacagcagcaaauauguacauuuuagcaaauuuaaacuuuaacaaucuucccucauuuuucaagaagcuaaucuuuuacauuuucaaaugaacugaaauaccaacuuaauauuuagcaaacucuaaaaacaucaacuggcaacucucucuccucucuuucucucucucucucucucugucucucucucucugucucucccugucucucucccugucucucucucucucugucucucucucucucucugucucucccugucucucucccugucucucucucucucucugucucucccugucucucucccugucucucucucucucucucugucucucccugucucucucucucccugucucucucucucucccugucucucucucucccugucucucucucccugucucucucucucucugucucucucucugucucucucucucucucugucucucucucucucucucucccucucucucucucccucucucucucucucccucucucucccucucucucccucucucucucucucccucucucccucccucucccucucccucucccucucccucucccucucucucucucucucucucucucucucucucucucucucucucucucucucucauugugagacaggguuucucuguguagccuuggcuguccuagaacucacucuguagaccaggcuggccuggaacucagaaauccgccugucucugccucccaagugcugggauuaaaggcgugccccaccaccacccagcugauuugauuuuagguuucaagauguggucaaacuagaucagcuggcuaaaagacuaaaaauacucccaguuauuuuacaguauacugauugagauguggagacucuuaaacacucugcacuacagcacugacauggcagacugggagaucauuaccguuucugaacaaccucccuuaaguaaagaaacgugucauagcucccugcuguguuaguauucaagauuauuuuaacugcauagggauauauuguaacucucaaacuuaucacuagcuccaaugaaauuuauugcuaguuacagcuauuuuaaaauggcuccauuaguagauaggacaccauuucaauguucaaauuuagcauuucauuaaaaacaaaaaaugucugccccaagaauucauucuccagcccggcggagguggcgcccgccuuuaaucccagcacuugggaggcagagacagguggauuucugaguucaagggcagccuggucugcaaagugaguuucaggauagccagggcuacacagagaaacccugucucgaaaaaccaaaaaaaaaaaaaaaaaaaaaaaaaaaggaauccauucuccacuuuguucccuuguuuuacaguaaugacuaaagcaggggguucucagcgcuccugauaagcccacccuuuagcacaguaccucaugcagugaugaucccaacccuaugauuauuguugcuacuucauaauguaauuuugcuacuguuauaaaucauaaugcaaauaucggagcguucccccgggggucgcggcccacagauugagagccauuccucuaacaacucggucaggagugccuuuauacacauaugugggggagggcagcuuagguaugauccuuaaauaaacgucuuggaauuucuacgaaaagugacugcaacucauaaaacagcuuuuggcuacguuauaucaaaaauuuaagagccagacuagguaacugagguucuccauggauuuggguaugaauauuuaaaugugacauuuaaaaaaacacacaugguacagucaauuucauauagauguuaccaaauacagaacucuauaguucccaucuuuuuaaaaugaauuacugagaaaaaaaaaauuuaagcuaagcaaaggcuuuaaggaugauaucacuaagggcuuacacacacaggcucacacacucuugcaugccacacacaaaagaaacagacuuacacuucaaguccauuaaaguuuacccuaagauugugccgaaggcacacaaagauuuccaaaugcagagggggaaaaaaaaucccuagguacacauuuaguauacaaaagcaaucaaagguccauccggcagacacuuugagaaaauguuucaagacuucaagucugaaguccacuggaaucuugauuuauucguuacucucgaggcuagguuguuuucucccaacauacuucauugggauaacuaaagcauuuacaaauaaacuagucagucucaauuugaaguacaccuuccuuuucauuaaaaguucaggaucucuuaaggacuggacgcauagugagaucacauuacaguacucgggaagaacauuugcuuuguuguugacccugcuagggaaacaggucuugacucagccaaaguggcguucuugugggugauuaaugacaggccuacaacucgccccagugacauccaucccccuccaaaccccaccccuucuauacuaaaaccagccaagucuaaaauggaggaggggcugccuucucgccucaaaccacucagucacugaguuaauagcugcaaccaaucgauucagcccaagagacccggagauucgggugaaaugugacccuucucucgccugacuuaugaauaauaucacccucucugaucauuuccgcuggggcucuacauaaggaaacgauucuagggaucuagccccaaaugaucugccucacaaugagggacccccacaaugccggccaacccgacucguacccacccaaccugccgacaccacccccaccucgguucaggcccuuccuucccuuuguguccgcacccaagcucccggccgcagcccaccccggcagccccggggccgaggcccaccuguggugagccgggaagagacgucgccgaagggggaaggcuccauccggagauacuucugcggcgaggcggccgcggccgaggcggcggcggcggcgguggcggcggcaggggaggcggcagccgaagccggcgccgacaaaggcgcgcaccgccuccgcuucggagaugcggggcucagcagcgggucgaaauccagaguccuuuucagaguggcuccgcacgccaugguggcgggcggccgaggcucggcucgggcggggccgggaaggacgggggcaaacgggcccuccgaggugcccgguggguguggggcccgggacggcggagccgcgacagggcaggcgggcgaggcgcgagggucgcgccgccggcucggggccgcucccgagaggccgggccgcccccgccgugcgcucgggcugagcgcgccggggcuccugcgcggagacccgcucccuucggaaguggacccggccaguggcgcgacccagacgcgaucuccgacacgccggugcagacggaagcucgugaguggcggccacgcgcgggagcugcgagguagcccggccguacagagcuaagcaaugcacucgacccucucuucuccacggaacaacucugccacccgccgccggccccaauauggcgucaauaaca

SEQ ID NO: 1822 - RNA, 47730 nt, Mus musculus
cugcuuccgccagggcgcgcggaaguguggagugcgcaugcacacggggccgcggacuauggccaccuccuccgugucuaagguacguggggguggcgcucgccucagauucgcggugccuguuuggcaaguccgacgagguuugaugggcaucagcucuggcuccgcggagaacaggacucgggcggcuuugcccagguccggguucgaggcaagcuuugcucugggcaacuaggccauggcgccaaggcuaggagagcggcugcccccagaaugugcugcguccugccgcuucccccacucuucccccuccauaaauucacacugugcuuuaaguuaccgagaugcagauggaggcaaaaauagauuucuguucccagaaauacucauaagcagcugaucuugaauuggcucauuagcaaggagaaaaguucuaagagaggagggacgaaccaagguuucugggagaccgaggaaauucuuggagaaagugacaguuuggcuaaggucugaaaaauaagaaucuuggcaaaauauaaagcauuaguuugggagagcagaauaagauggucuuugccuuagaauguagaaauaaaagagcguauuaaguaaaaagagcaguuuaacccgugaguggagagaggagcauuaggaaaaaccagaauaaaaauguaauucagaugaguguuuugagggguuguggacuacucgauggcaaaggagugcuagucaaauuguaguuuguaagaggagaaauccuaggcuuguauugcccccuaggagccuguggcuacaucuggaauuaagauaacuuaaaauuaaguuuaccauuagcaaccauauuucaagaauaucaaacagggcagcagauggaaaagaaaggucuauuggucugugcugcuaugccuuguaaaguaagacuugacuccuguucuaagaacagaaggacacuccugaaggaagcugaaauaacagacuucugaaagguuucguaauuggggcuacaggggaacacugaagugggcugucuucuuuuauaacaggucuguuaggggugauguuaacaucagaaucaggcaggcaggcaagcaggcaggcaggcagcaacacagcagagccagugaagggaacucuggcccacggggcagagugagaccccuucaguguuuuuacggggugaacccgcuggaggacauugaaaugcucucugguuuuggcgcacagcccacuagguuguugcuggagguaagcagcgaaugacuccucaguuugugaaguuuaggugauagauauacacuuuuucuaacugggcauuccugaggggagauggagcagggaagacaaggauauaaaggcaagucauuuuaguccaagaaacgcaacugccgcuuaaagaaauugucacaguucaacagaaauggagacacuuuacacaugguacgguucuggcugaggguuaagacauuugagaaguguguuagugaugaaagguaacggugcaccagacauuuaauuuugauuaaaauggucaaugacaagcaguacccccaaagacuacauuucaaagagaacaaacacugugguuuaauuaauuuuuuggaggcauguucucucgaugugccuuuaucgguuugcaacucuauauguagaucaggcugaacuugaacucuccugccuuccugagccugccaagugcuaggauuaagggugugcaccaccauacccaguuccuaguuaaagacuuuugugguuuuuuuagcuuuauuccuauuuuuauuuuuccuuggcuacaaaguuccagauguuuugagugcccuaacuccuaauccuguuuguugcuuaagacuucauugcguucucuuuucugguggugaauguaacaauguggacuuugugcacacuacacaaaagcuuuaccacagcugcuucuccagcccuuccagagaaggagaauuuuuuuuuuuuuucaaaaagccaucauuucuauaaaacuuggagaugauaguuuuuucagaaaagcacuuuucuuuuugcccuaauagaaauaucuguguugauaaucaugaaagaaauauuauauaaauaagaaccuuuaaggacaauuuccagaauucauggaacugccaacguuuuaauuuauuuuccuccuuaaacauaucaaguauuguuggggguuuuuuuugucauauuuuuuggcugaugguuaaggugguuagccacauuacuguucauuaauguuuguugcuuauauucauauccuugugcuaauauuuguuauacuacuauccauucuauaacuggcuguaacguguauauggaaagaaugcaguaauaagcuugucaugcuaccaugcacuuguuagaaauacguacaaguaauucauagaccuuuacuaguugcaaauguaagaccaugagguacagcuuaauuuggaacauguaacccacguggcuacuuuauauuuugcaaagcuguuuaacaguagucugagaugaucuuuuuuuuuugucauauuuuacuucucguaauauuucauuuucuuuuuuuuaaagauuuauuuauuuauuauauguaaguacacuguagcugucuucagacacaccagaagaggccgucagaucucauuacgggugguugugagcuaccaugugguugcugugauuugaacucagaaccuuuggaagagcagucagugcucuuauccauugagccaucucgccagcccaaucuuucauuuucuauauaaauagaggucuuaagagacuguccaugaaauguaacuuucauuuuggcagaauacacugcagcuaaaaaauuaggagcuaaguuucaguggucacaaauaauaauagcaaacuuaauguaguuggaaaauuaccaggaaaauuacuuagcaaguauuuauucauucuguguacuggucaccuaauauauuuauuuauuaguacauuauaaacauugaggaggugguuauauauaaaauacaucugugcuguaagugugcucacaaauuaccaggaagauaaagcaaagauguuugaguccugagaucucaggagaagcauuucuggcaagagaguccaggagggucuccugagaagacgagggcuugguuuauuuugauuugguuugguuguauagccaggcuagacacaaacucauguaagggauuuucugucuccacagguacuaagauugcaagugucuaaaccaugccuagguuuucuaacuguauaaagcaggcuagccucaaucauaacaguucucuugucuugaguggauuacagaugugagcgaugaguuuugagccaaacuguaauggauaaauggaaaggagcuuauuaauugagaaaaggugucagaugaaacauccugguuguagauacuuagaguuaauuaggcaaaaaauccucuuggaaugaguguuuuuaacuuaauccauuuuaaugcacaucauuaauguuuaugaaacuugaacuuuaaaaaaaaaaaggucuaucucuuacuuagaauggguccuaaaaagugugagaacuuaugauugaggaggaugaaauugaugaauuuuucaagacuauuccacuucuguauuucuauucuuucuuuucuuuuuuuuaaaaagauuuauuauuauacauacguacacuguaacugucuucagacgcaccagaagagggcaucagauuucauggaugguugugagccugagauuugaacucaugaccuuuggaagagcuauaucucccacuccaguuccccuuuaaagaacuugcuuguugauagaguauguggguaauuaaaucugccugcucuguaccuaauuugacuuuaugcuuuauuccuccuucccucccuucuuuuuuaaacagggcugcuuuguguuuaaaccagacuucaaaaaaagaaaggucuuugugccaauagguaaaguauccuaacauccaauuuguuuauuuuucuuccccuagaucuuuuuauuucuuuuaagauuuauuuauuuauuauauguaaguacacuguagcugucuucagacaccucagaagagggcgucagaucucauuacggaugguugugagcagccaugugguugcuggaauuugaacucaggaccuuuggaagagcagucagugcucuuaacugcugagccaucucuccagcccccaccccaucuucuuaaacuuaagugauaauaaguaacuuucuuuaauguuggagaugauucaguguaccaggaguaguuuaaagaaaagguuauuccuucauuauauaugaaagacacauaccauacaaugacaucugaaaccacaauauaacaauauagcaauauaauuauaacaaauaaauuugguaguauauuaaagcaauuauuaugugcugaacuguucuaagcacuuuaguuuguuuaaucucagcuaacuguggggaguguaguauuauuuccauuaauauauaugagaauuccugacaauagaaagacuucucucagucuuacagugcuguaaacaucagagugaggauuugaacccauccgcugugacuuugacccgugcucuaaccguugcuguaugauacacucuuuuaaugugaggcaaauguuuacauagaacuuuauauuggguugcagugauaacauaaaguuuauuuacaguuuguaauaucaacaugucauguguacaguauaauuugaacauuguuuuagaacuguuaauuuuucuuucauugugcuggcuuaagauuaauguuuuauuccagacaaaaguguuuaggaauugacugauugaaagaaauggcaugagggaaauaaaucccacuuuuuagcaguuaccuucaccuuuaauauuugaagcaguuugauuggagaagggguaugguuuauguuuugcccaccauauaucccugacuugaagauauguagauauaucccuaagcaaacacugguaaauucucccaccugauaguguauuauggaagacugcacacguaacaacacaguugguagaacuugguaaaaaauugagaagagagccuggcagcuguguggcagggcugaacauacacacugacauagaagcugagcugagggggaagccuggauagcaguguccaucugcagcucuucucgcuguugcucacugugaccugacuucaaggaccgagagaagugaugcccauaggcugguguccugcuggugccuucccagcuucgaggaucaucuucacuguguacuuuggcuguggcaacucaacaugugaacucaugccuuaguuugcuacugaacauuuuaucaccauccuacccaccaauagaauacagugacuuuuuucuguuuaaggcaaacuuuugcuuuaucuuuuacaaucucucuuuuuuuuuuuuugcaucuuaauauaauaacuuugccaucuugauauuuuaauggcaaaacuaagacacuugugaaaacuaagucagcucuuauaaggaggaacauguauucuagauuaccaacaaaaggcguagcacuuccaauaggaugccggagugaaaguucugucuuauaaaaagaagcaaacauuggagugaaauacugauuggcagaaaguaggaaauggugaggaacauaagaugugagugaaggaacaagguacuacuguuuuaaaguaugcuuuuaaaauaaauacaucuaguuauguaggaccugugcugucuucaaacuuugaguacuuuugcugaaugcaggccuuuauauuugucuuuggccugcauaugaauuuuuauaaccauuaaauuuuuuuuucuuuuuaccagcucagucuaugcauuugacuuaaugcaguuacucugccaguguuaauuauuuugagaagugccaagaugacuauucauuuccuagcaugaggguuuuguuugguuguugugggaucuuuuguuuuuaauguguguauuuugccucugagaguacguccauugugugcauuccgggucgcugcugcagaggccugaggaucguaacagcuacccuggaaguguagcugcagguggcugagcacggugugccugcugggccaacucaagcccagacccucugcaagagaagcaaguguguuagcugccgcaccgcuucucuagcccgucuguacucuagauucuguuugaauccaagaggaaaauuccuugguggcuguaggaugagaauugguauggaaauaaaacugaacaauagaacaaaguucccaaacugauguucaacuaagagaacaucugagaugaacaggagguaggguagucaacauauaaauacauuucugcuguguccaaauuggaggccccaacccauugcacguuaugcagucacuuuaguaaacugugaaauagaacacauuugcuguuagaggauaagaguaacaguuguuuucugggacuuuuguuuuuaugucuacuggaaauauauucguuaaauuuucaaaauaauauauuccuugauacacauuuuuuucagaauuauugcaauaaggauauuuugacagaaaggcugacaggagagaacaguuuuaaaacuauauaaaguaauacauauuagggcagagauaauucucaacuguuaggagcauuggcugcuuuuguagagaacugggguugauucccaggccccacaagcagcucacaacuaucuguuguuagguccagucaaggggauucaacacucucuucugccuuccuuggcagugcaugcaccuuuuaauaggauugaauucuaaaaaagaaagggucuggugagaugguguagcaguuaagagcacuggcuucucuucugacgguccugaguucacuuaccagcauccacaugguggcucauguccaccuauaaagggaucugauguccucuucuggcaugcagguguucaugcagacagagcacucauacauaaaaaaauuaaauggaaaaaaaggccauggugguggcucauaccuuuaaucccaauauuugggaggcagagguagacagaucucuaaguuugaggccagccuccucuacauagugaguugcaggauagucaggauuaccuauacagagaaacccugucuugaaaagcuagaggggggcaggaggggaaggguuggggaggggaagagaggagaagagagaagaaaagacaaaaaagaaaguaauacuuauuaaaucaaaggcuggaguaaacuauuaggacaaaaaaguaugaaaaauuauuugauaaaguuaaagaugguauggaugaaaacauugauguuuaccuugaacugaaagucagcaagucaaugcuuagagauucuuaguaagaaauagaacucuaaaauuuuaaauguccuuuauauuaugguaaaaauugagauuuaaaauuaaauacaaaugauaaacuauauuguuuuucuccaaauguaaaggagacauguauauguagauacauaguuuuuggaugcauagaggcauagaaaauguuuugagcagaggcaggcggauuucugaguucgaggccagccugguuuacagagugaguuccuggacagccagggcgauacagugaaaccuugucucgaaaaaaccaaaacaaacaaacaaacaaaaaaaaaaaccccaaaaaaagaaaaaaaaaaagaaaauguuuuaauccccucucccaugcuguuugucucuauguacagucucuuaauuuuauuguguuaaaaaaacuugacuuucuggguuuuuuuuuuuuuagaggauuauuuuaauaaugaggaacuugacucugaggacaguaaacuucgauuugaaacauauagcuugcuauggcaacggaugaaaucugaaacagaggugaauaauuuccuuuuuacauuucuguaauaaaauaguaugagucuuguauuuacuucucauaucuaaugauguauaagaguauauauagaaaaugagaaaguacaaucaaacacagccuauauaccacaaguaaaacaugugucauguucuaaaguuauguauggccuucgucgcugcaacaugaucauuucuaagaaaaaaaaaaaaucacuguggugaacucuuaaauucaguuaagagguuacacaagucugaaaugaagccauuucgaaauuugugcuagcauccaauuuuugcuguguuuugguuugcuucuugagacauagucuuaagcucagguuggccuagagcuuacugcauauuggcugugaauaucgucaguauaguaauggcagcagcuccagugccagccgcucguucggcuuaagcgacgcgaugcuauagugucuuguuuuugaaugagaguugcacacaauuuuuaugugggugcuaggaauuccaacuuaggucuuucugcuugcacagcgugcacgcuuacccacgaggcauuuuuccagugcacccgcuguccagucucuuagugcuucccaucugucuuuacuacuuuacacuccacagaagagggcauugaauucacugugguuggaguuaacaaggagggaacugagcuccagcccucugcugaaacacuguacacaagcucuugucuaggcuucuuaaccuagguuacagaugcauucuaauggugguuaucugggagacugucugcauaaugaggccaucuuugguagcuagguauccuucacucucacaguccuguagcuugguguccuuaucccucccugccuuaauccccaaacuucaaccugucccauuaacuuuacccacaguuuuuuucugauugucacuuucagcuauuuugcccuuuuauucccucucaauacacugugugcuugcucacugugugucaagauaugugugcaugucccauucuguccccuuccaauacauuguuucugcuuguuguguguuaauacagucuauagguuucccccucuucucuucccuuucaauacaguuugugcuggccauuguguguugauaucuguggggauuuuuuuuuuuuuuuuugaguuuuugaguuuuugaguuuuuugagacaggguuucucuguguagcccuggcuguccuggaacucacuuuguagaccaagcuggccucgaacucagaaauccgccugucucugccucccaagugcugggauuaaaggcaugcgccaccacugccuggcaucugugggguuuuuuacccgguugcucuauugcugcuuuaucucaucaacuaaaauuacugaacauucaaagggaaaagaaaaauuaaaaacuacaccaggaaagaaaagaaauacaacuacuaauaacucaugaaauuuuguuuucuuugcagcaauuacaggaggaauuaaaugaaaaucuguuugauaaccuaguugacuuucugcagaagucccauccugaauuccagaaaaauucaagagacuggggcucucaaaugaaauucagagaaauuccaacagcugcucuuauucuugguauguaugcauaucugugcauauuuuuuaaacugguuuugcuauugauacuaguggaaaauaucuuguuaugauaaaacuccuacaaauuaaaacaacugugauuugacuuacauacuuuguaaauguuuauuauauauucagguaucuguagauaaaaagaaauugaccuagcuacauuacuaguagaagaacugaggaaaacuacaauuguuuuuuuagucuucuuccuguguguuuuuaggguaaugacauuugaauucaauaauaaaacaguaguguguuaguggauuuaauuauuucuacuuucuuaaaacaaucauaucuucaaugaaauuuauaauacuuauuucuugcacuugaaaucuuaauucagauucuuuuaacauuaauugcauagagaagaauuuguauaaauuguauauaaauuacuuccagauuauguuauaauuuuuuaaaauauucaucaauaauaucuaauuuagagcaagcauauuucaggauaauacaaaauaucugauuuauuaacaguaguuuuuucagguuaccaagaaaaccagaauaaauaagacaaagaaaaagcacaacauguagacacaaaaguacaagaucaaaauauauacucaaaagaccauuaagaccaaaaaaaugccuaaacacaucaauaugagacaaaaagucucagaaguccuacugaguucauuuuuuggaggccaucuacugcuggcuguggggccuacccucaagggugguuaacaugcccaaugagacgccacugaagaaaacuaacuuuucuucugggggguguguguaugaauauuaaacguuucucuauagcuuuauuccccccccccccuuuuaauggguauuuucuuuauuuacauuucaaauguuauccccuuuccugguuacccccuucccagaaaccccauuucccagcucccuucucccugcuucuaugaggguguuucuccacucacccacccacucugucuucccugcacucaauuccccuauacuggggcaucuagcaagccuucauaggaccaaggaccucuccucccauugcuacauaggcagcuggagccauguguacuccuagguugguggcauagucccugggagcucugaaucaucuggcugguucauauuguuguucuuccuguaggguugcaaaccucuucagcuccuucaguccuuucucuaacuccuccauuggggacccugugcucaagcauccaccucuguauuugucaggcucuggcagggccucucaggagacagccauaucaggcuccugucagcaagcacuuggcauccacaauagugucagaguuuggugaauguauauggcauggaucuccagacaacuaacuuuucuuugcacauggguacuucuugcacauagcuucuuagcuaggguuggaagccuaugacucauuaccaccucuaccucucaguauuggggcccugucugguuugaaccugaucuacuacuacaaucucugugagaugcauguggcagucuuguguuagaaagucauuguuuccuugguauuauuuaucuccucuggcucuuacagucucucugccuccucuucugcaugcuuauugagccauuuaauauugaguguuccaaaaucucucacaaugcacauugucugcuugugggucugggucucuauaauaggcccccucuacagcaauaggaaacuucuuggaugaugagugagcaaggcacugauaggaaucuguuuauuauugcauuuagcagaacaguaaguaguauuugguuaucuuuuugacauaauggccuaucuguuuucaagaucuucuaagauaguagguaguuacucucauguuugugccaccauugcaacagcauaucuuucagguaaggcaaccgaccuagauaggauuuguagcuggaccuuucucuaggagcauacagaguaccuucaagaagucucuaguuagacaucagcuugacuuccuaaaaguguuuuguucagcaauagaaccuuacugucauucuguagagagcaaccaauaaauagccuuggcaggagccugaguuguuugggagucucuuaguuacuguuuguuuuguuuuggugaaaaagcaccaugaccaaagcaacuuauaaaagaaagcauuuggcugagagcuucccuacaguuucagaggauuaguccauagucaucauggcaggaggcaucuuguuggaacaggaacuagcugagagcuuaaauucugauccaaggaggcggcagaacgaaggcgccuggcucugguguuggauuuugaaguaucaaagcaaacccccgguaaccagugacacaucuacucuacaaagccguaccccagauccuuccuaaacagucugccaacugaaaaucaaacaucgagacaugugggucuuuggggccugucuuagucaggguuucuauuccuaaacaaaaaaacaucaugaccaagaagcaaguuggggaggaaaggguuuauucggcuuacacuuccauaccaaaggaagucaggacuggaacucaagcaggucaggaagcaggagcugaugcagaggucaugaagggauguuucuuacuggcuugcucccucuggcuugcucagccugcucucuuauagaaccaagacuaccaguccagagaugguaccacccacuaggggaccuccccccuucaucacuaauugagaaaaugccuugcagcuggaucucauggaggcauuuucucaacugaagcuccuuucucugugguaacuccagccugugucaaguugacacaaaaccagccaguacagggcccauuuuuauucaaaccauuacaguuuccauggggccauuuuggccaauaacucacauaaauuuagccuauuccugccacuggauguuucacuugguggcaagagacauguagcuggaacucuggucuuauuguuugguuauugcguuuagacuucuuccaaauauguauauauuguaagaagcuuuuuacaguaguggguuuccagaugacugcucaaauggcacuuaguguuaguugacuccccccgcccccaaucuucccuucuucauccuucucuccuucacuccacauguaauccuuucccugcagucacucccaugccuccccauaagucuucauucugucucuccuuccugguggggaugggcuagaaggaagaguuaagagggcccaugcaucaggguuugguggcaucccuagggaauggagguagugugugaggagaggcaucugcaaggaggcggcuacagggcuggaggcgagucugaguaaggucaggaaggagagucuuuuuguccuuguuuaaauaaugugugguguugggaaugagaccaggagcuuuaugcaugcucagcaucuacccucccauugagccacaccugguuuacguuuuuucauucugaaaauaaaauagaaauuaguaguguuccaaacauguuguauugauuuugcuuccaauauguuauuuuuuuguuuguauauuuguuuuguuuuugacaaggucucacuguguagccuugguuagcucagaaucuucuauguagaccauacuggucucaaauccauagagaucugccuacuucugccuccuuagugcugagauuaaaguaugcuaucacacuuggcccccaacuuguuacuucuuuagaguuuguuaacacugggcucuaguauuuaacguuuuaauuccuuuuaaauucuauuuuuaauacccuaagucuucuacugauauuuaggacauauuuuaaauuguacuugaugauaguguguaauguuuugggguagggauguauaggaucccacuguccaaaaacucaaaaagcagcuacuucaugccuggcacuugacuuuuuauuuguagccucuagugacuuaggguggcauuacccucuccccugcccaggauagagcagcucuauugaaacuuuuucucucugaauauaaauacguuuuagaaaguuucuacaguaguagaaaccauggccuuacaccauaguccuuaugcaccuguccccauccuccuuccuucccagccccauaccauuuaucccuuccuccguuauuccccucccccauucauagcaucugcaucugucccccuuuccugaaccacuccuucccauguccucuuacuaguuuucugccgucugugguuacuccaguuuaaaugaacauaucuaaaaauuuaaagcugcaucacauaugggagagaacaugaaacacuuugucuaucacggucugggugaccucacucagaguuauuacuuccagcuucauccauuuaccuguggauuucauauguuuauuuuuaaguagcugaaugauacuacauuguguauaugaaccacacugccauuauucauucaucauuaauggacaucuagguucuuuuuguugcuuuugugagugaagcaacaaugaacauggacgaacaggguucucugcaguaugagccagacagaguccuuugggaggaaucuaacuagaucgugugcuaaauccauucccagccuguugaggaacgccaguguugacuugcauuguggcuccaguuugcucucccaccagcacggcguaacuauuucucuuucccacauccacuugcauuucugaucauuucaaaaucauuuuaauuugcauuucuccaauagcuaaagguguuaaacauuuuaaaaaauaccuccuggcuauugauauuuacuuugagaacucaacauuuaguucuguuccucaauuuugaguuuagguugguugcuuuaaugcuuaguucuuacagauccuaguuacuaacccucuguuagauuuauagccgaugaagacuuuccauucuguaggccgcgucuucaugugaaugaugguguccugacuguguacaaguuuuuuaguauuuugagguccaauuucucaagaguuggucuuaguauugguaccagggucuuuuuuagaaaguccuuuucauguuauaagugcauuccuuacuuccucuccugucaggucuauguuuaggcccuugggccauuuggaguugaguuuuguguaagaugaaagauaagaaucuauuuguagaaccaagagauugcuuuuggucggguggccauuuucacaguauuaaaggucugucaauauaggaggucuuucugucuuuugguaucuucuuugguuuccuaaaauuuucauuguacaaguuuuuuacuuccuugauuaaacuaauacuaagauuguuauucauguaguuauuuugaggcaacugugaaugucugagaaugaucauuggucauguauaggaagagugcugauuuauguuuguuauguuuguauccugcuucuucacugacuguguucaucagcuguugcaauguccuguaaggguccucaggguuuuaccuauacagaaucauaccaucaauaacaauauuuuggcuuuuuccuucccuguugaugucaugauuaucaccuucccuugucaucucagcccgaaugggcugugggcuagucaggaaguaaacuguaucuccuuccuuuagauccccgacugagaggagccagguguggugcagucuucuugauuucuauugcaaauccuguuuuuaaauuguucuuaccuggugcucuacuuguucucuaaaauccgcauugcuaaguuguuaaugauggugauuacaugauaguguuuauuaucucacaggugugaaugucacggaucaugaugugauacucagaagucuaacagagacccuucagaauaaugucacaccauauguagucucacugcaagcuaaggauugucccgguaacguagaaaugcucaccucuuaccccucccccacacuuugugcaugucucacucauuucuacucauucucuuaaaucuauguuuuucccacuugaaaaggccauuggugguuaaacaguaguccauaugcagagccagacuugaguguauaaacgguuccaucaugaagcacacacaguaugugacucagacuugugugcauauaaagccgucauaguauaagcugugcacacggucacacucagcuuuguugccagcuggacugagaauagaauuaauguacuuugguucugacgaauuacaauuaauaucucaaggaugucuuuuaaaaaugauugcaaaugaagauuuauaaucaguaagauaauacauauaacuuucauuuuuaaggaccaugacauucuuuuguugucaaaauaauguaaauauaugauauucuaaaaauacuguauaauuuucugccuauauauuuucuuagauaauacuuguagauaauauacauuuugaucugaucuuaguaugaacuagugaaauauacucauuuauuuuaucuuauuuagaaagggucuccuguaagccauagaggcauugagucuaccauagagcagaagaugaccugaacuucagauccuccugucuucagggauuuuaggcauaccugaccacauuugugcuuauuuaguucugggugucaacuuuaggacuuugugcaugcuaggcaaguacacuaucaauugaauguguccaacacuaacaaaauugaauauuaaggacaggguacuaauguguaaugguaguauacuuagcauauuuuuaacuguauugaugaaauauagaaaaauauacuccacguuaaguauugcaaucugcuaaucaaagguuucaauggcuuuaauuuugucuuaaagauggagguaaguuuccuugcuuuuuauauucugcagaugugaaacauuuuuuacaaaaguuuaccucacaguugauggacugcuguguagacaggcauuccaaggaggugacaagugguaaggcccugaagaagacaaauuauucaauggauucccuuuguaguugguauucggcagucacacagguaaaggaaacugacuauccgguuaguuggcucgcaauuacuuuacuuacagcucucugcuaagaagcauguuuaugaggcaaucauagcacuuugacgguagcuauuuuuucugaagcuacuagaauuugaaaauauucuaauauguagacuaauuccugguaagugcuuggauucuuacgaggacauuguauuugugggagaguuccauguaaugacaagaaaacaucugaaguugguucugcuacagauuguauuuugguaguaaugacuguaacuucccuauauuacuacugguaguguucaggauuucuuuuuguucaggagacacauaccaccuuuucaugcgucagcuuauuccuugaguaauucuauaauuuuuaaaauuuaguuugauccaugcuuggaaaucuuggggaaauguuacaguauaaauaagguauauugaacaaaacaguauuuuauaaguaaaguauauucaagacaauuauaaauuuccuucuacuaugaccaucucuauuacaaaugaaugacacagaggccccugaacuccugagguacaaccauagucccaguuauauugcugggucaccagacagcaugaguacugggugacauuuucuauucaguguuuuuguugaaaucauacauaugauuuuauuuugcuuuuuauaaggaugcuuauaauaauaccuuaauuugauguaaauuuuagauuuuuuuaggaauuaaagucuuugcaauuuaaguccauuaucuuuaaguuugauuugaucaaguauuuaagguccauuucaagauugaaaguuuguaauauguaauaguacauucaguguguuuuuacaucgacgauacaacuuauguuagugcauaaauguguaucaacugaaaaaauuaguuguauagaaaagugucuuuuuucuauguuuuucaguagaaaaucccuuugauauuuguuguauaggucuuucugaaccuuuuucuuaguguuaaccaugucuagaaacagauuuugcuaaaguaacuguuagaaugaacuacuauuuucauuugggaaaaauaacaguuacuguaaaauauaaagaacuacguuaacaaguggcauuguaguauguuugacugggaaggcuuacuuuuaaucccuccguuucacauugguuuaaaagaaagcagaccacaaagugacaaucaaaaagaggacagcaucuggccauuggcgguccccuccuguggugcuuaucuuaaagagcauggagaguuucaccagcaaaguccuccaagacuucauaacuaucagcagguagcucggccggcccauuuauagugcagucgucuucuuuuucauuuucauuuauuccuguguguauggaaguggcuguggaugugcugguguuugugccaugguauauguguggagguuagaggucagcuuuguaggccuccaaucaaauuuaggagcagauacccauaaggcauuucauacauuugguuuugccugaccuuucccuuucucucacucccugccuccaucccugcuuaaacgcuuccuaacacgugacuguuggcuuuuaggcaaaauuuccuuuuucuuguuugguuuuucgagacagggucucucugcauagcccuggcuguccuggaacucacucuguagaccaggcuggccucaaacucagaaauccaccugccucugccucccgagugcugggauuaaaggugugcaccaccacugcccggcuuccuuuuucuuaagacauuacuuuuaucuuagaaaaaaauaguguucauuuuaagaccaacuuaaugaaauucaaaaucugaauucagauuuuuguaacugaaucuucaaagaucuccuagcaaacuauuuucuugguuuuugauaaaauguugaacaucuaagacagguucauccuguuuuuaguuaacauauguaauuuagguaaauagguauaaaaugucauuuauuaagaguugucuugagccaggugugguggugcacgcauuuaaucccagcacuugggaggcagaggcaggcggauuucugaguucgcagccagccuggucuacaaagugaguuccaggacagccagggcuacacagagaaacccugucucgaaaaaccaagcaaacaaaagaguugucuccuugccugucuguuaaauugauaauccucuaagcuguaauauucugucaugccuuuuuuucuuucugaguuuuaucuuuagaggcucuguguuccauauauguuaacuugcuaaaaauguuuucuguaugauguuaucuuauuuuuauauaauauuuccagugaguauuauuuuaauguaagaguuuuuuaaagcaaucuuaugagacuuaaaauugaaguaacuaggccuauguuacaucccuuugaaauuuguuuccaauguauauuuguuaggguauaguuaacuuucuuuugcauauucuguauaucaacuaacauacuagacauucuuaucuugagugggguuguauagggauuuuugccccauagauuuaugaguuguagauacacucaccaccaccauccauauuccagugcugggacuagaacccaggauugcaugaaugccugagcaaauucucuaccauugaaguguauccacaggagauuaugugcugcacgguguuuauguuauuuauuuaagcuagauuuuguaguacuauggcccucgaaaguaaaaacuuaggacaguuauaagagcguacagcauuuuauuucuaugacuagaaaagagcuccaugcagccaauucuggaaaacaauaagaaaugggagcgagugguaaaaugaucggccaugaugccaagaagugugacuugcagaagcccucacaaaugaugccauugcacucuagcaguagaagcccuuuguuucuguuugguuguguugaugugaaaucauguugaguauguuuaggauaaugauguaaggaaggaauacaaugcuucugagugauguucauuagaaagauaucuuacauauguauaaagggaaguaugugugaaaaggaaagcaggaauuugaugggaaaccauaaggaagacuacaugaggcucaaaguuggugggcuuauauucaaugcuaguugacacacuguuguauaacuuugguagucuaaucucagcaggagcauuuggucuuucuggaucucuauucuuauuuauaagaaaagcauucauuaauggcuugauuucaggauuagaaucuggaaagugauuauuuuauuauuauuaauauuuuuuauuuuuuaaaaaaugaaugaccuggaaaacuuaauauuguaaaauaauauauugaaauacacuugcugaagaagcuucuuuuguauuuucuuuuaaaacuagucagcaucugcaugaguuuccgcuaauucugauuuuugggaucgccacaucuccuguuauuauccaccgacugcuuccucauucagugucaucgcuguuguguguagaacuguuccagucucugucuugcgagcaacaccugacaguaguucuugauaagguaaaaagaaaaagugcuuaccaaugacagaguaaaaccaaagcuaccagacauauauuauguauaauaaaugauaccaauacauuuauuucuauguaucucagacuuuguucaacuuauguacauauuugaaugcucuuacucaauuaugguuagaauuauguuuucucuuugcauauaguugccuucucagauaaaaaauaagcuuuaugaaagcuacaaucauuuguauauauucauuguuguuuuuaugacuuaguugaagaauuuaggcuuuuaaaaagaaucaggggucaaaauacagcucacuaauagaguacuugucugcaguguaaagggaggcccuggaaaguaggaaguaaauacuaaugaguaauaagccacugacaguaauaaauaaaauuuuauagaauuuauaugcuucagaguauuaucagugugcuuugaucuuauauccuuguauaaaaugaucuaaagcuuucagguuuauuuugauuugauagguaugcguguuaguccacauauauauaugugcaccacauucaugcaguacuguggaggucagaagaggguguuggaucucuacaacuggaguuacagaugguugugagccaucuuguaggugcagacaaugacccacaguccucuggaaaagcagccagggcuauuaacuucugacccaucucucuagccccaaaaguuuuuguggacuuugacaacugucauauugcucuugacaauagccacuaaacuuagacuauaacugcuauaauguuucuguguaauagcagcaugauuacuacugacugccacgcaaauccauucucaguuccauuaagaaacguuugugaugguuguauugcguaguaaugacaaccuguauguucaccuaugaacugcuacuacacuuugcuacacacagauagcaaucugauuuauugacauguuaggaaaaagucugucacuuugaaauuaauuauagucaaacgcaguugccuuuguguggcuauacuuuugguuaaaaaaaaaucugcuaguauaagguuugauuuucagauguuaagcaucacuguagaccauugaacacuaacuaaauacaaaauuucucuguauuuccaaaaagaaaaaucuucauuuuguguuuuuuuguuuuuuguuuuuuguuuuuguuuuuuguuuuuuguuuuuuguuuuuucgagacaggguuucucugugcagcccuggcuguccuggaacucaaucuguagaccaggcuggccucgaacucagaaaucagccugccuccucuaccucccaagugcugggauuaaaggcgugcaccaccacgcccggcuccauuuuguguuauuuuauaguacauagcuugcuacuuuuuacuaauuuggauuaguagggagaaaaaaauuuuaucugguaagaaaaugguacauuuuuugguaucuucuaguggaagacaaaggguuauauauuuaauaugcguuauuugaagauuaggaauuuaauggaaguuugguagacaacuuugauuuagaggguaguuugaggaugggaguggugguucuugagagagaaaggcaggcagaucucugauauauauuuuuuuuaauuucuacuuuuauuuuuauuuuuuggcuagauagccagucagagauagccagucagguuuagcggaugagacccucucucaaacaaacaggcauuguaauacaaauugcuuuuugguguuuucaacuuuaaauaaauacgguuuaugauuugguuggcauuugacuguagaaaaaaauauagcucugauugcuucauauuuauugugucacaguauaauuuuuagccuagcuauuuauuucauguucacgaggagggccgaccaagaacucugacuuccaucuugucucuuucagcuacuucuuacaccucaguuucccuuuaaacuaaguaaaaaggcauuacagguucugaccaacaucuuuuuguaucaugauuucucaauucaaagcuucaucaaaggaauuaagguaagaaaaucugaaauugaugaauuugaaagugugcugucuaauucuaauuaguuaacauuauuucagauugaguagugugauaacuaaggcauuuuaguagcaagauuuagaaaaaggaaauugcauuuuuuuucuagguuuuaccuuuccuuuauuaugcugaagucaccuauagaagacagaauuaggauugucaguaauggaugcauucuagcuagucuuaaccauugaguguggcagagagggaaaggacuuauuuuuguuuaggacuugaugaaauuguggugucuuuuuaccuaagaaaugccauuaaccuuugaugggccagagagguaacucuuuagcuuugugucuuggugucuuuuugaguugguuaaaugauaauauuaauuacuuuucuugacaacucccuaaguugucaaaguauagucauugugaguauauggcaguugucagugucauuaagacuuaugcguuuuaaccuuuauauguaaguuacauauguauauguuauaacguuuauguguaagugucaugguuuguauauucuuggaccagggcguggcaccauuuguagguguggccuuguuggaauaggugugacuugguuggaguaggugugacacuguggaugugggcuuaagacccucacccuaguugccuggaagucagucuuccacuagcagccuuuggaugaagauguagaacucucagcucugccugcaucaugccugccuggaugcugccaugcucccaccuugaugauaauggacugaacuucugaaccuguaagccagccccaauuaaauguugucuuuuguaagacuugccuuggucauggugucuguucgaaggaguaaaacuguaacuaagacagaaguugguaccaggagugggguauugcugugagaggccugaccaugcuuuuauuugaaagaauguggauuuuggaacuuuggauuuggaauacaguggaaugcuuuaaauggggcuuaaugggucaucauaguaggaauauggaagacuuuguugcugggaauaauuugaacuauguugaccuggcccaagagauuucaaaggagaagaauuucagaaugugguauaaagacuauuuuuaugguaucuuggugaagaaugugacaacuuuuugcucuugucugaaaagucugccugaggcuaaggugaagagacucagauuaauugcauugacaaaggaaguuucaaaaaagcccagcaaagacuuuguucucugguuaagucuuaugaagagaaguuugaacaagcauagcaagcuuagaaaggaaaaauauaaaauauauaguucuacucuuaaagggguaccaagaaguaaaauggagcaaaauccuguguucuaggagauaauagauuaaggguaugggaucuuggagcaagauccuacccagcuaaauuuagauccaggcauggugguacacacuuuuaaucccaggagacaggcaugcugaucucugcguucaaggucaaucuacagagcaagauccaggacagccagguuuaggcagugaaggagauggaaaacagaaagccagugauaauguaauaguacaaggggaucauuuucuaguuccugcaagcagcagaacuuggcagcuucagccauguggcucuggcucuagaguuaagaauagaagaaacuacugggacaauuuaugcuggguagcuggagcuaagaaauuagcagugauuaagaagagaccagcaucacugaggugaaaucugggaauuguuuucugggagcgcaaagaagcuguguuccagagauagccaaguuuguaccuggugcugcaguuggacuugguaauguguaagagucacccaggugguacugguuuugaaggcaugaagaugucaugaagaacagcugaggcuuggcauugugagaggucauggaaggccauuggagaaggugcagccucaguuguaguugauggcccaggacugaaggggucauacaaaagauuugagguguggcaacaugaagagaaccuaugaaaggcuauuggugaaguugaguuggaguggaacaccccaguguauuggagaugucaguaccauaggaugaucaccaagaacaacagccguaguggaguggaucaaccugagcuuagagugcuacagagggcagagcuggagaagugaugccagcccuuaagaggaguugaaaagaucaaguggaaucccagacacugaaacaagaagcuguaacauugaaauugccucggaaacucaaagauguuaaagaugccagagccaugggauacaugcugaggaaagcugcuaacagggaguggaaccagcccaggagaaaacaguuuguugcagucaacaaagaugaaaaaggaguggaaaucugaagaccgauuugauaucagucauggagaugcagaguuuggaguuugcccagcugguuuccugccuugcuuuggggauuacaguuaagugauuggaugaaucucagaagagaccuugaacuuuggacuuuuaacauuguugagacugcuauagacuguaaggacuuugaaaguuggacuaaauucauuuugcauuaugcuauguuuaaguaugccucccccccaccccagacucguguguuugaacaagucuaugggggccagggaguggaaugucaugguuuguauauucuuggaccagggaguggcaccauuuggagguguggccuuguuggaauagguaugaccugguuggcauagguaugucacuguggguaugggcuuaagacccucacccuaguugccuagaagucagucuuccaguagcagucuugggaugaagauguagaccucucagcuccuccugcaccaugccugccuggaugcugccaugcucccuugaugauaauagacugaacuucugaaccuguaauccagccccaauuaaauguuuuuuuuauaagacuugccuuggucauggugucuguucacagcaguaaaaacccuaacuaagacaauaaguuaaugugacaaccuucaucuuuuuauaguguuugaaacucauaaaauuuuuuuuuuuuuuuauuuuguuuugcuuuuugagauaggguuucucuguauagcccuggcuguccuggaacucucuuugugaacuaggcuggccuugaauuuagagacuuaccugccuuuuccucuugaguacugggauuaaauuugucugcuaccaccuccugacccaagauauccuuccauauguagucuuccugcauauaaucacagugguuugauucacugacuuuuuuuuuaaaaaggauuuuaaaucaagacagaauuuaccuuagcaauuuaugaaauuaaaugaaagaauaaccucuaaaauuuguucugccauucauuuuguuuauuuaugaaauacuggguacuuacauuaaggaaggcacugugcugagcccuagauguacagaagaaaaagaaaucugucuucaaaguguucauuguccaguagagguggcaagaaaguaaacccacaguuaaaauucugagucagccaugccagaaaaaaacauccuuagagguuuaugaaagaaaaaacaagaauaaggcaaguuucaagucaguauacuuaaagagguaauacagaucagagcagaaacaaaugaaauggagauuagaaacucuaggaagaggcaaaaguuguuucuuugaaaacauaagcucgauaagcucauagccaaacuaacuaccccaaaacgacuugagugaaauugagaggaaaaagauauacuguaacucauaccgcuggaauaauuaagaagaaaauaagaaaacuuaauuccagugaacuagaaaauagaaaaagauaaauaauuucuagaaccaacuaagcgaugaauaauaaguuauccaugaaggaaaggccuggaccacgcaguucuccugccagauauacuguggcuuuuaagaauaacuaauacugcuguuucucagacuacuccauaaaauaugagaauauuuaguaaagguaguauuaucuugacacuggcaccaggucaauacuuaaucacuacaucaaaaaaccuacauauugccgggugugguggcauauaccuuuaaucccagcacuugggaggcagaggcagauggauuucugaguucgaggccagccuggucuacaaagugaguuccaggacagccgggcuauacagagaaacccugucucgaaaaaacaaaaaaaacaaaaaaaaaaaaaaaacccaaccaaccaaccaaacaaaaagcaaaaaaaacccuacauauuaauuucugagguucauauagauucaaagauuaucaguaaacucacaacccaaaucaaucaacacaaagaucgaacaccgugacuaaauuggcucgauuucaaggcuacuaggaggcugguugcuacuguacaauuuaaugcaggcaauguaguacaucaguggacucagacagaaaccaugugacagucuuaauaggcacaaaaggggccuuugacaaguuggaauuauuuugccuaaaagauccaaggaaucuaggaauagaccaaaaaaaaaaaaaaaaaaaaaaaaaaaaaaaaaaaaaaaaaucacaguaaccuguagccucccaaauauuuuaaaauuuguuuauagaagagcauguugaauuauuaauccuguggagaaucauauuuucuacugacuagaaucuguuuucuccauugcuuaaggaacuagcuauucaguaacacugugugcuaguuaguuuuuguccauuugauguaaaguuaccugggaagaaaaccucaauugaggaaauuccuuccucacauuggcuucaucuuuguggcuuuuucuucauaguugauuauuggaaagucagccuucugugggucgugguauaagugcauaagaaaaguagcugacccugagccuaaaaacagauaguaagcgccguuucuccccaucccuacuucugcuccucagagagcugcugcccugacuucuccagguaucgcucuggggcugggguauauaagccaaauaaacccuuucuuggcaaaguugcuuuugauuauuguauuuauuagagaaacuagggauacagguuauccgggaaaaaaaaaaucagucuugagaaacaugcuuagaauuaaaaaaaaguuugauaaucuuauauuucaucuuauaaauuauaguagaauuuuaaaauaaauuaccuuaggagaugacagugaguacuuuaguagucagugugccuuuuuuuuuuuucucgaauggcaugaaacugaauuugaagguacagauuuucguuauuuuuaucagucagcacaguuccuaccgcugcagcguuauguuucuuugaacagguagaucugguaauacaguaauuuggggugaaacauuuacuggaucuuuaggucauaugcauccauuuauguuguuuccuuacccgguccauagaacugcagccuuggaaauauuaaaguuguauagguacugcuacaauguuauuaugacaugauuacuuacauacuuauuuuuguucuauguguauggguauauuuccugugagugugcuuguuccccacaugugcagugccuuaaaggccagaagagaguauugcauucuguggagcugaaggugccggugguugguagcugccuuccgguugcugagaaccgaaccugguaacaagugcuccucguugcugagccaucucagacuucagcccccaccauaaauaaauagucuuaaggacaggcgaugguggcacacaccuuuacccccagcucucaggagguaguggcagucagaucucugugaguuugaggggcagccuggucuagaccauuccagggcagccagagcugaaacccuuucuugaaaaaccaaaacaaacaaaaacaaaaaacccaaucaaacaacaaaacaaaggguaaaacauugacugccacacuguaauaaagaccuucguauuucuuucagcuuucucuacuagaacauuuuuauucccagccccuaaguguucugugcugcgaucucucagaagccaagaaaagaguaaauguuuucucaguuagucaaugugaaaacauccgccgccuuccuucauuuaggagguaagauaaguauauuuaaugugucuuguauuagagacuagaaugaacuaaagacuucuggcuucaguuguuuuugaaguuaggaaugaaauaauaagccuuucauuuugcaguauagaaccaugcugcuuuuaaggauagaauuuccuugcuugauucaaaauuuugacauaaauuuuuuacuaauauuuuauacaauuugcaaguucuccagaguuaucuuggagaaauaacucuuccuauuucucggguauauagccuuaaugacuucacuaguuaucauuaaauuaguaaucaaaaacugaugucuugaaugaguuuuugaaaagaaaugaaaaaaguuuggaaaccagucuagcuagcaauuuuuucuaacacgccauucaacuauauaaagugcuaacauuccucuuuuuucuuuaugggauacuaaaauguuagguacguggaaaaccagccuuugggaaagcaaguggcacugcugacaaaugagaccuucuuaaaggugggaugugugugugucuuacugacuuguucuugacuccaugcaaaagagugugcauuaauaaagcauccauuaacuuuauuaaaaauaucuguaugucguaauacuuagaugaugggguacuccuccauguaaccaacaugacaaagccuuguuuaaaagguuuuuuccaagaaaaaaaauucucugguguucuauuuuggaagcauuuuuauaucaaccaagagcuguauugauuauauauauagauauagauauuaaauuaguaaucauuaguaaucaaaaacugaugucuugaaugaguuuuugaaaagaaaugaaaaaaguuuggaaaccagucuagcuagcaauuuuuucuaacacgccauucaacuauauaaauauauaugucauaugacauaugauauauauauaagauuguuauaaauaaaagcauguagaagcuagguagcauaaccauuuauugcugaguggauaggauugauuuuauuugaagauuuauuauuuauuacuaaucuagcaccaauacuaaauuacagugucaguucuuauguguguaaaauacagccagauuggguacuaaacaauugucuggacuguauccuaaauuugauuugccaaguuuucaugaauuacgaagaguaacuuguaguucuaaauccucaucaguuuucuagagaguauguaucaaugaagucauuuuuaaauuuuauuuuacuaccaugcauauuauuauucugugauuuuuuuuuaggagaaaacucaaucauugcuggaagaccugcauguuuaccauaucaauuacuuccuugucuugagaugucuucauaauuuuaccucuucucuucccaaguacccacugggucgacagguaaguaaaauguccuccuugggagucaacaaagucagaauaauaguacuuucuuguuuugauuucucgauugcucaggcaucagacuuugagaugaagccagcucuuacaguaagaacaauccauuccagcuguucacguuacuaauaauagaaaauggcuuuguucugaaaguuagagcuggaaauagccacgugaaucccagugcauugucuccucuguacuugugcuguaguguauagccuugcgaauuugggucucucugucuguccugugcauagggagagcuaguucucuaccccuggggaaaugggagauggagacuguuugaaaguauuuggugguuaauuuuacauuguaccaagaguuaaaacaaacacaguacuucugcucuuugcaaaauuaugcugacgugaccuuuuuauuauaucccuaaccuacgagcccugugugggaggcauguggaugggagaauaauuaauccccagauccuuagaucagauuagagauugacuagaacaauggccugugugagguucugcuaacuuagcuauuaaacuuucaaucaguuguuuauuccaucucuaaugauacuuuaauugcaucaacaugaugauuuugcacaacuaguagccuauaaacuugguaugugguuuuuauuucucauaaaucauauccuacauuucuagauuagggagcuguauugcacauguuuagaaaagaagauaugggauucggaggaguacaagucagccuugcagcugcugagguaacuucuguuguucuuuuuugugugucugcuuuaagccugccaguaucaccuuccuccagaacuccugucugcccaaaagcuuccuguguagccuguauguaagaauauuuaaacaccuuuugaauugaugcgugcagucucuagugguguugaugcagcaaccaucuauuucuuaaugccgucugugcuuccagggcaccuucucagcacacagcacgugacaggugacuagcauagugagcucuacauucggcccugaaguugcucauaugauauaauuagaaaacauuuuaaucuauugauuuugggccaaauguaaccaaacuaucauuguaaaaagacuucaguuguuuagagcccugcuucccccaccccacccucucuuuuuuuuucuguuuuuuaaaauuuggcuguuuagugcauacccagcucugagaccucuuguuuaccuucaucacuugaaugugucugauuugcacucuuauuuuuuaacauuuucuucucagggaucuaggacccaauuuuuuugugauacaggguaacaacugaucuuagcugcuuuggagccaaacugagacagugaaagaacuuuaggguucacaguaagggaaaguggggaugcauaguguuacuugagguagaaggaggccauggugucaaggggucaaguguuggcagccuuuaguuagauuuauaaaguuuuaggcauuggaaucuggaagacaucaaucgugaaugaacagaaagacagagauuuagggagugcucaaggaaggcuuugauuguuuggcauagauuccuaucugaauuuaauuuuggguucucuugugaagaaaaaguuaaaguacucaacugguuuacucuuucaguagguaucuccugguucucauuuucaguauuuccuggaaaauagauuaaucuucaacaaggggacucaguaacauucugaaaucucacauaugugauaaaccuugcaaaacuguuuaaugguuguggcuguacuuugcuauugcauuuuaagaccauguagguauccauuauuuugaaagucaucagucuccuugaguccuuccuguagguaugggucaccgccauggaaaucccuguugaccauguagcugccuguggaagcaucuggggcaugcccguuuccaccaacucucuucccuaggggacguauacuggcuggagcccagccuuuggagauuucauggccucuguucaggacaaacaacuuacccaaggagucccuuuaagagaaagggacacacauuuacugugguuuugggcccucuuagccuuguugcuguuggccuccaagguuugggugcugaacucagaaagaaggucuugccagucuuguaauuuucacuuuccaaucugacugaguuucccuaagugauuaaaagcuaacaaguuagggacuggagaggggccucagugcuugcugcucuuggagaggaccuggguucagaccucauuguggcuggaagcucacuggugagcuagcuuagcccaaaaccucaggguuuggguucagugagagacccugucuccaaaacuaagguggagggcuggcuuuucaguuggcuccacacacaucgcagcuugagcaagucauugauagccauauaaaggagagaccugacauucacaaguuguccuguggccuccacacgugcuguaacauucuugugcacacacaugugcacuaacacaaacacaccuaaguaacggagacuuaaaaaaggguguggagcuggagcaauagggaggaccccugcugucaucccuugcauguauccuacauacauacacauggguacuucuacccacacacucaugugcauugucuuaggcacuguucuguugcugugaagaaauaccaaggccaugacaacucuuaugaaauagagcauuuaucugggggcuugucacaguugcagagguugaucauuauccucuuguggggagaggagaaggcauagcagcaggugaggcagcaggagcugagggcuacaugcuagucccuaggcagaggagaggcagagaucaugacagagagcaccaguacacuuggcacacacaggcaagugccucggucuggcaugugcuuuggaaaccucaaaacccaccccccagugacacacuuucuccaaggaggccacaccuccugauccuuacaauucuuuuagaauucuacucggugacuaaguguucaaauauaugagccgugggggguggggguggggcauuguauuuaaagucaccgugugcauucuccucacgcaugcagauagcagucacuuccauagugagaaagggaaccaaaaugagagguagguuuuuaucaagguuuaaacuuuccucaguagguacaaauguggagguaaacacaguauucaguuauuuuccuuuugagauaaugccuccuuggguagcagaggcccggccuugaacucagaauccuuaugccucuggcaguguacaugccacaccuagcaaccggaacuuguuagaaagaagucuguuaacuagauuuauuuuuaguccucauucccugcaugcccugaagaacagacgggcaccguaggacguuacuuacuuuuuguugcugugauaaaucaccaugaccaaggcaguguauagaagggagcugcggggguuuacuuuguggugguagcaggcagcacugcagcagguggcaggcuucuggaaugucuuagucaggguuuuuggggaggaaaggguuuauucggcuuacacuuccacauugcuguugaucaccaaaggaagucaggacuggaacucaagcaggucaggaagcagaagcugaugcagaggccauggagggauguucuuuauuggcuugccucaccuggcuugcucagccugcucucuuaucaccacccacaaggggccuuuccccccuugaucacuaauugagaaaaugccuuucaguuggaucucauggaggcauuuccucaacugaagcuccuuucucugugauaacuccagcugugucaaguugacacaaaacuagccaguacauggaaccacaaggauuacagagcuggccuccagcuuccggugcuguguugucuccagcaaggcugcacuuccucugccuccccagacagcaccacuaccugauacucaaaugugcaaacacaugaacauacaggggacauucuuacucaagcugacccaaauucuaaaaacuggaauacaauuauuagugauuuaggugcacuguaacuaugaaacugaaauuucuuacuauauggaaaauaaauccccaaagaaauuugauuuucacugaaaaguuuuguuucugaggcaggcuuuguacuccuugcuggucuagcuaagaggauuuaguccagccaugagucacugcaguuccuccccagugcugggguuacaggugcaugacaccaugcucagaccuuuuuuccccauuuuaaaaaugucauuaaauuguuuuuguguguuuauaaauuuagaauagaagguuucugagacuuugcuaguccaggauggcacugagguaagcugguauugcuagggaguaagcaaguuuaccccaagucaccucuccagcaccccgggcaauugaugccuuguguuauaacuuuauuauuggaaucugucaucccucuccucuuagguagucccaaauucauaaauucauugauguggaaaaaacuuacucauaaaauuucggguuuaguaaucugguuggagcccauaaaugucaauccaguaggguacaguuccuggacuauagaaguaaugcugauaacaggaacugccuuuuauugagcgagcgcuugcugugugccaguacuaucguaggcacccugagcacauuuugcaguccagugcagcacaccuuuccggcagguuaguuagccacguuuucccugggaaucugaaccauagaaagggacuaagggacuugcaugagauuguuucacugcuaauagguucauaauucagacuaaaaggcgcgcguaccuucaaaauuuauuugccuagaucuaaaguggaaguuggggcuauaaauaaagcaaaaccaauaaauaccaaguauaguuuccauguuuuuauuaagcugagcucaacagcgcugaggaucagacauagcaguucuaacaaggacugguacacuggggccaccaccaaagacacgugauggagaagcuugcagcuucgcagcaaaugucucccuccuguagacucauaaggcauguacaaaacaucagagacaguuucugcuguuuguauaaagucugaaaaacagccuuuccuaguuggcagaacaggagcguaaauguaaaucuucaaaaucuagcauauuuucuuuugcauuccaaacagaaauguaucucauuuagguaugucuuccacgcucagagguucuaaacgguuucaaaaugagccaggaguaauagcuucuguggccuccaacaccucacucaccacgaccaucucagcacauaguacagacagaaaaacgaaacacuguucagucuacauguccuaagugcguuguuaggagcuuacugcaaaacaaacucauacauugaaguugucauggauucgacucucaauguggaauucuaggucugaauuuggugcuuaauuucuuguuggcaccuaggggcgggggcauguauguggaagucagaggacgacucucuggguaguuuucuccuucuacuaugugaguuugcagggaucaaacucagguuauaaagugccgccauuucccuggcuccuuucacuggcuccggcuguugacauaaguccugucuuaguuaaguuccucuugcugggaugaaacacuauuaccaaaaguaacuugaugaggugcgcuaguuuucuacuugugcuacauggccugucccugucugucuagaaugcuggcaaaggaugaacuggugagcauacuucagcgcuguauugagguuuuagauuccucuacugaaaagcagcuuggcaacacaacacagaaaauaaaggauuuccugacccaguuucagaaccucgaugguaaguguaauaucccgcccugccaguccuuuaaccagagugucaucaaaacgccucggugucagucagcagaccagucucugaagguaacaucuuaacaagugcaaacaggcaaaggcauuucgccucuggauuuguuuuaaacaauguagaaaaucaaauggaagaacaucauuuucauucuucaggugagaauggguggcaggcaguucucauucucuggauagaccauucuguacucuugccuuaucuggggugcugugacggggugaggaaagaggcuugccucauggcaucauggaaauaccugcuuuggaauguuuguuugacucccuccuguggcagauauuccuuugucuuuaaacuccuuuacuuauagcaagcugucuguguggaaauguguccucagaccccuguagcuccucugcagggggucucugacaggugcucaguuacagauuaaggugguaagcagugccaauuugcuuccuccaaguuaugugugagagggagcuccacagcagugacccugaaccauuucacagaaguaaaaaccuuaaaagucuacaaguugagaucauuccagcuacgagaaacucaacucugagaagaaaaguaaacugcuuuauacuucacagcuauugauacagcacacagacuagagccaaucucucuuggcuuccagcucagugagugaguguguuuguauguguguguguguaagaucagaucacaguugcacucucaccaaugagaagcaacucuuaaggacauaaagagacuguagauaccauaauuuuaauuagaguucauguaaugugaccuagcgaacaaauccuaugauaaauuagcauuaagugauuaucauuuuucaaaugguaaggcugaagauuaaaauguuugacaacaguauaaagaauaguguuuuaugaaucaaaacaacaccauccugcugauuugucuuuauuucuugguuuaaaaaaccaauuguuauuaauaacaaaguauacuuaaaauuuucacaagaagaaauauuugguuauuugccaccuaugguuucuuuacacuguuggcauauuuauuuuaauuuagaauuaaauuggagaggguuaaaucaggcuggguguuauaaucaguuuuaaacacgguaauggaauggaauaaaauaaagaauuuagcuagcaguuauccuaaccuuagguuauaacuuucuaaaaucaagaguuaucuucugguucuuuaagaauauacauucuuuagcuaauuuuuauaucauauuugaaccaaaucauugucagguucccaagucagagcgaguaccacauccuccugcagcauagccauacguuuauaucaguuagggggaccucuuccuagaguuacuuuuauagcuuuuauacaccuccuuccuuaugcuaaacgguaaugaaucaaaagcaggacaguggaagguugagcgcagguggaucggaaugcuucuaaucaaagggaaauaguuucaagucuguaugauauuuuuauauaggcuuuuguucugcuggcuagaaacgcuugaguucaguagcuagugauugaagaucucacuacuauauaaacaauguaauauguauugccuucagcuucuggaaggagcaucaucugccugucuugcucauguuuuaaaaaaguauaaauucuacuuccagugucuauucucuguuguauucaaagcagauagcaaagaggaagaggaugccuguggaucacagccaaaggggcugcagaagacagaccuguaucaccuucagaagguaggcaucuuucucuuccuuccagcugcacuggaggugguuaccuuguuuuaauuugugcucuugucaucacuuucauaucuuacuucacaaccaggaacaauauagacagacugaagcuaaaaacucagacaugcugaugccaucuacacuguaggaagggauugguuuucugugcuaauuauagaauuagaaggcaggaaagaagugcuacaggaaaucuuggguaacuccuguggagacaguggagacauuauauauaccagggaaaucgaagucccuuuuggggguccuuagucuagguucauggaaaaaauuaaccaagugcccaaacaagcggagcagcaauuucuuaggugguguuguuuuauuuuaaagcuucucuccaaacaaagcaugcaagcuguaccuguggaagcugccaaaaguaaggaagauaggcuggcacagcagcagguagcugcgaggcaggaggauagcuuuagagacuauggaagcccagaggauuaggacauuuaaaaagcguacguaggcuuugccaaugugcaauagaaaaaaaaggaguaauuaugccugagucaguacucagaaagacuuacaaacccagaaacaucauggagguucuuuacuaacuacaggagauguugaacagcuuuucuaggggagccucucagccaggcccuccauugacuuaauucucaagggagaagacaguagcaugucuccaccuagagguagguuccauucuguacuauaauucuguucuuugucuugcugucauccuagaguauaccugcgcacagucuacagucuacuagacaguauagaaaacaauucugaagccuuaaggaagacaacagaaguaaaggggacaugggaaugugauuuacaaaaagaauauaauguacuuaucucuaagucaaauauuuuugaccuccccccagcccucuagugcugagaagcaaaccuaggugucucgccacuagcuagagccauaccacuaaacuacaaaucucagccuuucucuuuuuuacugaacacucauaggguaaaaaggcauuugauagucagaugacccuucuugucccauuuuaccaaguuaaacuguacaauagaauuucagucugggugaaacuacacucauaacaucuauuguuccugugggccaaagcuguggauugguguuuucuuccucauguuccuaaaugaaaaugguuucuaaacaguaagcacucuuguauaacugaacagugaaguaagcugcucucuucuuccuuugaacauucacuuggucuauguuuaaagcaaaacacauagagggguagcgucuucccagauucuuagcagaaaauaaagcacacguugaucugguucuuggucugcacucuguauaaguaagggcaucagcugcuucuccaugugagugacagcucucaaaguguuuuuuuucugaagucaaagauguuauauauuuuuuuacccucucccuacuguguccuguaguccuuacuagaaaugaaagagcuaaggagaacuaagaagccaaccaaguuugaaaugcucagagaaaauguuaugaacuucaucgacaacuuagugaggugagucuaaugcuucggugaagaacaguaacccuguucuuccaaaugacaccaggaacucacugcccacagccaggccaggguguuucucccaucugaguguuuuucuugaucuucuguccuuguuaccuaaucaaaugacuucguuuauuuuuuacuguugguuuaggaaggcagguuuaaacuucaucuagccaguuaggccgggugaggaaacacaggacacuucagaguauucugucaaguuugcauuguucuuaguuuuucugccuguaguaggaucugggucagcccagaaacagacauuguauacuagccaugcuacuguuuuguugugaguguuuuaucaggacaacuaaguaucagcaccaaaucgauucugccugcaguaucuacucagcaacuauccaagucuccuaucuaguuuguuuaucggccuuucuuggggagccuggaucauucuggguauuucccaaaagccagcuuuauguguguacaugaaaucaaccauccaggugaccuuauggaaacagggacagauuuaaaagaaugugaguacacaagagaugacuuagcuaguuacaaacagugcagaaguagagguccagccuguaaccccagcauuugaggcuagaacaggaaaaaaucucugggcauugcaggcaaacaugacccugagagccugccucaaaaggaaaguaggaaaagugcuguuuuuagaugaaguuaguugaaggcaguucaaacuggucaggagaugaggcugugaauaagaaugguuuguuuuuuuuuuuugggggggggguguaguuuuuuggugacuacaaugaucuugaccauccugaaagugcaaauuuucauuucccaggacaguguugagggcagauccaauuaggaaaaaugccucagagaugugcccugcugccuggggaaaacauuaauuccagauaucacaaauacagagaaaguuuuaaaaguaguauugacauauaaaacuaggugaaacuauauggguuccauuacuugguguuuguuugguugcugaguucacuguuuauuaagcagcaaauacucauagaagauugacaaaacuguggaauugaaaaccaaccuguacguguauguauguauguauaaauguauguaucuaaagcuggcaccugauuucccgguuucagagacuaccuucugccuccugagagccagccucugcaugagguaguguacuucagugcugccaacacacuccgugagcacuuaaaugcugcuccaagaaucgcucuucacacugcacucaacaacccauacuauuaccugaagguaagaaggaagcccaacucgcccaguuacucacauuuuucuaaaauaaaaaaaaaaagaguuccuagauuuuaguuaaagugacuuagcgauaguagcagucaguagucaacugaggcuaugugcauuugcucacauguaaacugucuuucaugggagauagccagugagaugggauuugccacuaagccucauaaccugaguuugguauaaggagacaaccgacuccaaaaaguugucuuauguucuacacauucaugaccacacaccagaagaaaaauuugaacaaaucauaggcagaaagcuuuagaauguaauaucuuacucuuguaaaaaaugaauuuuuuccccagacauguuuuucucuuuuucuucucuuuucuuuuuuuuuuuuguaucuuuguccugaaacuugcucuguagaccagacuggccucaaacucaagagauccaccugccucugcucccugaguucugggacuaaaggcuuagaccaccacugccgagcagaaaaggguucuucuguagguaacaacaguuggucaguggccagguaauaaggccuaaugaaaauauauaaaauuccaagugcacauuuuaaauggaaaaaaacacccuggaauuucaucauggauuuuaaauccuaauaacaaucuauucugggaggaucugcaggguacugcuguagaaacuccuaaaacagcauacaagggaagaaacagcugccuaaaauccagaaaguuacaaauuuccguuucaaauguucaaaacuaccguuguuuugagagauaaaugaacacuguauuauaaguagguagauaggguuuuugaacacgggugaaugugcaugcucgggaaguuggaaguuuuccuuccagaaaaagaugcuuuagaaggcacuuuugaauggaugugguagcacgcuuguaauucuagcucuccagagguucaggcaagaagaucaccaaguucagggccgguaugaacuuacugauacuuugaaaagaguaaagugggcagucaguauagcucaguagaugaaggggcuucugauuaccugcuaagaagcuuaauagccugagcuugacccccugggccccuguaaaaaugauuccacaaauuugucauacauauacauacauacauacauauacacauagugauuauauuuuuaguuaaaaagugguuccaaaagauaccccaaacuacuaccaguuccuugcaaaaugggguacagaugugaaguaugcggaggauacugaauaggaaguuacuggucaguggucuucaaugaugguagguagcuaccaggagcuugacaguuuccuauuuaaaaccuaauuaucuguuugggcaugugcucauguggguaaaguaccuauaagagugcagaagaagggauaagaugcccuggagcugaaaugaaagguguugugagcugauagaguagggagccuggagcccagcucugguccucugugacauacagcagcagaugcuauuaacuccugagcaucucuccauucuuaauaauuucaugguucaauaagaggagcgucugcucagauagcucagucaucaggugaaagcaucugccugacagacucagaccacagagggaagaacagucuccaacacccaggugcuucauccccuuugcacaacaaaugaauccagguuuuuguaaagaaaaacaacuuuuaauguaugaguuacaaacuaaaauauuuagugguagaguuacagaaacaaacugauguggucuuucaugcauuuuguguaugagauuuuguuucuuaauaaaacugggauuucaaauaaguuaaaccaauacugacaguuucuauagggcuuguggugugagggcugauugccuccagcucuuugcugguacucucucccagucucugcagaugacuauauuuaaggggcagcaucuguucacauggauacacucauucacagaaacaaaaauaaaccuggggggugagaaggacgcucugcacugcugguuaggccauguggagacccugguuccaaaacaguaacagaaagugcagugcugagagcagucucuucuuugggagaucacauuuacucuacccuacucuacgauuaccaaugacaaguguuuacuaaugccacauaacugcuagaauugccuuuauaacaaauguuggacguagcauuuuauuggguaaucauucccagagauuucuaaacuuuuacagcaaacugaaacauguguuaugagaggcucuacaaauaaaaaugagauuaaaaaaaaaaaagucuuauggggagaguggcuuagagcuagagggauauagccaagacuugaaguaugaagaaaggaaaugacaagauccuacuuucuaauuuacuaaauuuaggaguucaacuaauagcuuugguuuucauaauuucuaagauuuuaacuuuuaaucugcuguuuuuagaaugaagaacuggaaggauguauuccaaauacugccccugacaucugcauagcauacaaacugcaccuggaguguagccugcugaucaaccucgucgacugggcagaggugggucacaaagaacaaguuagguguuuaacuagcguuccuagcgguuugugcuccccccccccccccccccgucucuguuucguuuguaaagcacaaauguuguuaugcuucagaaguccuaaguaagcuccuauucugauccuguguuuuuuaaaaacagaagccaaagaaaggauucagaucagcucagagcaagccagaauacaggugugguggacaccccucacacaacaggagaaauucuauucuggaauauauggcaaggcaggggacaagugcauagcugucaaaaguccuaacugacaucucaacaucaaaggacaugcugaauuagagucuuccaagagaaaugcauuuucuuggaguaaaagauuaacguuagagggaacagggauuucucugcuuuuaaaauuuugaauaguuaugcuuuaauccucuaacacaaauguagagucaguuuuauuauuuuuaaugaauaacuggcaaaacuuauuaaugucauuagucaucuucaauuugaaaucuguugugaaagaugugucagauaucuacagcaaguccuaaaaccugacuaguuccaaaacuaucucacggguacagaacaagaugccuagcaacaaguuguauuuucuucucucuuguauacucaaaaggcuuuugcaacaguugugacagcugcugagaaaauggaugcaaauucuacagucucagaagaaaugagugaaguuauucaguauccuuuuaaaaccaguucuacagugacccaguaacaguauuuuaauguucuuguuucuugacuggcuaggucauuugcuuaaaacaaagaacauuugcuuaaacaaagggccuugaauucaaggcccaacacacacacacacacacacacacacacacacguuaaaaaauaaaaauuuaaagaaagcacaucuaaaaauucauaaauauguauugcuuaaccauaccaucuuaaaacaaccuuaauuucuaaguacucugaauuuagucuauucuauucucaauuuauuccaguuuuuacuaaggaaauugucauuauugaauuaucaacuuuuaaaacauacuucuagaaguuuggcaagggggcgauaguguucaacacuuuuccaucuguuugugauucauuugacauuuuugugagacaugguaucauguaaccucaccugacuggccucaaacugccucugucucaagugcugggauuacaauaggugugcacuguaacacacaacuccauuugaaccuucuauucugauugcauuuaacaucuuccaauaggguuauauaauuuaguaguauuuauuucaaccacuuauuucaauuuaccaguuacuauuucaacuuugaaauuucauuuuaaucuuuuugucaaacuaaaaaaacaaagcaaaacaaaacacccuaauuuuccuuagcuagauccucuagugcucgauuuauucgagcuguuucugaauuagaacuuuuaggcuuuauaaaaccuacgaaacagaagacugaccauguugcaaggcuuacauggggaggcuguuaaacagcaagagagugaagacaagaagaguuccauguccaacuugcauauuuguaucaaaacguuuuuggaguacuucaaagacuaacaaaugcauaaagccuuuauauguuaucaguauacauugcuucauucuugcuugucuaguguguaaaugcuagaacuucuuacgcauagcucucagcagcaccccaaacgccagcacacuguaaaguuagacacuguaaacaucuuucagguguuuuccuugcuagaaaggcucuaaaaucaccucagccucuccauuucuuauaaucuuggcaacuuaccaggcccaaagcuauuuggcuuuauacuuaauaaacauucauaugaacagccacggagacuuacaaccaguaagggccuucacaaacugcuccccuaacuuacaaaacucagaaauguaaagguccagugaaauaauaucguaucuuucaugacaagaacuuaagaaucagacacauaaaacucauuauuuaauguucaacucucaagagaauuguaccaaaauuguucacaaaugauucagagaguccauguccagaaaaaaauuuaaaagccucugacuuguguugcaagguauaugcaagauuaugauccuuucuccaugccccccaucccgaagugcuaagauuauaaggaauuuacauuaugcccagacgagaaaacaggucuuuaaacaacacaacauuuugugcauauaaaauacagaggaacugguguuaauacuggcauauuuuuaucuugucugaggcauguuuucuuuuccuaggcauugccugcauuugugcgugugugcacauugacuucucauacuaucaaaaggaccuguaggacugaaccauuaaacugauuguguguaauuacuugguauccuauaaaaacucaauccuucauugaggugccuggcacuuacuagauauuuuagaaacaagaucaguguuuuccuuguccuuuauguagcaaagcagaccucacuugagcaaaaguauaggaaugaaaaaaacuacccaggaggacuuaugggugaccccacuaggcaggcaacagcaguaaccaauauccuaggauggggacaccaagacagagacagcuaggauggaucaggggguucaaauaauaggaauugaaugaguaggacaagagugcagguagugaagcuuuguuuucuucggucagaagcaaaaggguaaagccuuucaaugaucaacacgugugagaacagugaggccugaugcagcaaagcaaccacuaguuagcugaccaagagcagcgggguuggugucacuguugauuaacuacaauuagaugcacauuuagauccuuaaaaucccuucugcuuauaaacuagaagcauugcuaucagugggcugcuauggcuacugcucgguggugggaucucuaagaacuaagguauaaugggaagucugcgaguguggccgcaaggaaaaugggaggauccaacaguccucuuuauucuuuugcuuccuggcugaugagcuaacaguuuagcucuaaacuggacucuagucaugucuucugccucaacugaucauacgccuucaaaaugcaauugaaauaaacuuccugacuagauaaaccugaguauuuuauuguaguuauggaaggcuaauugaaagaaacagcagcaaaacugaguuuggcuuuggcuauaacaaucaggagagauucuggugaaaugcuacacaguaaggugagcagaaucuuguuuagagaucaccaacgucagcacugaagagaggcaaggagaucaaacuccagcguugagguuuaugcuuauuuguagguaaaaauucaagagaacauuaaaagugaaaggaaucaggcaaguaucuuagaagccaacugaagacuuugaagcucauauaugaauagaguaaacaaugcgguaaucuuagguaacuugguuaauugaccgagccaaguaucaaacugaccaguaagcgggggaaaaagccauaugcuaauacuuuauaauacggacuccauaacaucacuuuacagucuuaaccaaaaggcuuaccccaacacuaaaacuaaacauuaauaaaguucacaagugaggaacuugcuguucuucuaaaagaccagaaguggguuuguagcaaccacaucagauuuuucaaaacuaccuagcuccaagggaucuaccacccucuuuggccucugugggcacuugcacauccauguggacacauacaaguauuaaaacuuuuaaaucugcauucuaguuuauaacuucaaaaaggacaggucauguuaaugguagcacaaagaaauacucaacuuagucuuuccagaaaguuguaaucuugguugaauccuugugggggaagagaggagggguuggggugcuaaaagcauuuagaaaacagagaaauacaaauguagacagcaucuaccucaaguggccagcgcugagguuagagagaagcauauguguuuagacaacuucccaacacagcuuagcacuuucuacuugaaaaaaucaaguaggaaaugacacuaaucuuucaacuucugugaugaguguuuuccuaacaaguugagggcuauauuugaaagauaacgugaagauuuuuguugacauaaugggaaaggggagagauaccauuaacacucuagaauguacagauacaucccaaaguaccaauagcauugaggcugaaaucuaagugugagauuaguucacuuuacauccagcugccccauucuauaacuuguguuucuuguguacuaauggauuuggaacugccugacaaucuugugaaagccacagagcacacucugggugcuuauuuuuaaaugagguuauuaguaaguuaaaaaugaaauauuguguuuuaagauuagucuaaugacaggaaguaugcuauuaaaauucaaagggagccagagagguagcucagcaguuaagaauguuugccacucuugcagaggacuuaagggauuuugguuccuagccucaacaugggcagcucaacaacuggcugucuuauggccucaggcacauaagcguauacaaauaaaaucuuuuuuuuuuuuuuaaaauugaaaauaauucacugagcaagacugaggggguggccuuuaaccucuaauccugucucaacuaccaagaugacaaaugugugguuaguacuuucagcuuucucacuacuuuguauacauuuaauuuagucauucacugugauauuauuuaauguuuuauguaugugugcuugccugaguauauauguguguacugugugcauggaguucagaaaaggcaucaguuggugagcuguuauauagguucugggaaccaaacaagggucuuccaaaaaagcaaccugagcucuucugagccucucuccagcccuuaagauguuaacuuuuucaucucaacaguaccuaggauuuucuaaaucuuaacaaggcuugucuagaucaguuuagccuguaagcaugucugugagugacugaauugccuuaaccaaucaggaagagagccaaccagaaguggguggaaccauccacuaaacuuaguacuuaaacauuuacugauggcucucugcucuuacuuguggcuacaaguuccugcaguuuugauuuccccacagugauagacugcaaccugggauuuugagguaaaguaaaauaaacacuuaauacccu

SEQ ID NO: 1823 - RNA, 8302 nt, Mus musculus
gggagcacaaaccgcuaggaacgcuaguuaaacaccuaacuuguucuuugugacccaccucugcccagucgacgagguugaucagcaggcuacacuccaggugcaguuuguaugcuaugcagaugucaggggcaguauuuggaauacauccuuccaguucuucauucuaaaaacagcagauuaaaaguuaaaaucuuagaaauuaugaaaaccaaagcuauuaguugaacuccuaaauuuaguaaauuagaaaguaggaucuugucauuuccuuucuucauacuucaagucuuggcuauaucccucuagcucuaagccacucuccccauaagacuuuuuuuuuuuuaaucucauuuuuauuuguagagccucucauaacacauguuucaguuugcuguaaaaguuuagaaaucucugggaaugauuacccaauaaaaugcuacguccaacauuuguuauaaaggcaauucuagcaguuauguggcauuaguaaacacuugucauugguaaucguagaguaggguagaguaaaugugaucucccaaagaagagacugcucucagcacugcacuuucuguuacuguuuuggaaccagggucuccacauggccuaaccagcagugcagagcguccuucucaccccccagguuuauuuuuguuucugugaaugaguguauccaugugaacagaugcugccccuuaaauauagucaucugcagagacugggagagaguaccagcaaagagcuggaggcaaucagcccucacaccacaagcccuauagaaacugucaguauugguuuaacuuauuugaaaucccaguuuuauuaagaaacaaaaucucauacacaaaaugcaugaaagaccacaucaguuuguuucuguaacucuaccacuaaauauuuuaguuuguaacucauacauuaaaaguuguuuuucuuuacaaaaaccuggauucauuuguugugcaaaggggaugaagcaccuggguguuggagacuguucuucccucuguggucugagucugucaggcagaugcuuucaccugaugacugagcuaucugagcagacgcuccucuuauugaaccaugaaauuauuaagaauggagagaugcucaggaguuaauagcaucugcugcuguaugucacagaggaccagagcugggcuccaggcucccuacucuaucagcucacaacaccuuucauuucagcuccagggcaucuuaucccuucuucugcacucuuauagguacuuuacccacaugagcacaugcccaaacagauaauuagguuuuaaauaggaaacugucaagcuccugguagcuaccuaccaucauugaagaccacugaccaguaacuuccuauucaguauccuccgcauacuucacaucuguaccccauuuugcaaggaacugguaguaguuugggguaucuuuuggaaccacuuuuuaacuaaaaauauaaucacuauguguauauguauguauguauguauauguaugacaaauuuguggaaucauuuuuacaggggcccagggggucaagcucaggcuauuaagcuucuuagcagguaaucagaagccccuucaucuacugagcuauacugacugcccacuuuacucuuuucaaaguaucaguaaguucauaccggcccugaacuuggugaucuucuugccugaaccucuggagagcuagaauuacaagcgugcuaccacauccauucaaaagugccuucuaaagcaucuuuuucuggaaggaaaacuuccaacuucccgagcaugcacauucacccguguucaaaaacccuaucuaccuacuuauaauacaguguucauuuaucucucaaaacaacgguaguuuugaacauuugaaacggaaauuuguaacuuucuggauuuuaggcagcuguuucuucccuuguaugcuguuuuaggaguuucuacagcaguacccugcagauccucccagaauagauuguuauuaggauuuaaaauccaugaugaaauuccaggguguuuuuuuccauuuaaaaugugcacuuggaauuuuauauauuuucauuaggccuuauuaccuggccacugaccaacuguuguuaccuacagaagaacccuuuucugcucggcagugguggucuaagccuuuagucccagaacucagggagcagaggcagguggaucucuugaguuugaggccagucuggucuacagagcaaguuucaggacaaagauacaaaaaaaaaaaagaaaagagaagaaaaagagaaaaacaugucuggggaaaaaauucauuuuuuacaagaguaagauauuacauucuaaagcuuucugccuaugauuuguucaaauuuuucuucugguguguggucaugaauguguagaacauaagacaacuuuuuggagucgguugucuccuuauaccaaacucagguuaugaggcuuaguggcaaaucccaucucacuggcuaucucccaugaaagacaguuuacaugugagcaaaugcacauagccucaguugacuacugacugcuacuaucgcuaagucacuuuaacuaaaaucuaggaacucuuuuuuuuuuuauuuuagaaaaaugugaguaacugggcgaguugggcuuccuucuuaccuucagguaauaguauggguuguugagugcagugugaagagcgauucuuggagcagcauuuaagugcucacggaguguguuggcagcacugaaguacacuaccucaugcagaggcuggcucucaggaggcagaagguagucucugaaaccgggaaaucaggugccagcuuuagauacauacauuuauacauacauacauacacguacagguugguuuucaauuccacaguuuugucaaucuucuaugaguauuugcugcuuaauaaacagugaacucagcaaccaaacaaacaccaaguaauggaacccauauaguuucaccuaguuuuauaugucaauacuacuuuuaaaacuuucucuguauuugugauaucuggaauuaauguuuuccccaggcagcagggcacaucucugaggcauuuuuccuaauuggaucugcccucaacacuguccugggaaaugaaaauuugcacuuucaggauggucaagaucauuguagucaccaaaaaacuacaccccccccccaaaaaaaaaaaacaaaccauucuuauucacagccucaucuccugaccaguuugaacugccuucaacuaacuucaucuaaaaacagcacuuuuccuacuuuccuuuugaggcaggcucucagggucauguuugccugcaaugcccagagauuuuuuccuguucuagccucaaaugcugggguuacaggcuggaccucuacuucugcacuguuuguaacuagcuaagucaucucuuguguacucacauucuuuuaaaucugucccuguuuccauaaggucaccuggaugguugauuucauguacacacauaaagcuggcuuuugggaaauacccagaaugauccaggcuccccaagaaaggccgauaaacaaacuagauaggagacuuggauaguugcugaguagauacugcaggcagaaucgauuuggugcugauacuuaguuguccugauaaaacacucacaacaaaacaguagcauggcuaguauacaaugucuguuucugggcugacccagauccuacuacaggcagaaaaacuaagaacaaugcaaacuugacagaauacucugaaguguccuguguuuccucacccggccuaacuggcuagaugaaguuuaaaccugccuuccuaaaccaacaguaaaaaauaaacgaagucauuugauuagguaacaaggacagaagaucaagaaaaacacucagaugggagaaacacccuggccuggcugugggcagugaguuccuggugucauuuggaagaacaggguuacuguucuucaccgaagcauuagacucaccucacuaaguugucgaugaaguucauaacauuuucucugagcauuucaaacuugguuggcuucuuaguucuccuuagcucuuucauuucuaguaaggacuacaggacacaguagggagaggguaaaaaaauauauaacaucuuugacuucagaaaaaaaacacuuugagagcugucacucacauggagaagcagcugaugcccuuacuuauacagagugcagaccaagaaccagaucaacgugugcuuuauuuucugcuaagaaucugggaagacgcuaccccucuauguguuuugcuuuaaacauagaccaagugaauguucaaaggaagaagagagcagcuuacuucacuguucaguuauacaagagugcuuacuguuuagaaaccauuuucauuuaggaacaugaggaagaaaacaccaauccacagcuuuggcccacaggaacaauagauguuaugaguguaguuucacccagacugaaauucuauuguacaguuuaacuugguaaaaugggacaagaagggucaucugacuaucaaaugccuuuuuacccuaugaguguucaguaaaaaagagaaaggcugagauuuguaguuuagugguauggcucuagcuaguggcgagacaccuagguuugcuucucagcacuagagggcuggggggaggucaaaaauauuugacuuagagauaaguacauuauauucuuuuuguaaaucacauucccauguccccuuuacuucuguugucuuccuuaaggcuucagaauuguuuucuauacugucuaguagacuguagacugugcgcagguauacucuaggaugacagcaagacaaagaacagaauuauaguacagaauggaaccuaccucuagguggagacaugcuacugucuucucccuugagaauuaagucaauggagggccuggcugagaggcuccccuagaaaagcuguucaacaucuccuguaguuaguaaagaaccuccaugauguuucuggguuuguaagucuuucugaguacugacucaggcauaauuacuccuuuuuuuucuauugcacauuggcaaagccuacguacgcuuuuuaaauguccuaauccucugggcuuccauagucucuaaagcuauccuccugccucgcagcuaccugcugcugugccagccuaucuuccuuacuuuuggcagcuuccacagguacagcuugcaugcuuuguuuggagagaagcuuuaaaauaaaacaacaccaccuaagaaauugcugcuccgcuuguuugggcacuugguuaauuuuuuccaugaaccuagacuaaggacccccaaaagggacuucgauuucccugguauauauaaugucuccacugucuccacaggaguuacccaagauuuccuguagcacuucuuuccugccuucuaauucuauaauuagcacagaaaaccaaucccuuccuacaguguagauggcaucagcaugucugaguuuuuagcuucagucugucuauauuguuccugguugugaaguaagauaugaaagugaugacaagagcacaaauuaaaacaagguaaccaccuccagugcagcuggaaggaagagaaagaugccuaccuucugaaggugauacaggucugucuucugcagccccuuuggcugugauccacaggcauccucuuccucuuugcuaucugcuuugaauacaacagagaauagacacuggaaguagaauuuauacuuuuuuaaaacaugagcaagacaggcagaugaugcuccuuccagaagcugaaggcaauacauauuacauuguuuauauaguagugagaucuucaaucacuagcuacugaacucaagcguuucuagccagcagaacaaaagccuauauaaaaauaucauacagacuugaaacuauuucccuuugauuagaagcauuccgauccaccugcgcucaaccuuccacuguccugcuuuugauucauuaccguuuagcauaaggaaggagguguauaaaagcuauaaaaguaacucuaggaagaggucccccuaacugauauaaacguauggcuaugcugcaggaggaugugguacucgcucugacuugggaaccugacaaugauuugguucaaauaugauauaaaaauuagcuaaagaauguauauucuuaaagaaccagaagauaacucuugauuuuagaaaguuauaaccuaagguuaggauaacugcuagcuaaauucuuuauuuuauuccauuccauuaccguguuuaaaacugauuauaacacccagccugauuuaacccucuccaauuuaauucuaaauuaaaauaaauaugccaacaguguaaagaaaccauagguggcaaauaaccaaauauuucuucuugugaaaauuuuaaguauacuuuguuauuaauaacaauugguuuuuuaaaccaagaaauaaagacaaaucagcaggaugguguuguuuugauucauaaaacacuauucuuuauacuguugucaaacauuuuaaucuucagccuuaccauuugaaaaaugauaaucacuuaaugcuaauuuaucauaggauuuguucgcuaggucacauuacaugaacucuaauuaaaauuaugguaucuacagucucuuuauguccuuaagaguugcuucucauuggugagagugcaacugugaucugaucuuacacacacacacauacaaacacacucacucacugagcuggaagccaagagagauuggcucuagucugugugcuguaucaauagcugugaaguauaaagcaguuuacuuuucuucucagaguugaguuucucguagcuggaaugaucucaacuuguagacuuuuaagguuuuuacuucugugaaaugguucagggucacugcuguggagcucccucucacacauaacuuggaggaagcaaauuggcacugcuuaccaccuuaaucuguaacugagcaccugucagagacccccugcagaggagcuacaggggucugaggacacauuuccacacagacagcuugcuauaaguaaaggaguuuaaagacaaaggaauaucugccacaggagggagucaaacaaacauuccaaagcagguauuuccaugaugccaugaggcaagccucuuuccucaccccgucacagcaccccagauaaggcaagaguacagaauggucuauccagagaaugagaacugccugccacccauucucaccugaagaaugaaaaugauguucuuccauuugauuuucuacauuguuuaaaacaaauccagaggcgaaaugccuuugccuguuugcacuuguuaagauguuaccuucagagacuggucugcugacugacaccgaggcguuuugaugacacucugguuaaaggacuggcagggcgggauauuacacuuaccaucgagguucugaaacugggucaggaaauccuuuauuuucuguguuguguugccaagcugcuuuucaguagaggaaucuaaaaccucaauacagcgcugaaguaugcucaccaguucauccuuugccagcauucuagacagacagggacaggccauguagcacaaguagaaaacuagcgcaccucaucaaguuacuuuugguaauaguguuucaucccagcaagaggaacuuaacuaagacaggacuuaugucaacagccggagccagugaaaggagccagggaaauggcggcacuuuauaaccugaguuugaucccugcaaacucacauaguagaaggagaaaacuacccagagagucguccucugacuuccacauacaugcccccgccccuaggugccaacaagaaauuaagcaccaaauucagaccuagaauuccacauugagagucgaauccaugacaacuucaauguaugaguuuguuuugcaguaagcuccuaacaacgcacuuaggacauguagacugaacaguguuucguuuuucugucuguacuaugugcugagauggucguggugagugagguguuggaggccacagaagcuauuacuccuggcucauuuugaaaccguuuagaaccucugagcguggaagacauaccuaaaugagauacauuucuguuuggaaugcaaaagaaaauaugcuagauuuugaagauuuacauuuacgcuccuguucugccaacuaggaaaggcuguuuuucagacuuuauacaaacagcagaaacugucucugauguuuuguacaugccuuaugagucuacaggagggagacauuugcugcgaagcugcaagcuucuccaucacgugucuuuggugguggccccaguguaccaguccuuguuagaacugcuaugucugauccucagcgcuguugagcucagcuuaauaaaaacauggaaacuauac

SEQ ID NO: 1824 - RNA, 8302 nt, Mus musculus
guauaguuuccauguuuuuauuaagcugagcucaacagcgcugaggaucagacauagcaguucuaacaaggacugguacacuggggccaccaccaaagacacgugauggagaagcuugcagcuucgcagcaaaugucucccuccuguagacucauaaggcauguacaaaacaucagagacaguuucugcuguuuguauaaagucugaaaaacagccuuuccuaguuggcagaacaggagcguaaauguaaaucuucaaaaucuagcauauuuucuuuugcauuccaaacagaaauguaucucauuuagguaugucuuccacgcucagagguucuaaacgguuucaaaaugagccaggaguaauagcuucuguggccuccaacaccucacucaccacgaccaucucagcacauaguacagacagaaaaacgaaacacuguucagucuacauguccuaagugcguuguuaggagcuuacugcaaaacaaacucauacauugaaguugucauggauucgacucucaauguggaauucuaggucugaauuuggugcuuaauuucuuguuggcaccuaggggcgggggcauguauguggaagucagaggacgacucucuggguaguuuucuccuucuacuaugugaguuugcagggaucaaacucagguuauaaagugccgccauuucccuggcuccuuucacuggcuccggcuguugacauaaguccugucuuaguuaaguuccucuugcugggaugaaacacuauuaccaaaaguaacuugaugaggugcgcuaguuuucuacuugugcuacauggccugucccugucugucuagaaugcuggcaaaggaugaacuggugagcauacuucagcgcuguauugagguuuuagauuccucuacugaaaagcagcuuggcaacacaacacagaaaauaaaggauuuccugacccaguuucagaaccucgaugguaaguguaauaucccgcccugccaguccuuuaaccagagugucaucaaaacgccucggugucagucagcagaccagucucugaagguaacaucuuaacaagugcaaacaggcaaaggcauuucgccucuggauuuguuuuaaacaauguagaaaaucaaauggaagaacaucauuuucauucuucaggugagaauggguggcaggcaguucucauucucuggauagaccauucuguacucuugccuuaucuggggugcugugacggggugaggaaagaggcuugccucauggcaucauggaaauaccugcuuuggaauguuuguuugacucccuccuguggcagauauuccuuugucuuuaaacuccuuuacuuauagcaagcugucuguguggaaauguguccucagaccccuguagcuccucugcagggggucucugacaggugcucaguuacagauuaaggugguaagcagugccaauuugcuuccuccaaguuaugugugagagggagcuccacagcagugacccugaaccauuucacagaaguaaaaaccuuaaaagucuacaaguugagaucauuccagcuacgagaaacucaacucugagaagaaaaguaaacugcuuuauacuucacagcuauugauacagcacacagacuagagccaaucucucuuggcuuccagcucagugagugaguguguuuguauguguguguguguaagaucagaucacaguugcacucucaccaaugagaagcaacucuuaaggacauaaagagacuguagauaccauaauuuuaauuagaguucauguaaugugaccuagcgaacaaauccuaugauaaauuagcauuaagugauuaucauuuuucaaaugguaaggcugaagauuaaaauguuugacaacaguauaaagaauaguguuuuaugaaucaaaacaacaccauccugcugauuugucuuuauuucuugguuuaaaaaaccaauuguuauuaauaacaaaguauacuuaaaauuuucacaagaagaaauauuugguuauuugccaccuaugguuucuuuacacuguuggcauauuuauuuuaauuuagaauuaaauuggagaggguuaaaucaggcuggguguuauaaucaguuuuaaacacgguaauggaauggaauaaaauaaagaauuuagcuagcaguuauccuaaccuuagguuauaacuuucuaaaaucaagaguuaucuucugguucuuuaagaauauacauucuuuagcuaauuuuuauaucauauuugaaccaaaucauugucagguucccaagucagagcgaguaccacauccuccugcagcauagccauacguuuauaucaguuagggggaccucuuccuagaguuacuuuuauagcuuuuauacaccuccuuccuuaugcuaaacgguaaugaaucaaaagcaggacaguggaagguugagcgcagguggaucggaaugcuucuaaucaaagggaaauaguuucaagucuguaugauauuuuuauauaggcuuuuguucugcuggcuagaaacgcuugaguucaguagcuagugauugaagaucucacuacuauauaaacaauguaauauguauugccuucagcuucuggaaggagcaucaucugccugucuugcucauguuuuaaaaaaguauaaauucuacuuccagugucuauucucuguuguauucaaagcagauagcaaagaggaagaggaugccuguggaucacagccaaaggggcugcagaagacagaccuguaucaccuucagaagguaggcaucuuucucuuccuuccagcugcacuggaggugguuaccuuguuuuaauuugugcucuugucaucacuuucauaucuuacuucacaaccaggaacaauauagacagacugaagcuaaaaacucagacaugcugaugccaucuacacuguaggaagggauugguuuucugugcuaauuauagaauuagaaggcaggaaagaagugcuacaggaaaucuuggguaacuccuguggagacaguggagacauuauauauaccagggaaaucgaagucccuuuuggggguccuuagucuagguucauggaaaaaauuaaccaagugcccaaacaagcggagcagcaauuucuuaggugguguuguuuuauuuuaaagcuucucuccaaacaaagcaugcaagcuguaccuguggaagcugccaaaaguaaggaagauaggcuggcacagcagcagguagcugcgaggcaggaggauagcuuuagagacuauggaagcccagaggauuaggacauuuaaaaagcguacguaggcuuugccaaugugcaauagaaaaaaaaggaguaauuaugccugagucaguacucagaaagacuuacaaacccagaaacaucauggagguucuuuacuaacuacaggagauguugaacagcuuuucuaggggagccucucagccaggcccuccauugacuuaauucucaagggagaagacaguagcaugucuccaccuagagguagguuccauucuguacuauaauucuguucuuugucuugcugucauccuagaguauaccugcgcacagucuacagucuacuagacaguauagaaaacaauucugaagccuuaaggaagacaacagaaguaaaggggacaugggaaugugauuuacaaaaagaauauaauguacuuaucucuaagucaaauauuuuugaccuccccccagcccucuagugcugagaagcaaaccuaggugucucgccacuagcuagagccauaccacuaaacuacaaaucucagccuuucucuuuuuuacugaacacucauaggguaaaaaggcauuugauagucagaugacccuucuugucccauuuuaccaaguuaaacuguacaauagaauuucagucugggugaaacuacacucauaacaucuauuguuccugugggccaaagcuguggauugguguuuucuuccucauguuccuaaaugaaaaugguuucuaaacaguaagcacucuuguauaacugaacagugaaguaagcugcucucuucuuccuuugaacauucacuuggucuauguuuaaagcaaaacacauagagggguagcgucuucccagauucuuagcagaaaauaaagcacacguugaucugguucuuggucugcacucuguauaaguaagggcaucagcugcuucuccaugugagugacagcucucaaaguguuuuuuuucugaagucaaagauguuauauauuuuuuuacccucucccuacuguguccuguaguccuuacuagaaaugaaagagcuaaggagaacuaagaagccaaccaaguuugaaaugcucagagaaaauguuaugaacuucaucgacaacuuagugaggugagucuaaugcuucggugaagaacaguaacccuguucuuccaaaugacaccaggaacucacugcccacagccaggccaggguguuucucccaucugaguguuuuucuugaucuucuguccuuguuaccuaaucaaaugacuucguuuauuuuuuacuguugguuuaggaaggcagguuuaaacuucaucuagccaguuaggccgggugaggaaacacaggacacuucagaguauucugucaaguuugcauuguucuuaguuuuucugccuguaguaggaucugggucagcccagaaacagacauuguauacuagccaugcuacuguuuuguugugaguguuuuaucaggacaacuaaguaucagcaccaaaucgauucugccugcaguaucuacucagcaacuauccaagucuccuaucuaguuuguuuaucggccuuucuuggggagccuggaucauucuggguauuucccaaaagccagcuuuauguguguacaugaaaucaaccauccaggugaccuuauggaaacagggacagauuuaaaagaaugugaguacacaagagaugacuuagcuaguuacaaacagugcagaaguagagguccagccuguaaccccagcauuugaggcuagaacaggaaaaaaucucugggcauugcaggcaaacaugacccugagagccugccucaaaaggaaaguaggaaaagugcuguuuuuagaugaaguuaguugaaggcaguucaaacuggucaggagaugaggcugugaauaagaaugguuuguuuuuuuuuuuugggggggggguguaguuuuuuggugacuacaaugaucuugaccauccugaaagugcaaauuuucauuucccaggacaguguugagggcagauccaauuaggaaaaaugccucagagaugugcccugcugccuggggaaaacauuaauuccagauaucacaaauacagagaaaguuuuaaaaguaguauugacauauaaaacuaggugaaacuauauggguuccauuacuugguguuuguuugguugcugaguucacuguuuauuaagcagcaaauacucauagaagauugacaaaacuguggaauugaaaaccaaccuguacguguauguauguauguauaaauguauguaucuaaagcuggcaccugauuucccgguuucagagacuaccuucugccuccugagagccagccucugcaugagguaguguacuucagugcugccaacacacuccgugagcacuuaaaugcugcuccaagaaucgcucuucacacugcacucaacaacccauacuauuaccugaagguaagaaggaagcccaacucgcccaguuacucacauuuuucuaaaauaaaaaaaaaaagaguuccuagauuuuaguuaaagugacuuagcgauaguagcagucaguagucaacugaggcuaugugcauuugcucacauguaaacugucuuucaugggagauagccagugagaugggauuugccacuaagccucauaaccugaguuugguauaaggagacaaccgacuccaaaaaguugucuuauguucuacacauucaugaccacacaccagaagaaaaauuugaacaaaucauaggcagaaagcuuuagaauguaauaucuuacucuuguaaaaaaugaauuuuuuccccagacauguuuuucucuuuuucuucucuuuucuuuuuuuuuuuuguaucuuuguccugaaacuugcucuguagaccagacuggccucaaacucaagagauccaccugccucugcucccugaguucugggacuaaaggcuuagaccaccacugccgagcagaaaaggguucuucuguagguaacaacaguuggucaguggccagguaauaaggccuaaugaaaauauauaaaauuccaagugcacauuuuaaauggaaaaaaacacccuggaauuucaucauggauuuuaaauccuaauaacaaucuauucugggaggaucugcaggguacugcuguagaaacuccuaaaacagcauacaagggaagaaacagcugccuaaaauccagaaaguuacaaauuuccguuucaaauguucaaaacuaccguuguuuugagagauaaaugaacacuguauuauaaguagguagauaggguuuuugaacacgggugaaugugcaugcucgggaaguuggaaguuuuccuuccagaaaaagaugcuuuagaaggcacuuuugaauggaugugguagcacgcuuguaauucuagcucuccagagguucaggcaagaagaucaccaaguucagggccgguaugaacuuacugauacuuugaaaagaguaaagugggcagucaguauagcucaguagaugaaggggcuucugauuaccugcuaagaagcuuaauagccugagcuugacccccugggccccuguaaaaaugauuccacaaauuugucauacauauacauacauacauacauauacacauagugauuauauuuuuaguuaaaaagugguuccaaaagauaccccaaacuacuaccaguuccuugcaaaaugggguacagaugugaaguaugcggaggauacugaauaggaaguuacuggucaguggucuucaaugaugguagguagcuaccaggagcuugacaguuuccuauuuaaaaccuaauuaucuguuugggcaugugcucauguggguaaaguaccuauaagagugcagaagaagggauaagaugcccuggagcugaaaugaaagguguugugagcugauagaguagggagccuggagcccagcucugguccucugugacauacagcagcagaugcuauuaacuccugagcaucucuccauucuuaauaauuucaugguucaauaagaggagcgucugcucagauagcucagucaucaggugaaagcaucugccugacagacucagaccacagagggaagaacagucuccaacacccaggugcuucauccccuuugcacaacaaaugaauccagguuuuuguaaagaaaaacaacuuuuaauguaugaguuacaaacuaaaauauuuagugguagaguuacagaaacaaacugauguggucuuucaugcauuuuguguaugagauuuuguuucuuaauaaaacugggauuucaaauaaguuaaaccaauacugacaguuucuauagggcuuguggugugagggcugauugccuccagcucuuugcugguacucucucccagucucugcagaugacuauauuuaaggggcagcaucuguucacauggauacacucauucacagaaacaaaaauaaaccuggggggugagaaggacgcucugcacugcugguuaggccauguggagacccugguuccaaaacaguaacagaaagugcagugcugagagcagucucuucuuugggagaucacauuuacucuacccuacucuacgauuaccaaugacaaguguuuacuaaugccacauaacugcuagaauugccuuuauaacaaauguuggacguagcauuuuauuggguaaucauucccagagauuucuaaacuuuuacagcaaacugaaacauguguuaugagaggcucuacaaauaaaaaugagauuaaaaaaaaaaaagucuuauggggagaguggcuuagagcuagagggauauagccaagacuugaaguaugaagaaaggaaaugacaagauccuacuuucuaauuuacuaaauuuaggaguucaacuaauagcuuugguuuucauaauuucuaagauuuuaacuuuuaaucugcuguuuuuagaaugaagaacuggaaggauguauuccaaauacugccccugacaucugcauagcauacaaacugcaccuggaguguagccugcugaucaaccucgucgacugggcagaggugggucacaaagaacaaguuagguguuuaacuagcguuccuagcgguuugugcuccc

SEQ ID NO: 1825 - RNA, 48131 nt, Mus musculus
cgacuuccggcgcggaggcggggcgugcgggaaagggaggcauggcguguggcuuucguaggucgaucgccugucagguacaguccagagcggcgagccagcgggagccagggccggagggugcagccuaggccgacccugccuccuccuugcgcugcggagugggaagauccucgagagcccugagugcucacugucuucucauuucccguucuuaaugcuuuaaccugggcggacuguccagaggccaugauuagacccuguagaaauuaauguuccuccuucguuuaugcccuuuauuugcucucaugaauaaccugguaggauauaucucgaauaagaaauuuuguagcuuacuaaaccuguaggcgaugcucucccgaggaaaagcucuaaauccggacuuggagaccauuggauaaaauagaugauuuaaaaggcaugcuaagggcugcggagauggcuccgcgggugaagugccugcuauacaagcaucugugccugcguuugaauuuccagaaccuagguugaaaaaccugcauagcuaaggaagucugaaaccacacuucugagagguggaaacagaaaccgguggcuccagccucugguucggugagagucugccucaaauaagguggagaaagacacuugaccuguacuccucgcguguuuagcgcagccuauccugccuggaguuugcuagugcuagcacagacuuaggcccgcuguggcuggguuguuuuagacaauucugaaagauggugcauauacuucuuagguaguucugugggaauuaagcuccagccuacagagaugacuuuaauguguuaucugugugucuguguuuguauguuccuucaugaggacaggccacagguugccuguguuuccuccagucacuguccaccuuuccccccucuccccuaaggcagauuuucuccccgaaccuggaguuuacccguuuagcuagguugguuagccagggagcugcagguguaauggcaauucugcuguuagcugaguucauugcaugguacaagcaaaaaacaacugacugucugggaaagacaaaaugcaagagagaaagaagacagaggcagagugaaacuguuuuuauuaaggcaggccuauccuccggaaugagggacgggaaauccagaguuggggagccuguggcuggaugaggguggggaagggugccggugucucagguuuucuccauuggcugugcacgccccauuggcucaccaaagagaugaucgcaggcuuuuaugcacagcuugcucaauuaaggaagcggccaugcuuuaaagacccuucucuaucuuuacucguccuuucuagcuguuaaccacgacucucugcugaccuuuaucccaagaaggcaaggucuguccuuagaccuugcagguguuaaugcucuuaagcucuuggcaggcucuguaagccauuaguuaaguuagccucugcuuucuuuguucuuguguuuaugugaccagcuuuuaguuuuaccauggcaggaaauuaacaccugucauaaccacuguccacacggaucuccggcucuccacucagagggaagaaaggauagcagaugcugcggccaacuuugacugacuggaccagcaacauggguucacguuuccccaaucuccauaguuccaguauggaugcaguuucguggagcagcagaacaaagagugauauuaguaaagcaaagcauuuaaaaaauagauugauggcaccaucagcgaggcugguuacagcaagaugaggguaacucuucuguagaccccggcugcucucugacaacacucugaccccucugcuugguggaaaacuaggguuuuuuuguuaguacauccccaaaagguuaucuguuugucaggauguuaacucuugcuuguaguagcaugauauuagguccaaaggugggagacacuaaugaaauuaauuaggucccagaucugcacuauccauaacucuccacagucgucgaaguuuuagucagucagcuacuacagacacagcuuauuuucaggaauucucacucacauuaccaauacauuuagcugcaguuuuucuugguuaccuaugccagaacuccuugucugugggacagccuggagugguuuccuuccuaaaauaggaacaacccuucuuuauuuacaguuuagcuccuauaacugggcaacauugucuuacauuaguuccucaaggaagccaacuggccugcuggaacuggcucagcccuguccuccuuuuuuauguuaaaaaucauucaguguauuuuucucguauacccuuccccccuccccacccuaccauucuccuuaucugguccucucauacccagauuuaggcucuuuuauuuaucaucccuaccuaauaccccagcucucugcagcaccagcacuguaaagucacaaacacgugucgccacacucagcucuuaaagugugcuaggguucugaacccaguccuccuggcauucacuuggugagcacuuuaccauagcaagcagcaagcagaguuccagcucuggugguucaaucuccuucucucuccuucucucucagugcauccccacagucccaggagucaucucucaaguauacugcuugcaccaaaguuccaaggcugggcuucacaacucugcauuccagcuaguugugguuuucuguagucaucucuggcugcuuaacagaguucucucucuuucgugugucacguguccaaggaauaacuaaauccuauaaugugugugugugugugugugugugugugugugugugugugcgugugugugccuuucaccaaaaauuacugaaaaccuggaaaugucuguaccacuaaauucaacacagucaugaaagaagcuuccugaaaauauaaauguacccauuucugcuuacuuauuauuuaugugcuaaggaccaagccuugcuccucauauguaccaaaccaggccaaguggcuggugguuuaucacugaguuauccuauggccuuugcuuugguuuuuccuuaauuuugauuuauuucuuugcugcuucucugaugaguaaaccuuuaauagaguuugggccuggggauuagauauuuuuuccuuaauauuuacuuguuucuauuaaaugccauaauuuuuaaaucuguuuuguuuguuuuuauagccacgaugcuuagaauacuaacugguacagacuagcuauucaauaaauauucuuuugaugaaaaucaucuuuugauucucauugauucauaucuucuuuuuugaauauacguguuuaaauuugacaaauauaaaauccauugaaggacaagcagccuccugcuugcugcuuuauaaucaaaccauugcaucauauucaagcccuggcagccacagaucuuacuucagucagagaguuuuguguuuccuagaauaucagauauguugaaucauacuuaauaccuucuuuuauauggguuuuacuuaugauguauuugagguuccuucuuauuaaguguguuaauggcauuucuuuauugcuaguaauauuccauucgcucuggaauagauggaucaaccauuuuauccuguuuuauucuuuuuuuccuuuuagcuuuccagaguauuggcucuuccaccagaaagcuugaucaagucaauaucugcuguuccaguuucaaaaaaagaguuaaguaugcuuguagugaucucaaauuguugaauuuguuggcaauccaauuuuauucaacucuuaaauuuacagagucguccuuaaaguuaggauucauuauauucaacuuauuauaauuagggucauaaaauuccaguucuauuuuaaguauuccgugguacauguaacuauccuuuuguuaauuguuuucauauuuguuuaugcuagcaguaauuaugucagucugaucugauuggaacguuagagacuguguaaucaucugaugcuugaguucuaguguaccauacuuacucugccucuuugguuguguuguuugcuugacuucauuugaagacucccaagugauagagaauuauuguuuaggguuauauaaaauccauauuguuuucuuagguacagggaaaaaauaaucuuuuuuuauauuagucucaucauuuuaucauuuuggcaaaauauuuuagugcuuggauaaaauguagccuacccauggauguauuaucuugggccacgggaucaaaauguucaaaaaaagaaaucacaucugcauuaaaucuaaacaagguuauuuuuuuauauuaucucugaaacaauacacugauaacaauauacuuaugaugcauuugcauuguagcaggaguuacagcaaguuaggggugguuuacaguagggggugcacggagggugacuagacauaugcaagaguccuugagcuccugcagaguaguaagaaacuugacacauacuagauucuuagcucuaagguuuaaagauggaauauaaaauucucaguauuaauguauccuuuguucccugaauuuuguuagaacuuucaggugagagggagaggugaguauuccucuuuucaugauaaagaagaaauaaauagaaagaaaaggcacagacuagagacuacugauaaucuuacuauuuucaguuuugaaaauagugaaaauggggcuggguguggugggggaugccuuuaaucucagcacuuagaaguuagaggcagacugaucucuaugaguucaaagaucagccuggccuauauaaugaauuccaggacagucagagcuguguaaaggccugucucaaaaaaggaaaaaaaaaaaaaaaaaaaaggaagaagaagaagaaauuaagagaaagaaaaaagaaagaagaaggccugcuuuaaagaaaucuguaugucaauuacugagcgcuaccacugugugcauagggcuaguccucagcauuggauuguguuguaacuacuagauuucaaaguauagcuauuacaucuuuuaaaagacuuguuuuucccacuaauuuacuguuuaaaacaaaaguguaccaggcagucuaguuagaaaauucaggacacuuuccccuugguuuugaaaugauccacacaagguaguuauugacaaccaugcugauuaacccaauuggaaguucuuuuuauugauggccagaccaagaauggcuugugacucugaaaaaagcucuugagcuuaaggucagggggguaucauuuuaaaaacaaagccaucauugcucaaggagagagagagagagagggagggggagagagagagagagagagagagagagagagagagagagugucugugaguguguguguguguguguguguguguguuuuacuagccacgucugacuucuuuacaagacccagcaguaucuuccuggcagguacuacauaauuugcuuggaccauagccaaugccauggacagucucagaaacgguagcaagauaaauguggccguagaaggcugagaagugaucaggcagacacagaauaccauggggaccggauggcuucaccuuaaucauuucaauugaaaauaaaacagcacaugucuguuuauauucacuuuuguuguuguuugaaacaggguuucucuauagccuucauuguccuagaacucagucuguagaucaggauggucucaaacacagagauccaccugccucugccuucauagcauugggauuaaagaaaugugccaccacucccagcucuguuaauaauuuuuuaaaagacuuucuuuuuuuuuuuuuuuagcagcauaugauucuuacuuugagucuuucuggauguuugcgagccaugcuuguaagauugaaguccuaguuaaucauuuauaaagaacgcuaggacuauaucaagaaaguauaauucaguccuugaucuacucaauucccuaucaucucaauaacaauagagcucauuacuuuuacuuuuucuuuauuuucucugacuuuuaaaaaucucuuuuuguugcuucugugccacuuuaugcuuuauuccuguuuugcuaagugcauuucuuuaguugcccauagauugguucaaauacuugacuaaauuaucaaagacuuagaugaauugcuacaauuaaauuuuguuuuccaaaaauggagugggucaucauauacccagcaaagaauaaucuuagaaaacacaagagcacacuugccaaccauuuuaguauagaaaggacaaagagaaaacuucccccaaggugcaaguguuggucauguuugauauucuguuuagcaucagaucaaugacuaacauaauuuauaaccgagauguuguuucucaauaaccuuauaaaguacauaccauuguuaucaucauuuuacugagguaccaagauauugagcaauguccaguauugcagacauaaauugguagguaaacuugaauuugugguuacagcucaaacaucaguuuggauugguaaacagauguuguacuaaguugcuaggugaugaauuaaaacccagaaaauggccaggcacggcagugcacaccuuuaaucccagcacuccagagacagagagagguagaucucugaguucaaggucagccuggucuacagaaugaguacuagaguagccaaggcuauauaaaaaaaaaacucuuucucaaaaccaaaaagaaaaaaauuagacccaggaaauuucauuggguuuuuaauuaauuuuuuauacaaugcaauuuuuauuuuuuggauuauaauuugauuauauuucucuucaaguccucccuuacuucccuccuugcucuccuucugucucaugccccuuuuguuaguuauugcauagcauguaaauaaggauagguacauacauaccuauuccuaaauauaaccugcucggcugcauggugcuaguaaguguauauguauacauaaauauuuuuaaauaaaauguguucuguggcauuguacucuucccuagggaaggcuaccuuucccguucccagcucuucuuacuuggcuacagcccuuuguauagaguuaagaccucaugggcuuuucuccguucaguuugucauaucuguugcugucauccuuauuuggcucauguuuggucagucaugucagugaggcuuuauguguguagcuucugacauuacuaggagacaaucucacagcgaacucucugacccucuggcucauacucucuuuuugccccuucugcaauguuccaacccugcgccuuucaugcagaaguguuuuguagauguauuggguggaacugcauguaauacauuugaucacguuuuuucuucuauccaauuccccagauccuuucccaugucccauggugagcaggggcucccccaacuuuauguucugucccugucucucuaaaaaacaaaaacaaaacaaacaaaaaccaacaagacaaaaaauaccaaaaggaaacaagaaucacagaagaaaaccucggggucuguuuuguguuggcaugggccuacccuguauuggggcugcuguacccagugacacuccauugggguuucccucugcagaagguuucaguugauauagcuuauuaguauuugugcccaccucccaagaaacuucauaacggucauuugagcuuaaguucuguaaugugaugucgacaagaagccguauaggacuuuuagguguuccucugugucagcccgugugcccuccuuguauauucuuuuaugagagugacacaugggcuagacaagcaauggcauaacuugcuuagcucucuucacuagcucucuguugaauaccagaagaugccaguauaugugguugugcaguuauuaaauaaucugaauugucacacccacagaaaacucuguagagauaugaugagccauucccagguaccuguuuaaacugagaagucuuucuuuuuuuuuuuuuccagauuuaagucuuuuccuugugguaagguuaaccugauuuuuguuuuguuuuucucagugaaacuacaaauucuguuucaaagacuggguacauuuccaggcacacgccuuuaaucccagcacucuggaggcagaggcaggugaaucucuagucugugugaguuccaggacagccaaagcuuacagagaaacccugacuugaaaagccaaaccaaaccaaacaaacaaacgaacaaauaaacaaaaagacacaaacagacaaccccauuuugcucuuguuauuuggaagguuauauacaaacauuucaaauggagaaacagcuucauaguagaugucgaaagacuugggcuuuuaugaaucugcuuacuaguugcacuucacuugccagauaucuuugucuguuucaaagauaaacuuagguaagaauuuuauaaaauaaccaaagacuuaaaaguuauaaguaaauaaaaaguuuuguauuucuugacuuuucauuucaaagguauucauaaagaacacacaggcaauguuucuauaacaauucuuucccauuucauguuaaucuuuagagagguggcagauuuucagcuuucgguggauuccuuacuagaagacaacaaucacaagucacagguagacacucaagaccaagccaggagauuggcagagaagguauuguaucucuaaauuauaauaagcuuagcauuuaaagaagagccgagcucuacaggcagccucagcuauaaugaacuaaauacaauuucuuuguuaagacaucuugaaaaauacuauaguucauuguauccugugaggcuuaaugguuuucaaaguaguuguaaagaauuccuuugguuguagucuacuuucuguugcugugguaaauaugaccaaaaaugacuuagagaggaagagguuuauuugccuagguaacggcacaucacugagggaaaacaagacaggagcuuaagcaguaacugaagcagauauccugaaggaaugcuugcuguuugccucucgggccccugcuuagcuugccuguuuauacaacucaggcccauuuaccuagggaugccaacugcagugggcuggacccuccuacaucagucaaaguguuucacacacauggucgugggacaguaugaacagucagguuccuuuccuaagugacuagguuuuaguugguuuuguuuuuuauuagccacaggacugaaauguuaauuauauuuuauagauugaaauuguauaauuuuucuuugcuugguugguuugguuuuaguuuuccaaggaaagauuucucuguguagcccugacuaucgcucugcagaccagguuggccuugcacucagagauccaccugccuuugccucccaagugcugggauuaaaggcgugcuugaccaucacccggcaaaacuguauaagcuuuuaaagacagauuugcuugcuccccuugaguuccagcuugaguuccagccaguugugagugcuagcaauagcgcccagguccucugaaagaccagccacugaaugcuucuaagauccaagccaucuccccaggccccuggauaaaggcuugaaucuaggaaaacaagcaugauauauuagaacaguggguugcaauuuuuuaaaguaaguuuuugagaagagcauuaaaaauaugaggagaaauaauguauauggaaagaucacagagaaguuguagcuagaugauuuuguacacauucuguauuuuuaaguucuuucucauagguugaguccauugagugaaugaccaaaucuaaacuguuugcuucagacccugacaugaagcauguuggaaaacuuuuuguuuguguuuaauuuuauauuaauaagguuauauguugcucaaagaacucuaaaagauugaaacaguaaaaaucacuauugggaaaauauguguauuaaaaauuacugcuaaaggagcuuugguaacaguaauacuaauuucaguauaaaaucacuuguuugggguuuuuuugguuuuguuuuguuuuguuuuuaagucaggauguauaccaggaguaaaauuaauuauaacacuuaaccacuccaugucuuuuaaguucucagaaauagagauuggugcucuuuagugacagcaggcauugugaguuacauagacuaccaaaggguuugaaugaacacacgcagggcagacagucucuuuaaggcuucagucuguguguuggugcaagugcuguagcaguggguccugacacgauguccuacuuguggcuuucauaaaggugaaaaagauaaaguguucacuguaugacagauggggaaauuuaaagagaaggaacaggaaaggggggagagagacugaacagcauuuuugugaggaaaaaagaaaagaaaacauguuuguguaagaauggcgggacagaaaacacugucuaagccccuggccccaccguaaugccugagaacuaauucaccugcugcugucuugugagccaguuucaugcugcuagaaccacgugucucaucaggucgguucuagaauguaaccugcuuuacacgauucauuauuuuucagcuuaagugugauacaguggugacagccaucagugcuggcccaaggacucuaaauuucaaaauaaacagagaauuauuaacaaagguaagcauggauuauagucuagucuuugugcuuucucgcuguguuagccacacugaucuuccagcucuggaacuuguuuagucuggacuacagccuuaaguuaauaugcuucaaguuuuauauuauuuucuuggugguuuuccuuuucucucucuuuuuuuaacugccacuguucagcuccacagccucugauaugcuuaagcaagcgcuguagcacugggcuacuuggcuagcccugacagucagucaccugcugaccuuagggcgguugcagcucugcuaggcucuuccuuacagcaguggccucugcuauuuuaggcuuacuugaccaaugccacgugugcuuucaacucuaacucacuucaggguuuauagcgucugucuuucccaccauucugucuccauguuuucacauaauggcuaaugcaucauagauaccagaugaauaacuguuugaugaaugaaugaaugugcucuauguuaagagaaauacguugguuucuacucucuaguaaucuauaauuuauuggaagcauaggcaucagcuggagaaaucgugauguagcuuuuucucuuacuaaaacagugaguauuaaaguaaagaccuuaagucaagcucauuuuguucacuguuuuaacauuauaaugcauacuuuggccuauuuuuggcauacucuuggccauguuuuuaaagaaauauagcucacuguuagcuuguugaggcauaguaaauaugguagucuugaauugcaaaaugauuauaaagccaaaagcucucugucccuguucuaaguuacaauuggagaaagauguaauaggcuuagcaaaagcagccgggggucugccggacugugcucgacugaccacagagcagcuucccagaaguccccacaccaacaucucuuaucugaccuacgagcugucuuaagcagcuaccgaagcaagcacaaccuuuauaagaauuccagguuugccaggaacgucuuaugacuaaggucaggcaaaggcucugaaaugcccaaggaagaacuucccauaaaucugacauaacaauuacugcuuauuuacaagagaugacguucaaggcugaguggucaucccuccagaguaaaggccagcuggcucuugugaaauucugcuacgucucugacuguggacucucucaaggguuuucuuuuuagauuuauguauaugaguacacugucacugucuucagacacacuugaagaaggcauuggaucccauuacagaugguugugagccaccaugcgguugcugggaauugagcucagggccucuggaagagcagucggugcuccugagccaucucugcagcccucaaggauuacuuuuaaucucacaccuuugcuccucaguccuuaaugcuucugaauagaguuggugcuuuucagaucguugggauucuauuuuuucaggcaucuuuuuuuuuuucauguuccagccuuuuuuuuuaauuagauauuuucuuauuuacauuuuaaauguuauccccuuuccuaguuuccccuccaaaaauccccuccccauucguccugcuccccaacccacccacuccugcuuccugggccuggcauucuccuauacuggagcaucgagccuucacaggaccaaggaccucuccucccauugaugaccgacuaggccauccucugcuacauaugcagcuagagccaugaguccuacuauguguuuucuuugauuggagguuuagccucaggaagcucuguggguacugguuaguucauauuguuguuccuccuagggggaugcaaaccccuucagcuccuuggguccuuucucuagcuccucuauuggaggcccugugcucuauccaguggauggcugugagcauccacuucuauacuagucaggcacuggcagagccucucaggagacagcuauaucaggcuucuguccgcaggcucuugcuggcauaugcaauagugucuggguuuggugguuguauaugggauggauccccagguggggcagucucuggauggucuccuuccuucagucugcucugaccuuucucucuguaacuccagacuuucagucaucguucauucugaaguaagucaaaauccaaaaugucacagaugagacauuuguguuaagccguaccuacagccugcuaguguacuugucucccagggucuacuacacuucccugcagggccccaacauacagccaaagccagccucaaguacagaauucuuuugaaaucaucccacggcaauucacugacuuuaucauucaucacuuuuaaaugaugcuuuuguaguuauuuucugauuuauggaaguggaaaugaaucuugccaaauaugcuuuucuauacuuuuagcccuugauagcaauauuguccuucuuuuguuuuuccuuaguuuggagggggaggguagaauuuuaccuuuaaagguacuuuagcuaaaagagauaagguguauacuuccaggaaaaaugcauguuuguguaauaauuuaaaauuucaauggccauggacuuuuacuuuauuucaguuaaaaaacuguaggauuuuaucaguuguauuagcuacuacaaauauuuccauggcugggugagguagaaaauccaugaugguguaaagagcucuuauuuggguuccacacuuaacgcuugccaauaacuugaaguccuuugugggagaaucuguaacaucuacuggugcauaauucaguuacuagggagaaaagaaaaagaugauuuaaaucaagcuauauauaugauuuauuuauuuuauguaugaauacacuguagcugucuucagaugcaccagaagagggcauuggaucccauuacaaaugguuaugagucaccauguaguugcugggaauugaacucaggaccucuggaagagcagucagugcucuuaaccacugagccaucucuccagcccucuauuugcauuuuuaaaaaugcagauaaaaccuuauuuucuuagauauaucuaaaaaauccauggugaauaaaaucacauuuuuuuuuuaguuuacaaauccaauuuugcaugcucuacuaacaggagaagaaacugcuuugugacgucaguaaauaaguuuugccuauagguagugaauacaucaagcuguauuuguuuuauaaacucauagaaauagugauuuuacuacuaacgaacugaccaggcaaguugguaguggcaaauuccuuagaguccuguugacaggcaaaagagaacagucaacccauagaguuagaaaggagaaaagacauaagucuugcauaggaaggacaauagcaaacagaguagcagccaguagguauaucccucgaguuccuugagcuccaauaacagaaagcucaaagacuucauuucugauuaaaaccuuuuaugcaugaguauuuacaugaguacagcuuacacucaaacaugcauauugguaaauauauuagauucuagugcucuuaucuuuuagaacacaauggaacaauaacaccuccuagacaguuugaaguuaaaaaaaaaaaaaaguucauuuguaacugauagcuucuagaaaagagaaaguuaguuuucuucaaagguguggccccugguagguugaacaugcucugcuggaugcccacacaccagagaauguacagguagcauuacuuagacucauggguuaaaaaacaagacagugaaucggggccuuacugugcaguguagccuagccaauaacucagguucaccuguccuggccuuccuucugaguugcuggguuuacaagcaugcaccaccugccuuaccucauuucuugacuauuuuaacuaauucuugauaauaaaauucuugccccagaugaaguuggcaauacaaauccaacaagaguaaaaauaauacuuuauaacaguaguuucaaauaaaaaauuggggggcuggagagauggcaccaagguuaagaguacuugcucucggaggauccagauccaauuccuagcaccaucuguggcacaagcucccagggacccugccuacucuuuuggccucugcaggcaacaggcaccgugugguucucuaguauacauguaaacacucauacaaauaaaaaaauuaaaauuacacauaacuaagagaaucuuuuaaaaacaaauagaaaccuguaugaaaccaugcauuguaaccuguacagaaaugaacucugaacuaugcuguaguuuuguguuacuaaauaaacguuagcuuagaauauguuauagaaguuucugucagguuucaucuuccaucuguagagccagcaggcauuuuaguacauauucuuauguaauuacauauucgcuagcucuacuuggugucuugaguuagcacagaagcaacaauagcaggcacguaguaacuuaacacauucacuugacugggagaaguuuugcuauuugacuucuaaucgccuaugucccaggcuggcuuugaacuagaggugaugccagugaugaccuuggauuucuggagugcuggaguuggaacacagagaucuguacauucaaggaaagcacucuuaucaccugagcuauuaugaccuuagggaaauuaaccucugcucuucuuucuaguuaauauaaaaacccuccucacugucuuuauaacagucuucacucaguaacugauuugacccugcuuuuggcucagguauuacucuucccauggaacuuuuggcaguuagccuaaccucacaaaguuucaaguuccgggucuuuaagugccaucaaugguuacuguacuguugaguggguuaaauuuuuaguccuggaguagcccaucacacucacuaucucacauuguaagugcucugagaggacuuagugauacugauacuagagcugcugcugacagcucuauacaguucuaagaaggaacuaguuaacauuugguuuucaguaauacacugguugggaauauuuauuuauuuauuuauuaucuguaagucccacuccuguuuuuucaggcaguauugcaacaaguuacugaagauggcuguaaauauggguuaaaaagugaacuuuucucagaucuucccaagaagaggauugugguugaauucaggugagugacuguugcucuuuugugccgauuggcccagcugacaggacggagacuguggugauagaguuuucacugaauuaggcauggaaaguugaaaaugagcgacauuauguuaucuuguuaggaucuuuguggaucggucaccaaaccaugaauaaaaaugacaaaaaucaauaguuuaugaauccaguauggguuugccuuuuccuuucuuugcacaggaucuccagugucccaggcuggccuugaacugagcuuguaccuccugagugcugggucuguaggcgugcgccaccacaccacguuuaugcagaguggguugcaacucaaagacuuguuccugcaagagaguugcaugcuacagcuggagugggagucaguucuccccucugcuuuuauuugggugcugagaauugaccacggauugccaggcuugcuucgcaaaccacuuuacugucuugccagcccaauuacuaugguuuguuuguuuuuguuuuguuuuguuuuuuuaagaacucaucuuucacuuuaguuaauuuauaaagcaguucacuacuguauuaagaguuuuaacaugaggcaggcaaauuucugaguucaaagccagccuggucugcagagugaguuccacgacagccagggcuacacagagaaacccuguuucuaaaaaccaaaaaccaaaaccaaaacaaaacaacaacaacaaaaaaagaguuuaacauaguuuggauaacucaagaacaaagccuugcaauuauaauuagauuuuuuuuaauuaacagaaaaauaacuuuaaggauuuuuugguuuuaauuuuuaguuucuauuguauaugugagguaggucagguucauaaauaugguguugugcacguggcggucacaggacacccauggguguaugccuagccuaccuugucugagaacaggguuuccuguuugccucugugcuucacuaguuggccugugugcuuucagggauucucccuuaucuaccuccugucugccauuggagcacugggauuacaccugauagcacacccaguuuuuacccgugcucugagaauacaaauacagauugcugucauucugugccaaagauacacuguccaaguagccccugaggguuuuguagggguuuuuuuguuuuguuuuguuuugccuuucuuuuguuuuucgagacaggguuucucuuuguagcucaagcuguccuagaaaucacucuguagaccaggcuggucuugaauuuagaaaucugccugucucugccuccugagugcuggaauuaaagguguguaccaccaugcccccaaguuuuuaauuuguuucuacauaucuucagauaaauuucuaauacauuauaaauaaaaccaucgaauccuuaagcugucaugaaauaaucaaaacuuuaaaggaaacauuaauaacuaacaucgucacaguauagcugacuaguuggcaguuaaaguauuuaucuuccaaaagaagaaucuuaaugaacuacguccccauuuagaaagauaaggcucccuagagucccuuuucuucuucugcauuacuucuggggacaguaugagugcacaugcaugcacauacacauguccuaugaaggccagaugucagccuuggguguuuccucggguggggugauccuccagugcauccaccuugguuuugagacggguucccucccuuggccuagaacucacccaguaggccaccguggcugucaguuagcugucaggaggacacuguucucuuccuccucagcacugguguuauagcagcacaccaucagccuggccucugugcacggguucugaagauuggauccaggcagggccacaugcugcucagucaagcagcuuuccugacugagcugucuccccucugacauuuuaaaaagcugugggaaaugucuuguguuuacuaccucacuuuuguuccucagguacuuuuuaaaaacuuagguaugauuucaaauuggacagucagagaaaggguuuuccaaguugcacauguacucggcacuuagagucuaagggcagacacuggaagacauaaaaccguuuauaacugaggaugacugcugagaugauugcccugcccauagcgcaggcgcggaucuuggugcagucugugcaauguaaucauagcauuuaaaacugaguuuagagauuugugugugugacaaagagaaagaggacuuuaaacaacccuucauacuggaggacaagacacuaaggagcagcccucguccuggugggcgggcugugugcuacagagcucacauguguguucaggaccaaggcuguggugaaguuuugcagggcagcacaggcaagccuugcuggaaacacugcagagccaugauguguuugauccugaacgggccuucugaaacuucuacuccaaccucucuucccaagaaauuuaaauuuuuuaauuuacauuuauuuguuuguauaugugugagagagcauuugugugcugugcaugcagagaggucagagggcaaaugugggaaucacuucuccucugaacaugugggaacucagguggucaggcuugucagcaggaaucuuuacugagccaucuuacuggcccugccuaagaauuuuuauaaaacuuugagugcauagguaaauaaaauauaaaacaggaauauaaauuaauguuuagugauauuauaauuuauuuuaaaacaguaauuuacauaaaacuuaauacuaugugcuaauuugcauacuaaugugacaaauacauuuauuuuuauacaaagaauuaaaccuuagcuuaauguuuaguacuauagaacauagucucuccagcacuuuuaucuccuuaaucuuaaaauaauugguuucauaagugugccauuucugaauaucaagacuacauuauggaucacacagucaauaauuguugguuagaaauaaggugauucuuuucaaauucuaauucacccucacuguuacugaauugucagaagcccugcucccuauuuauggcauuaucuaugcauuaucuaguucauucucaaaguuuuuguuauugaaauaagaaaauauucuugcaauuuuugcaguucaccuaauauugccaaaaaauuucauguuggacauuugcgcuccaccaucauagguaaguguucccucaacaggaaauacuaaacaagccuuuggugacguggagaagaaugcgguguaauggucagaguuuaaaucagaaggaaggaaaggaaggcucccaaauguaaauguauaugagcguaauccuaagcaaauguugcacugaauuggaaaauggguuuacagauuaaaaaccacaauugacuucaacaggaaaagacauagaaaucaguuuucaauaguauauguguugugauuuuugacuguuauccuuauggaaaacuaaaagagguaaaaaauaaaaaauugucacaaauuauuucugugggauuggcagaaauauuucaaaauuuuuuguucacauauguuuuguuuuaaauaaauucacucucagcacuuaguaauuuuaaagacuaaaaauuucuauaagaaauuuuaggaauacuaaaacuacuucauaauuguaaagcuucaguguauaauaugcuuuuuuaaguguguguugugugugcguguguuguguguguguuugugacagagagagagagggagagagagaaagagaccaugaacugcccacagaauccagaaguggauugaaccggaaccgccuggaguuugaguuacagguggcuacgagccacccagcgcgugugggaacggaauucucaugcucucaagagcaccaagcauagcaaacacaaccacugagccaucucuuagguucugccuucuaccuacuuacauuguuuugcaguacuguaauucacaacucagcuuagaauuaugcaguauuagaauugguguucauuuauuaaguauauagugaggaagagaacaaauagcaagacagagagagaaagagacaaaauggauggugagagaggaaagcaugaaacccaaacauggucaagucugaugcucaaaacauucaaccgaaacucaacugguaaauucuuugaagacagccagcuaauagagcucccaacugagaguccccucagcugagacuugcaaguguaaggacaagcagcagcagccagagggaaugccaaaucagacccucaccgcuucccgcugaaccagccugggacguugaguggucagcucgaguuucccguugagccugcuggguuuugugucacaacuccagcuucucuuucuuuccuaugaguguuguacaucacaggauagacuucuguuggagaugaucuaccuucuagcucuuugcaaggccagcguuuauacucggggacugcuacucuucccucccugucacagaguuagggagccagcccauucucaaggagccagcgugcuugggucugcaguggaggcagagacgguuucucagugagugugaacauuacaugacaguuuacaaauaggauguacauuuucccccacuuaauguagcucuguuuggcaagaacaauucgcuaagauguguguagaagaaacucuuacucuguaagaacuuuccuaagaucacaugaauaaaguauuuguggcugggaucuaagaguccaauuaggagccauauacagguacuuagguguauuugugauauaacaguauucuaagaaaaguagauauacaaagcagcugaaagagauucuuccugcugggacuauguaaauuuagaagcuguagaccuagagaugcuuacaaagaaggaagaugcuguaauucacauuaggcuguuuauacuuuggaucuuguugccuugugacagggucucguuuguagcccagguuggccuagagccacucuguaguccagacugagcaugaacuuuuagcaguccucuugccucaaacucccaagugcugggauuaugacuguuugccagcaagccacuauauuuaaaucagaaaaugauuuauuauagaaucucgaaugacuugcaaaguuauugggaggacuaaagagauuuucaauugugcuggcaugagugacucugagaagugucccauagaccaagguuggugaccacaggagaaccugccucuucugccauugcuuccaugcccuagugccacugccaugauccagaaacugccgcugugcaugucaugucuucugcaguccauuacagacaacagaggccaugacauagccugucuuucaguuuguuuuagaggucuggacacggugcuagaaccuguauuagcagguaccacugaagaggcaggagaaaaacaaaacaaaugccccagagugucauagcugcuuguguguguguggggagggggggagggacaaacaaaaaaauagaaguaacuccuuugccaacucacauacaaaguguacccuacuguccaaucuuagaggguuucuggaaccuaauuauaagacccugguaacuggggaagaagauccuugagguucccagcuuuugcaguauaugaaggcagguagaaggcugaguagaacagacgcuggacaucagggcuguaucaacaggaaaugcagauaaagggcauggaacagcaugugccccuagggacaggcuuguggaggaugcucuucagugcuugaaaagauuacgucagcuacuuggaaaaacaaccguguacaggucacguucuuaggacacagacaaauuauauaguuuucuuuaggauggagcccgcucaugugguauguggugcaggugccuacagaggcugagaggugugugugugugugugugugugugugugugugugugugugugugugugugugugagcacagguauacacgauugcaaagcaucugaucccuuggaguuagaguugcagguagcugugagcuuccugaucugggagcuuggaaccaaacuugggucuucuggaagagcagcaaguaaucuuaccugcgggccaucucucucgcccccugaaugccauauucauuaauuacugagguucuguucucuuaggcccuugggauuagcuaagaauagugauuaauuuguuucuaagugcccauagugauacugaugaaaauucucuucucaugacaauuauggggacccuuuggaauaacaucucuaagaaauuccuuacuucauaucuuaugcaagaaaacgcauuaugaaugcuuuaauaggaaagacugaguuuuauuuaauauaaaaauuuuauuuagaaauagaaguuuuauuaaaaggguuuuucuaucuuauaacuugauaaaagagaaguacaaaguuuuaaagccaaaaauggauaaacuaauauaagacuauauuuuaucuaugacuaggaaauuuuauagcaaaucuaaaagaagcuuuaggacaucaaguaacaagaauaaauuacauuggagauuggggcaugcaguuugguaagaaucuuugacaugcuuuucauuuuaucauauggcuuaaucuuucaaguacuaugucacuuugucgucuguaugaaauguagacaaucccuauuggauaaaauaucugugaugcuagaaauugaucuuggggucucauguauaccuagaacauguacuaccacuaaccugaaucugccuaucaacuuacauguucuauauaaaucucaccauauaauuaauuggcauauuuagagcaguaccuaauaaauuaguauacuuaacacauacauuaagccuuuaauaaagaacaguagcuugcuuuuauugguuaaauguaggaaugaauacacagagaagaaauaagucucuagccaucuuuaaaucucaugaguuccaacaccuccccaccucuucaccccaccacgauccucccacucccacccccagcccguccuaggagacuugggaucuguuacuguaugacugaguagcccagagaggaaacaaagugccaugccuuagcuuucucuugaacucuccaucgaaguagguggagguggaaaggaaacaggaggggaagggugggccccaaggaguuacaugccauaagucauguuuauucagaaacacugugguucauauaacccgacaugaagguuuaagggggacaaggcaggugaaguuguucauguugggaaggacggcuugcacacugaguacaggcuuuaagaucgcgcuauacagcuauauucuaugagagauauggccuuugcauaucaccacauuccuagaaggcagcucuucucuguaaacguggcguuuuauccuucuguccccaagcucccaaaauaacgacucugcgacuccaauuauauuuacagauagcuuggcuauaagcuuuaguuguccuccagcuagcucauuuauuaucauccccuaugcuauucuaacugccauguggcugguuccucuguucaccucccaggcuucuguccuccuccaugugccugggcgaaucccugugcugcucucuauccacugccagcugucccaccuccugucuucuuucucagcucauuggccauaagcuuguuauugacaggugaugccuauaagagauacucucuacacucagcuaggauuuuuguuguagcacccuaugugcucuuuucuccacaagacgcuaauuuccugagggaauaggcuaugccuuaauuauuuuuguauccacucagugaugaauggcucuguuuauaguacuaauagcaaagcuaagugaugauguuguaagccuucuccaaaagcauaaaguuuccaaagaagcuuucucauaagagguucaucauagccuucucuuaugaauaguauuucaguuacuaaaaaauguuuccagaccuuaaaaauagaaguuaauccuguucacagucugcacacuauugaagacacagagagcaugcccucuguuucaaaagucugcugucaguucacagcagcugguagucagagguuuaaacuuaggguacaacaaucaagacuuccuagcuaucguccacugcuuguucuucugacuggucuaaacaagucacagcagccgcagugugugacaaguagucaucagauucuggcugcaggguuuacaguaguauuuuccuagaaaggaauucugugauuaaugaucugccaacaucccauuccagccaucauuguagaauuaauagucuuccagcucucccaugugagaguuggcacaugguggcugugcacagaacuagcuuuucaacagguaucagacugaauguuaaauggagcagccuuuacuuuccccaucuuuuuaguccacgcuucgcaucuuuccacauucugcuuccauuacccugaaucacaaucacauuuguuuuucuuuuaaaauacacacaacuuuacuuaccuuucucacugcucucuaggaucuagaauauugcauacucucaugugcaguggcauuuuacucugugcugacucucguuuagaaaaaugagcauuggcuucuuauuucagaaggcauacaguucauggugcuggggaggugcgggacggggaguagcuggucaugcugguuuugcagucagggugcagugcaggucugagacguucaucuccuuauagaauuauaccuguuucucaccaugacucuucucuacuauuuuauuuuguaauuuuuuuuauucauucauuaucuugauaggucugcugggaacugguuuccagcuguuuggcuaugaagagaaacuccagaccaauccuuuacagcaucucuuugauguaaguugguuagauaaccauaauagagauuucccccuaaagguugacuugaggacacaguuuucccucacuguacauguacccuaaaccagccuaagguagauaagcuuuucuauacuucauuucuggauauacuugaauagaaaguaucuaaguuggauuguugucaagggcagggaaacuuacacuguuguuucaggagagguggaugugcaaaccaguucagauugggggaagagaagauucuaagguuccuaggugcauuguuuugagagagaagugugcauauaaaacuauuauccuggauuuuugucagcuugucacaagcuagagucaucugaaaggagggauucucagcuaaaaaaaauaaaaaaaaaaaaaaaaugccucuaugaaauugccuguaggcaagcgugagggguauucucuugauuaaugguccauguggguggcgccacccugggcaaguaguucugagauuuauaagaaagcaaagugagcaggccaaaaaggagcaagccaguaagcacuccuccuccauugcuucugcuuuagcuccugccucuagguuucugccuugaaguccuucccugacuuccccuccgcugggcugugauuggaaugaguaaaccaaauaaauccuuuguuucccaaguugccuugggucaggguguuuuauuacagccauagaaccuagcuagggcagaaauugauuccaggaauauccccuauaggcucggccagcauuccuaacugcagcugacguuucaaguccuagcagcucagcuugauccuaugguccuguggugaaacagcauacacagcagucagggcuguugaagagccuccuguuccauccagguccuacccaaugcuagcagcuuuccaagucacaugguauaugggccagaguaccauacccaagugaggaauauguugccuccaaacucugguuagguugacuaaaaguguuguacuucccucaguggugagagggaccacauggaacaacuuuuccuuugcuuuagaaggaauacucggcauuuccaugccaccuaguaauguauaaggcauaauuaaaggcauguuugugggcuauugcugugccagaccugaccguguguucugaaggauuaugggaguguuugaaaauuugagcuagaaaagccguugucuacuuggagcccauuaagcuauuguggaaacuuagaagauaaagcugagaaagguguuguuaauggaggccugcacuugaagcuucagaaggaaguuugagaauuccucagagaauaucaggaguacuguuuauuguaauauuuugaauuaacaaucuguguuucuggucaguguggcuuugaggaaucagcugugauuaagagacaagaaucauucaguugaagcauuauuguuuuacucugccaaucaauucugguuaccugguucauuacugaggaagccaaggcaggaacugaugcagcggccauggagggguacugcuuacuggcuugcucccuauggcuugcuugcucagucugcuuucuuauauaccuaggacuuccugcccuugucagucaucagucaagucaguaucccacaggucugccuguagcuacuccgaugagcacaguaucucaacugagauuccccacacucaggugaguguagcucguguuaaguuuacagaggaccagccaguacaguguaucaaguugucagugggucaguuguccugauuuguuucuauugccuauccucaucaauauggcaccuuuaagaauacauaauuguguuuaaucaguuuuugcuggagauacuaaguuguuuuacuagaauguaugccauguguagcacauuugacauguggagaguaucgaaguuacagaacaacuuuugggaguugacucuccuuuccucuuuauuuggguucaggcaacuucauugcauacugcuuauucaaauucauggaaaaauucuuguagaauauagcagcaaccugucauaauauuacuagacuuaggaguuauaaccugugccccaacaagccagguuuggcuacccauccuugauaagcccaguugaaagucauauuaauagugaaaaauaggaauagauuuauuucauauggcuacauuggaccuggaauuacaguugugaacugcugugugggugcugagaauugaacucauguccuaugggagaacaucuucuaacuacugagccaucuccauaacuucuuuguuuuaauuacuuuuagaagggcuagaauaagcaugcccaucccaguuugagauacaaucuugccucaaacuuauuuuggaguuucuauuuuuuguuuguuuguuuguuuuguuuuucgagacaggguuucucuguauagcccuggcugcccuggaacucacuuuguagaccaggcuggccuagaacucagaaauccgccugccucugccuccugagugcugggauuaaaggcgugugccaccacgcccagcugggaguuucuauuuuaguuacuuuucuauugccauaaaaagcacgacaaccaaagcaauuuauaaaagaauuuauuucagagcuugcuuacaguuucagaggguuuguccaugaucauuaucacagggagcauagcagcaggcaggcauggcugagcaguagcugagaguuuaaauucugauccaaggaggaggcagagaauaaaagguugcuugugguauaggauuugauuugauuuaguugcuuuuucauaacaggguuuuucuggguagcucuggcuaccuggaauucauucuguagaccauguaaccuugaacucacagagauccaccagccucuaccucugguuccugagugcugggauuaaagaugugcaccaccauugcuugauucauccuuacaacuuucaaaugacuaauguaucuguauuuuuuacagaugagaaaugcagauuuucacacuaguaagccaucucacauacuuagccguauugcugagcucaccaguuagaauaggcuggcuaaccagcaagagagcugccuggcuccaauauccuaaacauaugccgugacaucugucuuuuguuguuuguuuuuguguguauguccucugcaucuguagugugaugguuagugcugaucgucaacuugacaggauuuggaaucauccuaggagaggagccuccuugcacaccugagggaguagccucugacuguuccuaugagagauuauuuaagcaugugaacauccacccuauaacauccacauugcucuguaggauuggcuccuagacugcagaaaaaggagaacucuuccuaaacacaagcugucaucuuucugcuucaugaccguggaggcaaugugaccagcuccuguugccgugaacagugaaccacacgauaagcuccucuuuccauaagaugcuuguaugcgggcauuuuaucacagccaacaggaguagcacauggcaucgacuuuuccaacugaggugucucccuagccccucagagccugcuuauucauuaccgcacuguggagcauccgcugcaaaguuacuuuacuuauggcuccuccgugccuaggaugcuucccagugugcucagguuuaguucacaggguuucugauggcucgucucagaagcaucaguuagcugugaguguuucuugucguuucuuuaaaagaacaauaauacccugaggcaugacacagccucagugucaaacaaacagugagcuuguuuguucauauuauaacugugaguuccuaaugagguaaacauucaauugcauucaaacacagaagacacaaguauaugcauuaacgggucuaagaugccaaccuuaugccacaaucaucuguggcauuugucaacuugacaacucagcacugcuaaaaaugaucagaagguggcauuaaaaacccugcaccaagaaguuaacugugcccaagugacuaaugguuccagugacguauuuuaaaggauugagauacaaaaguguuuccacuucccuuacuuugugcuacuuuauaauaaagcaggccaucccaagagcggcaauaaugagcuuaguggaauuucaaaacaaaagucauaugguguuugccaauuccaacaucagaacucuugaaaggggaagguuaauacccucuuaaggaaguugguaaugcuuaaguaaugcuuaguuuguucuuuauuagauaaacaacugauuuuuuacauuuugaugauugaagaaaaguugugcuuuuauucucaaaaacacuauacuacagcacgcugucuuacuagcaaccacaauuuaaauuuuccuuuuuauucucuggaauguaaauguaccuaaaaaaaaaaaaaagcugucucugaaauucauacuuucuaaaauaaaggauuuauauuaauuuuacauuuaaauuucagaauuacauuacaugugugaaugaaaggaaacuaauucuaaacuguugacuuacaguuauuuauaggcauacuguaaaaugguaauauuucuauauuauauacuuuaauaaaacauuuguguguauauacaaauaguaauuugguuaucaccacuuaacagauacuuuaaaauguaggagggguuuuuguuucauuuugauuuauauuuuuuaggaaaauauuucuaauauuuuugaaacauucacaucaauagauugacuguauaauagauuacuuguuuuauuuuuauuaaaauaaaauuacccccuuucggcuccggucuugcacgcugcaugagagaaagcauacugugaugguccuuuuguccuggcgcugcuuguucucuccucucaguagauccuuuucugcucauagauaaucaucauauuuaagcauauaugccuaguagaucaaucaguguguguguguguguguguguguguguguguguguccccaguagaacauuauucaguccuaagcaaugaguuacaucauuuucagaaaauagaauagaacuggagauugaugguucuauuaagucagaccugaaaugaauacaguuugaaaaugagcaugauucuauguauauuuguuuguacauuauguguauaauauguggugugugugacucgaagugaccgucugagaccacucauggauauauuugucuguuccuguauuaguguauuaauagcauuugcucauucaugucugcuugcuuuugccuuugggugcugggauuaggggcuccuugucacacaccccuuuugucuuuggcaacaguaaaaucgguuucuguguaaauguuguugcugugguguucuacuacuguauaaagguuuagacgccucauuguuuuguagaguuuuuagcaauuucugugucuuuguauagagucacuuuagcagccuucuggacucacucauguuucaaggugggagugaguuaauuacagcuucuaagaaaaauuccuuguagucuauauguauaacugcaacccuaauugaacuauacugcuauauguauuguuauguauuaauaguauguuguggauauuggggaaaaaauuuaaacugcauuagaagugaccccucaguaaaccaucaaccccuuuccaguuggauauaaaacuaaaccaagguuggauuguguuaagaacccccuaacugcuauuccuuguaaugcuuaagaguugagauuagaguguacuuaagcuuucuaagagguauuucuguuugccaucauuaccuguuuagcuggucuuuuguagauuaaaagaauagcuuuaaaucauuucauuaaaaguagcuccugaaccacauaugcacaggaauggacuggggugcccagggaugguagggugggcuccuguauucccccaacccacccacccccauggcucagcucuuugcuacugacaauucaggggccagggagucaucgcccucagguguguaccuacucauacacucugaaccagaacuuaguagaugauuccaggccagcagucacacggaugggucacaaacgugaagcagaaguccugaaucugggacauguagagagggauggagguugguagugggggagagacagaugagggaggggcagggaaagugcaggcggaauauauauaaaaacaaacaaugagaauaauguuuaaguagcugugaaaucucccauucaucuuuuauuuaccggguuaagccaugcuacuuugauuagccuuucucacgaacuuucaaaaaggguaagaugauuuaaacaaacaaaaaaagaucccaaacugucagcuuaaugaaagaguugaaaaugacgcuuugucauguggccucuugguuaacuuuccauggggacucaggauuguguuugguuucuuuucuguggugauacagcauauaauaauguauuuaauguacuuuuagguuuauguacaaguuaauaaagaagcaacagaugauaaaaauguaacaaaauuggcacacgaguucuuccaccgacuagaaaugggugacacgcaggcacugucacuguggcagagauuccgggacuugagcauugaagaguacacccagauuuacaagguacccugcagucucugugcccccuuuccugggucgcuuggcuagugcugcugcuuacagccugcugugcaagcucuuacuuaagcauagauucuaguuuaguugaaaauucaguggaaugucguucuugggguagagagcuaaaauaaaaaacaacccagagcagugccaggucagcacuacucauagcccuuacucucucaaggaacuuaacuugugagauaguacuggaugcugcaaagcaggcucuggaguacgugggcacagugagcagcugcauggaaguggagcuagaggagcuugacagacacccuuuucagggcucuacuggaucauacagacuucugguucuguaaccauccucaguggcacagggcccagcaggugccccuggcugcaugagcaccuuuagugugacuaaggaacuaccagaguaaauggucaaugcugucgacuucuguuuacaaagccauaaauaccugugacuacuauacugaacgaacgccagauacauggccaguaugggugugugugucauuagaaagucugacuuuuauuuuucugaucuuugugacaguugguaagacaucuuuaauuuugucuuaguguaaaacaauauaacuaacauuuuucuuguauuucuaaaucuuagcgucuuggaauauacuuugaugaauauucaggagaaucauuuuaucgugaaaaaucucaagaugucuuaaaguugcuugacagcaaaggacuucugcagaaaacagcguaugaucgaguuacuauucuuucuuccuuuuucuuuaagauuaugacucgcuuucugcccuggaacucacuguagaccaagcuggccucagacucagagaucuuccugcuucugccucucaagugcugggacuaaaggcgugcaccaccucucccagccccaugugcugugugugcuggcauuagucaacgucugugugauaguaauauagucucugggcuucuuugccaucuguccucucuugccaggggcagucgguggugcagaucuuuccucucagcacuggggaggcagaaucaggaggcucucugaguuccaugacagacagucagggccacauggugagacuccauagccgaaaagguccuuuuccacgcugugcguggggaagcacgccuauagucuguaagcaggaggccgagguggaagagucagcagugcaaggauggucugaacagucucaaagaaugagaugcuuugucacgugcuguauagcauuuucauugccaaaauucucagcucacagggguaagggaggcaccuguuaaaguaugaaguaugaagaccauguggccugccucagcuuacaucaauugaucccgugaagacaggaagcagaacacuuuuguggcuuaauguugccuucaaaaguauuuaaggcaccuuaugaauagguuugcuguaacaggcuuucaaugagugaggcagagaaaucagggaauagcaggaaaaacagugugaagucagauaauggucgcacauccuuguuggcaguguugccuggcauguaguagaaucacuuccuuuuugagagacuugacaaacgacaauuuuguguuuucauguuguuguuuccauaugugcauuguggaccagccaggucaggugcaucggcacacauagguagcuguggugagaaugaacgauguaccuagcaccucacauugucagcugugaugugagcguccuaacgcacgugagaaacugucguuggaguuuucauuuucaccaccuccaggcagcuuggugguuuugacuacuguugcuucuagcuugaacugacacuacuuacuguucugugagcaaaaaaauagacucugcuuugccaaaaaugcuauagcuacucuacccccaaaguagaauucauaguuugccucuuugauuuucuagggagggaaauguuguaguagaucucucugggacuggugaccucucuucugucugcacugugaugcgaagugaugggaccucucucuaugccaccagguuuguagcaucaggacgacgagcacagccgcgugcgacuucacgccuaagauccuaagauccgugcagguuaucagcuuauccgcacaccacuacaaaagcccuaguugcaaaauagaaaccuaucacuugaauauuuuaagaauauuuacugcguuucuaguuauugacaguugcaaucccagaaauauuuaauaugggaagacugggacacuauauucacauuuuauucaauaucaugaucuguuuacagcagaaaaaaucauuccauguuccuucauagccauauguugaggguuuuugauaagugcacauugucaggaaauauuuucuaaaaaaccaccgagccaggguucagugaugagcucaugcauuaaagaccauucugcacgcguguaaacgccaaaccucacugugcuguggaagaacaggcuccuccacgcaucccugugggagggagggaacacucacuguucauauagaagaagaacugcacuuucuaugcacacguggacggugaagcagccauccagccagugcaggcaaaagguuccagugucuccaggcccgaguuucaaguagcucacaaaccacuauauacauuucuuuuguuuguuagcauugugguacuaggaauaaacccaagauuauguguauguuaggcaagaauguaccacugaccuaugccaacagccuuacagaguacuuuuauaacguaaugguauuuuugcuauugaauaccaucauuauuauaaguaacuugaagcaaccaaugaauuuuccuagugacccuuaaagaauucaucuguuuaaaaaaaauauucuuuaaucuuuuaacaguccagucguuaucccccuccuggucuauccuuggacaguugcuuaucccacuacuucucucccaacuccccgcccccuaucuccaagaggauguccccacccccacccccacccccuagaccuccccacucccugggaccucaagucucuggaggguuagaugauucuucucucacugagggcagaccaggcaguuuucugcuguauauguaucagggccuucauaucagcugguguacacugccugguuggugacucaguguuugagagaucucagggguccagguuaguugagacugcuggucuuccuaugggguugcucucuuccucagcuucuuccauccuuucccuaauucaaccacagggguccccaacuaaagaauucaucuccuuuuagcauuucuccucaucaauuuccugcaaugaaaaaaaaaaaacuggaaugucuaagagauacguguguguacacauuacacauauaaguguguguguguguauauauauguguauauauauauauauauauacauacauacauacauacauacauacacacacgcauacaauuucauuauggaaacuauugcuaggcaaaguaaagaauccaagccuuguaccaaugugcaaacauuuccguucagaacaggagucccugucaggaaggcaugguggcaaaugccuuuaauuucagcacuuuggagucagaagcagccaguucaugaguucaaggacuuccugaccuacacagagcugcaguucagucagugcugcuuagugagagcaugccaaauacacacauuagacagacagacagacagacaggcaggcaggcaggcaggcaggcaggcagacagacagacagacagauagguagauagguagguagguagguagguagguagguagauagauagauagauagauagauagauagauagauagauagauagauagauagauggaugugcugagagcugaacuuggauccucuacaaaaaugguauaugcagucuuaagcaauccauggacuuaaaagcuuuuuaaauguagaaauuaccacuucugagugaucuaggauuuugaaaguuuuuaauaauacaaacuagaaagcagguacuucuuuggcuuuuuugucauuuacauuguuacuguguuacuugagaaaguauauugccgaaaagugacaauuagcucuuucuuuucaggagaggcuugguuaauuauauaacaccuauaagauaggauuuaaugcuuauuuguucucccccuuuguuuauuuuuaguugauuuuuaaauuacaucucccaaggccuuggauuuacuuuucaagucuaauuuuguuauuacuuacuaccaaagcauacuggcuacaaggauaauuuacaugcucuaggcugcagaauuauacagauuuuaguuacuguuaccaaguaaguaaaaguaauuauaacccucccucuucuccccagggaccuugcagcugcuauacaucgcauggacaaguacaauuuugacacaaugauuuaugucguaaguaaucacaaugcaaaaccuaccucaugaaacuagagagagagagaaauaggaaaccggagcaggggagauggcgcagugggucaggugcuugcuugcuuuggaugccugaugaugccaguucaauuccuaaaacccagguaaugacagagagagugcacuacacacuucuccaugugaguccuggcacaaugcccgcucacauaugugcccacacacagaaaaaaagaaaaauauguugaaaaaaauuacaaaaacaauuuugucuaacuacauaaaauacgaaguugauuaagagagugaauucuuuuuuaaacuuauucuuaaaaagacucaaaucauuuacauugcuucauagugaaaaaauuuaccaaaauuaagaaggugauuauaugaaauuacuauauaugaguuauuguaagacaguggugcuuguucugcugaugcacuuagaaaaauauuauuguaauuugguuuguguggaagaauuaguaaccuggaaauuuuccucuucuguuuaaaauugcaucaagggacuagagaaaccgcucagcauaauguuaggccaggcacuacacaccugugcuauacagacauauaugcaggcaaaacacucagauacauacauacauacauacauacauacauacauaaauaaauaaauaaauaaaucuuuuuaaaacuuuaaguaaaauuuaaaaacuguaucaacucauuauauuauagucuuauuuaauauguaaacuucacugguauacauaaaauaaagcauauguuagaauuauguuuuuaaaaauaaaaauuacauuaaaaaucuuguaauaccuuaaagauaagaaauuucaggcuagcaguguuucugugcacccuucuacacagacauggugugccaugucaaaucagaugggcauuuguagaaacaugcaaaucucaggagguuuucaugcauugucuauaggcuaguuuuauggaacuguaucacauguacagaucugugucuucaugaccacauuagaacauggaacugcucuguaacagagcagacucgcugaugauccaccagcuaaucauuguccccuccagcccucacuuugauauuuauuauaaaaacugucacugaggaugguguguaauggagucaugcaguauggaacuguccgcccgagauuuuuguuucacccagcauauugacugcccuugagaaccaaccaagcccuuguauugcgaguugguucuucuuaugcuaacugggguucuaguacuuucugccuuugcauaugcugccucccucuagacuaagaaauuaccaccaucuuguugcagcuuagcuuuggucuuguggaaauagaccuccuaaccccugagggagaaggaaaugaaauagaacacucugagagucaggguccaugugcccuccuguguuaagguguugagaccuuauuuucccauucaaccuugaugcucuuauagugugcuuauuuuaaagauuuauuuuagcuuuuauuuacauauaugagagagagaaugaaugaaaguuuguguuugugugugagugugcacaugugcgugugugcaagggugugaaugguggugcauguguguacccccaggguagaaaagggcaucagauccucuuuagcuggaguugugagcugcccaguguggaugcugggaaccaaacuuggguccucuggaagagcagcuagcaaguacccuuaagcacuaagccauuucuccagcaucuacuguguuuauuuaaaacauauugacaaugacuuuagucuaauaaugauguuaauuuuauuuagaaccagccuacuuuuauuuacuaauuugucuuuguuuuguuuuguuuaaauuaaaaauuuuuuucuaaggcagacaaagggcaaagaaggcauuuucagcaaguguuccaaaugcugaagaucaugggcuacgacugggcggaaagguaggauccuuguucuucuugcugaucaaggccacuaacuccuaugucaccaauccucagagcauaacuacaguaauuuauguucaguucucuuuucaggauguugguauagaaaggcagacugauuuuguguuaauuuacaccuugauaaauggauuuaaucauuuuauauauugaugucugcugucaguguuuugguuuucaguuauuaauaugcauuucuucuuccuuauaaaggcuucucauaauuuaaucacaaacuauuaucucaguaaaaugaaacuuugguggacuagaaaaaccuacaucuuauuuuuuaaauuuacaauucguuaguuauacauaaugauaucuuaaugcaguguacauauuguauguuaucauauucccaccaggccccucuucucccacucccccuggccccuucccgugagucuuccuauuuauuugccagugguuuguuagguugcuuaaagcuccuggguugcguguuauugauagaugcauggaugaccuuuugggggcaauaguacugacaaaaaucucucucccuucaacuacucacugccuguuuguccucaggaagguguagggccgcauaaaccccucuccaagagggaguguuuuaaugggggauggaggggcagagcagacuggcagguucacaguuauugugaguucauuaauguauugucccugccauaccuaaaagacaucauucuacaacacucuccuccuuccuuugauucauauucuuccugcccacccacaccacccacccucguuccaaaauguucacugaaccuuggaggggugauuuaggugacacauuuaggacucagcacucagcagccacucuguaguuacucugaauucacuguugcccacuggauagagaagucucucugaccaaagcugacagcacuuucaugaguaguuccauuugucaaaacaacccuaguagauucuucauuaaggcuuaaaccacccaugcuguuagcucuagcuauguauacauuaguaaguaugaauuccccucuguggacugggacucgagucaacucaggaagcaguuaguuaccccaguuacagucaugccaguguacaccaaugggcacaucuugccuggcaggccagcggucuagcaugcaagguccagaggugaguaagguagugaguacauacgccucucucccagccuguugcaucgucugguguucugaaagcuagccagcagggaggaaacuuccaguccauuccagcaugacuucgcaauguccuguaacugaugcauauuauaucuuaccuaagacugccgggcaaccaaggagcuuuccugaauaauacgucauaaggcagcaggcauccauccuggcacugagauuuuuuaaugaacuuauggcucugagaacaguuuuaugcauccacauagaauacugcaauucaaacuuuuaaaaugauuauuuucuaauuaguuuacaaaguaauugguuuacauauaguuuucucauacguccuuagguuugguugucccucuccccucaauucuccccuacuuaaauucucugccccuacucuuccucuuuucacuuucauagcagauguguuuuccugucccugccccuaccccuugccaguacucucaugggucccuucccagccucaacacauaacugacuucuagaaagugcacacacguaaacauuagaagucaggagagaacauaguaguguuuguuuuuucugagccuguguuaucucacuuauuauaaauauuguggauaucuacagguaggauaaugaaaguagucaugucucacacaguacacaaaaaucaauucuaaauggauccuagaccuuuaaguaagauuuaaaauuguuagaagaaaaaguagggaaacuauuuaagauuuauauuuuaaauuagauuuaaggcaaauauaaggacuuucuaaauagcacuucagucacucaggaaguaagaauaauauuuaacaaauggaaccucauaaaauuaagcauguguacauuaaaggaaacaguuaaguaaagaaagugugcagagugggagaaaauuuugccagccauacaugauagaggaguaauaucuagaauguauaagaccuuuaaaaaaaaaucaagaaaacaaccaaagcacaaaaugaacuaugaaacugaaaaaagaggucuuuaaaaguuaauaaacgguggcacagcacucaggaggcagagucaggaggaacugugugaguuugugaccagccuggucuauauagugaguuccagaauagccagaauuugaauagugagacaauuauauuuuuaugauauauauauauauuuuuuuuuaaacaccuguuaaaauuuuuguuugaaacaggaucccccacagaggcuagccuugaacuccuaaucuuccugcuuccgucuuccaaaugcuugauuugucaccauguaugccauguauccuauuuauuugguaauuuuuuaaaucucuacuacaaagguuaaaaguuugaauuauuuucugaaaaaguacuaagguauacucacgucauuagcaauuuuuuggcuuugguuaaugaaugccuguccuuuucaggugccagcauguccccuuugggauaguaaaggggaugaagacucgaagaggaggggucacuuuucuggaagaugucuuaaaugagguucaaucaaggaugcuacagaacauggcuuccauuaagaguaaauccuccuuaccaacuguaugcuuucauggacguccccgagccugaucagaagugccuuugaugacuuugcuguguaguccaguuguuuguuacuguaacguuagucuuccuuccauggacagcuuugacacugucaucuggugucagaggcauccugugcacuguuugcaucacauuuauacgucugcgugugugcagguguccaugugcauacaacauucaugcugaggcaagaggaguucucggaugcuguccacuuuuuauaaaacaggcucggcuggcaggcccuugagccucccuagcacgggcuacacgcaugugccaccacacucagcuuguuuauacauagguucugguucauacucagguccuagugcuuucgagcugucagaguuuucuauugcugugauaagucaccauagccaaagcaacauauaaaagaaagcauuuagucuggggcucaugguuccagacgguuagagcuaugaccgucauguggggauauggcagcagacaggcaaaugugacacuggaacaguaacucgagauccacaagcaaaaggcagagagaaacugaaugacuuggaaccucaaagcccgccccucagugacucaguuccuucaaagaugaacgaauccucuccaggcaguaccaccaacuggggacccacauuccagugcgagccuguggggccaugcucauucaaaacacuacauugggcaagcacuuuaccagcuaagcugucuucuagcccagguccuugugucgcaaauggauccaugugacuaaaguucauguaacuguuuaaucuuuaucgcuggaaaaauaacugcgguguaucuaaugccuuacgagggauaguucuuaaaacaaacuagcucaugugucuucacuuggauguaaacaggagaacuggcucaggugaauuagcccaaguuagaaggcaaagcaaccauuaccaucuuaguuuugacuguguguuucagauuuuccuuucucagguugauugauuauuucugaccaguguggcgcaggguuaaaacaucgguccuuauuuguuuucagccacgaaacaauuggagaacccucaggagacggcagagagaguggggcuugccgccgucaucauccaggugcgucaggacgccuuccucugagaccucuguguguccuguguagcaaacccaggguaacaguguauucuccuucuaggacuucagaggcacucucuuaucugacuaucaguucaguugggaucguguuuuccagagccguggggacacuggagucuuccugcaguacacccaugcccgccucuguaggugagacggggcgggagggggcccgcugugguucuaagaccagugguuagcccucuuaucaacaguucuuacucagaucugggcaaaacacaguggcccucuuguuguuaaacauucauuuauaguguaaaacacccauuauaagaaacacucgcugggcagugguggcgcacgccuuuaaucccagcacucaggaggcagaggcagacagauuucugaguucgaggccagccuggucuacagagugaguuccaggacagccagggcuacacagagaaacccugucucaaaaaaaaaaaaaagaaaagaaaagaaaagcuuucacauggccuuacuucauccucaguaauucugccaaagaauauccuguaccuacauucuaagagacucugaaaauauuugagaaaaugagggcuuccccaaauuuuccuaaagcuagaaguugucacaugugcccauggauagcugacugauccuuucucaucuguuuaaacuucggugacaguuuggaagagacuuuuggauguggguaucucaaugacuccaauguugcuuguuuacaagagccgcagucuguuucaauucuccagcaucuucucagguaugaaagccuauuauuaacaagucuaauaguaaauugagucuuaacuaaauuaagagcguugcugauuucuagaguccucgguucacaggcugccucuagguaagcccgaaaggaaucugccuucuggggacagauugagggcacagaucaagcucguggucaaggcuaauccuagucagaaacauauuaucacaaaguguauugccacaauaugaaagaaaaaugcacauuuucuuaacacucaagguaagagguuauugucacauaacaaaugacagaccugugcccuucaucuuuuagguuugaugagguacuuuaccugucaucucaggaccuacagccgaagcacaucguuagcuaccuccuaacucuaaggucagcuucuaaucucccuguuuccuuucaaaaauauuuuuaagauuuauuuuuauucgugugugugugcgcgcgugcgugugugugcgugugugugugugugugugugugugugugugugugugugugugugguguguguguguacacacgcuugugcacaggcaugcauguuaguucaccuugauugauaaacucagucaccaaucuggauaggugcuacauugaggaaagaaaugaaagcccugccccuuggaggguuugcccaggagugagccggagccuuucucaccuuguugccuccgccgccgcagcaucuaucuguagcuugugaguuacuguaaacucagccgacccauaaacuguucuccugcaggagucugcaccggggccugucugaugcuguccugucugucccuaacaaagggcuuugcucucuacugaacagaagagaaagcaucacauggcaaagaaauauaagauaccuuaaggaagucuuuaaccgaguuuuacaugggaggaaacgucaccuggcuccagcuggccagaggcacucagaauagcaagcagcacuacaaacacagcauuaucgagcaauauccauauguucuuucagcauuuauuguggauguuuauuauauaacgucucuuuugucguaucugcuguuuccagccugcauuacccucugggucagggacauggaagcaugcaucauuuaagaugaaugcguagcuuaacauagcuuagucugguaaaaagcaauuaccugggaagucauagccaagugagguugguugugaaauuguucucguaaaggcagguuaaauaaacaggguaauacacaacuggauaucugucuagacuuuaagugacuuucaguuguuuuaacuuggcuauaagguucagccaaaguuucaggcucucugaauauaagagcuguugucauagaaacgguaucacaacaugugugauuccucuggaggcccccagguccucugaagcuggacuuacaggcaguugugugcugccugacaugggugcugggaacugaacucggguccuggaaaacugcuggaaccucuauuucuuuuuuucaucaaaagguuuccuauaagcaaauccccugcccuagaaauuguuuuaaguuguagaaacuguuacuucucugacgacuagauuucauuuuauuuauucagugauauaaaguaguaucauaguaaugggcaguggcauaggaaguuauagcaaagggacacgugcguugucaggaaacagauacacuuugggggaaucucaucuucucgggaggcagcagcagauguuaaccaggagaagcaaaugccugggaaguaggggaauguccaggguugagcagaaacuacaacucuagugaggagagcaagccuugggccuuggacaguuuccagggugcuuggucgauguuacuggucuaagagagacaaugaaaucacauaaagcuuagggagucaaagccacugguugaaauuucaugcugauuugaaugcuuucacuugaagcaagucuaaagaaaggacauuuugcuuuuuacucaccguuuacuaaaaugagagaauacggcaacuuuguucuuaauuauaacuuuuuaccuucccucccaggcuuuguuguuugagaaaggaucucacuguguagugcagacuaaccugggauucacuuaucuuccugcuucuguuccuaaguacuagagaccuaccccugauucccuuagauuuaaagagguuugauuguguuuguuuuggguugauuuuuuuuuugaauuuuuguacuuacauauaaaggcaaaaccaaaaagugaaaugucaauaauuaaaugacaaucaugugcauuucauggcucauugcugccuucacagaagauugcuucaaggaguucccagugugugcaaugaaugaauaacugguuucugccccaccucaguugacaggggaaagggcacgccaugucauacuuguaaggaaguacuacuuacuagaaaagcaugcgucuguaaaacacuggaaucacaaccuuaaaagacuugcaauuugguagauggaaaauucaaaucugaagcucuaguguuuugcuguauuacuggcaagcaaaugcauuugauucaaacuucagauagcucuagugacucugggcuuuaaaguguuggauuaggauuccugggacaggaaguuccuguugguccucauugugauuucucucuugcuuauuucagucaccuugcagcuguggcacauaaaacacuccaggugaaagacaguccuccugauguggcugggguaugugaaauugaauguccucuauguaaccauguggcagcuggaacuaguauuauaaaauguuaguacuaagccuuaggaauuuuucugaccuaucuccuguuacuuaacuacaacaguauacuuucugaccuagggaauggguagacuggggcuguacugucaggguuauuaucaguguuucccaaacaguagacuaucaaaugcaucucccaccggcugcucaagugacaaacucagccucuccgcugcacauccucucuccacugcucuuucugcaggagaugcuagagucuaguccccuugccuagagugugcacaggacugugaagcaauacugcaacuuuaaauuagaauuacuucuaaagccauucuuucuugcuuauugcuaacauauuauugagcauuuaaucauucuuuauuuuguaggccagacuucaccuuuucaaagcuguccguucugucuuagccaauggaaugaaacuucuuggaauuacaccuguauguagaauguaauuucuagauaaauauguuuuuuaugcaaaugaguucuaguuguuaucagauaccuugcuguucagaauagaauuuaaaguauuauucugucccagaauguguguaguaguguguuuuuuuggggggggagagaguuguuuuugagacaggguuucucuguguagcccuggcuguccugaagcucacucuguagaccaagcugacccucacagagauccaccugccucugccuccugaguggugagauuuuuuuaccuuuuuuugauucauguaccccaaucucacucaucuccccaucuccuccaaaauaaaaaacacacaaccacaacaaaaggcauagaaaacaucucauggaagcuauaguaugucaccaugugucccacaauauuuccuucaguccacacagcuucaccagcaaauguucauugcaaugaguuauuggucugguuugaggccucuggcuucugugacaccaucaauauuggguucucauugugucuucuccuguggacagugggucaagccagaaaacuugguaggauugaguggguaugagacccagcaucaaugaucaccugagaugguagcuaucucugugcucccuacuagauuccgggccuggaacacaugaccacauuccccgcaucccaucggucacguagcccagaacagaguucuccaugcuaaugagguaucuagagaccccgggguuuagccaauaagcuucccuuacugagcacuccucccugcaaaagguacuuaaucucugguccacccugagaaggugguauguacccauuuuucacgaagaacaaucaauaaauaguuuggaagcaagaacuuucucuuccauggagaaccacuguugggggucaugaagaaggucuuugccuacagagccacaaccuaagucucccacagaagggccccucugugcucccagacaaccacugcuaagcuaaagacaauugcaaaugaacuaagccagaguuccccauucccccuggcucugggcucaucguuguccucagcccacgggcuacuucccuccacccagcagcaccuugaugaccaggaguuugggaaccucagguccuguguuccugaucacaggccccggcacuucggaaccucacuuccaacuccgcugugcaauuuuccagugacaacuggauucccaggagucagggaagcccagcuucagccucccacauccugggcuacguuuucccacccccuuagugguuucuuggugcuucacucgagcccaacacuggacaacgguaaacacagacuagcgcucuauguucagccugcccaacagagggacaaaacauggacccacauucuccuaauuauccuauuguugcccugugucauagagauccugcagcuuuggaucugcaaggucugcccuuucauaggucccaacuguuugcagaugauacagauuuuggagugggccaucucagcucuggauuugggccuggguggcagcacagcuggucagugugcuggcugucccuuauccacaccaccagaacaggcucuccaguacugcucuggcuagaccaucccaugaucuaucaucagcagcucucuuacuuuaaugccagcucaccuaucuccaugccuccagaagccagcucucccaagugcugccgccuguaaggagcugggcuagcucuccugcucucacacccuggaggcugacucacccuuaccucugccaucagaaccauuuccacuguguugcccaggugagaugcagggacugcucuccauaaugcuauagccagugagggggcagggccagcucuaucaaccaucgcagguggcaaagggagaggagggaaggguggcaucacacccaauggggucagugcucgaaucccucuugcccucagggcaggcccauccuaacucuugcaccagggcaggcacagcugugcuucccaugugcuauagccagugagggagcagggccagcucucccagcugcugcaaguggcaagggagcaggcaucacccacgccagcucacagcagacaagugcugggagagcuccuccuacauucucaccuuggggcugacucacccgccagugucagcucugcugcccuguacaggcgagcuggccugcucucucaggugcuaccuggaaccauguugugguuugaauaugccuggcccgugggaaguagccgagggagguguggucuuguuggagggucacuguguagguaggcuuugaaggccccuagagcucaggcuccgccaguguggaagagagcaaucacugguaggcauuguauucagguuuuuugugaagugucggccaguauuaagccauaauuugagauggaguguuggcucccaugcaucugcauauaaacaaggcaguuuggcugauuugagucaacagugugagcuugauuaagcauaauguguuaagguugauagccagcguuucuacuuggccugcuacauuuaaucuaaaugucaguaauacaguaauuuuuuuuuucaagacaggguuucucuguguagcccuggcuguccuggaacucacucuguagaccaggcuggccucgaacucagagauccgccugccucugccucccgagugcugggauuaaaggcguguaguaauacaguucuaaugaagaggaguuagcaugagccaaacaaagccucugcaguuggaguagacacuguuuuaaacugacagguguggucuaccucuuacuguagaaagcauuuauccacaucuguaagugacuugcuaauuuucugcuuacauagagcaccauuaagcuuccgauagaaaccaaccguggaauggacauagacauuuaggacuugcuuuauguccacucuuccucaguguuucucuggagaaacuuucuccuagaucaaugaguauuuaagcuuggaguaaaaucauacagggacuaagccuugaaaauauagcucucugaaaagauuuguuauccuguaacucuuacca

SEQ ID NO: 1826 - RNA, 1384 nt, Mus musculus
augguuuuauguagcauuuauucaugaccucugaauucuuaagcucacacagaaauuuauuucauaaauauucuuuagauuuaucuagcucuuuuaauugauuuaauuauguuagucugcuuucuuacagucaagcccccaagugaaucacaagcggaaucacaaaaauauaguuagcauuuuccagauguauuuaagaagagacaaggaaacucagagcagaaaacgagaagcuaggaaaacagcuugcuucauuagaaacgacucauccucuauguuacauaaaccuuuacauaucauugaaaaaucuuuuacccauauuuaauauguccagaggaaaauagcuuguuauaaaaguucuuuuuuuauaaacauuuuuaaaaccaggaaaaaaaaucaucacuuccaaaauauacuuuguuugucuaauucuagacaggaaucacuaguuucuuuaaagccagaaugacgcuauucuccaaaucauaccuuugccaguuuuugaagauaugcugugcuucuuuuccuuagugugguguccuuuaggcuaaggaacuauuggaaguaaugugcuuucaucagugacaauggacuggguaaauggugggcuggaauaaaucaaauuucaacgaaucccaaaaguaagaaggaaacuuaggaaggucaacauaaccuagucaaagauuuccauauggucaacugaaauagguaagaaaauccaaagguuucucuuacagccaagacuagcaaaaaacauagcagggucuggagaagguuugagauaacucaucagguucacagugugcaaagucuguaacacagacagagggagaacuauggagcucccaauucaguaagaggaacguuuaauggugaaaugggaaaacuucugagaagaugacacaauuggggcgauucugaaggaaggcugaaggaccgcugguuuaggcuucagauauuucccuaaugugcaaaugaagcugccauuauuaagcaugugcuaccacugugucaucucgggaccuuccuaaauaacauggcaugagacaaaggcuggagcucaaagggacuauuuggcuuggguuggauggguugggucucaaagguggugaagucucagugggacguacagaggauucuguagaacuucugugccugaauauccacaaaaggagaauaggcucuaccuagaagguggcuggcaugguugggagauaggaagaauaaguuaagaagcucugaagguccuuccuaauuaagaaaagaaauaaaaaaacauccagggaagagaagaucaacagcugaggaagcagaaaaagacucuagaucaguaauuuaaucuuuccuuuucauuauuuccacugguggaacccaaagccagagg

SEQ ID NO: 1827 - RNA, 4734 nt, Mus musculus
caaugccaauggaggaguacuuaguuggcaugagcaagagaugcugugguaccaaacucauccauacuagccugagggagaucauuccugccuacagaugggggaagggugcuucugacacaggacaacaauacggacacugguguuaaagcaccaaggacaauagacagaugugaguuugggugcuauaaaaucagaacagauuuuucacuuaguuccacggacccagaaguccuugcucugacaugcuacauugcggccguuccagugugcacacaagauuaagaggcauuacuccccagcuccugccgguuucuguagcaacauuggcaagggagacacaguugaggcccaaagagacauacgaguaguccccacauccucucuaucucuuugcuuugauguacuagcagcugugcauuuggucuucaaggaccucacggucuacauuccucucaccagagcagccugggagaggccuggucccugcccuuguaccuucacuacucggaugcccagagcacuccaggucauccacgcccugcuuaggugucuuggaagcuucuauuccaccuggauggcagaaaaagcaacuccuaggaaagagaagaguuuccugggcugaagaaggagaagggguuuaaguggcuauuugcuaaccauguggccuggaaguugucucucccucagguggguagagaugaugucagggaaggccagguccaacguuaggcugcaggcuguaguaacauccccaggaaaaggaagaggagaaguaaaggaaacaaggaaaauauaaaauauccuaagcaaucucccagccaguccacuucggaaaagcugggcugcuguggaugcaggagccaagucaacucccauccagccuugaugcaggcagaggccuggcggagggaccacagcucuccaaaggaggcuagccucccuugccuguggugaggauuucucuggucacuuucuagaauccaaauagcuaugucgaccaggggagauaauguugguccuugggcaaaagcccuuggcaauucccacuccacugcucugaacaagucuaugguguuagcauucugucuaagcuccaccccaguugccuggcaacagccagguaggccugacccacucuaaaaggggcugcuuggccccuccucucucucgugccacacucucuuguucccucuugcucccccucucuccccauucccuucucucucuccauguggccauggcuggccucuacuucucuacucucucccgcucucugucuuucucugucucuacuacccucuuaacuccccuccccaugcccugaauuaauucuguucuauaccacaccaucguguggcuggucccucagggguaagggaugccuuggcaugggccugcugagacacuccuucuccuccacaacucaccacaccccccauagaacauaucuuaugccacuuuaucuuuauguaaacacaucacauggaauuugcuuguccacugugcagggggaggcauaccuggcuguuuucaugauaauggcgugagagaugaacgucagaaacucuuuuaugaauuuaugucauucuccccuccaagcugagggaccuuccuccuggcccucagacaggcacgcuuucugccaggaagacucuguucaauuguggccaaacugaccggcaaguaauaccagauuauagggccuaaacauuuugcaugagauuuuuauaaugcaacugggcccauuuaacgagaacuuggagggggugagggguggagaagucaguaggaagcugaugacggucacugugcaugucaaaugucuaucuacacaucugcacagauaacacgugguagacugguggguggcgaaugaagcagcggucagaaggaaggagugauggcaaaacaacacagcgagcaucucguguccgccccgggcacaucuaucuuccccugugugccagacacugcacugugcggccucuggaacgaugccacuguguguggucuccucacucugcagagggaaccgagggucaacaucuuggcauagucacguacauggucaucaggacagcaagucugaaaucuuuaagucugucuuccucaagggguccaucagcuacguccccaggcauccagccuucuguaucuccaaucagcaugugcucucagcagagccugacucaguggccacacugcaucugcgcuagccacagggugggacugcuccccagagccucgaagcuagggcugcuucccucucucucucgggagcauuccaaagucugagauuguugaauaaggcaggagagcagucagacuauaaaacuuaaaacaaaacacaacgaaacaaaaaguccccccaaacccucauaaguauggaugagguccagcuagugcagaagaauuaaaaaauguccuuuuuggugccuuuuagggaugugggugguggaugagccaaacgaaguaaaaauagcaauguagcgggccagagcucccugaccggaaagaacaauauuuauuugauuaauuuuguuccuagccgcccacauuacuuagacagaggguguuuccucuaugcaaaggugggucugagcauggacacauacaugcaggcccucaaauccauacagccauuaaguaugggcagauaaacacauauuccugccacccacugagaagaguuauucauaaccuauacaaaaaucaaacugcuuuucuuuccccaagcucuacaaacauaaaaaaagaaguugcuuuauguaaacacaaccagcccucgguuuacacugauugacagaaaagggagagcugcggaugucugaaguccucguacugaacccgugggguuaucaacacauggcugcaugccuccuuucaggagaacgugggucccagggugugauggcugcuaugccaacgaaacaaguugucgaaccaugugggagacaaacggggcucugggcagcaugccugugagaaacgaucuagauuaggucagacuuaucuagaguggauuagcuucuggcuaugccuuugagagauuauccagauuagguuaacucucguaggaagacccaccugagcugugaggagcaccaucccauguuggggucuuagacagaauaaaaagcacaccagugcagcaggcgcuccauucauuacacuccuuccucacugaaggugacuacagggugcccagcugccucggaccccuguugacguacucugcuauacgauggacugcgcccacgaacacgucuuuccuuaugucaccuuuguuugguauuuugucacagcaguaaaaugaguaaccaguacucugguaucaccagaguucucaagagccccacagaccccugaagcacccugauugaccacaguauucuuucuagcauugugacuuucucugcagagucaccuacccugcucucccccugcuaacucaucuggcugaggugcuauuacuuccugaccaggacgggacaguggacagacaccaucuuugcucuaagcaaugcuaccugugacccagcauaacauagaagcugccugcuguggcuuucccuuauuguucucucccauucccauuucugucugcucaguuuccuuagaguuucccuaaaggucgcuguuguauggucuuuaguccuccagucaaaacaagaggccaucuucuuaguuaggguuucauugcugugaagaaacaccagggccaagggaacucuuaugaaggaaaacauuuaacugggacuggcuuaccguccagggcuuuagcucauugucaucuugguggcaugaaggcagacauggcacaggagaaggcauugaggguucaacacccgaaucagcagagagcaggaugaaagagugacacugggcaccgaaaccuaaaaccagugacacacuucuuccaacaaugccauaccuccuaauagugcuacuuuccauggacccaugguagauauuuucauucaaacauacuacacauggcaacuaaaacagaagggcguaguggaaaacaggucuggauagcguuaaagaagcuacuuacucaggucaggagcccuugaccucagacucuaggucuuccugacucuccuagcuacaggagauguuuggaggcgcuacacuacacccaggaaauacuucuaacuaaaagcaggacucccugguaguuuccacgaaguugucaucccugauguugugggacuuugcagugauucaacuguuugugugcucgguaagaaagucaauucagucacucauuggucugggccagcuggacuuuggugagauaguacuuuggucugucauuggcuuccuucuaggguaauugcuuauuuguuuuccucuucccaggaaaaaugaacacaacagccuggugucugccacaagccaagcguccucuucccacagccugccuucacuuacauggcuggacuggcucuugcagacggcucaagaugcccccagcuggacuggcuccugcagauggcucaagaugccauaugagcaguaaaacagauuucugcauugcucaaagcuuacuuguggagccugccagcuccuggaagcugggggugggcaucaugacucacucuccuuucuguuucuguccuuggccauccaucagcguucagaaaggcacuggcuggaagcaggguuucacccuguggggucgcuguaagcgcuauaguucaaaugaaugggcucaacuugaau

SEQ ID NO: 1828 - RNA, 36060 nt, Mus musculus
aggcaguuucgauuuccuauggccagccggcuaggcagcuuuuucaucgggacuccuuggaaaguccccacuucguucaucucuggcggauuugcgggagccagggcgcucaucgaucgccuggagccacagaaugacagcggagcagcggcagaaucugcaagcauucagagacuauaucaagaagauucuggaccccaccuacauccucagcuacaugaguuccuggcucgaggauggugagugguccccaacuggggcucucaggcucuccaccuuagcgaggggaaaacaucacucagaucagaaacaauugaaggcucugccccccccccucccccgcgcuguccuuaaguuaauuuguguaacccgguguaugugagacucccaggccauauuagaguagacagcauagggauuugauggucaggaacaaaauuccugcaagcuguaguaacuugcauaaggaugccacucuuuucuuucuuucaaugcuggggaaauaguuuguuucucuuauuuacaccuucuagacugcugugugccucccuuuguccugucaugagaaacugagaaaucagaaugcgcccgccccuccuuagauuccuguacagagcaaagagcaaggcuuugggcucgggccaaagguggaggugggggccgcaggaagcaagaggacugacugacacgcacauuucugucaaaggauguugcucacaggaaguccguggaagaaaacuuucuccagacuccguguguucagaguuuaacacaguuguucauaucuagcuuuggggauuugauugguggauaauagacucuuuguaaauugcacuggguguuuccaccugagcaaacagaccuccccaccucacccccacccccagggagaagggagagggcguuugaaggggugaccgagggcgugcggcagcuacuuuucauuuugccaguuaaagccuagaugucuuuccuggcguuggacgacgguggcaacugcagguuaauucugacucucuugaguuccgaagccuaacaggcuaugcagagaggaguaaaagagcacuacccagggcuacccacaucccgguuguguuagagagaagcagcaaaaaagcccuaaugauugggggcggggucugaggagaggaaacccacccaagagguuucuuaacaccagggucacuugccuuucaauccuuuaaucugaucuuuagucauuuacauuagcauacaaaguaacuaguuucaauacugaaacaaaguaacuaguuuguucagccauuccugccauugcucuuuguucuuauuuaauugccucuucuguggcucuuccacccccuuuaccugucccucucuggaugcccucccccccaaaugguaccccguucugcuuucuuauaacaugagguucaucacacucccucccucccucccucccccauuuaaaguaucauccuuuccucucagggugccuguuuuaguuucaugaauuuuaggguuuugguuuuuugucuguuuaguuaugagauuuuuuuaaaaauguggauuauguugaauuuguagauuguucuuggugcuagaggccuuuuuauaguauuauuuccacccaucuugggagaucuuucugaaaucuuccagugucuucaagaauuuuuuuuucccacugccuuagaaguuugcauuguagcuaucguucaccucuuugguuaggguuuguuguuauuuguuuguuugaggcuauugugaauagaacucccuccuucccccauaucuuucugggccagguuguucuuaguauguaaguaagcuacugguuucuguauguuuauuuagaacccugccucuugguugacuuuuuaugagggcugagaguuugugguagucuuuggggggucuuuauaggauuauauaagaaucauuugacucauuccuuuccuauuugucuaacuuuuguuuguuuguuuguuuguuuuuuugagacaggguuucucuguauagcccuggcaguccuggaacucacuuuguagaccaggcuggccucgaacucagaaaucugccugccucugccucccgagugcugggauuaaaggcgugcaccaccacacccggccaucauuuccaaguuaaagauuugaucuacauuagacgccgccacgcagaaaaccuugagacuugguggaaaggccaaaggccauuaaaauaaauuuucuuuuuucuuucuuccauucuuuccuuuauuccuuccuuccuuucuuuuuguuuucuuucuuuucuuuuuccuuuuuccugagacaggguuucucuguauagcccuggcauccuggaacucacucuguagaccaggcuggccucgaacucagaaauccaccagccuuugccucccaaguguugggauuaaaggcauucgccaccacugcccaaauauuuuauuuauuuauuuauuuauuuauuuuuauauaugugaugaguacacuggaaauuccaucaaaaagagcagguuugacuggugucacuagauuuacuauugauagggaucccuaaaggagagcuaagguaaagggcucucccucuccuaggucuucugcauaccuuccuugaguguucugggccagaucuccuaagcucuaagaaugugcugaaaacacacugggaacuggcucccuccuugggaauuuguacucccucugcugugggaaacuuggauauaagaggcuacaggaggacagugaguuauaccccaggcacagaguuagcguguacauucaaaacgcauaccauuuugaaaguagcagcugcuagcauuuccugucaccuggucaaccuggucucuuuagcugccccaccccuuccacuuuucugcuguguuucuuuuacucucuuagcaaaaauuggaaugaaagaccacaaauguauuuguaauucaaaaugcuugcugcaucagcuauacucguuacuguugccauagggcguucauucccacccacccccaaccccuuaguccagcaguugcuucagaguuuugaagaagaggaggaagccuuucuucuuccaugugacacccuccacugcgacuucugcuuacuguggggaacuugaguggaggacgggagugugcauagaugaaagaguggaggacgggagugugcauagaugaaggaguggaggacgggagugugcauacaugaaggaguggaggacgggagugugcauacaugaaggaguggaggacgggagugugcauacaugaaggaguggaggacgggagugugcauacaugaaggaguggaggaugggagugugcauacaugaaggaguggaggacgggagugugcauacaugaaggaguggaggacgggagugugcauacaugaaggagaggaggacgggagugugcauagaugaaggagaggaggacgggagugugcauagaugaaggagaggaggacgggagugugcauagaugaaggagaggaggacgggagugugcauagaugaaggagaggaggacgggagugugcauagaugaaggaguggaggacgggagugugcauacaugaaggaguggaggacgggagugugcauacaugaaggaguggaggacgggagugugcauacaugaaggaguggaggacgggagugugcauacaugaaggaguggaggacgggagugugcauacaugaaggagaggaggacgggagugugcauagaugaaggagaggaggacgggagugugcauagaugaaggagaggaggacgggagugugcauagaugaaggagaggaggacgggagugugcauacaugaaggaaaggaggacgggagugugcauagaugaaggaguggaggacgggagugugcauacaugaaggaguggaggacgggagugugcauacaugaaggaguggaggacgggagugugcauaugaaggaguggaggacgggagugugcauacaugaaggaguggaggacgggagugugcauagaugaaggagaggaggacgggagugugcauagaugaaggagaggaggacgggagagugcauagaugaaggaguggaggacgggagugugcauacaugaaggaguggaggacgggagugugcauacaugaaggaguggaggacgggagugugcauagaugaaggagaggaggacgggagugugcauagaugaaggagaggaggacgggagagugcauagaugaaggaguggaggacgggagugugcauagaugaaggaguggaggacgagagugugcauacaugaaggaguggaggacgggagugugcgaggauggaugaguggagucugcugccucucaaaggucuucugguuccaugaguuguuaugacucccagacccacaugggaaggucuggucuguuaucuuccagugacuagugcuucugcaggcuacucacuugcccuugcuucuguuugcagaggaggugcaguacauucaggcugagaagaacaacaagggcccaauggaagcugccucacucuuccuccaguaccuguugaagcugcagucagagggcugguuccaggccuuuuuggaugcccuguaccaugcagguugguuccuucuucuuccucacaguucagaguacuucacucugcugccucagaaggcugaggggagaaaagugacucguucugugacaucuguguguggcuucugccucaggcgggaaauguaaagacuauuuugaaucagauaagagaaugguuuauaccagaaauauccaaagcaaucuacagaguuguaacuacuaggagaggugacaauauuaguagcaugccgguaucuuucaagaggagaacgaguaaauaaaucgguuuuauaauguuuacagugcuccauuauacugcaaugaagcguguggacaugucuguaaaugacaacccagcugaacuguaggcacgcagcauuuaaauuugaauaucauaaacuauaauagcuauaaaguuccacaugagucaaacuaaacauauagggaaggaaacuggaucuugggcgacccuggcugaccaguccuggggaguaagcuuaauaaacucucccugucugacugagaucgguguccugugguuugugaggcaauuccuggacucuaacacuuaggcaauuacauuucuugccccucugccacucuagcuuauucacuggugaaagaaggagaauacuuuaguguuaccaacaaugggggggggggggcgggggaugggaaaugggaaaaagcaggcccggcccaguguaguaagaaagaaacaccaaagaaagccaagggcuccuguugcuuucauuguauuggaguguuugucagucggcugggggauggggugggggguggggaagcacaccuuuaaucccagcucuggggaggcagaggcaggcagaucccugugagcuccaccagucauggcuggccucagcaagaacuguauccaucacauccuaacacagguguguugaauuaacaugguacuguuaaagcaaacacgcugccuuccucgggugcugcggucccuaggaagccacacauuggcagcauguuggcagcaguuguauaaaaacuaaugcuuuuuuuuccuuuucuuuuuaauucgguaaaaggguuuaaaugucauuuguuauaaaacuugguuuccugcuauuuccaggauuaacaauugacuuauucuuucuauuuccugcuuuauagaccaucauuuugauacauuaucuauuugcaucucagugauacaugcuuaucuuacccuuuuauuucguuuuaagaauugugugugugugugugugugugugugugugugugugugugugugugugugugugucugagagugggcaugcauuuaugagugcauugccuagaggucagacauuccccuggagcuggaguuaauggcaguugugagggacugacgugggugcugggaucugaccccaguccccugcaagaacacgaugaaccuuacuugcuaagccaucuccccagcccuuagcuguugcaguuacucuccauuccaaauaagcccuggcaaugaaaacaagacuuaauucauaugaauacaugcugugcaccuagauugggcagaucuaccgcuacacuaccaucuucuccaucuaugagacucccccuuuuuuuuuucuuuuuuucuuuuuugugguuuugguuuuuugagacaggguuucucuguauagcccuggcuguccuggaacucacuuuguagaccaggcuggccucgaacucagaaauccgccugccucugccucccaagugcugggaauuaaggcgugcgccaccaggcgguuucuccaggcugugugcuucugcuccacuuuucuuccuccuccucugugguauccucucccucuuccucuuucuccuucucucuucccaccuuccucuccaacuucccuuuaucagcccaaucaccagcucuccuuuauuuuacuaauugaggugggaagcagguuuacaggaaaucaccggagugcugacucauuccuuguucgcagccacucaaugcagaauggaauuaccaucaaauauaauuagccccagggcuauccacaacacuuaccuagcacaucaaauggcccagcaggggaucaagagaaaaggaaacucaacuucugcuuauuuuccucaucucuuauguagccccaucagagaagcuguuguuuuccuuuugugggcucuaacuaauuugaauauuauauuuaagaucuauucucuuaaguaaaaauggcacagcuaacuuuaacuguaaaauuauaugagguuuacuaggaaaagucuugaguuuaagcaagaaagggaauuuuaaaacauuuguauuggaacauaagugcuggaacaucucucuuugcaagugaggugcuuuguguguacaacccuaagaguuucuuuuuuuuuuuuuuuuaauuuauuuacuucauauuucagacagaucucauuucaggugguugugagccaccaugugguugcugggauuugaacucaggaccucuggaagagcagucagugcuccucugcgcugagccaucucuccagccccccuaagaguuucauaaaggaauagucugcauuaauaaauucagaaaaggcucagaauauaaagccaauaucaucaaguagguuuccaguuuauguauuaacaaauaaugcaaaaaagauuuuaagcaagcgauuccuuuuauaacagcaccaagaacaauaaaguuaggaaugccagugcuccuaacugcugaaccaccucagcaaugcaaacuuuuacaucuuagcacuaaguccagcuccuaauucgugaauguaagaugucauucauguccgugucccuaugguucguuucagaagugguuuauggucuucgggucauaggucuuuccccugcucagcuuugcuuauuccuaacuuuauuuaaaguucucacuguuguuauaaaaggaaucacuuggggcuggcgagauggcucaguggguaagagcacccgacugcucuuccgaagguccugaguucaaaucccagcaaccacaugguggcucacaaccauccguaacgagaucugacucccucuucuggagugucggaagacagcuacaguguauuuacauauaauaaauaaauaaauaaauaaaucuucaaaaaaauucuaaaaaaauauggaaaaaaaaggaaucacuuaguuaaaaaucucauuccuagccgguugugguggcacauaccuuuaaucccagcacuuggguggcagaggcaggcggauuucuaaguuugaggucuacaaagugaguuccaggucucugaaaaccacaaaaaaaaaaaaaaaaaauagcacuggcugcucuuccgaagguucugaguucaaaucccuccaaccacauaguggcucacaaccauauguaaugggaucugaugcccucuucuggugugucugaagacaguaacaguguacuuacauauaauaaauaaauaaaucuuugggugggagugagcggggcuggagagagaaggaaaaguaucugaagacaacuacaguguacuuacauauaauagauaaauaaaucuuuaaaaaaaucaauaaaugaaagaugccaauauuacccagaguuggcacagugauaccuuucauaaugccaaauuuugguggcaggauuguuuguuuauuaaacaggaauagaaaaauuuacucucaaauuuguaugaaaucuuaaauggucaaaauauuggaaagagaaacucacuuggaaaccuugggggacuuauacuuccuggugucaaaacaguacagaaccuccauaaagccagauaauuagaccauuagcccagaaguaaacucugaaggauauggccaaagguucuucaacaaggguaccaugaccacccaaaagggggaaaaaaaacccagucccuuuaauaugaaaauacauugggguaaguggguauacauaugggaaugagagguaucaggcauaaucuugugcuaugaugugaauuugaaauguucucaucacauucauguuuugagugcuugguccccagcuugugggguuuuaggagguagagccuagcuagccaaaguaacacguguauacguucaugcaugugugcacacagguaugaggguacuuguguguagcccagaggcugacauucagugucuuccuuaggagcucuccaccguauguuuuugggaauggaucucucauuagacccagaauuuacccucucgggcucgacuggcugggauuauagggucaugcugcuacacuuggcuuuuuacaugauagcuggggacaggaacucaggucccagccuuguguggugagcacuuuucuacuaagcaccuucuugguccuggagcuauuuugauuguuuuaguuuuuugggucuauaggggggagaaaaaaaaaaaaaccacauugucuucccagggccuugaaugaaguaaaugagggucugagaggcaggcacgccugguggaucuguccaaaaaccccagaguacggcauucuuggauucuuuuagucagaagucauuuuccuucuccauuugcccauugacuuaaucuuuucuuggaaugguguggaaggaaacacuuuucaagggcaggauguaagauuuguauuuccucuggucuucuuuacuguuuccucuugagaagauaaacaugaugaauuugacuaauuuaaaaguaaauugagaugacaaagagauggcucugugauuaagagcacuugcugaucuugcagaggacccagguuugguuccuagacuuacaugguagcucacaaccaucuguaacuucaguuccaggaaucugacccucucuucugcucuccaaagauaccagacacacucacgauacacagacacaugcaaaguaaaauagaaauaaauauuaaaaaaaaauauauuguggguuguuguuaaagugcgugaggggcauuuugaagauuuuauucuaaggucaaauacaaggccucauaucuguccuuaggacuugacccugaaagauaaugaauuuuaggagaccuaaacuguuggguaccaaaaaugaguauuacucccauuuuggaaaaucaugaauagcuguauuaguugacuuuaacuacugugaguaaaugcccgaggaaauaaaaagcagaaaaaugagagccaagaggaucuguagcuucugcacccgugcguggugaggcagggcaccauggcgggagcaugugggaaaagccgcacuuucugguagacagguggcaaagggugccgggcaggggcccuggacaagaugcauucuucaaagcacaucuccagugacucacuucucccagagaggguacaguucucaguugcuccuucuguaugaacucaaugugcugccaguggugacgccaggacucgaaggauguggucaccaggucccgcaggguguggucaccucuaaagacugucaccagcugguguccaagccugcaaccugucagccucauggucuggcuccccagacuguccagugacugaggccauuugcagaugguuuucaguucccuugccacugauuugaacaggauucccaugauuuugacuucaaagcauuuuuauguuggauuugcuuaagaaauccccauuucucuuuucuuuuucagguuacuguggacuuugugaagccaucgaaaguugggacuuucaaaaaauugaaaaguuagaggaacacagauuacuuuuaagacguuuagaaccagaauuuaaggccacaguugauccaaaugauauccuuucugaacuauccgaauguuugauuaaucaggaaugugaagaaaucagacagguaaaccaaugccagguacuaaauuugaagaaaaaugcagagacauuggaaaugcccauuuuucugucuuguuuuaggcccaaggauaauugaaacccauaaaagcucucaucuagcagauauaaugacuagaauagaauuuuuaaagugaaugggguaauuuuugugcuagacuauuagaaaauuauuuaaccuauuugcaguuaaaguugcccccuuacuuuaaaaaaaauagugguuuaugcauaaugcaaaucacaccaaacagugcaacaauuaaaaggaaaaauaugucaggcucuugggcauagauacauuuauuacagucucgcagucacuuaacuagugaugugaugccaggcaguucucuaagcaucugugggguuuuuguuguuguuguuguuguuguuuguuuguuuguuuuucaugucuaaaguaagaaaauuuaucuuuuguuuuuuguuuuuuuguuuuuuuagauuucuuuauuuuauuuuauuauaugugaguacacuguagcugucuucagacacuccagaagagggcgucagaucuuguuacggaugguugugagccacuaugugguugcugggauuugaacucaggaccuucggaagaacagucggugcucucaaccccugagccaucucuccagcccccuuuuguuuuuguuuuuguuuuuguuuuuguuuuuuuguuuguuugguuuuuuugucguuguuguuguuuguuuguuuuguuuuuucgagauaggguuucucuguguagcccuggcuguccuggaacucacucuguagaccaggcuggccuugaacucagaaauccgccugccucugccucccgaguacugggauuaaaggcaugcaccaccacgcccgacgaaaauguaccuuauuagcacucuuuuagggcuaaaugagaggucaugcacaaaauguguaugucagcuugaugcauagcagucuaugcacaaugcauuucaguuaucauuagaaagaaaagucauagaacaucugcuuagaaaagagaccugcugcugugcuguuaggcauuuccaaauggcucugugugccgauacauccuuagggugaaugguuagcgucuggguuaacgcuuuuaccccaggauugcucuuggucagggauauaaggauucagaagaugagaacauuugccuuggcauauugauaacacauuauaaaggacaaaggugaagaaaggaauaucuuaaaagcuagugcuggacagggcaaaaagaugaugcuaacuaagcccuacucaacuauacuucacagugauuucaaucagauaccgcuuccacaaaagcuugccagaggaaaggcugagcugccugaucagugugcugcauuugucucccccagauccgagacacuaaagggagaauggcaggugcggagaagauggccgaaugucuuaucagauccgacaaggaaaacuggccaaaggucuugcaacuugcuuuggagaaagacaacagcaaguuuagugaauuguggauuguugauaaagguggggugcuccaagaaagaacccuggacccugcugcgcuccucccaguucuccccacuuuacuuuccaucagaggcgcuguucacuucagauaccaaaggcuauaucccuaggauacaagcaguggaaagcugaauucugggaggaagggaacuacauggcauggaauuaacccgaccaggucaaagaaucuagggaaggcuuccagccccaauuuguuaucagagaaauagcuugagaauucuagaccuaaagguucaaacugcaagacuuaccucccuaucagagcagaggcugaguguugggggugauagcuauggacuggugcucuugcccggaagccaucuggacuccgacagagcaagaguaaacgaagauuuucuguguuuaagccaaccucauuuggcuuccggaaacucacuucuugcuuuaaacagaccuugauaaauaccugaguuucuaguuuccuuucucaccuagauuuccuuagaacauaaauuauuccagaaacucucuacaucguuggucagagauggaauccugucucuuuagugugcucaggaaugacgccccugcguuauuggcgugaguuccggaguggggaggggcuccggaugcaaacugcugagagccccggguuccacacuuggagucgcguaguuccagaugaaacuggaauucaauugccaaguugagcuucaaacucagaauaauccuugcaguuguuuuaagccgucaaaguggggcucucuagauggcucaguggauaagguuccugccacugauccugaagacccaaauucaacguccagggccuacaugauagaaccaauccccaaacaguguccucaucccucggcacacucacugugucgugugugacacacacaguaaacaaauccauuucaaaaauaaauaaaauguuaagaaagugcaagaccgugauuguaagagcucaacggaaauuuagauguuuaguguuaguguuaggacuuuuugggacuuccccaaccaaaaccauaaucacauugcgcaugcuuuuaaucccagcacucaggaggcagaggcagguggauuucugaguucgaggccagccuggucuacagagugaguuccaggacagccagggcuauacagagaaacccugccucgaccaccacccccuuccaaaaaaaaaaaaaaaagauucuaagcuguaagcuguuauuuguguuuaugauuguuugcuugccuguuuaucacaaagguuucaaaagggcugaaagcaaggcugaugaggaugauggagcggaggcguccagcauccagauuuucauucaggaagagccagagugucagaaucucagucagaaucccgggccuccuucagguaccaagcaucguuugcucucauccaugauggugucccccagcacuuugaugcccuuugaaaaaaagucuuuuuaaaggaugauuaagaaaagaaagaauuuguggggcaauagggacuucauaauuagaaucccugcuccugucuuccauggccucugcauggccuucaacccucccccuccucuccccuccccucccccucccuccaguauguaugccuucaucuguaccguguucccagaacuucaguguccaugacuucucaaagcagccuugcucucuaaagaacacuucugcucacuaagcaauggcuuugagaaucugggcugacagcugguuuuccucggcuguuuuugaugaucuguucuuacuuuguuccaaguggcuuuguuuugaauuaggccauucuugcuguccuuuuucuugauaaaguuuccacgauuaagaaagaauucauggggcuggagagauagaugguucagcguuuaagagcaccgacuguucuuucagagaucccgaguucaauuccuagcaaccacauagugacuccagcgucuggguuaauguuuuuaccccaucuguaaugggcucugguguacucuucuggugugucagaggacagcgacaauguguauauucauauacauuaaauaauaaauaaaucuucaaagagaaaagaaggaaggaagaaguaacagagagagagagagagagagagagagagagagagagagagagagagagagagagaacacacuuuggccaagaucccaaaccucaaacaggggcauuguugcuagagucagaacucauguccacugaauggcaguugcaccaugauuccuuguagcaugaacccuucgauaacuuuguccccucuauauuacagaagcgucuucuaauaauuuacacagcccauugaaaccaagaaauuaccaacuggagcuugcccugccugccaagaaagggaaaaauacaauaauaugugccccuacugguaagucaguugcugucacucacagaacucucuggcuucgcuuuuucuucccccuuugggggcuguaaaaggaggaguuuuccccguggcccaugcugcccaugggagagcuggucuagcagcuuaaggaaccuggacagcgauaaggagggagauaagugucuucuuuaguuugcuuuugguucuugcuaccugagugcacguuacuuaggaaguagcuuggcacuuuucagccauuguuuaaacugucauuguuagugcggaggagggauuauuaguuuauuuguaucccaguggucauagagaagccaaaauaaguaccauucuggaaaaacagcuaacacagguuaucuguugguuuuuuuuucuuuucuuuuuuuuucuuuuuucuucccuacuaaaagguuguggaaaaaccuuugugucgcuucuuauaugugaacaccaucuuaaaaaauucccauguggacaaaaagggaaaguggucuucuucgcuaaccaaauuccugucuaugagcagcaggcaacuguguucucacgauauuuugaaagacuuggguauguacuacuacaaucaaucuaacugcuuugauuuuugguuuuuguuuuguuuauguuuguauuuuaaauucuagccccuuuggcugguuuugggggcuuuguugugucugguuuugggggcuuuguugugucugguuuugggggcuuuguugugucugguuuugggggcuuuguuguguguuuucugagacaguguaucacguagccuugaguugucuccaacccacuguguagcugagguuggccuagaagagaugaucuucuugcuucuacaagugcugagauuacagugugcacuggcaugccuggcuguucucugauuuucuuucuuuuuuuuuuuuuuaagauuuauuuauuuauuauauguaaguacacuguagcugucuucagacacuccagaagagggcaucagaucucauuaugggugguugugagccaccaugugguugcugggauuugaacuucggaccuucggaagagcagucaggugcucuuacccacugagccaucucaccagcccucucugauuuucaaagcuaugauuaaaggaaaaucgccauggacuuaacuuuuagagguaguuccuuugugcaauaacauuuuugguuuaacuuuaccagaaaugcuaagcccucaugucaugcucugacaguuaaugaacuugguggccaaauuuaacauguaggcgauacacaggucauccuuaaugauguuauacuugauuggcuauuacucuuuucaaaaucauuucucucuuaaugacuugaaagaauaaauacacugugaucagcuauaaccucuugcauuuccugacuccccggcuuugugucaggccugugagaaaguucaagguacuacccaguuguacucuuuugggcuugggcugacuucuuuaauugcugcucugaccuagacuucuacuuugucuccuuguucauucacaucaagguugaugauaagggauuucugucauuccccagguacaacauugcgagcauuucuggggcaacaucugauagcgucucagugcagcacaucauugaagacaaugauaucaucauccugacaccccagauucuugugaacaaucucaacaacggagccauccccucguugucugucuucacucugaugauauuugaugagugucauaacacuagcaaaaaccacccauacaaucagaucauguucagauaccuagaccacaaacuuggagagucacgggacccacugccucagguauuuccaaucuucuaagaagaaccacaguuuuucagagucccacuuaguugcucuuuuguagccacauuugagcuugcccuccucggggucucaguccaucgguacaacucaguggucaauguugguucauucauuugaccaacaguugucccuugguguccaggguagaugcccuucacaaaaaacaaaaucuaggcugcuuaagucucuuguaugagaugacauugcauuuauauauaaucuacacacuuuccucuugcauacuuuaaaucuucucuagauuacugauauuguacaguaugaugaaaauuuuauauaaauaguucuaguacuguaauuuuuagggaauaaaggugggaaauucauacauguuuaguacuuaugaaguuuuaaaaaauauuuuugauccaugguuguaugaauucacauuuauauaaccucuggauuuggagggccagcuguauaaaccaugggcuuccauggaccuugugcauuguucuaggcucugggacaccaauacagaagauauaguccuggcucucauacaguuaaguuugcagggagccaggaacauaguagucacagcuuaucaugagguaugcugcagagacagguaaaggguguugucagaacauaagggguaauaaggcauagaaaugaagggaacugacaggggcuugccagguagauagcuucugguuucuaguaagagggugcuguguguccaggggcucagggaaauggaagggccugacaugccccagaaccuuaaaacucuacaguaucacuugaggguagagugugaagcagggaacaacagucaagcugauuguuaugacagaugacccagagacaccaggagggcagagcgucagugggcaaguggauggcuuagcacagggaacaagcagcagccuucugaugucauaugagaagagucacuucagagucauucuuacaugugacaagaggaguacaaauucuccuucugucuaucauaggagagggggugcuuugcugaaagucaacgauauagaaacaggagggggcuagagaggaugaggacgguuugacucaggcacugauagaugcaauaaagaaugacgguaguguaucuaucaggggccccaagaagcuguaaaccaugaauuauauacaauucuuuugcuccaacaauaaccuuuuuaggacgugcagguuaaaggacauuuaguacaggacccacaguuuguuauucucgaguaucguugcuaggaagcagauuucuuaccguccagcuaaucauuuaggugaaugcuuacugaaggguguuaucauacugaaucuacacagcucucuuguacacgacucacugauuguugaagguauuuguccaggcgcacaaaaugcaugugauaugaaugagccuggaauggacuuuuucuucccauugugauguuuaguaagagacugggggauaaaaaaaacaggguagcccugccuggaaagguuuccucucuguucuggaugacacgcuagauuuauuuccgagcuuugcuccaggggggucuuugugcuggagaaugucagagagccagugguggggugcuccuuacaggucguugggcugacugccuccgucggcguuggagaugcuaagaccgcggaggaagccaugcaacauaucuguaaacucugugccgcccuggaugccuccgugauugccacagucagagacaacguugcagaacuggaacaggucguuuauaagccccagaaaaguaaguggaggucagcagcccacaccucgcgacuuuguaaccuucuguccccucugcgucagagacaguggaugaaguuugaugcuguauuuguuugguaaaagcauagugguuacauugccuaucuuucucccuagucaaccucuucucccuagcgacgcaugagucucaaagguagccagaaagggacaaacaucccuacucuuuaccagcagcugagugaaggaggcagugggaagauucaagcauuuugaaagccucaauagcuaguggcggaaucaggucucugugcuccgggcccuaggcaggggcuauguggccaucuuguucuuguauguaucugaucauuguaguggcaugacccgaaucaugacaguucaaaaggccagaacauguuuuuaaaaugagcuucauuagaagaugguuauuacuuauuaacuaccuguguaagcagggagguaccguaguuacccacggcuggaucuuggccugagcacucguucugugaguugacagcaggaucaauggcagggucaauggcaggaugagcaauggggggguggggguugggauggcacaacccugguucuuucugagagucccccguggagagugugaagaaggugccuccccacccacgcccaccccuuagcaacacucaaggguuuuucuacaguuugagcccuuggagcuuagucuacuucaaagucauuuugugucacuuucuccgucuaugcaaacccucuacgagcuauucugagggugugucccagcuccugcgcgccuuccuuuuucccuuauuauucaucuugcggcagcuuccccggagagaaugagguuuccuccccucuuugagagaugccuuccuggccugcaccugcuucccagggcucugaugggcggguuuaggagcacaccuuuguuuccuuuaaggaguggguggguuggggagcagggggaggggggagggaggggauaggggguuuuuggaggggaaaccaggaaagggaauaacauuugaaauguaaauaacgaaaauaucuuuaaagaaaagaaaagaaaaggaaagaaagaaagaaccugccuucugugcagcauaggguagcucuugucagcucucugucacugaaacaggacaugugacaggcaguucuuuuucugccaaaaguacacaaaugugaacgauaagcucaaugggggcacucuugggggcucggaggugcgcaggagaauaggaaaucaggaaaacggggcuggaguaugguauuugccgaaaccagaaggcugccagaccugccacaguagaggcaccaggaaagcugacugagacgcuggcuuagacuagaccaggagagacacuagaaucagaagcaguuccgaggucagaggcuucugaccgccugcugugauuugggccacgugagcuuggagccuguggcuuuaaaggacuuacccaggauggagcagcuucgggaaauggcugcauaggaccuggguuuccuucagcuuacucacaugccuuugaccccaguuuccaggaaaguggcaucccggacuucgaacacguuuaaaugcaucaucucucagcugaugaaggagacagagaagcuagccaaggaugucuccgaggaacuugguaagccugugccaaguccuggagagagaaaucucauguuuccugucccuuccauuuagagguacucauggauugcucguuagugucuucaguuuugggugagauuauacucagagguggacugacuuauuuauucacacauauuucuuucugucucuguaucuucuuuaucucuucauucuuuuuugccaucauuuuuuucuccauuccuuuuuaaaaagauuuauuuuuauuugauauguguagauguuuuugucugcauguauguauguauaucacauguaucagauacccgggaacuggaguuacagacaguugugagcuaccacaucugcugggaaucgaacccauguccucuagaaggguagcuggugcgcauaaccacugaggagcccccauuucucuagcuguuuuuaagacaagguuuuuuucccugugucccugguuggccugaaacuugcuaugaagacaaggcuggcuuugaacuugcagggguccccuugcuucagcuucugaguccuggggucucuggcaagcgccaccauaccuggcucagauauagacuuucuuaauccuagguuguuuaggaaccuuauaggaguucuuuaauucucucuugccuuuuucuuuuuaaauacaaaacacauccaccuggacauacauaccugagaaauacugucuuuaaaucaucuucuaaauuuccuuucuuccuuuuuuuccccucuugagauagaaucucuguguucaguguaggcuggccuugaacugggaacucugccccuccuccuccuccuccuccucccaagaugugcaucaucacugagcugccauuagagugccauugucccuuccaagagcaguucccccagugaccuaacacucucucacuguccucagcucuugaaagugucaccaccuccuaaccucacacacugaggaccaaccagccuuuugccacaugagcauccagaaggcacuuagacaguagcuaaggcacagcacugggggaggaguuugaauaaugaauccacuauggguccuaaaguaguaggguagcaagcaugcucucuccucuagaguuuuggaaacucucuguaagguaaagaguaaagagaccagguagucaguacauggcucaccuaggaacaagauaacauggucugacuaaagugguggauggacagacggacaggaauagaguuguaugacuuacuuuuuuguuuuguuuuuguuuuuaaaacagucugucuguauagcucugacuguccuggaacucucuuugcuggccucaaacucacagagaucugccugccucugccuccggaggcauucacacuuuagaaucuuuucccaccuccucacauugaguaucugucaauagcugccucacuucuucuggaacuuggacguuuuucauugugaacugggugugguggcaccaucucuacucccagcagcugggagccugagucugaggccagcuuaggcuacauacugagcuccuguccuuggggcggaggcugggaagaacuugucacuguuucuuguugguacccguccuguguucuguuauugcaaaugugagggaagccauuuaacacacaaaugcauuucacuucuuugaacuguacugugcuugucucaagaagcccaggacacaaaacaauagagcaagcaucuggggcuguucccacuucgccuuucccccccuacccacaccaaucuuccccugagucugaaucgcugugaaucccacaguagaaccaagcagucaagacaugcacaugcgcacacagaugcuuccgggauaacuguguuugacuccgccuugugguuggugcugcaagugcugcucugagaucagguguuugggcuucauagcaacauagagcaugcugggaaggguccuggugcucccauuuuuauauaacugucuccgaugaagcucuugagacgugcuacucuaaugguaucuucauuuugaaaggcaaagugugucccuccuucucuuccuccuccuccuucuuccuuaccccucuucuucguucucuguuauuucugaacuacuuuggcugucagccccuuaagccugcagagcauagacaccacagagcuaggcuugaauucuugccucacccacacaauaugagcuuuaugacauuggggguaaauuaguuuuccuuuuauagaagauuuauuuacuuaaaaaaaaauuaugugcaugugcaugugcgggaugguguuguugccuccaggggucagaagagggcgcugaaugcccuggaacuggauuuacaggucguuggaagccacccaaugugagugcagggaacugaacuuggguccucuacaagggccuaacuauugagccaccacuucugcuccuuacucaaucuuucugaaucuguuuccucuuuuuuuuuuuuaaagauuuauuuauuuauuauauguaaguacacuguagcuaagcuaucuucagacacuccagaagagggagucggaucuuguuacggaugguugugaaccaccaugugguugcugggacuugaacucaggaccuuuggaagaacagucgguguucuuauccacugagccaucucuccagccuguuuccucuuuaaaaaaaaaaauuaaauaaugaccucaugaaauuagaaaauuucaaugcaauuaugaagcuugauuuugggucauuuaguaaauaguuauuuuacacacuccucccccccaccccccgcgcacgcacacaggcacacacacacacacacacacacacacacacacacacacacauagcuuaagacccagucuacuucaggauaaacaucuuucuuauaaugaauaagaaagaaaaucagaggaccggugcuugcaaaucuuuuauuuaucuauuuauguucuuacccuguaggaaagcuuuuucaaauucaaaacagagaauucggcacccagaaauaugaacaguggauugucggcguccacaaagcgugcucaguguuucagauggcagacaaagaggaggagagccgggucugcaaagcgcucuuccuguacacaucacauuugcggguacauugcugcucuccagggcuuauucucaucaccgcgccuccugggaucuguacugaggcagcugagagaacaucagcgucucaagucuaagagcuuagugaggaacuuuucccgaaagucaucacuaaccuuauuuguuuucugaaacuuaucaucaagucuccaaaaacuggauuaaaggcucagagucuaugccacaccucccuccagcuugugacuggugaccaccaucuaacugagcucaaaaaaguggcuccuguggccauauccugaagcuuucguggucuuaauuuuguuauaaagucauauauuagaaucucaggggcucugguuaacacagagggaaggaguaacuguaagagcccucagcucuguuugcuaugcucugggaacuauuuaaagacuuacuccacaccaugggauugugggaucuaacgcuuaauggacuuucagcauaggugguaagggccaucguuaugcaaggcccauguacacuuuaaguaugacuuggaauuuaaggggaaugucaaagcuaacuugcuuuuguuauuguuucucaagauaugcuguuucuccucucccaagguggaguuuuauaauccaaagugaaucuacuuuuaauuuucuagcugagccaaaaauagaagccagcuuuugguucagagguuuuuauuguagacccacuaagggccauucgccauuaaacccucagcuguacuguaugagaaagauuuucugcaaaccaguuuugugcuaaauacagcgaguugaacuugaguguagugaccauaugcgaccucagaaauguauugagaaucacuuuucauuucaaacagaaauacaacgaugcacucaucaucagugaggaugcacagaugacagacgcucuaaauuaccucaaagccuucuuccacgauguccgagaagcagcauucgaugagaccgagcgagagcuuacucggagguuugaaggugagggagauuucugaagucaggagucccuggggucugguggcuuuuguggcagugugcacaucguaguuagcauacguagccaucauguuggguuuaaggugagauuuguaggggcugugacggagcaugaccuuagcauggcugaaauccccagcacuaaaaaacgaaccuaugcugaaacuuuagagccaaccaaccgacaacaggaggguuuggcuucagagaaaucuaaugccuguggauggaucugaugcuugccccacuuuucacuugggaaaaugggaaacagugggauuuggaaagggugcuuccucuaggugguagguagugcuauucugauuaacucaguaauucagaagguuuaauaacaacagcucgugucugauggugucaagauugugcuguauguauguccuuccuuccuuccuuccuuccuuccuuccuuccuuccuuccuuccuuccuuccuuccuuccucccucccucccucccucccuccccccuuucucuucucuucucuucucuucucuucucuucucuucucuucucuucucuucucuucucuucucuucucuucucuucuccuucucuucuuccuccuccuucaucuucuucuuucuuccuccucuuccuucuccuucuucuucaaaacacagucuguauagccccggcuguccugaaacucacuuuguacaccaggcuggccucgaacucagaaaucugccugccucugccuccugagugcugggauuaaaggcgugugccaccaugcccaguuugugcacauauaugugcauauguuuauuauaaauuuuacugauacaggagauggcauagcacaaaacacacaaauaauaaacacggaguucauguuccacagaaugccuuuggaggucuuuucaguacccuuguguccagagccaaccagagacagcaauuacccaauauggaguucugaaaugaaagucaguuuuauuuccuguuaauggcagaaauaagaacaaaacgaaacagcagaagcauuuuggaagcuugcuuguuucucagugaugggagcaacauuuuucugagccagauaauaguuuuucaaacacgggugggacauuucugcauuuuuacgugaugcauaaacaguagcuaaauuuaauccccauuauauacuuagcacuuuacaaagucuagccagacaauaaaggaugaagcaagugcuaucuucauuuccaugguauggguacuucuaggaucaccaaucuccaaccaucaccauguugcugaacuuguguaaaauugagcaguaacacacacugacauuucuaccauucauacacuacagguaaguacacacucaagagcguagauaauaguaaacuguaauaaaaugaguuaggaaauuaauaagcguggcuauuuguuacauuuguuuuuagucauugagcugcaagcauaaagaguugaaauuuuaauaauaguuauauuuaaaaccagguccacaagucugaagaacuuaauaacugaccauaaucugguuugaucugguucuaucuaguacaccaccagugugugugugcgugugugcuccuaugcauacuuauacauuaaaaaaaaaaaagauauccuaugcuucaauuuuuaacauaaaauaaccuucugacagcugggugguggugguggugcaugucuuuaauugcagcacucaggaggcaggggcaggugggucucuggguucaaggccagucugguuuacagagccaguucuaggacagccagggcuacacagagaaaccuuguuucaagacaaaacgaaacaaaacaaccacaaauaaaaaauauaucuuuuugauguuuccaaaucagcagguguauauaacucuuuaacuuuaauaguaacaguguauuuaccucaguuugguagccugggauccauugagcuguuucucacuaagcaguguuuugguuguugguuuuuuuuuuuuuuuuuuuuuuuuuuuguauuuaguucauaguuucaacacugauuguccuuggaaucuucuucagaguuuuuuuuuuuuuuuuuuuuuaaagauuuauuuauuuauuauuuuauuuaaguacacuuuagcugacuucagacacaccagaagagggugucagaucucauuacggauguuagugagccaccaugugguugcugggauuugaacucuggaccuucggaagaacagucggugcucuuaaccacugagccaucucuccagccccagaguuuucuaaauagaacuaugagucaauuccuaucuguggauugcuguaucaaagaacaugugaguuuuguauugcugcgcugcuuuucuaaaggggauuccugaugaaacgaguguuuacugcucugaucucuggugaacaguggaaagguuaaccgaaauagaaggccacuguuuguucuaaagcuuuaacauuuguaagccuuuugcaaaaugcucucuauuugcagaaaaacuagaggaauuagaaaaaguuuccagggaucccagcaaugagaauccuaaacuaagagaccucuacuuggucuuacaagaagaguaccacuuaaagccagagaccaagaccauucucuucgugaagaccagagcacucguggauguaaguguguguguuuacagauuagcucuaguuuauugaaaagguugcccguucuucacugccuuauaaucaaguauccauacauguguggaccuguucugaugauuuguucuuacaccaauugucauuguuuguauugacccacaguuauaagucuugguccuauagaggaagcccugcauccuuuuuaaaaauuuaaaauuuccacuuccagucauccuguagguuuugauuaaugacuaaugugucuuauauaccucacaguuaucuucauaucaucuuuuaaaaauaauuuacucagauuuuaaaaaccaguuuuaaaauugggcaaugggcuggagauacagcucaauggucaaaugcuuguucagcaugcaugacuuuaauccccaguucuggaaaaagauagauaucucucuguuuauguagaaugccuugagucuggccacagcgccucccucuguuuauguagaaugccugcauuguuucugcugaguaguagauuacccauagagccagaggcagaaaaagucaagcuuuauuauuuuaugagauccguggaucaggaucuggaaaggacuggauacuuaugccucaaggucuccugaggccacagucagcucggcacucaaggcugaccucucggcuccuuuugcagguuguuggcaggcuugugaagaugagccuccaacauggcagcugccccugccuacagugagaugagagacugaggagaagagggccuaguagacagacacugccauuuuauaaaguccaucuuggaccugaugucccaccacaucucccauauuucagagauaaacuacagauuauuuuuagaauauaggauguagaagucauuaagggucgcuugucaugugaucuuugcugucuucuuuuguuaaugaauguggguguuuaccaugugcgugucgugcccacagaguccaggaagggggcaugacaugcccuggaacuggaguuaacagacaguuguaaguugccauguaggugcugggaauugaacucagguccucuggaagaacaaccagugcucuuaaccaccgagccaucucuccagcccccuuugcuguguuuuauuagcauuuugucauuuuuaguauagagguccugcauacauuuuguuagauucauaccuagguauuaauuuuaguguugucauuccgaaauuguacuuucaaauauuucucacugugggcuaggaagacaucucaguaaagugucuaaaguacaggcaucaggaccuggcuuccagcaaccugguaaaaaagccgaguacaguagaguacucuuguaaucccagcccuggggacagagauaagcacaacccuaacuggcaaugcccaggucccagggaguuacucauuacucagucuuaggcagaacgaagguggguggcuguuaagaaaugauaccuagggcuggugagauggcucaguggguaagagcaccugacugcucuuccgaagguccagaguucaaaucccagcaaccacaugguggcucacaaccauccguaacgagaucugacucccucuucuggugugucugaagacagcuacaguguacuuacauauaauaaauaaauaaaucuuuaaaaaaaaaaaaaaaaaaaaagaaaugauaccugagguugaccuccacaugcauguacacacacacacacacacacacaugcgugcguggacauacuccccuccaacacagucagccauguacaccuccacacaacacacaguucuuccaauugcagcugucugcugauauuuacuguguaauuaauuuacauggauugaucuuucaccuuaaagccuugcuaaauuucacuuacucuaugucugaagcuugucuuuuuaaucacuuaaaauaucuccuacauuaagccauaaugaggcagaguucuauaucacuagcaucaauuguuguuuggaauuuaggauuugccagucugaaauccauuuuuaucuuuaguuguauucucuuuuugcauauacauccauuauaucaaauugaugugagguuuaaaguuuacaaguggugucuaacuggccguugcuuuucacuuuuaggcucugaagaaauggauugaagaaaauccugcacuaagcuuucuaaagccuggcauacugacugggcguggcagaacaaaccgggcaacagguauuuaugucuauugaauuagauuuaguauacuauguauauaaaauguauaaacacuacauuguuuuaguguuucuaucagucagagcucaaccagagaaauaaagcuacuagauuaugcauauguaugugguauauauguaaguauguaugcuuauuuguuuguuuguuuauuuauguacuuagagauaggguuucucuguguaacccuugcucuccuggaacucacucuguggaccaggcuggccuugaauucagaaauccgccugccucugccucccgagugcugggauuaaaggugugcgccaccacugccuggccuauacuguuauucuuuacccaguagauuuuuuuuccccaucuacugccucuuuaauaguuuuaaaaaaacaguccaggcaauccugaacucuagcuaguguggucuagggaggaagguuaucauuucccauaagaacccuauguggcuagcucucaucacagcuacgucccaagucauaucucacgacuguaugaccugcccucgcuguucuuccugccaguguuguuuacacuaaacaagucuccaccccuucucucuccguccucaggcauugcucuuguacuuuuccauuguggaauuucccgaucucauaaacauagaauggacucaaguguugaaugugugguuucgagucuaacacuacccuaauguggcuggauuuucaaaguucuuugccaucucuccaacaugaauccaacuugauuuucaagcuuugcuacugacauauaaaucgagccuugaauaauauuuugugugcucauccaugcaugcauggauccauggauccaaucauguguccaaccacucauccacccauccgugcaugcauccaucuuuccgucaugcauuuagaccuuacucagcuccugcuucugugaagaagcagccaucccugucaucuaacacccgaggugccccuccccccgccacguucccaucuuacagaucucaccccacuuccuccacaauggcuuccugcucaucauccuuauagauaaagauggaaucuuuaagcgucauauuucuaccugcucagccauaacccauaauugcugaccgaguguuggauggaugaaugaauugguuaggaugauucugcuauuguuguuuucuggaugauucuuucuuguuuuauagcuaaccugggaaaaaagguggacuuuuacaaaaagccacagguugcuugguguuuggacauuuucagauucccuuaucuguagcauuuuuacuuccuacuuugagacacauguuguaauguuuaugccuuacuaucuucaucugucaaauggaacaauaaauaguuguccccagcucauagguuaacgagaauggugaaaccugagcuuuuuuuuuuuuuuuuuuuuuuuuugugaaaaugacuuuggcacuuuuagaugguucaaaauuaguagccaguuuaugagugaguuguacagugaccucuuuauccaacacaggaaugacgcucccggcacagaagugugugcuggaggcauucagagccagcggagauaacaauauucugauugcuaccucggucgcugaugaaggcauugacauugcugagugcaaucucgucauucucuaugaguacgugggcaacgucaucaagaugauccaaaccagaggugagagcggcugaugucauucccgccccgcacccgcuuuucuccuuuccucagcuguaccaugugauugacagcacagcugacucugguacucgaaaucuaaaagcugacugccuuggucaggauugggugguuauagguuuacccauaauacuccauugcaacucuccacaaugguacugcaauuuuacccagcguucaauggcauagucgugaaaauaucauauccacuaggccagaggcuuugccagucggcaaguagaccuuugauggguguggugaguagcucucuguacuccagagucuggucccaccugaaccagagucugacuuccuuucccuuucuuguuuccccaagaacagcccccacauucccuuuccggaauaacgucucugugccugucacucaucagucacauccauuuuucguccuccuccaccgcuuacugugcgguucagccagccagacuccgcuuccugcucguccaguuucucagauacugucgcucuacauguuagguccuaucucugucucugccacacacaaccuaauucuucuaccuagaacaagcacuccuuuaaaugcccacuaccguuuauaucugucucugcaagagcaugacaauugcauuccuuucuccgcauugcagaagggucaggugcgcgugcacggugccacugcugcgggcucaugccagauuaucuguaaauuaguguugcuggcagugcagagcaaucagacuaugccauuggagaccccaugaaaacugccagagauggcuuaucugugugcugagcacacuggcuagaaccugcauuugagucuacucuucgguucagcuucccuagaaaguaggaugcagugaaucaaaguugaacucgagaaauacuccucacaucucuuuccaguaaccucagaguuugacauuaacacacaaagaaaacguuuucugcaggccgaggaagagcacgagauagcaagugcuuccuccugaccagcagcgcugacgugauugaaaaagaaaaggcgaacaugaucaaggaaaaaauaaugaaugaauccaucuuaagacugcagacaugggaugaaaugaaauuuggaaagacgguaagucucuuuuucugugcuacucuuauggaaucugacuagaaauaacaaaugaccaugguugguccugagugugugugugugugugugugugguauguguuuguggccaugugcauuuauuuaucuuugugugcuaguuuuggccauucaaauaaccuuucuguucgcauguagguucaccgcauacaggugaaugaaaaacuccucagagacagucagcacaaaccacaaccuguuccugacaaagaaaacaagaaacugcuguguggaaagugcaagaauuuugcgugcuacacagcugacauucgagugguugaggugaguggcccuggugauuuagcaccgguuaaaucuuaccaucuuccggagaaaugguuguagcaagaacacuauguugugggguuucgaguguugaccaugguccuguauuaagaaauaaaauccugcuagguggugguggcacacgccuuuaaucccaguacuugggaggcagaggcaggcggauuucugaguucgaggccagccuggucuacagggugaguuccaggacagccagggcuacacagagaaacccugucuuggaaaaaccaaaaaaaaaaaaaaaaaaaagaaauaaaauccugcuucuaugugggaaccagaaaggcugauguuauuuaaguccaaaacagaaaauggugcuuaacggcgagaagaggaggggggucuaauuguagcugccccagacagucaggcaggauggauaagguuucccguuccacugcacagcagggugaauacugcuuauaguuucugauucauuacaacucuuacaaagaauuagacgagaggaauucauagcuucagacauaaagagaugaaaacuguccaggcagaagggaaugcuaauuacucuggcgagaucauuagauacuuagaaauuaucacacugcacacccuaagugaggacaacugugugcuuugaaagacagucucacucagaccaggcuggcuucaacuugagauucuucugugacucagccuccccagugcagggacucuaggcaugcaccaccacucucuccaaagagauaguuuuucccagugcagggauagaaaaugaaggcucugcuagauacaguguuauguccuugguuaguuccagggaggaggaagggcuaggcauaaaaaucugucauugauuucuuaguuuuaacaaaugugcaacugcauucaaaauggaacugggcuaaaggcauuugcaaaucuucugaggcaucucuguaacuuuacuguaugucaaagauuaugccaaagaaauguuaaggcucugauuuugaaguguacaugguucuaguauaaaccugccagcaaaugaaugguaaagugggaaaauacuaugaauaugaaauuauaaagaugcuuuuguuauggcuacauacaacaugagcagugauaucuuugucaugaccaauguggguccaccuuuccuaaaggggaaaaaaggcuaauauauaaaaaugacauauucugcuagugaauucucucuuccuguuuuguuuucuaaacuuccuuauuggaacagagaaugcuuuuauaaugaaaacaaaacaccucauuuuaaaaaauauaacacuuguagguuagcuuucuacuuuuucaccccuuaaacuuuuuuuuuuuuuuuuugagacaggaucucucucuauagcacuggguaucuugaaacucauuauauggagauucccuugucccugccucccaaacgcugggacguaaaggcauguaccauuacacaaggucuucuuaaaacuuuuaacuaaggcaaaaaaccuccagagacgaaucuugcagucaucauuccugcuaccgauggcgggggcagauggcugugcuagcuaggggagggguacaguccuuauuaugagugacauccacuuucugagucugauucuuuagaugcagaagguccuuucagcuccaaauucaaggcuucuccuucccaguggccuggagaacgagaugcuuggucugcgcuugcgucuguaggguacacucuuuuuuuuuuaauuggauauuuucuuuauuuacauaaagaacaccuucaguuccccuacacuggggcaucuaagccuucauaggaccaaggaccucucuucccauugaugcaugacaaggccauccucugcaacgcacgcagcuggagccauguguacuccuuuguggauggcuuagucgcugggagcucuugggggacugguugguugauauuguuuuucucccugugggguuccuucaguuguaggguacucucuuaagucaagucuaaguggggucuguggacagcauggcuccugagccuguucacacacauacccugugaccccugggugucaccagcccugugcuuuggugccuuccuggccucuggugaacuugaacuuuguaugugaacuccucuuugcuucugaguuggaaagcuggguuuccuccuuucucaggugccagacgcccaggaaauggguccuaaucggccuggggaagacugucuauauaguuuuuuuuucuuccaacuuguaaaauaaaugggaucccacucauuccugacuuuuagcuacugaguggcuucuaagucauuuucagacccguuucuaacauugugcgcuccaucucuuccuccuagacgucccacuacacuguccuuggagacgcuuuuaaggagcgcuuuguguguaagccacacccuaaaccaaagaucuaugacaauuuugagaagaaagcaaagauauucugcgccaaacagaacuguagccacgacuggggaauuuuugugagauacaagacguucgagauuccagucauaaaaauugaaaguuucgucguggaagauauugugagcggaguucagaaccggcacucaaaguggaaggacuuucauuuugaaaggauacaguucgauccugcagaaauguccguaugaccucaggcuucuccgucucgugccgcagggagccgugccuuaagcauggaguugaugagccaaugcuuucuuacccaagcuugcacaauccuuucuuacacaagccugcacuguguugaaugccagauaaccugacugguugguuucaagcuggugcuguccacacaaagcacacacgccugaacugcggcgccgaauaguuucuucaccaauaacucauagcguagcccuuggccaugguggggagggguuaaacuugucccuuuuacacuuuucagaacugcccgacagggaacgugcagccacucgguacaccgagacgcaugauggcuggcgugcuggaaggguucccguucucugucugcucgaucugcuguaagcugccuuugcccuuaaugacagugcccuuaagaacagugacuuaguucuuuuucaggccaccagacugacugccagaucccuucugucccuucugucccuugcacugauuccuuuccggauuugacccugccacccugucacccucugcagagucuccugguuucugucucuuccuugguuucuuugcugacucaaauuugguaguugcaagguucaguaugcacacauauauauuuaaaaugacauauaauuuaaaauguaaaagacuauaguugacagcuaugcuuacugagaugguauuucuguucuguucauuacuauacaucuuacccuugcucucaucuguucuuuuaacuugggccauuucccgucuuugaauagacaucucaaacccugucuguaugucugucuguuucccaccuguuugagacagggucucucuguagaccagaaacuccauauguagacuaugcuggccuugaacucacagaucccccugccucucaaguguugaaauuaaaaucuuucaccaugccuggcucuagcuauuuucaauaaaggcucauguuuaaaguuugaacuacuuccaauucauucccugacguggcuuguuguuguuguuuacuuuuggagacacuguuccucucuguagcccuggcuguguagaccaggcugcccuuggucacagagaucugccagcuucugccuccggagcacugagauugaaggccugcaucaccaugccuggcuugcccuuucuucuuaaacauuauauauucaaauggcauuuccguguuucuucucaaggugugccagugcuucagagagcuuaguuugggguucuucagaucaagagacaagugucugagcgcuguuacugccaacagagcaaaguacucuucaguucagggaaggaacagugcugguuuuguaggcaguacagugguuuuaacaccuuccuagaacuuacuuguaauucaucaguuguagaccaucaauggccuaaaccaaacugcagagaucaucugaccacauaacuccccuuccaggacauuuacauuugaagacuaucccaagcccacccagagcacaguggguuacccaaacuccccaggucaacccuggaggucaacaguaugacaugggauagcacaccacuucucacagaugccuagagaaauuacccagcaacauaacucuuuggggaaaaaacaccuauagggauuaggcuuuuaauugauagaauagguagaaaaaaagauauguaguaguucuugauagugguuacugguaaaauucuuagugcaauaaaaugaauuugccgagagcugacuuucuuuuuuuucuuguuuuuuugagacaggguuucucuguauagcuuuggcuguccuggaaugcacucuguaguccaggcuggccuucgaacucagaaauccgccuuccucugccucccaaguguugggauuaaaggcgugcgccaccacgccuggcugagagcugacuuucauuuaugucuuuuagucuauguugccuuucuuugcugcuacaguuuaagaacucuacagcuuguauaagauaccuacuggaaauuauuugagaaaaaaaacuuguaaacauuacaauaauuuaauuaauuaaaaauuuauguauuuuauguau

SEQ ID NO: 1829 - RNA, 2792 nt, Mus musculus
caaaccaggugcugguugauuagucccacacgcuuugugccuucguagcaguagcauauauugcagggaagacaccguugucagaguuuauggcugguuggugcuuacauuucucuugcuaguaucagaguaccuuccugaaccaaagaugcuagaucauaggguuggaggcucugugggcaucaccucaacuucuccauguugaguggguccuugucaucauuuugugaagagcaacugauucuagcaacagccuagguuugcagauucccuuuggccaacaacucaauucgauguaacccaauuacugaaaaccucauuuggugacagagauggccaguuggggcucucucccucccacuauuuggauauagauugccuucauauauguauauauuuuaggaagcuucuaccguauuagguuucuauacaacucuucaaaugcccaaauuuuaguuggcucuucuguguuccuucauccucucucuccccuguuccuccccacuugaacuucccauuccagcccccuucucauccauaaguauagucuaauucccuuuccuaucaagauuuguuccuccuaauccuguacucuaccuaaccucugguucuguggauugaagcaugauuaucacagcuuaauagcuaauauccauacacaaauaaauaccauucuuguuuugggugugggcuacugcacucaggauggcuuuuuuucuaggcccaucuguauacuugggaaugucaugguuccaguuuuauaaaguguuuucucagccauuuguguuuccucccugagaauucuguuuauaucugucccccauguuuuaauuggacgguuuucuugauaccuaguuuaguucuuucuguauuuuggauaacagugauacauacuuaggaaaaucuuccccuucuuaggcugcugcuuugugggaauaaugguguucuuugccuuacauuauauuuucaguuuuaugaggucccauuuaccguugaucuuaguuccuaugcuaaugguguucuguucagaaagucuuucccucugcuagugaguuuaagacuauucuuugguuagauuuugaguuuugugcagggugagaaguguggaucuauuuggauucuucuacaugcagccauccaguuugaccaguaccacuuguuaaagaugcuuucuuuuuuccaguguguauuucuggcuuauuuauaaaaacaaaacaaaaaaccaaaaacagguguccauagguuugugaauuuaugucugggucuucaguuugaguccacugaucagcaugucuguugugccaauagcaagcaguuuuuauugcuguagcucuauaccacaacuugaaaucugggauggcgaugaccaccaggauuguuuuugcuauccuggguuauguguuuccauaugaagcuaaaaauugaccuuuuaagaccgguaaagaaucauguuggaauuugauggagauuguauuacaucuguagauugcuuuuggucggauggccauucuuacuauaccaauccuacugauccaugagcaugggagagcuuugcauccucucuuuaaaauuucuuccuucggugucuuaaaguuuuuaucauauaauccuuucacuugcuugguuagaguuaccccaagauacuuccuccuccuccuccuccuuccuuccuuccuuccuuccuuccuucuuccuucuuccuucuucuucuuucuucuuucuucuucuuuucuuucacggucuuuuggucauuguuauaaaggaggcuccugauuuuuggaguuaaucuuguauccagccacuuggcugaaaguguuuugucagcucaggaaucuguagaguuuuuagggucuguuaucuauccuaucauaucugaaaauaauacuuugacuucuacuuuucuaauuuguaucaagacuucgggugcuguauugaguagauaggaagagugggcaacuuugucuugauucugaucuuagugauauugcuuugaguuugcccaaauaagugaauguuggcuaugggcuugcuguaaacugccuuuauuauguuuaaguaugucccuuguaucccuaguuucuccuggacuuuuaucaugaagggguauuggacuuugucaaaggaguuucucuaguaagaugauccugugguuuuugucuuuccgucuuauaugguggguuacauuuaucaguuuauguguauugaaccaucccugcaucacuugguugaaaccuccgugaucaugguggaugaucuuggauguauucuuggauuugauuugcaaguauuuuuacugagauuuuuugcaucuauguucauaagggaauauaaacauaagggagauaaacaugucuguuuaucucuuuguugggucuuaaugugguuuugguaucaagguaacugcagccucauaaaaacugcuaggugauguuucuucuguuucuguuuuauggaauaauuuggagacuauugguguuaacucuuugagggucugguagaauuuuuguacaaaagccaucuaucuggcccugaaccuuuugggagaguuuuaauuacugcuucuauuucuuuagguguuauaagguaguuagguuuguaagccaaagugcccgagggguuuuguuuuucgucaguuuucuuugcaaguaaccaggucuguucuaggauuucuuuuguguuuguaccauuugguggagccgguccguagguguacuuuugugcuucacucuugcuuauaaccaccaccccuacucauucugaggacaucaugcaaaaaaaaaaaaaaaaaaauc

SEQ ID NO: 1830 - RNA, 1374 nt, Mus musculus
cgggagcgcgcagagucccgcugaaaaauggcugcugcaucggggugcaaugcgcccgcgagcaggcuguagggcccuugccaccccguccccgcugcucccuuaccaugaggccgaugagucgccgaagccuggacuggacuuacucccugguagguaccgagcagagcggagcuccagagcgcaccauggcagggcccgcgagccgaagguagacuguuggcucgcagcuuggaacuccagaacccauuccuaaauugagcguucacgcccugcccucggcuccgccucuuccuggaggacacgcuuuuccgccucugacgucagggguugcaggccugcuugccucugggcugcacuguguuagaggcaugugaugccuuuccaccuguagcugcuugcucgggcuacacagggaaaggacccggcacauugauuucuucuuuuugcuuuuccuccccuccuuuuaguugcuccuugcaaucgucuugcucucuuggggauucgucaucuaugcaucgacuguagcugcacgacgacaacuacagaaggaguuuccagacaaguucuucugaacgaacuuuuguaauucuuagcaaacacuucuuuucuucagauggcaccuauguagacucaaaguaaaauucacaauacaaauuugcguguggccuuuugugauaagcguuaacaugccaauuuuucaaaaugaucggacaacaccccccccccccuuuuuuuuuuuucgagacaggguuucucuguauagcccuggcuguccuggaacucacuuuguagaccaggcugaccuugaacucagaaauccgccugccucugccucccgagugcugggaguaaaggcgugcgcccccacgcccggcucuauuuuguaucaggucauagcuuuucauucuagugcucaaacacuucacauccucaugucaaaucaguauguaaacaacacugugacuaaaauguguuuugcauccuguuuaucaaaauggacagaaaaaaguagcuaauagcucuguuuaguauuugucuuuuuacuguuagucucaaaucauagaaccuuuggacaguaacacggacagugauaacacucugagaauaagcuuuauuaauuacuuuuccaggaaacagauucaguaaauacagcacuuuaggaacauacuugugcuguuacacaagucuguuaaguuuuuaaggacucuucaaugauguugaucaggaaaaucucucauugguggaauuacuucuccagucuccagaauuguaucacccuagggaaaacaggaaguguuuaauagagauuuuucaccaaauauacauuucauuguaaauauuccaacauuugcucaacacaauaaaugacua

SEQ ID NO: 1831 - RNA, 1374 nt, Mus musculus
uagucauuuauuguguugagcaaauguuggaauauuuacaaugaaauguauauuuggugaaaaaucucuauuaaacacuuccuguuuucccuagggugauacaauucuggagacuggagaaguaauuccaccaaugagagauuuuccugaucaacaucauugaagaguccuuaaaaacuuaacagacuuguguaacagcacaaguauguuccuaaagugcuguauuuacugaaucuguuuccuggaaaaguaauuaauaaagcuuauucucagaguguuaucacuguccguguuacuguccaaagguucuaugauuugagacuaacaguaaaaagacaaauacuaaacagagcuauuagcuacuuuuuucuguccauuuugauaaacaggaugcaaaacacauuuuagucacaguguuguuuacauacugauuugacaugaggaugugaaguguuugagcacuagaaugaaaagcuaugaccugauacaaaauagagccgggcgugggggcgcacgccuuuacucccagcacucgggaggcagaggcaggcggauuucugaguucaaggucagccuggucuacaaagugaguuccaggacagccagggcuauacagagaaacccugucucgaaaaaaaaaaaagggggggggggguguuguccgaucauuuugaaaaauuggcauguuaacgcuuaucacaaaaggccacacgcaaauuuguauugugaauuuuacuuugagucuacauaggugccaucugaagaaaagaaguguuugcuaagaauuacaaaaguucguucagaagaacuugucuggaaacuccuucuguaguugucgucgugcagcuacagucgaugcauagaugacgaauccccaagagagcaagacgauugcaaggagcaacuaaaaggaggggaggaaaagcaaaaagaagaaaucaaugugccggguccuuucccuguguagcccgagcaagcagcuacagguggaaaggcaucacaugccucuaacacagugcagcccagaggcaagcaggccugcaaccccugacgucagaggcggaaaagcguguccuccaggaagaggcggagccgagggcagggcgugaacgcucaauuuaggaauggguucuggaguuccaagcugcgagccaacagucuaccuucggcucgcgggcccugccauggugcgcucuggagcuccgcucugcucgguaccuaccagggaguaaguccaguccaggcuucggcgacucaucggccucaugguaagggagcagcggggacgggguggcaagggcccuacagccugcucgcgggcgcauugcaccccgaugcagcagccauuuuucagcgggacucugcgcgcucccg

SEQ ID NO: 1832 - RNA, 50164 nt, Mus musculus
uauggaccacguucucagccuugagguuuguacagcuugagauuccuccucccuuccugcucugauccuaacauacacccgcaucuucuuugucaacaaaagcacggcuuucccuugcucucagggacauccucccauccugucuugucaucuccaucagacaguggagccugcuuuuucaagaaaacaauaguaacccauuugaucaagaaacaaaagagcucuuagcugagaguggggacgaagaccugucaucccaguauuucagagguagacgcaggggaucuugaguuugugauuagucuagggcacagugaaaccuugucuaaacaacccccccacccccaaaaaagggggccuccguaagguucaguuucgacugcguuucagauucuacacucugauuuuacucacgagauaggaauucuuucaucugccaagaagucuuuagugauuuacaauacaagacuuucagggaacguccuggaauugcuauaaaaaucaguacacauaugucaucccaaccuccugcugauugcccucaguucauuuagagaagacaucauaaaaaaaaaaucuuagcaggguuccucugucucucucuucagucuuuuuucuccuuauagagagaaagaaaaguguaauuuuaacgugggugguaaggcacuccagccuguaguuuaaacgauggcuucaaagcuguguuugguagcucacaucugcaaucccagcacugggggaaucuaaggagauucucgcgaguucaagaccaauuugggcuacagaacgaauuucucucacuaccuccaaccucguucuuucccuuucaaagauggcuuuaacuuauagcaagcuuccugaggaggaagugcuaaaaggcgacauggcugcguagaugagccacagaagacugcugucugaaaucucuccggauucagacaaccgggaggcugcgagcaaaggagcuauccucacgggggacaacuagcggcuagcgccacuguucuaccuggguaucgggcgagaaaacguuccagccaauucucgaaaagauacuggaaucaucaccgguugcuaggcagccguuugugacgucaucucucagcaccggaagcggcgaggcgcaguagagcagcgugaaguuuguggguguccacagucgagguaaguuaaugguccgccugccuucguaguuugcuggguuagaagcgggcaggggcauuuggcccgggcugcuaacucggagcggugaccuugaggguggaguucgagguuucuuucuucugggcggauuaggcuccaccccuuggucuugcucaggugggcguguuucagaguuuuguuuccgccgcauuguuccggccucccacccuccccgccccccauccccacccggcuccuguaccuaguuggcugccagaucagcaugaaaagauuuagagauaagaguggacaaaguccaugcagcggggcuguucagccugacaggaaaguguuucugccagaaacgccuuccaagaguaacucgaggugcacuagcaguguccccagcgggccuuaagaaugccggaagcaguguaaggucuuucucuuuacaaugcagagauucaacaaagcagggguuuuugaaaugacaccaauuuggaauugcuggguaauuacuuuugagaaaucgacauauauuggggauuucguaagaggcccuuccuccccacuuaauuuuagaggucuccuguagcccagcuggccuccucaaauuucugauccucuugucccuaccucccagugaugggauacaggcguuugccacugggcuuggacaauuuuuuuucuucuucaagauggguaacaguauguaggguagucuaaccucaaacuucuggauauccuguauuagccaggagccaugcugcauucuugaaagaugguaugugcagguaaaggugccugcauguaugucuggggagggaagagugaggauguuggccaguggagccagucugugaaauacuuagccuaauuccucugagaaauuagaagcugagagucuuaaguucaagucuguguuggacauuaguccacacucacuugugcuuaugcaacuuuaaguuuaauuggaaauucaguuccuuacuuguguuaauggcccuucaaaagcucaguuaucaguguggcuugaagguuuacuacauuuccauuguugaagaaaauucuugugcuaacagcgcuucaagauagauuucuggccucaugucacuugcccugucauuuggguuuccuaacgucauuguuuguauaugcuaggcccagggcguggcacuaauaggaacuguggccuuguuggaguaggugugucacuguggguguggacuuuaagacccuuguccuaguugcauggaagccagucuucuccuagcugccuucagaacaagagguggaacucucagcuccuccagcccuaugucugccugaacacugccauguucccaccuugauaauaguggacugaaccucugaaccuguaagccagcccuaauuaaauguuguccuuauaugaguugccuuggucauggugucucuucauagcaauggaaacccuaacuaagacaccuaggacucaaaaauagcuagguggggucuggugagauggcucagcaguuaagagcaccuuuuggaggucaugaguucaaauccuagcaaccacaugguggcucaucuguaaugagaaacaaauaaagaaccuaugggccggagagagugggcccuggagcaagcgggauuggagcaagagggagaaaagggaaggggaaaaaagagcugggugguguuggugguacaugacuuuaaucccagcgggaggcagaggcaggugaaccucuugaguaugaggacagccuugucuauaguuccaggacaaccaaggcuacacaaagaaacucugucuggaaaaaggaaaaccaaccaaccagaauuaaucagggcauaguaaccagugguguagucagcaaaugggccauugcagaagggagagggaaugguagaaugaacuucuguuuuggggcauucuacuuuaaacaaacccagcuauguucuuguauucugcagucauuaauuccuacagauugggucuggaggcccaaaugggccaaccugcuguuuaagguuuuguguaagcauugugcaguaacugcaucagcuccacaggaagcagugcaucggagcaucacaacuuaagaacuuuguggcagaagggaguguguuuccaucgucuugccauguuccuaucuguucacuggauucucucuuccuacucagaagcugcacugucugcuggcuucuuugucaaucauaagacuuguuucucaauacccaguaaggacaugcuucacucuccugucucuuaccugcccagccaucaauuuguagcugguccaacagaugccccaugggagguagcauuauaaaugggaucugccugcaguaccaucaccacuaggccgggguuuagaucuuagaugaacagcugacuuuauacucguaucagcuccccucagagaccuguugaauugucuuuuggacuuucuggccucuguuuuaauagcagcuucuggauuugucucugaucccagcucccugcacuccuuugccuacacauggcccuuggcuagguauucuugggcuucuguugauucaucauccucugacauguaaagcuuggcuuugucuccugcugacuguguuggagcuuagccucuugucccgguguucuuccccuacuuugcccucuuuuugagugacacuugaggcggcgugucuggugcagccaaguccaccuucuccugacucacacuuccuuguggaagccugcacugucacgugugcucuuuaacccgagaugccuguuucaguccuuccugcucaguccccuuggcucuuggccuucucugaccugguggcuuuggaggccuuuucugacugacagagaacuuugaacugaauugguaaauuguuaauccgcucugaacuccccgcugguggcacuuuugcuaccacaagccaaaaugcucuggauucgugaauguaagacacacacacacacacacacacacacacacacacacacacacacauucccucauguuuaauaugcucucagcagcucaaaggcuaggcuacucuuguuaucccagccccagucugggauaucagagcccccggggccacuucccugacacaacauggcuggaugcuuucucuccugcucccucaagucugaucucucugcuucucuggugauucuuaaaacucccucucuucccuugccugggaaaucuaaaguccugccucugccucccugcccagcccuuggccgcaggcaacuuuauuucaccaaucaaagccaacugggggcagguaccuucagugucuuucagacaggcaugcugguucccacguaaguuugggagucaaaugaacacaaauggcauuugaagggaucugcaacccugaaccuccuuggccugcaugugcucacaccaauuacucccuggggaugugcaccucugggucccucugccuugcacccucuugucuucgcagaugguaacaguauucucauuuuugggaauaugguuucuuuguuuuucguuucugaguacagcaauugugcagaaggcaugcaugugcuugggcaggaggcaagauaucccccgagguauuagaagcuugagcuagagcagugguucucggccccuuuuggggucagacaacccuuucacaggcguuccauaucagauauucugcauucuagauauuuacauuacaacucaucauaguagcaaaauuacauuucugaaguagcgcgagaauaaacuuuaugguuggggucaucacaacauaaggaacuguauguauuaaaggguugcagaucagggaggcugaggaagcacugcucuagaggguggagaaacauccugaggaccuaguccgagccuugccgugaucuucuuuccgggucaccucauccuuuuucuuugcuucaacuucucucaaauauguucaguuaguccauucuucugagcuuucuacuugugucucucagcuugacucuuggaucuuccacaagucaauuaauuguguucugguguaaaauucagggcuggagauuuggcuuagugguagagggccuguuuagcaagggcagggcccuggguuugguucccaggacacacacacacacaccucaccccuccaauauaaaauugcuucuucaucucuuuucauuuuuaaaagaauaaaauacuuauuuuuuaauuauguguaugugugugugggaggguggucugcacaggugaaugcaggugcccacagaggccagaagugucagauccccuggagccaggguuauaggugcuugcaagcuugguaucucuccaaaagcaguauguacuguuaaccuuugagccaccucuguacuuuucccaccucuguuucuaaguagugucuucuauaaauucuucaguuuguuuaauggcaucuuccaaauuaauuaauuaauuaauuaauuuuuugagauagagucucauguagcccuggcugcccuggaacuuguuauguacacaaggcuggccuugaacucacagagaucugcccgccuuuuccuccuuaguucugggguuaaagucaugcaugaugucuggcuaaauuagaaaucuuuuguuugcuaucucuuuacuccuuuguuauuuuccaaaugucaccagaauauaaguauauuuucuagauuccuccuuuucuuguuuuugagacagggucuuacaauguagucuuggcuggccugggaacuugcuacguaggagacagacagaggucuuagaucucugagcguuggagaccagcuuagucuaaaugguuccaggcuacccagugcugacaugagaaaaagaaagagcagggcuggagagacagcuuagcaguuagcacauuugaccuguggugguugcaauggcuguagccuuagguuaaaccuaggcaugcagguauugugugcauguggugcacaaacugacaagcacacacauucucucucaaauaaggacuaggaauguaguucagugggacugcacuugccuagcauguacaaagcccugacuucaguuaauuuccccgacccccaaacaaaaagaaaagagagugagagagagaagccugauacauagaaagacaccagagaccugaagaacuuuuuuuucuuuaggauuguuuuuucuuugaguguuuuguuuguauauauguaaauauguguguaaugaccguggaggucaggagaggguguuagauucccugaaauugaaguuagagaugguugugaaccacgauguaggugauguagguaccugaagagcuguaagagcuguuacugcucagccauuucucuuggcuccacaucuuugucauucaguucuugcuucucuguuacaacccaaacccuuaaauauaucccuuucuucaugagacccuuuuuauuacucucaagggccaguccugucacugggcuaguggcauguuugguuacucucuaggcgugcuugugucuuaucgcaguaacuaguguauguaugcauugucagcucacauacucuaacauacccuacuccagccucuuuaacuuacuucugagggacacucugcacuuaaccuaaugcccggcauaggcuaucaacagauguguaacaaauguuugaaggccuggguucuuacuuaccugcauuaucucauuaauccucagcagccucugaguccugucauuaucacaccuuuauaggugaggaaguugagacuagggagaugaagucaccugucuuagugaccauccuggaagucaggugugugugaggcugggcguggccugggugauguguuuuucagcgauucuguuuuguuuuuagagcuaagaugcgagugugcugguuggugagacaggacagcaggcaccagcgaaucaaacuuccccauuuggaagcuguugugauuggucgaagcccagagaccaagaucacagauaagaaauguucccgacagcaagguaacucgucauaacaaugugaagaugacuguguuuaguuaugggggacagugauaaccagagagagaaacacauuuccugguguucuugcugaaaaacuuauuguauuccaaaaacaagguuuauaaguuguguucuuucagcuaauaccugggcucuggaucugaauccagaaucauccuguguacuaacauguaaggcagauucagguaagggauagguggcugacaucuugcuacauugggauggcaggacugagucuuguacucugcuguguccaguaauuaugcguugagcagaaagagaaguuaauacuggaaucgccaagcugaaacccuaucugagucauagugggguggugucaggcuuuacacaccgccucacacagaggguaggucucuaggaaugcggcauccagcucaucuuucaaaugguuuaugggaaaagcuaaaagggaggcaugcaagcacacgcacacgcaugcacaauuuccugcaaucuguaggcaugcucaggguaaauccuaagguucuggauuuagaguuggggcucugcauugcuuucuugaacauucuuucuucaggcuagcuuggacuucuguuucccgagauccuaucuucuaccucuuucucuguugaagucacuugaugcuaauguuccuugucuugaagcucaugcuagagaagcccucuccuacuuuagcuucagccccagcucuagguagguucuccuucuccccaauaguaggagcuuaucuaaucaugagcaggagcuuuucuccuguuggcagucugugaucccgagcugccuagggguccguagggguucaugaaagcugccucacaguuuuuuuucuuuuuuuuucucucucucucucucucucucucucucucucucucucucuuucuuucuuucucucucucucucucucucucucucucuuucucucuuucucucuuucucucuuucuuucuggcucacuuuguagccuuggcuguccuggagcucacuauauggacuaggcuggccucuaccucacagagcuccuccuguuucugccucugaggugcugggauuuaaaggugugugccacugcaaccagcuucaaagagugaaagacacugagcacuuguuugcuuuucugauuuauuuuuauuauuuuaaaauuacauguguaucuguguggguguauguuugacuucaguucccuguggaggcggaggcgucagauugcucuggaccuagggugagaggugguaaugagccgcccaguguugggaaccaagcuuaggcucucugggaaaagcaagugaguacuacuagccacugagccaucuuuccagccuccacuccccucaccaccccaggguuucagccagaauauuagcaguagguaacagaauacaugcacuaauauaauaugugugugugcgcgcgcgcaugcaugugcuugcacaugagcaguugcacaugagcaguugcacaugagcaguuaagauauucuuacauauuccagacugaccucacacacuggcuaggcagccaaggcuggccuugaacuaaucuggacucuacuuuccaagucugagauuuccaccauggccagcucgcugauggacaguuuauggaaggguuugaagcuauuagaaauugguaggauuuguaggcccaggcacaagcagaacaggcucagcuggggguugacugcagcagucaagcuuuguuguccuuuggggacagcagaguacccaguuuugguugcauuuguguuuaauuuuucuuauuucuuucaguacaguugaaagcagaguguaacaagggauaugucaaaguacagcagguauguguguucgcgccuuguuucuccaguuuuauacucgauaguuuucuuaugccguugcuuucgacugucugugucagcugaugaacgcuccucugucauggggaagugauagagugagugccaggcagguagaguaagcaguuaauauagcaccagcucuaucaccaauggcauuacugcuauuacacauuauacauuauacauuauacauuauacauuauaacgguguauccacagaugggggucaaccccaccagcauugacucgggcgucaucgggaaggaccaagagaagaagcugcugccuggucagguucuccacauggugaauggacuuuauccauacaucguagaguuugaggaaguggcagagagcccuaaccuaacacagaggaagagaaagaggucagacugugauagugaggagauggaagcugagucugggacagggcuggcaccugggagcagccccagccagugcucuguguccccuaagaaggacaagaauggagccaccaaaaaggugagaauggugugcuugaaagaugcuguggagaugaauugacauaaugacugcuuaauuguuguguacacgguacauuguuuguacacagugagaugguauuaaucuaaugaggguucuuaaccaugaugaaagagucacuuguuuguggccugaaaaucacuuggugaaugucccuuuagauucuuuucuauuaaguuccugagguaaaccacuugaagaaagacagggcagucaguaaugacagugugacacacccugcccagcuuagugagggaaugaaaaaaggacagacacacauacagagaagcuggaaauggguaggcucuguuaccuaauggagcugcagcaccaccaacagcccggaaacucagcaugguuguuuuauacaucugaauugaggagguggcuuuauuguguauagcugaacagggagacagguuuagguaacucugguaggaggucuuuguaagggaacagucucaggcuauaaacaucuugcaggaggaguugugauugacggcuucugcaugcacugcacagcuagccauuuauaaccacuuggaccagaggagggguuugucaucccucugggccuuauccaucuaggcacugaaguucucuccaugacuggucauggcaacaacacacauucauucaggacuucauccacuccuuacacaucuauucccauuauaguauaauuaacguuuaauacuaaaaugggucauuugccugucuaccuaccgguuaacacugaagccuucauagauaguuuuucacauguugaugucaaaggagacacuuggguaggcugcagcuggaguguaagcaggcaaggaggacgauuuaaaacuggcaguuuuggcuuuauggagcuuuuccuggggagaugugaauggaucucucuucaucccagauauggcacuaaugacagaccaaccaugccacccaaguuuaaguugguaaaccaucgagucuaaucgugguuacaggggccugggcagcuuaagugugacuacucuaucagagaggaggcucccucuccagcagcugauagcugcuuguguguccucccuccucguccaucucccaguaagugaauauuuggcccaguacugccaccgucuuacucagguaauauuagcugcuccuagucaagguagcaauccuugcacauuggacaaaguuccauggcaggccuccauccuuacacccaggucuagauguagaagaugguggggaagcuugugguccuaaagggcgaugggccgaagcaaaggaagccuagugucauucucaaagcuaaccuuccuuccauguuucauuuggacgcugcugauaaguaguauuagcuacauuucauuacuggcauucucauuuacauuguuuuuuuauuuaggaaucacugggccacuggagucaaggcuugaagaugucuaugaaagaccccaaaaugcaggucagaauaaaauuguauacuuuagugucugucauagaguccaugagcaugcuacuaacgugguaacuauagaugaagccaaaggaugccagcucuuccucgugggauucuguuacugcacuggucuaugaggacaagaaucacuuaacacuacauuuuuggucucuucucuaaauguuauacuauacccacacuuaauagcuguuuccacauauacgugcauacauuauaggcuaggagccauauauaugaaaauuuccugauuuuggaucaccuugcuuaguauuauacuuuuugaguucauccauuuuccuguagauuuugugauuucauuuuucuuuugaaaacauuuuugauuuauuuuaaugugaaggguguuuugccuguauguaugucugugcacauguaugugccuggugcgugaggaugccagaagaguccccugggacuggaugauugcggaucacuauguggguauugggaaucaagccuggauccuggaagaauagcuguacucuuaagaucuucucugcaguggcccccucgccccuuuuuugagacagggucucuuucuauagccuugguguccugaaaugcucuguagagcaggcuuuccucagacucagagguguguccgccugugcuuccugagugcugggguaagaucauacaccuccaugcccagccccugauucccaaaugcacuccauuuuguauauauggcacauuauccauucaggguugaugggcacgggggucaugaaagagcauguaagcuguuucuagccugagcuugcaucgcuuuuucuuuucguugcacauaagugcauagauuguuauugauaguguuaaacccuaaaugaaaccccacagccucaaaauggccauuuuaacuauaaaaguucacugagauacacaacauugaguacugggcaagugugugugaguagcuaccuuaaucugugcacugguuuuuuuuuuuuuauacuuuuuauuacauauuuuccucauuuacauuuccaaugcuaucccaaaagucccccauacccucccacccacuccccuacccacccacucccacauuuuggcccuggcguuccccuguacuggggcauauaaaguuugcaaguccaaugggccucucuuuccagugauggccgacuaggccaucuuuugauacauagugcacugguuuuugauugugaguuuguuaaagugguuuuauaaaaaguaacuggaggucgcuuacuucuucuuuuuuuuuuuuuuuuuuuuuuuuauuaaaaauuuuuuuuuuuuuuuuuagauuuuuauuuauuauuauauguaaguacacuguagcugucuucagacacuccaggagagggcgucagaucuugucacagaugguugugagccaccaugugguugcugggauuugaacucuggaccuuuggaaaagcagucgggugcucuuacccacugagccaucucaccagcccggucgcuuacuucuugagaugaauaugcugucugcuuugucuccuuuuaccuucuggcugcuguuaggagagauuguggacuggcaagagggcuuaguggguaagggugcuugcugccaaggcugacaacuugaguucaguccuggaaucaacauggcaggagagaauaaacuccuuaaguuguccugugcucuccccaaauaaauaauaaguguuaaaaaaagagauuuugcuaaccugagcaagguccuuuugaagggaucaucagagggugacugucguaaugcugucuuccgacaugucagaagucaucuuuggaggagccuuugaggccugcuucagucaggguuccuugaggucuacacacauggaugcaggucuguguuagagagcugggguugaauucugccuggggagauuuaacauugaguucuugagagcucuuguacuguguaucuucucuguagccuauguagugugcuguuucaaaaccugggcucuggaguuuaugggguuuggguuggaagccugauuccucacuguguaaugaugugacggguguaagacgcuggcagugugucugcaucugcucuaccucuuaaaacuuucuccaccguguuuucaaguaagucagugacugacugagcagacggcacgugcacagaagguccucagcugcugccucuuuccuuccuucccgcgcucuccgcuagguuuacaaagacgaccaggugguggugauuaaggauaaauaccccaaggcccgucaccacuggcuggucuuaccgugggccuccauuuccagucugaagguugugaccagugaacaccuugaacuucucaaacauaugcacgcugugggggagaaggugauagcagauuuugcuggauccagcaaacugcgcuuccgauugggcuaccaugccauucccagcaugagguaagccuuggggugagggugguguaugcugguguguccugugagcagccugcacuugagucgcugaguagcccaggggaggcaaugggauguuugcgaggcacaugggccaaaucucguacuugccuaacuugccugugagcccagguuccugcuucugcauguaauucagucccuuguaguuuuauacuuaccucagagguuaagcguuucaacaugcaagcuugaugaaguagcuucgauaccuuagaugagggcucaguggcuuguggcuuguugacauucuuggaguuaccuuuaauaacuaaauaauuaaggaccauugcucuaaaggaaacaaagcaucauggacuucuguagaaaucagcucaggguacgcacagcuucaaauaaaugagcgaaaauguggggacuguacuucacuggcuuaguuggagaagaauuuggggcagaaugguuguuuuucucccacagagugcauguaggauaaacucuuucaauuuauuugguccaagcaaaaagagaaugcaugggcuaugccuuuggguaugccucugucccaacuuuuaaaaaacgauccuauaauaaacaacaggaaacuuagauuguaaagguuuuuauuuuuugggacucuugucacaucagcuuccugaggcuggggcuacagggguuucuacuccagauaaccacuugaauauuuuugagauuuauuuuuauuuuauguguauggaugguuugccugcauguacaucuauuauauguguccuugguguccauggaggccagaagggggcaugggaucuguuggaacuggaguuagagaugguugauaauaauguggguccucuggaggagcaacuccugcucuuaacugcugagacaucucugcaaccccuuagcucucccucucccucucccucucccucucccucucccccucccccucccccucucccucucccucucucccucucccucucucccucucccucucccucucccucucuuucuuucagacagguucucacucuagcccaggcuggccuuaaauucagaauccuccuacuucaacuucccaagcgcuaggauuucagacaugugccagcaugcauggcauguucuuuuuuaaaauguuauuugaauuuuucuuacuuauuuguuuuucuucauuagaauuuaauuauucuagaugcaaaguccuauccuauauuauuuacuaugaaaugccuaauguuuaauuagauacuuacuaagcauuaaauauucauauguguguguguaugcauguguaugugaggccacuugcuuucucccuuauuuauuuuuguauuuaugaauuuauuuuuuuauuuuuuuuuuuuaaagauuuauuuauuauuauauguaaguacacuguagcugucuucagacacaccagaagggggagucagaucuuguuacggaugguugugagccaccaugugguugcugggauuugaacucuggaccuucggaagagcagucgggugcucuuacccacugagccaucucaccagcccccugaauuuauuuuuuugagacacucucucucacuauugcuuucuuauuuauuuauuuauuuauuuaagacagcaccucauuauugguuuucuauccauccaucuguuugagacagcaucgcacuguguagcucuggauggcuuggaacuuguuaugcaaaccaggcuucccuugaacuuugagaguuccugcuaucuaagccuccagacugcugagauuaaaggcauaugggacaggggaacccagugaacgugggaccugcugauuuguuagacugccuccucggugcuaggagaguguguauugcugugccugacuuuuucacgucagugcugaaaauuaaauuuaggucuuugugcuugcaugaugucuugauuaggguugcuggugcuguuaugaaacaccacgaccaaagaaacuugaugaggaaaggguuucuuuggcuuacccuuccauauugcuguucaucaucauaggaagucagggcagaaacucagagcaggaaccuggaggcaggagcuguuccagaggcuguggagggugcugcuuaccggcuugcuccucaugacuuacucagccugcuuucuuauagaaccaagaaccaccagcacagggaugacaccacccacaauucaugggcccuccuccaucaaucacuaauuaagaaaacaccuuauggacuuucauacagcgugaucucauggaggcauuuucuuuuuauuuguuguuguuuuuguuuuuuguuuuguuuuguuuuguuuugagacagggugucucuguguagcacuggcuauuccagaacacacacugcaggccaagcuggccuugaagucacagagaucugccugccucugccuccagcacucuggguuuaaaggccugggccacugacgccuggcuggaagaauuuucuuuuuuucuuuuuuuuaauauuuuuuauuagguauuuucuggaagaauuuauuagguauuugcuggaagaauuuucuuaauggagggucccuccucucaggugacuuuagcuugugucaaguugacaugaagcgguccugcacacauggcaaggacuaacuauucucuccuaaaugacuggguagguugcccugagcggacacagcguccgaacuguauguuccugugcuugcuuugacugcugucauccugauuacaccaguuuuuaauacucgguucuuuuuuguuuuccuacuuucaacuagccacguacaucuucaugugaucagccaggauuuugauucuccuugccuuaaaaacaaaaagcauuggaauucuuuuaauacagaauacuuucuggaaucacaagguaaauauuuucuguuuuuauuuuucauuuuauuuuuuaauauuuacuucauuuucuuagauguuuugcuaucugacucaguugcuucucuaaguaacaaccuggccucaaauggccucauauauuuagugaucucuauaaaaaggccacuccuaaaaugaacaaagauguuucaugguaauagggucgcuacuuugcugugaacauccuggaggggcccuggagggagcuguuaugucagggucaaaaguguuugauuuugacagcagaugaguuaggccugcucaguagagcuacugccagguguucugaagcucgugcgcugggcuggaugcuucacugggaaggagcuacacagguucugagucuaaccguugcuggagucugugcuagccaggcuuugucacugugucauuauacugauguaaccuaagaaguuaaaccuguccauagguuccuauuggacuuguccguggcucugcugcugggcuguggcgaggcucaacguugguagggaggacgagggggagcaacgcugcucacuucuugucagggagggagaggagagggugggagaguggggagggggaagaggggaagggaccugggacgaagcacaccuucaagggacaccuagugacuuauuuucuccagcgaggucccaucucuuguuuguuuguuuuuuuuuuuuuuuuuuuaaauagcauguacuuuuuaaaaaaaaagauuuauuuauuauuauacauaaguacacuauagcugucuucagacgcaccagcagagggagucagauccuguuacgggugguuuugagccaccaugugguugcugagauuugaacucaggaccuuuggaagagcagucagugcuguuacccgcugagccauccuaccagccugaggucccaucucuuaaaguuacuaccaccucacugaauacugccaacaacuguggaccacacuuugaguacccgaggcuucagaggggacacuaagugcuaagcaguuguuggaugaggaggggcucaggaguucuggagcaggagucuccugcuguguuagcaguaggcaggggugcucuguauauuugggguguaagcauuuccuaguauaguuuauauacuacuucaggacugcugugguguaaauguggcggcuaccaguuuucaaagagccacccggggaaaagcauggugagaagcccauaauguggcuauguggaguguguccugagggaguguaucaucucagcgggaggcugcgcagacuuagaaucugcucagugugagccuuaggauacuggguauguugauuagagucauguuuuuuagcuuuuucuuggugucuuacuggcuuuccaaaauaacuggguucugcaccuuccuuuuguuuguagcugugaucaagaugguucaggaagccggcagagugacuguuaaagauggcacuugugagcucuugaagcugccucuccguugccaugagugucagcagcugcugccuuccaucccgcagcugaaagagcaccucaggaagcacuggggcgggugacacucgucucggcgaccaagggcagugcuagcaucuguccgcauugccuaugcuccguucaauccugaacuaaagcguacacuucuucgaaacaaagcuuauuuauucuugagcagccacacauugggugcacucuggugcaggaacugggaauucggguuuuguggguguauucucugguaauggaggcugagacaugccuggucacccuucccaggaccaugacaggccugacuaaugagagggcaaagccggcuugagacucaaaugcacgauguagaagcagaggauugguaauauauuuuguuccuacccucguuccuggauuguguaguaucuguucaucaagguagcugagguucugaggggccugguucugccuuuagucugcucuaugagauuccucuucccccaugaggaggcuuucaaucuacugcaccaggcugagugucuaguugaaaauauguggcagucaucuacacagagagauaauuuguguaugacugugucagggaagaggaagugguaauacugggcacaguaauguuaacaguacagucugugcugagggcagccugggguggugugaacuguacagucugugcugagggcagccuggggcggugugaacuauacagucugugcugagggcagccuggggcggugugagcuguacagucugugcugagggcagccuggggcggugugaacuguacagucugugcugagggcagccuggggcggugugaacuguacagucugugcugagggcagccuggggcggugugaacuguacagucugugcugagggcagccuggggcggugugaacuguacagucugugcugagggcagccugggggcggugugaacuguauagucugugcugagggcagccuggggcggugugaacuguauagucugugcugagggcagacuggggcggugugagcuguacagucugugcugagggcagccugggguggugugagcuauauagucugugcugagggcagccuggaguggugugaacuguacagucugugcugagggcagccugggguggugugagcugucaguugacuguacagucugcauggagagcagccugggcaauguguauuuuuagcuucaggcagauuuuacugaggcuuccacuacugcucuugagaauuacagagcauuuaucuaaacuucagauaaaguuuccccaaugcaucugggaaaaacagauguugcaaaauaguucauuuaauuucuaccuaauacuauauaguuuagcacaucaauauuaaacugaguauuugguuauacaguacuaggaguguguguaucagacaguguaagaaugucagguauaauggggaacauucugagagugagaugaccaugcuuacauucuucauucugccccaaauagauuuuguaaggccgggcuaagugccugcuguuauuccugaggacccgaguuuuguucccagcacccacagcagguggcucacagacaccuauagcuccaggggauccuacacccucuuuugagcgccgugggcaugcauuccaguacacaaaccugaauacagacauacauauucauacauaauuaaaauuuuuaaaaaauuagaucucuuagaggaaaaaaauauaaauuaugacaugcaggaaccagguguugagguauuaaguauauucaucccauagcucuccucuccccagugggcuuucaucacuagggggagaagacugucuggccucugcauuacuugacagacgugucauugcacaauuaguugaagccuuccuucagaagcagagggagggaugaugggagacugcagaguagaagaaagccagccacaucuaaagccaggcacaguggcaaagucuccugcaauccccaaauguaggaggugguggagcaaggagggccgggaguuccggguuauccuugucuguauggugaacuggaagucuggacuacaugaggccugugucaaauaagcaaauaaaacauuuaaaagggggaaauaaaguuauaucugaggugccaaagaauauuauuuugcccguuugaccuuggcccuucauagccaggaaggacaauguuaucaaagcagugguuaugauucaaaucuggacuaacuccacaggcucauguuucagaguggcagguccuuuccaugcagugugugcuagaugcuguggagccuuuaggaagugaggccuggcuggcagacauagucuccaggaucaggcuuuugaaggcuauaccuguuccugguuggccuccugugaauaggccacccaucucugcuacugugggcugacacacacuguguguguguaggcaagaggacaauuuccagaugucaguugucuccaccauguggguccuggggauugaacucaugucauugggcuuggcuauaagugucuuuacccacugaguuccaguaagucagaaguacucuuuuuaaaaaguaauaacuuaauucucaaguaaacacacacacacacacacacacacacacacacacacacacacccacccaccacaaccuuaccucaucccaagcuauccuagaacucaacauguagacuagguuggcuuugaacuugcagagaucugccagucuguggauccaggcugcugggaugcaaguacaccacaaaaagaaaacacaaaacaaaacaaaugcacaaggauuagguagacauugucuguauuuaauuacgauucagugucuucugagaaugaaauauugucauggaauaccauucccuucugcaguaauguucagaucugccucuuuagaaugcucuuuccuuuuggauguugauaauggugcauuggcugguuuugugugucaauuugacacaagcuaagagucaucagagaagaaggauguucaguugagaaaaugagauccaacuguaaggcauuuucauaauuagugaccaauggggagagcaccauuggagguggugccaucccuggacuagugguccuagguccuaugagaaggcagcugagcaagccaggggaagcaagccauuggguggcaccccgcucguggucucugcaucaguuucugcuucuagguuccuucccuguuugaguuucuguccugacuuccuuuggugaugaacauacuggcugugggauugccaguuugucacucaggcuuuauggugacaccaggacauucaaaauuuggagguauauaauggagcauuauuuaagccauaaauaagaaggaaauuguguccuuuucgagaagacagauacccgggacaucauccuguggaaugcagucagccagacucagaacaauuaccucauauugguggucucaaaguucuuggcuccccugacuccaggcccguuggaggcagaguauggcagagauugacgcaugcacaaagccaccuuagcacaccagacaaaggcagagacaacacuuaccuauucugagauuggucuuacuauguagccaagacugaccuggaacucauguagcucagcuuggucuugaauucaagacccaacugccuuugccuugaaaguucuggguauauugcuaucgugcccagcuaggaaguguucucagaacacugauuucagagcaugagaccccuucaugugugggucaccgugagucaacuaacccuucuguggcuggacccugcagguaagggguggagcacagggcagaggaggggcuucuggcacucaguucuaaggagccaguggaccagcuggauucuuaucugccgcugacauuuccacaccacagacucucuaguuuguggcagcugggaacuuacuuuuguuuucaagaacccagcgauaggucagauucucaaauacagccgauugugguggucaugagugagaagagacucaagauguuaggaggagaccacaguauguagaccugacugaacuugccccugacaagcugacagcccauugcaucaucuuuacaugaaugagaaaaagguaccuguugcacguggaaaccuuuaacccaaauccccugaggccggagccgcuaugagacacaacuacaugacaguguaggcuggggacccuguuucccaugggguccucugucaccuucacaauggaauucugacuaccugaaaauaaaggacacaagauuuuguugagugaauaaaguagugucaugcuuuuugcuagcaaacaguaaagagacuucucucacacuggacuguaaugagggagguagugugcuguauggucaaccaguuuuucaucugauagccucuugaugccauccugaaugggcaaaggcucucuuacagguaggaaugagggguguguggagaagacaguauguuuucuaccuaauguuuuagcuuuucaguccacaaaaugggauucuccugugagagcguuucaguuuucucacuuuggccaccagguggcagcaugugaauaaagaauuuuuaauccucuugcggccuaagguuuuugggaagauauuauguaagucuccuguuucagggucugcacuuuaaaauauguacguguuuuaacuuaccagccuauaugaguuguacaaagcaauaguuucauuaugacuuuuuuaagggcagguuuucucugucauauggccuuggcuguccugaaacucagaggcguugugccuugggguguuugugucuuuccaaugcugaaacuaaagucguacaccaccacaccuguuucaucacaacaccuucauagauaugguguauguuggucauauuuaucucuuaaucuaguuagacauuucuugcuggggguaagacaucuuacuguugugccaugggagagaucguggcuauggucuguggucuucacagccggguaggacugcugacugcuuuucucccuuggcugcucgcucggcaccuucugauacuuugagagcugguccucagggagggggcuccuagaucagcuccaguuugguucucugaauccuacaucccaaguguaugaugucuucagcaguagggucuugccuucagguugugugagccugaccagaguuggauuucgggagcccauauaguggacggagagaacugaccccgcaaguugccucugaucuuugugugcacugcggcccaugcaauucccaauaauaaguacaugaacaaacaaaaaacccacauaccauuagaauugauggcuacugccaguagagagacgagagagcagucucaucccugggaaugguaaguuuauauuuuggaaaauagauuucucauacaauauauccuugucacaguuuccccuuccucuacuuuaccuaguuucacuccccaccccuaaucugcgccugcuuuuuuucugucucucauuagaagagaagaggauuccaagagauaacaauaaaacaacaaaauaaaaaaaauuagcaaagcacaagccaucauaucauugaaguuggacaaagaaccacagacuggaaagagccaaagagaaggcacaggacucagaaacccacacccaggagucccacaaaaacacuaaacugaaagcuauaucgcgcgcgcgcacacacacacacacacacacacacacacacacgaccugaugcacgcaugugcuagcccugugcuugcugcuucagucucugagcucauaugagcuuugaucaugaugacuuagugggccaggcucuccuggcguccuccauucccucuggcucuuauaauccuuuuaccuccuuuccugugagguucccugagcucugaggggagggauuugauggagacuccuaguuagagcugugucuuccaaggcgccucuguauauucugacuuagguucuuaguggagacauuuacugcacagcccauucagagcuuuccugcagguaaguucugaggcagccaugucagggaaggaugaugcacacgcccucugguggcagcuaugacucagugcaggaugcuguucucuuuaaugcagcauguguggccccagccccucacugauauucucaaaguagaggaacccucauuaaucugcagggaaguuuguuugaugugaugcauuuaguggaagagaauuguuuaaaaauucaucaacauguaaggucccuuuggaauggauauuuuuaggggacuuuguuuucuuuuucuuuuuuuguuguuguuguugguuuuuuuuuuuuuuuuuuuuuuuuuuuuuuuuuuugguuuuucgagacaggguuucucuguauagcccuggcuguccuggagcucacuuuguagaccaggcuggccucgaacucuuuucuaaagaccacaguuaaggguuuuuguuuuauuuuuuauuuuuauuuuuugagauagggugucauauaacccaggaugaccuugaacgcccuauguagcccagaccccuaacuucugauccuuuugcuuccaccuucggaguucugggauuguaggugugagccagcaugcuaagucuguguggggcuggaaauucagccucggacuuugguucuauucaguuugcacucuaugaacuuuuaucagggguaaguucuuauauaaagugcuucuuucccaaggaucuccucuccucauaguaguaacccagcacuaagacaagacuuucaagagaaaagaacagcauugcuaguagacaggcauguacauuagggagacuagaaugugagaccacaccucccagacuauuugucucuuugauaggugucagugguuugggguuucaggagccccucuuguccuuggcuuagcuaaaugauauuaucucugagauaauugcuuugauuuggauacccaugcccaguccauaugucaaaggcuuggccccuacauaauggugguguuggccagggggccuuguggaggaagaucuggucacuggggacauauucuugaagaggaugcuggaacucuggucucuuccuguuucuuuuuugcuucccaguacuugacuguacuaaaugcuccugccuccugggcaacagggcuaagcuaccauguccuacaccuuugaaacagugagcgaaaccaaacugaucucuccauauuuccugugguagcugaaagcugagcaaugaagaaauucucagcagagccccuugccccugacugccuaccagcggagaggcggcaccauucaaaggacugugcacucaccuuguguguuaauccugaacccacuucugggugugggugaacgugagccagagcugccacuguggaugcucaacaugagaaucugacuuuuguaggagauugaacggucacaguuuggaaagaacuugucacugcgugugaucugcccagaggcacucuucagaacaaccaaaaauucugcauacacuuuuuuuuauagguuuaaaccuuagguuugcaggagccagggugaccugcuaagcaauguuccguaggcaauuuguuuuucaguugaagaugguaggaggaaugccagaccauuuaugggaagagaugggaccaauccugaaagaaauguggcuuccaaaggaggaggaugcccaugcauucuagugagcucuggguuuggggugggagguuagggagauggguagggccaaaaauuaauuccuaugugugauauuuauuuagucagucucuuuucagguuguuauaugaaggaguuauacuagucuaaguucagagcccaaaugguuguacuauauaagcuuugaugcuuuuaaacuuguuuguuaagggacagaagggaaauucuucuaauugcaagaaaauccucaccacaagcacuuaaaacccaggaaccuucagccagucaccugcagccaggccagucugugccagggacuggcacauacccuugugcuggccacccuguagcuagcuuuuuucuccauguucuggguuccuccucuuucuccuccuccuucuugagacaggguuuuucuguauagccauggauguccuguagaccagcugggccucuaacucacagagaucuaccugauucugccuauagagcgcuggguuuaaaggugugugccacugcugccgggugacaaauuccuuuuaauccugaguggucccuuggucaguagucagggucuucaugcuguuucucuguugaauucuuccgugggaagauuccucagugccaacaaggaacaggacaccaucacccuuacuugccuuagcaccagcaaaggagugguaagaaggaagguucuagauauuagacccacaguguuccuugauggaauagccugugaaaagcagcugugggagaagugggggauacaguguugggaagaggagugugugugugugugugugugugugugugugugugugugguggcugaauccccagcaagcgguucagugauuggggccaugauggccaacuuauugucauucugacacagucuaggaucaccuggcaagagagucucugagaggcacugucuagaucagguuggccucuggagaaugaccuugauucugggcccuagccugucaggggacgaagugagccgaggcauaagcucaggaacauuaauucauccauuucugcuucuugauuguagaugugaugugaccauuguuagcacaugcugcugugacucucuggcgaugauggacuguaaccuggaacgaugugccaaaucaaaccgcuuuuguggacuauuugucauaguaacagaaaugaaacuaagaccccauauuagagaaauagaaaccugcuccuuccaaaagagacuucuacccagcuuggguuacuggggcuucugcugcuaugacaguucccuccccuccccuccccucccugggaguuuugagguccucucuuugcugacaaggaucagaggggugcuggcgaccagagacaagcccgggaggacacgacuggaccuucucccucccucccucccucccucccucccucccucccucccucccucccucccuccuucccuccuucucuccuucucuccuucugcuguccacugagacccgcugacgcugccggcaggcuuuggggagggguugcgagguggugcaguggccaucuggguucucaggagguagaacgggaguccugcucccauggagguggagcaugcuaagccucuggcccugccccagaugccagcaagaaacuacuaugucccuggaccuguugguuguggcuuggguaagauuagagcaaucuacuggccugcaagcagcagguggcgcaggugcuuugcgauguggugucugugauuucugugaggugcuccucaacccucagcuccaggcuuggaugcuuucuggguuuggcuacuggcaagagccuuacaauaacagagccagaguagccagccuauguguuggaucgugaaaggcagucuguguucugguugagggaggcuuauucuggagacccaguagaaaauucuacaaggaguggaacuguaagcuacgcccccagacauuagguuccugauaccccgagcccucaauuccauaaucuugugauuaucagucacguaggcaaugccccaagcuccugguauucuggcuggacucuaucuccacaguuaccuagcaacagccagguaacccagcccaccauaaaaaggggcugcuuggccccucauuucucucuuaagcucuugcucucuuucuugucuuuuacucucaccucucccucccgucucccucucccuuucccccucucuccccguggccauggcugcccucugcuacuuuacucuucucccucucucugucuuucuacaauaaacacaauaaaacuguggaucgucuuugcucauuaagauccaccgugcuggagcaauggagcaggcuuuccucuaaugaaugagccaugugucuaaccuccugcagggagaccucccagcguuuccagccgccaaacugcgccaaagacucucgaccucaagggaagcacucagcgccuucuccucuugccccuucucccuuuggccccagggcugacugaacugcccccgggggccccaccgguucucagcucuuuggcggugcccagcuacauucugcgaugcccaagagcuagaaccugucaucccuggccuccgggaggcccagggacccuggacugcucccuccccaccuccgcagacugggguucuguggcuucccacagccagacgcccaccugguguugucgagagugcauaguccaacuccugugucugcccgcccagugcccccgagcucuggagugaccugggucccucccaucccuuuauuucccuggggcuggcaccccauaccuaugaguggauuuucugcugccuugugaugaaauauugacacuguuuuuguuuuauugacuauucuugacuuucauuaguuuuauguuaaccaaaaccaccuccacacuagacaacauuagaagcuucagagucucugggcucgauucccagaucuaccacuuagcaguagcaugacucugguaaacucuaacucugugauccuuggauuucucaccuauaaaagucucagaaauuccauuuacugguaggauuacugugaacauaaaacaacaggaagaggacaaagcaguuaguaugugguuguaaaaauaaagauguuuuuccuuuuuuuuuauuuucuaaaccugagacuagauagcccagagaccuaggaucaaaccagacacuacugauaaauaacaauaauaaaaaaagggaccaacacagugacuccuaaugguaucccaccauacucauaaaucagugccuauccacucaccauguuccacuggcaacauaugugaacagaggcagaggcccacagccaggcauuacacagacacacagacauacacacagacacacagacacagaugugcagacacagacacagacacagacacacacacagcagauacaaauuaacaaaugagagacaaaagggggcauaacaacagacacugagaaaauucagagaaucauaaggacauacuuuagaaaucuguauuccaccaacuuguaaaaccuaaaagaaauggauaauuuucucaguguauaccagcuaccaaaguuaaguaaagauaagcaauuuauacagaccuacaaccccuagugaaauagcagcaauaauuauaaaccucccaaccaaaaccaaacgaaaccaaaccaaccaaccaaaaaucuccaaaaguucaggucagaugauuuuugugaggaauucuaccagauauucaaagaagaaucauuggaaaacuccucaaguuauucacaaaacagggccagaagaaacauuacccaauucuuuuuauaaggucacaguuauccugauaccuaaaccacagaaagacccaacaaaaaaggagaauuacagaccaguuucccuuaugaacauagaucuagacauucucaauaaaauaacugcaaguggaauccaagaagauauaaaaaagauuaucaucaugaucaaguaggccuuaucucagagauucaggaauagcuuaacauaugcaaauugauaaauguaaucuacaauauaaacaaacugaaaagaaaaauaccacacacaaucacuuuauuagaugccaaaaaaaaaaagccuuugacaaaaauccaacacccuuucaugauaaauauccuggagagaccagggauacaagggacaaaccuuaaaauaauagaggugauuuacaucaagcuauagccaaccaacgcugauccgauggggagaaacucaaagcauuuccacuaaaaccaggaacaagacaagguugucuacuuucucuguucuuacucaauauuacuugaagucuuagcuagagcaauaggacaguugaaagagaccaaagggauacaaguaggaagggaagaaaucuuuauuuuaagaugauauuauugugcacauaaacgacccuuuaaaaaguuuaaaaaguuacugcaggacuggugagauggcucagugguuaagagagccaacuacucuuccaaagguccugaguucaaaucccagcaaccacaugguggcucacaacuauccguaacgagaucugaugcccucuucugcagugccugaagacagcuacaguguaccuacauauuauauauauacauauuauauauauauauauauauauacauauuauauauauauacaauauauacauauuauauauauauauauauauauucacugcaaaauuccuacaacugauaaauacuuucagcaaaguagcaggacccaaaauuaacacacaaaaaucaguaguacuccuauauacaaauaacaaauggacugagagcgaaaucagggaagacaacccuuuucacuagagccuuuaaaaaacucuaaccaagaaaguaaaagacaugucugauuaaaaacuuuaagacauugaagaaagaaauggaagaagaaaucagaagcuagaucuccuaugcucauggauaggugggguuagcauaauaaaaauggccacuucaccagaagcaaucuauacauuuaaugccaucccuauuaaaauucuaacacaauuuucacagaacuugaaagaacaauuuucagcuuuauauggaaacacacacacacacacacacacacacacacacacuacaacuguucugcuaaaggaauauagcaauaaaaugauuucuaaugacauucugcuauacucauagaucagugcuuggucagccaucuucagaggagcuuccuccugcagcagaugggaucaagugcagagaccccacagccagacagugugcagagagugagagaccuuggaacacucagcccuaaaugggaugucuccaucaaaucccucccuuucgggcucagagaaccuugcagaaguuaagguggaaagcuuguaagagucagaggggguggagaacaccagagaaaaaggcguucuaacacagcaugacaaacacacauaggaacuuauagagaugguggcagcaugcgugggcuguacaggucuccaccagaugaggucccgccacugagaggcgggguggaaauaguccugugguaguuugaauaaggauguucacuauagauacauagauuugaaugcuuggucuccagggaguggcacuauuugaaaggauuaggagguguggucugaugauuaggugugucacuggggguggaccuugagguuucaaacaguucauucuaagcccagagucuuucucccuguggcuuguggauccggauguagaacucuccacuacuucuuccaugccuugucuuccugcaugccaccauacuccuucccugccaugaugacaauggacuaaagcucugaaacucuaagcaagccccacuuagauguuuuccuauaacaguugcuguggcuggguggugguagcacugaauaccuuuaaucccaggacucuggaggcagaggcaggcagaucucucuauauuugagaccauccuguucuacagaucaaguuccaggacagccaggguuacacagagaaaccuugucuuaaacaagcaagcaagcaagcaagcaagcaagcaagcaagcaagcaagcaagcaagcaagcaagcaagcaagcaaacagauaaacaaaccaaauccaaaaccaccccccaaccaaagaaaaaaaaaguauuccuguggucaugguaucuuugcacagcaacagaacacuaagacaguuccuaucccuaauacaaaagcuauuucuaguuaaaaagcacuugcaaauaaaaauuaauuuuucuucaguggagucucaauugggggggggguacaaccacucuaaaggcagacccugugccuagcaaugaaacgaacucaauggugucuuuggagguucuuugucucauaauguucagucagggcauuuauuuauauuuuauuuuauuuuauuuuauuuuauuuuauuuuauuuuauuuuauuuuauuuuauuuuuuaccguacagauccuuuguauauaugcuauggcuucccauguuguguuuuuaugggauuccugcucucugucuccauggguuucuugcacuuuucauuuggcucuuuuucuuuuaucuguuucuuuuguucugauguguuuguuuuuucuuuucucuuaucuuacuacuaguuugcuuucuaaugagaguuaggaauggggugaguuuggauuuguugggaggaucugagaggggucggggcaggggaagcuauaaucagaauauauuguauaaaaacuauuuucaaugaaagaaaaauaggaaaaaauugaaauuaaaaaaagaauuuucauaaagaaaauauccuuuauccuccucuucaaaguuccaaacacacagcaguaguuuguagacuuuguaaacuauauauuuugaagaggagcaacacugucaggugaauuuauucacacacguguagggcaaugauuaaguuaagucauuugaucaggugcagacuaaccccccgacugguuuguaccgcugggaaaggaagcauuuagaaaguacgagcacucguuacacaauccucaggucuugccuguggaugaccacuguucaggccccacaaccccgaagcuuaaagcccugugauuaauggcagagguggucagggcaccucagaccaccgagacucaggacgccgagacugucagggcauuucagagguggucagggcaucucuucuuuuuuuccucacugcuuugugucuggcucuucccaccggcauuuguaauuacauuucgaauauuaucuauccuuaauuuaaaagugaaacaggaguuuuggaauagaagagaucaaagcucauuagagaggaacaauccaggcagguugucugugugauuuccuuuguagucuuguguagcaggacuuaguauuuuaauaaaauguguuuucaaauugcuuuuuuaguuucucaucaccggauuaguuauggcuuuguuucuugagagaaaaggccuauuaaaaaaaaaaaaaacagaauuaccuaauuauagucauuuucaaccagacaaaagccaacauuaaaaaugaaucaagggaaauaauuaugauuuucuggcuguaaugaagcaaaugacuggauagaacugggcuuggggcacuugauuugacaucagcagaaagaggaguaucuguguguguguguguguguguguguguguguguguguaaaggaaaagaucuuguaaucuacucaguguauuaagcuacauuuaauuguacaugacugggcuucucuuaauuuguuuuucuggauucauguggugcuuaacaaagagaucacuuuagcuaauacaucucaauuuauuauacaauuccuuaauuauaacucuuacugacuacugagauuaacaauagaagagaucuucaugacuacauaucaagaugagacgucuucaggagacaaaagugaauaaggacagaaaagaggaaaucauguucccacaggaugucuuggggguaacagccuuacuggccaccugggucugaccccacagcacacagagauggacaaggaaagaaccaacuucacagaguuguccucugacuucugcacacugugucaugugugugcacaugcaauaaacaaacaaacaaacaagugaauaaauaagaaaacaagaguuaaacaauaugauaaaugccucaaauacaguagcagagauucuaaauggcaaagccuugauguaaucacaccgaguacaggagacaggaaccccuugacauuauuaugcuucgauguuagaagugucuagguagggaaaaaaaaaguaguugcuauaagcuugaaggaaaggaaaugacaaaccuuuuuguuuuguuuaugauuugguuauuugccuagaaaacucaagggacucggauaacaaaugauuagaauuuuagaugauuucuagaaaaguggaaagauucaagacaauaaacaaaaagcaucaauuucuuucuguuuuaacagccuauagaguagaaaacuaccuuauguaaaaauaaugauaaaacuuaaaguacuugggauaacgucaaaacaccucagcacacacaagagcacagaguacagcaccagcagccagcugcagaaauggcugugcuguaguguuuggaaacaaaauccaggagucagaucugcacauguauaagauauagggcuuauuuaaauauggcuuaaaaggucaaaauuauaaauaccggaacaaaugggcauaucauguccuuugaaggguaagaguggcaguuuacuuaccgcuuccaaguuagccacguguguagugaagguuugcuagugagggcugagagagguacuaaccuccggcuacaacacuaagucguuaggggucagaccauuacuauguccacuuaccagaauaauaguaguggguucucccaugaggcuuaugaucuguguagccacaggcucuuggcucuaaucacagggccagcuguagguuuaaacuuguaaagugggucuuaaguccaaucagagagugguuguuguuuccgugacacuccugucacuacuguaccagggcgugugucuucccaggacauucacuguuagagcuugcaggacucacaggugguuaagacggacaaucacauuucuucuccaguagcguacauagcaccuuccagcacaaugaaaacuagucaggguuuuaaaagcaugcuuuuuccuagucauaaccaggauaaauaacacuauuauaaaaguuacauuuuuacguugauuucagaaaaaaaaaauaugaauuugagugcuucuugguguuauggcguuaucaacaaugcuuuccagauaguguuugucugauaaaucuaucagaccaaauagucuguauuuaaaaaggaaucaaagccaaauaaaccaauauaguuagguuuacacuaaaauguuaauaaaaagucacuggauaugcauuuaaagguugccauagcaacaguaauuuucacacgaugguuuucgauacucgauuccugagugacggcaugccuuguuauucucuuugaggcaucuuuaaugcuugcucucacggauucuccccacauaugccuuggggaauagaaaauaggaaaggagcuuacccguagagaugccauucuuugauuagaagaaguaaaucauuuggggagaagaggaaguagagggggcccacgggaggcugaaggggcgaauaugauaaaaauacaucauaaacgcgcaugauauugugaaagaauaaguuaaaauauuaaagauaauaaaagaagcccaucaacuuugguucauuuauacaaaagugcacacuaguaaagugagaggacaguucugccugagggacaugugggugagaggggacuuagagaggucaggaacauggaguaacuguggcguucccagaggucacuuguuaucaugacacagccucuucuggcagcuguagaaggggcaagcuuggggcaaacauuauuuuuaaaacauuauuuaaaauuuuuuuauguguaugaguguuuugcuugcaugcguguauuuauauguucaugucuggugcccacugaggccagaagagggcuuuggguucccuggcacugguuauagaugauugugagcugccguguggguguuuugggugcugugaacuaaacuuggauccucugcaggagcagacagagcuuguaacugccaagccuucauuacaacccgugaguggucuuuugaacuagguuggucucccuguauucaagguucaaguucuagggaguuacuuaccugcuuaguuugagaaagaauuguuuguacguaugcacacucaugcauacuuuuuuuuucuucuagaucaguugagacccuuucacagugaucaccuaagacuguuggaaggcacagauauuuacauuucgauuuauaacaguagcaaaauuacaguuaugguggagcaacaaaacuauguuaugguugggggucagcacagcaugaggaacugggguaaacggucucugcguuaggaagguugggaacccuaagucauaaacaauagaugacagacagguggccaugcaagaaauuaagugcgcguuucaaagucacauuuuacuccuggcuucucugcauaguuuucuucaaaugugccuuucucugggaguuccucucaucuucuagacauccgucuguuuuguguagcuuuucucaaauucuggauuuuuaccagauaauuucauccaggaggauguucaguuccauuaugacaucuuccagggaccuucccuguggcaccugccccaacccuucccucuuuccuaagcuguguccaaaaggaucccaccuuuucuuucuucuuccuguagugcuuccguuuaagaucagcugcacauaaaagcagagauguuauuguagcauugauuagcagugaauucaucugaguuuugaaagacuucaauacugccccaaauucuccaguccucuuuauggucucaccucuuuccauguaacugcucuuuuucuuacuggacuacauugcccugacucacugggcaaugggacuggcuugggcaaugggauaugaguacacacgcugguauauacacuucaaauacgcugcuggcuuuugacuuccccucuuguugugagucgcugugaacaaacuucagaagaguaaauggcacguggaacaguugcucuagcagcccacauguccaaccugaguuugagcugccccagguugacccgacacagcuagacacaucuaauaaaugcuucuuguuucaugccccacaacuuaagagagaugccugugagcuuuuguuaacuugacacaaauguagauaaaccgagaagaagaaaucgucucuauuagauuagccuguggcgauguccaugggggcauuuucuuuuuucuuuuuucuuuuuuucuguucucaacaauuuaauguaaaagaagaauaaaaaugguaggguuucaguucuucauacauucuuggaauguuggccucccagagagcauuauuucaaacaguugaagaauuaucuaacuuuucugacucaaagacaguuuguugaaauuugaaaagacuuggcuccgugggggcauuuucuaaauuacuaauugauggaggaggacuuaguccacuguggguggcaccauuccugggcaagugggccugggcuauacaagaguuagcugagcaagccaggggaagugggccauaagcaguguccuccucuggcuucuggcuucugcuuuaguuccugccuccagguuccugcacugagucccugccuuagcuguccuugaugauggacuguaauguguaaaucaaauaaaccguuuccuccccaaguugcuuuggguugguguauuaucacagcaacagaaagcacacuaacaaaaggugguaauuuuuucuuauaaaguggcacuacguaauugguacuuaucucaguaaauauacuuuaaaccgcgggauucugaaguuugugucuuaaucuacgugacuauuaggggaaggauggggaugggaguggaggaaagaagcugccuugugagagggaucuccuugggaugcuucagaagcaaaguacguguugguuuuguguaccaaaugauugauguuucuauuaggaucucaagcugacuuuggaacaccuuuaacauugcuaggaugauucugguguaggcuagugauggcucucguuaucacagcuuaugagggcuuuggcugcucuugaaacuccuguuucuggcagauuuccagaccaaagucuccugguggggaggggagugacaguuccugaaacuccccuggcagugacacugacugugaguucaguauacuuuucucugacuuaacaaggccaguguuuauuagaagguccccauuccuggcagcaggcagcacauagaggagcacuuagcugucaucaaaucuuccagcacuucugggaagauagcaugaauaugcuccauauccuuauuguuuuuauguguauuaauuacuuuucugugauaaaacaccaugaccaaggcaauuuauagaaagcaaaaaagagagcacauuuugcuugugguuccagagggauucaagucuaucuuguuuugggagcaagccacaggcacgguagcagaggaaggaagcagagagaucacgugucuuacugaaagcagagaagggacaugaaagugagcaaggcuauaaacucucacagccaaccccagcgacauacuucccccaguacagccacguaucugaaccucaugcaaaucauugaacuaaguuuacaaaaucgacgugcggugucuugagugagaguggguccccguaggcucaugugucugaaugcccucuugccaguugguagaacuauuuaggaaggauuaggagguguggccuuguuagaggaggcgugucacugauauuugaguuuugagcugugagguuucaaaagcccuggccaggcccagucuuggucucucuuugccuguugcuuguggaucaggauguaagcucccagcuacugcuccagggacagugacauuccugccuguugcugugcuuucugcucugacgaucauggauucacccucuaaagcuguaagcaagggccugauuaaaugcuucuuuuuguaaguugucuuggucaugguaucccuucacagcaagagaacaguaacccagauaccaggcuucuacacaccagucaaacuguacagauaaaugcauuagaaauaaaggcucucaguaauccuauaccccagaaguaauuguucucagucccuucagaauuucucuuucuauauacaaacauuucuaaaaauaggauuggcaccacaauaagccaccuucagcuugcuuuuauuuuuaugugugagcauguugcaggccugcuuucuuguuacucaguauugcagcuuuguuuugucuuuauuuuuuuucucuagagauagugcuauuuguaacguaguucuuuuugagguaugauuuacauucuuuccuagugucauaucauagaaugacauauuguuuauugacaacuguuaaaaacagaaaaaagaaauacauucaaaaucaaaucauguuacaaaaaaugccagaugaugaaauuuuuauuuuuuacucaggagugggccuucgucugcuccaagcguagcuguaaugaaaaugagcucaaaucuuagcagaaacagacauuagugggggaaggucauucuagaagccugggguggugacagcaggaguugacguaugucacucuuacuuugagaaggugugaaggauaaacagucuccugaggaguguuuauaagaaaagaauaaucuagaaccuuugauuaugggaguggaggaccagcaacucuccaagauucugaaggcagugccagggaaggccuggugagaguccugagccagaccaaaaggcccauauuugccuaugguucaaguguuguguaucaguuggccagugguguugcacaccuuuaaucccaguguucuggaggcagaggcaggaagaucucugaguuugaggucaauuuggucacagagcaauuuccaggacagaaaaaaaaaaaaaaaaacaucaugaaggggagaaauguaugaaugaaaaaauaaauaaauaaaaagaaaaggaaaggacgugacugauccuagguaugguggaggaggaaguuuauuguggauaugugggagagcauacucagaggcagggacaucugacagagccuagaguggacauuaccagacugagcuguguuguguggagaggggggagaggaagagagaggggagagaggggaacaaggugcaacagccaggaggcccaaagguacaaaaaguguggguaacaaauugguuggauuuuauaaggaauuguaguccagccccguggccuggagaguucaggguagggggcaggaugugccagacaggagggcccuguaacagguagggauugagggaugcagggagaaccuggcggccaggucugcuuugcuauguuaaauaggcaccucaggcauuggucccagguuugcacccuaacauuguguaucuucagaaaacuccaaaguguguaaagcucagaaaauaucgaaagggccagauccagcuauaccaacaggauaguugguggcuccucgugccuugauugcauaacccaguguuaggcaggauggcaaggcaguaaguucugguaccaagcucucuggccaugacacuggguggacucaguagaugggagcaggagugaggaugucucacuuagaucugacaaacauguuuuucuucuccucuguuugcaugauguugaugucaugacaaccagaggagccguguguauuuuuuuuucuuuuucuuucuauugcugugauaaaacaccaugaccaaggaaacuuauaaaugaaacaguuuaaucgggcuuacaguauauaaugguagagugaagacaugguagcaagaacagcugagagcucacaucucaaaccacaagaaggagagagagagagaaagcaacauggcuaugcaucuuaguccuucccaaacaguucuaccuacuggggagcaaguauucaaaaauaugagcuacuggggcagaggcuguucucauuugaccuauuauaccaucgaugaaagauggcagagacccucccaauuugauucuucucucuucucuuucccuugggaugauuggacuugaacauuauuuuauucaaaaauagagcuagaaauaaucauucuggguguggcaacccagaccaagaaaggcaaaugucacaugucuacucucuugucugcaugcuagcuuugagucuucagcuauguguguuucauuugggaaacccacagaggucgggaaacuacuaaggggguauggagguggcuacuaggggauaggacacucuagcaggaaggguuagaagggaacaguggaauaggaaggguuaaacuggggagaggaagugguagcuuaggcuagaggagggaauaugggcacggagaaauaugccuuaguuaggguucuauugaggugaagagacaccauggccaaggcaacucuuaaaggcucuuaaggaggcccccuuaccacugaaacaugcuggccaauggaacugggccuuuggugagcaugucgucuccaguguccagugacugcugguuacagaacccuucaggaagcuccuuuuucuggguuuggcaucacacagacuaccuuuggucuugugaggugccccacugagcauguggggugucgucuuuguaucuguuguauuugaacaacagguucaaaucacccuuugugcagaggcugaguuuuguacuuucuccauuccuugagaaguuuauuccaggaggucauuccuuauauacgaaggaauacuguggugguugaaauggguuuuauguuuucauauuuaaaauaaauucaugcuugguaugguggcacaggccacucaagcauuugggaagcagaaguaggcagauuucugaggucaaguccaaggucagccaggucuacauagugaguuccaagacaaccagggcuacauacacaaugagaccaugucucaaaaaacaaaacaaaaaacaaaauaacaaaaauuuagcaaauuuuaaauuuaguuuuagugugugugcacagugcucuggcaugcaugguacacguguggauguaagagaaacuugcuugaguugguucucauguucccuccaccaugaggguaccaaggaccgaauucagguaucaggcagggcagcagguaccuuuaucuacuuauagauuuauauuuuuuaaaauguguguguguguguccccacacacgugggcaagaaaagaggccagagguugaacucagaaucucuuccuuaauuuuuuuuucuccauuuuauuuuuugagaaaggaucuccuacugagccuugagcucacugauuggcuagacucacaucuggcuccagggaucugccugccuccaaaugggugcuguguggcuuccuggcuuuucugugggagcugguagucugaacugagauucccacacgugcaugauaaacacuucauuuucugggcugucuuuuaagcucuuguuuucaauuuuuuuuuaaaugauguuugcucauuauagaaaaguuaccaauuuggguaacuuauuuucuaacuagcuucuuaguguguguauuuugauuguuuuugauagcauggcaguuguacugaaugaagguuuuagguaaccuaacgugaugaauuuucccuuuugguaguuauugauuuuuuauugucucccuuacaauagccauuugccaaaauauugggaucaauuuaaaaucuagcuguaauauuggauagcccuguccugacucccaggcuuagaccugugaaaaggcucgacuuuucacuuucuguucagggcucgugaaucuugucaguuaaaggaaauuguccaggccuuaaugccacggaauagguuauggguauuaucuguaccuuggagcuaugccauuuucuaauuaugucaacuggauuguggaagaaaaauagaaaauucuucaaaaaagaaaaguauaaggagagaaaaagcacuuguuggcuacauauuaaaaguccagaagucugugagccggauguauuugcuuugauuuagcuaacugcucuccagcucccaacacccacaaagauucugguuuuucuuuuuuuucuuucuguuuuuucccccagacaggguuucuuuguguacucuugucuguccuaguucuguagaucaggcacagagaucugccugccucugcuuccccagugcugggacuaaaggcauaggccacuaccacccagcuguuuaggguuuuucuacuaaauuccuguuagcuucuuuuuuauugcaugcgauagacuuuuugauuaauuugcugugucuaguaauugggagagauuuuuaaauuuauuauuauuauuauuauuauuauuauuauuauuauuuguucgagacaggguuucucuguauagccuugccuguccuggaacucacuuuguagaccaggcuggccucgaacucagaaauccaccugccucugccucccaagugcugggauuaaaggcgugggccuccacgcccggcuauuauuguuauuauuguuuuagagacagggucaccuguagcucaggcuggccuugaauuuacuauauauauauauauauaauauaauuuacuuuaagcucaugcuuccaaagugcuacaauuauagccccguugcauuugauccauguaagugucuuauuccgguuccuacugcugugauaaacaacacgaagccaaagcaacuuggggaggaaaggguuuguuucaauuuacaguaacuagguuacaauucaucauggagggauguaagggcaggaacuuaagguaagaaucuagagguaggaacugaugcagagaccauaaagaagugcuguuuauuggcucucuuccccuggcuugcucuguuucuuuucuuuucuuuucuuuucuuuucuuuucuuuucuuuucuuuucuuuuccuuuccuuuccuuuccuuuccuuuccuuuccuuuccuuuccuuuccuuuccuuucuuuucuuuuccuuuucuuuucuuuuuuaaauugaaaaacacuuagaagaagaagaagaagaagaagaagaagaagaagaagaagaagaagaaaaggaggaggaggaggaggaggaggaggaggaggaagaauucuguucucccaauugaacacaacgguuugggaugaacaugaccagagaucuucagcugguacauaaaccuggagcuguaauggcacugggguuggaaaaagaguuuuccuuccgagaaggcagggagauggcucucugggccagagggcuggaggccuuucaauggguaagcuggaggccuuuugauggcuucucuagcuuaucuagugugagguuugacuaagaaugccccccauagacccauagauuagaauacuuaacuaguggcauuauuuuaaaggauuagaaggcauggccuuguuagaggaaguauguuacuaggaggugggauuugagguuucaaaaggucauuccaggcccagugucucucucuuccugcugccuguggauccaaaugcagaacucucaguucuccagcaucaugcuugccuacauucugccauguuuccugccaugacaauaauggacuaagccucugaaacuguaagcaagucccaacugaaugauuuuuuuuuuuuaaccaagagcuccuguggccauggugucucuucacagcaguagaccacugacuaagacacuuagggagaggucccuuuaaagcagaugaauggguguagaccaaagagugccaugaucuacaccauguaacugaagaauaaaaauuuuuacugaacucuucuucaccccagagcccgaccccucccaucuagagauuguucccggaacacuccugaacucuucaccccagaaugcauuccugaacuccucacccuagaguucggacccucccaacuaaaaacuguuccaagaacauuuuugagauaagggccuccuggaacaaccucaaaaugaaccggguacauugccaaaugauaggacaugaccccuuaguuacguagauucccuuggcagaacccccuaguaauguaaacuuguacuuucccugcccagcucuucccccuugaguuuuacuauauaagccugugaaaaauuuuggcuggucgucgauucuccucuacaccauuaggugcaugaguuucgaccccagagcucuggucuauauucuaugugcuuucuugcuguuguucuauuaaaucuugccuucuauauuuugaguacggucucagugucuucuuggguccgcggcugucccggggcuugagugcuugagugagggucucccuucgggggucuuucauuuuggugcauuggccgggaaucagcgcgaccacccagagguccuagacucacuuagagguaagauucuuuguucuguuuuggucugaugucuguguucuguuucuaaguuugaugcgaucgcaguuucgguuuugcggaugcucagugagaccgcgcuccgagagggaacgcgggguggauaaggauagacguguccagguguccaccguccguucacccugggagacgucccaggaggaacaggggaggaccagggacgccugguggaccccuuuggaggccaagagaccauuugggguugcgagaucguggguuugagucccaccucgugcccaguugcgagaucguggguucgagucccaccucgcguuuuguugcgagaucguggguuugagucccaccucgcgccuuguugcgagaccguggguucgagucccgccucgcguuuggucacgggaucguggguucgaguuccaccucgugcagagggucucaaucggccggccuuagagaggccaucugauucuuugaguugcuuguggucgacgcagaguugccgccguuucugguuucuuuuuuugucuuagucucguguccgcucuuguugugacuacuguuuuucuagaaaugggacaaucuguguccacuccccuuucucugacucuggagcauuggaaggaggugcgggucagagcccacaaccagucgguggaggucagaaaggguccguggcagaccuuuugcaccuccgaguggccaacguuuggagugggcuggccaccugagggugcuuuugacuugucacuaaucgccgccgucaggcgaauuguuuuucaggaggaagggggucacccugaucagauccccuacauugugaccuggcagaaucucguccaauucccaccuccaugggucaagccuuggaccccaaacucuucgaagcugacgguagcgguugcccagucugaugcagccggaaaguccggcccaucagcaccccccaagaucuauccagagauugacgaccuccucuggauggacucccaaccucccccuuaccccuugccccaacagccaccugcagcugccccaccacagggaccaguagcgagaggggcucagggaccggcgggggggacucggagucgccgaggccgaagccccggggaggaaggggggccagacucaacaguugccuugccauucagagcacauguaggagggccagcaccaggaccuaaugaucucauuccuuuacaguacuggccuuuuuccucuucugauuuauacaauuggaaaacuaaccacccucccuucucagagaaccccucuggacuuacugggcuccuugagucacuuauguucucccaucaacccacuugggaugauugucagcagcuuuugcagguucuuuuuaccacagaagaaagagaaagaauccugauggaggcgagaaaaaauguucugggagaggauggcacacccacugcccucccuaaccucguggacgaggcuuuucccuugaaccgccccaacugggacuacaacaccgcggaagguaggggacgccuccuugucuaucgccggacucuaguggcaggucucagaggagccgcuagacggcccaccaauuuggcuaagguaagagaggucuugcaggggcagacugaaccacccucagucuuccuugagcgucuaauggaggcauauaggagauacaccccuuuugaccccuugucagaggggcagagagccgcuguagccauggccuucauuggucaguccgcucccgacauuaagaaaaagcugcaaaggcuggaggggcuccaagaucauacgcuccaagauuuaguaaaagaagcagagaaagucuaucauaagagggaaacagaagaagagaggcaggagagagagaagaaagaaauagaggagagggaaaauagacgggaucgccgucaggagagaaaucugaguaaaauuuuggccgcaguugugaaugauagacagucaggaaaagguaaaauagggcuccugggcaacagggaagugaaaccgccagguggcagaaagauaccacuggaaaaagaccaaugcgccuauugcaaagagaaaggacacugggcuagagauugcccuaaaaagcgggagcgauccaagguccugacccuagaagaugauuagggaagucggggcucagacccccucccugagccuaggguaacuuuguccguggaggggaccccugucaacuuccugauagacaccggagcagagcauucaguacucacuaacccccuaggcaagcugggcuccaaaaagacuaugguaauuggagccacugguaguaaauuuuaccccuggacgaccaaacgagcucuucagauagacaagaauauagugacccacuccuuucuggugauaccugagugcccugcuccccucuuggggugcgaucugcuaaccaaacuaaaggcucaaguccaauuuacuucagaaggcccacaaguaagcuggggaaaggccccuguugccugccuuguccucaacacagaggaagaguaccgguugcaugaagaacaacccaaaaaugcagucucuucagguuggcuaacugcguuccccaaugucugggcagaacaagcaggaaugggguuggcuaaacaagugccuccgguugugguagaacuuaaagcugaugccacccccauuucaguaagacaauaccccaugagcaaggaagcuagagaaggcauccgaccucauauccagagguugcugggccaaggaguuuuaguggccugucagucccccuggaauacaccacuucugccgguucgaaaaccagggaccaaugacuaucgcccgguacaagaccuccgggagguuaacaaaaggguccuggacauucaccccacagucccgaacccguacaauuuauuaagcucucucccaccugagagaacaugguauacaguucuggacuuaaaagaugccuucuuuugccugcguuugcacccuaagagucagcuccuauuugcuuuugaauggagggacccagagggcggacagacuggucaacuaacuuggacuaggcuaccacagggguucaaaaauucccccacccuguuugacgaggcccuccaucgggaucucgcgccuuuucgcgcucgaaacccucagcuuacccuacuacaguauguggaugaucucuugguugcggcggccucgaaggagcugugucaccagggaacugagaggcuccucgcagaacugagugacuugggguaucgaguuucggcuaaaaaggcacaaaucugucaaacugagguaaccuaccugggguauacccuccgagggggcaaaagauggcucacagcggcccggaagaagacuguuaugaugaucccaucgccaacuaccccacggcagguacgugaguuucuggggacugcuggcuuuuguagacucuggauuccaggcuuugcaacccuagcagcaccucuauauccuuugacuaaggaagggguuccuuucgaguggaaagaagaacaccaaagagcuuuugaggcuaucaagucgucucuaaugacugcccccgcgcuagcauuaccagacuugacuaagccuuucguccuauauguggacgagagagcggguguagccaggggaguguugacacaagcacugggacccuggaagagaccuguagccuauuugucaaaaaaaauuagauccuguugcuaguggauggcccacaugucugaaagcuauugcagcaguagcccuguugaucaaagaugcugacaaauugacaaugggacaacaggugacuguuguggccccucaugccuuaggaaguaucgugcggcagccaccugacagauggaugacaaaugcccgaaugacacacuaucagagccugcugcuaaaugagcguguaaccuuugcgcccccugccauccucaacccagcuacccuucucccucuaacaaaugauuccgucccaguacaucaauguauggacauccucgcugaagaaacugggaccagaagugaccugacugaccaacccuggccuggagcucccaguugguacacggacggcagcaguuuccugauagaggggaagcgaaaggcuggagcugcggugguagacgggaaaaagguaauuugggcaagcgcuuugccugaaggaacgucggcacaaaaggcugaacuuauagcgcuuauacaagcccuccgagaggcuaaagguaagaucguuaacaucuacacugacagccacuaugcuuuugcuaccgcacacauccauggggccaucuacaggcagcgagggcuauugaccucggcugguaaagacauuaaaaacaaagaagaaauucuggcccuguuggaagccauacaugcaccuaagaagguagccaucauccacugccccggccaccaaagaggagaagacuugguggccaggggcaaccgaauggcagacucaguagcaaaacaaguugcucaaggggccaugaucuuaacugaaaaaggugauccgcccaaaagcacugaggacgagagguauaacauaaaagagcuaugguggaccagagaucccuucccauauuuuuuugaagggaaaauagaauuaacucccgaagaaggaauaaaauuugugaaaggacuacaccaauucacccaccugggaguugaaaaaaugaugagacuaauuaaaaauucccgauaccaaguccccaaccugaagucaguggcucaaaagauuauagacuccugcaaaccaugugcauucacuaaugcaacuaaagccuacagagaaccuggaaagagacaacggggagaccauccuggaguguauugggagguagacuuuacugaaguuaaaccuggaauguaugguaacaaguaucuguuaguauuuguagacaccuuuucaggaugggucgaggcauuucccacuaaaacagagacugcccagauuguggccaagaagauccuugaagaaauccugccaagauuuggaaucccuaagguaaucggguccgacaauggaccagccuuuguugcccagguaagucagggcuuggccacucaguugggcaucgauuggaaauuacacugugcuuaccgcccucaaagcucaggacagguagagaggaugaauaggaccuuaaaagagaccuugacuaaauuagccauugagaccggcggaaaagacuggguggcucuccuucuucuugcgcucuuccgagcccgaaacaccccuggucguuucgggcucacuccuuuugaaguucuguauggaggaccuccccccuuaauggaagcugguggaacauuaguuuccgacucugacccugucuuacccuccucuuugcuuauucauuuaaaggcccuagaagugauuaggacccagauuugggaccaacugaaagcagccuauaccccagggaccacugcaguaccccacggguuccgaguuggagacaaagucuuggucaggcggcaucgaaccggcagccuugagccacgguggaagggacccuauuugguguuacugacaaccc

SEQ ID NO: 1833 - RNA, 2811 nt, Mus musculus
ggggguacgcagcaaggagcaugaggcgggaggccaauuggcuugggccuuggaccuccucgaggcgugcgggcgggcagggcgccgggcauucccggcagccuuccgaagcccgaggccggcucaaggaacccgcaguccccgcccacgcgggaccaaccgccuccggcugcgccuuccccggcugucugggguccagaccgcacgccgcgaccgagggaggccggagacucaccggugagcgggccggcgccggagagcggaaaggagcggagcacagcgcagcucagccacacgcugcuccuccaccacccaccgagcguucuggaaaguuccgcccggcccgccgcagccgaccucuuuuguagccgagccccggcgcgucacuugccggaagucccgccccucgccgcugccaccgccccucgguuaccugggcaacggcgcgggggcgggaaguggcugcgcccaagggccuuguggggguggacucaagcccggguucccgagccucguagaauuuucuagaggcuuuuuuucuuauugcgaggaaccagagugcggaagucuugagguggagaggucaugucccagagcccguaagccggggacgagugcuucaggcguugugcgcgcugugcugaaggggauugguggaacccagcccuggcugcgagucugauuuucugcagcuccagcuccuuagcucugagccuugcgggcaagaaaugcugagcaaggcgggccuacucccuaaaccagccucgcaggcuuugguuucacccaagcgcacuuaugucagagcuuuuuggacgagccuggcccaggcuucagauccuuuuggcucugacgacuugggcggagggaaucugggacuucaccaaacaggaaaacauuuagaaugccucaugcuaacggagggucauggucuuccacccaguuuggccgcagaggagcggccaaaagcaaaauuaauugcuuuagcuuauuguuuuaauucucugaccguuuuuauuuccaguuggugacucaaaaaucuauaguuggcaaaguugaaucuuaagcuuucaaaggacagagugaauguuuuucuuauucacuaacacaauagauacaucaaagaaguggagguguaagcuugaaagaguucacauauuuuaaagauuuauuuugaauccucuguguguguguguguguguaggugcccaaggaagccagaggcauggagucuuaagucuggcuucaaauucugaaaucuccugucucugagcaguugugaagggugguacaugcucuuaaccgcggggccucuugcuuggacuuucguuggaaguggaacaagcuaaaaacuuauaagagaaaucacaaaauacaggucagcaggugaacaagaagcaguuaagcacacuuccuaauggaagugcagagugugggaugagauucuuuaaauguucguuuuauuguguguuucuaggcuuguggaccauuguaguucucucguaccuuugcacgggcaacucaagucuucagugcguuaccagcugagcggcugucucagugcuuuauggagaucacagguaauuggauguagccagagcuaagggagcuggaaaggcugucuucaaaccuacccaaagacaucuuuagcucguggucuuaaaaaccuccggauuuugggauuucuaccuugagcuguccugccucuccaccguuacugcuuucacuaaacucuguuguggucacuaaagcuacgccacuucccuuacagacuuuuugaugaugugcugugguuuugguugagaaacaucuuuucucagcuuacguguuacccucucagauaucacaucuaucaauagguuacgucuuuaaagcaggggcucuuuaccuuccuaacgcugcgacccuuuauuacagcuccucauguuguggugucccccaaccauaaaauuauuuucauugcuucuucauaacugcaauguuguuacugcugugaauuguaauauaaauaugugccaaagguuuuccgaagggaucaaaacccacagguuugagaacuacugcuuuaagccaacacuuuugaguaaaauaucuacuaugccaggcauacucuaggccuugccaauacaaaacucuuguaagccauggccccuacucucaaggaacuuaacucguaaugagauuaaaaaccagaauuaaaaacaaaaaaccaaaccaaaaccauccaaccaaccaaccaaaauugcaggacuaggcugauaaagucugccuuuaaucccagcacucugaaggcagagguaggcagaucucuaauauagaggccaggccagucuacauagcagguuccagggcagccaaagcuacagaguaagaaagacccugucucaaaacaaaucaaacaaaaaaccucgaaaauuaccagcaacuucauaugugauaauuuuguguggaaaugagaucuuagcuuaguuugguaguucugaaaauucagaacuaggaagcagaaccaggaggcuagugaacucaagaucacuugaguuaggugugacaccgucuuuggagugggaauauaacacauagaaugagugcuucuuauucuguucaaggcccuagguaugauuccuaggacugcaagaagaaaaaagaaaacuaucuugcauguguuguuuacaacggauuauuuuguugggguaaauaaaucagccuuguuauuuuuugaugugguuugccugaucucuauugaauguuucagugguuuccaauguuuuauggugaagugcugaagaucuucaaauacagcuuuagguacucaua

SEQ ID NO: 1834 - RNA, 15249 nt, Mus musculus
agguucaugagaaggaugugauuggaaucgcacaccacccgcaccagaauuugauugccaccuacagugaagauggccuccugaagcucuggaaacccuaagucagccuuuacggugcagcccaggagcauguacuuaagugcagggcauggccauguauuccgacuacuuuuccaugucugcguccuagcauaaaacuuguaaauaagucagugugauguauugaggagcuucggauugauucuuuuaaaaagauuuuaauaaacuuaaaccuuucuuuaccauaagugcucauaagggggagggagagucgcuauccuugauccuccagucugguagugaguguaaaacagacuaauaugaaacaggcuuggugacacacacagauucuaauuaguauuucagaaaaaguuuuucuucuagaaauaucaguauuucaaaucuuugguagauuagugaaaacauuagugacuaccccaguuaaaaacagauaaacuaaugaugccuuuaagaugcuuuaaaugguaacuuccuuaaacaggaauuuucauaaaauuauuguggcucagucagacaauauauuugcuuaggaaggcagacaugaaaaaguuuuugcucucuugucagccuccucauucugcucuuuauguucagcccugcucuuguauuccaguuugaacaaguuagaggguuuaugggauuugaugcuugggugccuuucuuuccuauguagaggaggauuuaauacugaaaauguacuguuguaaagaaaaacuagaaaagcacuccagucucuuauguauauauuuuuuagugaacuaaagaaaaacuguucugucaacaaaauccuugaaaauagguuccauguugauguccuuuacauuuaaaccaaggcuacagagagagcauuuauaaugagcauacuaugcuaggcuguaucaagaaaggcugucuucuccuaggcuuaaaaauuuuaaggauuauuuaugcaugugagugcacuguugcugucuuuagacacaccagaagaggacauuggauccauuacagaugguugugguugcugggauuugaacuuaggaccuuuggaagagcaaucacugcucuuaaucacugagccaucuuuccagccuucuccuaggcuuuuuauugagaaagucauuaccaaauuucacauuuggggcuggggcuguagcucucucgauugcaugcauguuuugguuugauuggcaguugggggggggggcggaaacaggaagaccaaaauuucaagguagcucuauaguaaguucaaggccagccuggucuacaaauaaggacagccaggcuguuaacacagagaaacuggucuuaaaaauccaaaagaaaaaaaaaguuuuaagaucaaucuggucuguacagggagcccuuguccuugucugcccccaagagucagagcuuggcaaauuagacauacgccuuuaauugcagcacuugcaaaguugaggcacaaucaguuuuaagaccagcuagggcugcauuguaagaucuugucucaaaacaaaacaggaacuauacaaugugguauuccaguaagcuaaguaugggacaaacuaguaguguuuuuaguugcugguauagcuauguaccacuauacuugggaaagucuuagaagaccaccuuguucauucuucagcaauauuuggaaggaaccucuaaaagacugaccuuucuuaagccccacauagcuucagcugagggacccuccuaagaagcccuucugggcuaaggcagccugucccuggcacuccccacugaggaugucaaguagggagaaccuccuuauauguucggagaggauggaacuuuguacaggcuaguggugccuggugccaguuuuuaaucuggcaacccccauagccaaagguguuaagggcccuguaguagggguuaguggaagcucagugcuugggacuuccuuauaaagucagguucaggggaggcagucuuugguccaccagacaauucuguuauuaaauuuuaucaggaaaaaaccaaaaaguauccugcccccuuaguugacaaucaugacauguguuucagggugauguuucccagaaaugccaacaguguauuuacucuucacuaguuuuugaaucuugcagucaguuuuccucuccguucaagcugaccauauuaagagagagugaaagcagcuacauuucagucucaugauuuaccuaguaacuugagacauuuucaggucucaccccagauaugcaagcaagcauauuuucauauacagcauuuuauguugucuuuuuaacucuucccaaaugucucaccuuaaaugcuaaugcuauauuagcaucucauaucugaaaagcuuaaugaacaguaaguauauugaagguggcauguguuuuccugguuuaaaaugcugaacagcaagccagaagugaugccuuuaauaccagcaacugggaagcaaaucugaguuccagguaagucuaggggucuuaacaacaacaaaaaaaggcauugcauuuuaccaggauuaugcuuuuaccagcccaggcaacugacccaacaguuuuuaguacuaaaauccaagguugagguguuucuaaaauuggaacacuaucaacagugauacugcuucacagcacagacugguuuugauccaaugcaaaucccaugccuuaucccucagccucuuaaaugcugggacuacaggcauguuacacaugccuggcugucugucucagguaauacaauucuacccgcuauuagaccuucguguuuaaggcuauauauacaauccaguugaaccuaaaucccaacaggaugagaccugacuaguuucuuagguaagggaugguucaguuccuggcuacuuuucugaagacauggguucaauucccagcacccacauugcagcucacaacuguaacuuaguuugaggggaucugacagacacacauuaaaaccauuccuaggcaguuccauucacagccuaaaaugaaaacugaggaccgaaggcugggaacccuuuguaugccaaguuuugaguauucugcaugccuagugccugaagucgguuuuugggacucacuguagagagaugggacuugcuuggaacuuuuggguccucucucagucaguacuaaccauugaacccucucuucaccauggugauuugcuaacucagauguucuccccgugaagaaaacuucagccuacuuacagauuagaaauguuuuuaaauuucugacuagaagagauguggcagaccuagguagaccugaaagucacauauuuucauccagguugguugaaguucccuuuucugacuugggcuuaggccuauaccuuuauuucuuauauauggauaagaaauaaguauauauggauacuaaguauucccacauuccaggaacauagacauaaaauuacaucauaaaagcccauaaugcuuugaugaacugagaaaaaaaggccugcagugacacacuggaaacacuuuguaaucaguauauuagacagccauacauuucaguaacugcuuaaauucugauauccagauuuaagcauguaagcaugugacuucaaaacauacaacaaaucuauucauaauuugcuauacuaccaacauuaaauugcaguuacguuggagccuaagucgaauagaaagccuggaacagaccuaaggagcaccuucccuggauuauacaugcaaaucaccccuccacguacagaucucaucacuuucauuuguaaguuacuugggcuuuggaagucacuacacccaagcaagggcuuaucaugguuugagaaggggaaaaaggugaucauguuuucuguuuauauauauaucuuaaaaauugcacagcagaaggggaugcaaucuagaagagcaagcccuuaagcaguagcuuaugauaaacuucuuuaggaaugaaucauuucuaucacuaauaacacaggcgaaauguauuaugccaccuucuaguaauggcugaggcaauacaaugcaaaggcaucacaauugguucacuucauauaacuagacagaccgacauguaacuaauuguuuucuuuugauuaccaguuaaauacagaauuuuaaucccauagcuuaacaaugaagggucauacaacacauaccuagcaugucagucuaauguacacagcuauuaucaguuacacaagauaugaccuaacagaugcuagggaacuuuuuaaacuaguuuuuacaaguauucauuuucaucuugaacacugaagucaucauacauacagggcaaagucagagcuuuuauauuuguguuuauucuucauuuaacuuuuuuuaaaacacuacuauaguugaauauuaaaacaaaaacaauagccaaguagugagcuuauuaugauuacaguccuucccacauucacuacugcauacagaaugucaaagagugacuggcccauuaagaggucugacacugaacgccaccucuggggugauguucaucauccucauacgcuucuccauuauaaugacgccgucuuuccugauuuggaucaaaguccaccaguucuaccugauccauuucaucagucucuucuacuuccuuccuuucaggaaggaguuuuuccagcaaagagaguuuaucaggagagagaaagccauuuucaggaaaguuuaccugcaaaaaauaaaaaauaaacucaauucuaucauuagacauaccuuuaaauauacuggauuuacccccagaaaaacacauaauuacaccauuucuuuagcucuaccuugcaaaaucuggcuuagaaucaccuugaacucacugugaagccaaaggugacuuuuuugaaacaagauuucucuguagcccuaacuguaccagaacuugcucuguagaucaggcuggccucaaacugagagauccaaguaccucugccccccaagcaguggaauuaaagguguggccaccacugucuaaccaaaugauucagucuuuuacccucccaauucuaccuuucaagugcuagcuuauaggcacgcaucacacccaggccaggugcuuaacaaaaauuaacugccauaguugccacuuguaacccauaauuuaagagaaauccauuugguguuucaauuuuaacuggauaaagggagauuuuaaauacacuuguuuagucuguguuauauuuuaauaagcuaaccauucucaaauguucuugagaaauuacagcuuaccuuaaacucaaugauuagacgucccuuuucauauggccgacgguauauuggcauaccuucauuuagcacacauuuuauauccccaugcuugacaaucugaccuaaagacauugaagccagguucuuagguauggucucauuuguauaagcaaagaaaaaaagugaaacagacaaccucugaguuuugguucaacagcccuguuuccuucauuuauggcuuuuccaagaggugaccaguaaauuucaucucagcucuaaggauauauaaccauggaaggaaagcaagacauuucccucaauaccuauguaguacuucauaguuaucagaagacaaggaaaaugcaaagcagggaaacagguucaucucgucaucauaccuggaugagaggugaugacuaugguucgguugucaagaguagauauuggcuuuuggaagccgcacaaugcuucaaccagcuguauguccauacacaugaaaaggucuucuccucgccuauagcaauacaaacaaggcacaguuacauuuuucacacaugacuacauacagacacaacaggcaaacuucugucaccaaucugaaaaccaaacuaucaaauccugaaaauaacaaauuauuuuggaaacagucacugaacaaagcuucaaaaucauuaggacacagcuggacacacaugggagguaguaaccaaaggcagaaggucaaagccugccuuggacuuaaaacaacuguucuuuccacacauucuaagcaauguauucuucucaaguuguugccuaaucuuaaaucugguuucuuagaggggagaaaaaacacacaacaaaauauauacugggguuaaaggaagccagacacauuuguagcauaugaaucaguguaaacaaaaaauuacaaaaacaaaacaaaacaaaaaaaaaaaaaaccccaccucgauuuguguuggaucuucaaguaucuaguccaauuacgaaaacuuuaagagccaguaaagaucuuuuggauuuauguauuuaguauagugccuaguauagcauuguuuuuugagauaggguuucuuuaacagcccuggcugucaucaaccucaagagauccaccugcuccucucucaagggcugguauuaaaguugugugucaccagugcugggcucuugugauagcauuuuuuuaauagcugacauucccucacauuuaguuuuccaacacagaacaaacaccuguuagaaauauccuuuccuaaacaaguuccuuccauacacaagacccccucccccaaccuucauucauguucaguuuggaaauuuuuguuucaagacacaaauuauauguauuuaacaguuccaaauuuuaguuuuguauuaagauagcuugaguauuuacacauaaacaacuccguauaaaccaagaaugggcaaaugaugaaaggcauugccuuuuuugaagacuaucaagagacuguaggcaagcagguuuggucucccccccccaccccccagacaggguuucucuguguagcccuggcuguccuggaacucacauguaguccaggcuggccuggaacucagaaauccgccugccucugccuccugagggcugggacuaaaggcgugcaccaccacgcccagcuuugagagcaggguuuucuuauauagcuucuccaguugcuugcuauccauuaaugcucacaaaaaaaaaucuagucaacaauuuuaagacaaaaacaaucuugauucuacuuucagccauuuacaacugaaaccgagcuaaugagccuuuauagaauacacugcaguuuguuacauauaccugguguucuaagaguaaagaaaagcucacucauuuaaacuagaauucaaccuaauuagucaguuuggaaaagugauuaagucuuuaccuuguaaaaacagcaugguccuucugaucuaacacaaugauaauaucuccuggcuccaguccugguucuuggucuccuucaccguggaauguuaucuucugaccaucuuucaugccuaaacacagaucaaguuuguacuuuuacugauaucagaggccagauacuaaggucaggaucauaaaaucuacuaaacuacagauguggucuguggaugaagaguacagcauuaugccaaggcauugggcucaauuucauccuuaguaucauuccuucaaaaugucccaaccugcaugcaugucuuccagcauguacaugucuuuguggaugaaagaaaagacuauuuaacccagucuagucuggugcugaagcaagcuguaacacaguagaugagacaacuuucuacagucaggcuucuaaucucagaacuauuaccuauuuagcugcacaccuaacuuuccaaagagacuuauuucauucaagcaguugaggauuaaaaacacccauguuagaagcaaacucacaacuggcaaacaauauaaccaguuaacuacucugauuguguaacaaucuguaauuacuaucauaaggugucaacugccuuuuuuucuguuguaccagcaguauuucuaguaagaaaacuagauuuuaaaauccagaauucuuccuuuggaagcuucuuccacucuccauucucaucucucuguuaucuguucuucuguuugaaaaauaaaaacuuacaaucuugugccauaggucgauuaacuaacuacccaguacaugcaaagacccuggguuugguuucuacuagccuggacugauuaaaaaaaaaaaaaguuaucuggguaauggccagcagucucaacccaucccuuauuccacccucaaaauguuuauuacuauuggauacuuuaacauguagcccauauagaaaacacuugauuauuuuccaauacagcaaauguuuuugaaaaggucacguuauuuacugagauucuuacuggcuucuucuaaugcuagcucacaacuuuuacuuuaauaaaaauuuaaccguguguguguguguguguguguguguguguguguuuucagauguccuuccguuccacugaaccuggccacaagucccagugguguuaucuccaccuccuagaccuccagggcagaaguacacagacuaauauauaccaaaguuagcauuccccccccaccccccuuucaugcuggcaauuucaacucacuguuguacaauagaugcuauccacugagcccagggcccaagucuggauggcaggcuuaugaucacaguacuaaggaggcagaagcaguuugggcuacauacugaaacccugcuggaaaauguuaaaaacuuagaacaaaaggcaaccccccacgcccuuuguuuggauuuuucaagacaggguuuuucuguauagccuuggaacggucuuggaacucacucuguagaccaggcugacuuuaaggucacagagaucugccugccucugccucccaagcacugagauuaaaggugugcagcaccaccaccagacugacuuacuaaaaugugaguaaacuacauuacuaugcaucuguaaucccaacacuuaugaggaccaggaguucauagcaacuucugcaggagucccacucuaucucaaacaagaaacaaauuuuuggucaaaaaagacagggcuugagguuagccuuggcaauacaggaaaaaaauaccuaucucaauaagagaaaaagaaauuaagaagaguuuaaaaaauaauuauaaaugacuguucauuaggcugcacccucacucgaagaauucuggcagcugauguuacugacagggaguccuuuucuuaaauccuguagccacuguuaaacuguacauguuccaguaaauaauccucauucaugcaagcaauccuaauucaagcaguauaucacaaacaccucuaccacaaaaaugauaaauuugaaaagaauuuaaaaggaagugguacaaaagguaaugagggugaaaaaaaaaaccauuaaaauacauuacacacuaugaaugaaauugucagaauaaaagauaugauucagauuagaguggaucaguacucaccuuuaucaauaugaacuucuaaaauuuucuucucucgaacuauuuuucuuccauugcagcuuuuacaucugucuuuuggacugaugcguucuccaugacccuggcacuccaugcacacugacugaauuugcugaaccauuccugguccaaucugaugaauccuuaucugcauaccugucccccggcaguugggacagcacucuacugcuccuuucuuaccaccucggccuagacgguuuuaaaagaaacuuauaaaacuuagcaguaauuaagagucuaacuccuuaguauuuaaggucuuauggacugaaguccuaaaauggacaauucagauaaauuaauauucuuuguaagucuaagagaaaaacaaacaaacaaacaagguaggcaaauuaugaaucuccaaaguucaccagaggaaggugagaaguuuugaauuaugguuuaaauaagacacauggucagcaaaagcagcuguguuggggagugaggugaaggaaggcaugucuuuagauaugaaaaugcccacagaugucagagcaugcacucaggauuuuuggcucagacaggggagagaagaggagauauaggaagaaaagggcaaggccuagagaacuggcucacuaacuuaaagauuaagauuggcugcuuuuccagagggccugggguugcuccccagcaccacaugguggcucacaacucuccucuuuaacucuaguuccagguggaucugauacccucuucuggcuuccacagguacaacaugcagcaguagagauaaacacacaaaaaggcaaaacaaaggacauugugugaaguaguggugguaguaguggaguguuaagccuuuuuagucagcucaaaguaggcaguccuaacgguaaagaucucugcaagcauuucacuuucagaacacuuuaagggaucagugagauggggcaguaacuccaaaauaccuuguaucacaaaauagcuuguacauauguguucccacagcauuuuuaaauugagacauaguuuuacugaccuccuaagagaucuaacauggauuacuaugccugggaacagggccauccuuuuuaaaaaaaaaaaaaaaaggguagccaaaaugcuguacauucaacaccaggaggcacucaggaauuggagacaggaguuuuaguuaagaggucugccuggaugaaacuggucuuauuaaaaacaaaaacaacaaaaacaaaaugaaaaacaaaacuuaaaucaaguuaguuucaaaaagaagcuuauuugagacagaucagaguuugaaaaacauuugguuuggucaaaccaagucugaccaaccccaguuugauuuuuaaggcaugcauaguugaagaaaaaaaaaaaaaaaaaaaacaaaccaaccucauuacugcaaugcaauuucugaccucucaacacaacacaacaugcauauaaauguacaaagcauugcuuuuuaaaaaaaaaaaaaaguuguugcuuaggaucuacacaggauugggcccaucaauguguugucauaaaggagcugaugacaaagccucaucccugaagagacauuuucuucuacauguagccacuaauucuacuauaccauuucuacuacauguagccacuaauucuggugccuguccuuugggaacaauuccucauccacauuccuguaagcaacucuaaugggacucacugggccaucaaaccacgggcauacagaagaauaguaaggaaaaggaguuggagaagagaauaaugaaaauucuauacagacaugaguaugucacagcaaagccauuacauuucucuuuguagaagauucagcuguuuuuagugcugcacuccaacuuuaucagggaagucauggggaccugguacucagaaaguugaagaaagauaaaaggccagcuuacaucuacaaaggccuauccucauaaacaacccagcuaacaacacccaacacuuaggaacccuuaccuucacauuugucacaaaucacauucuuuugcagagccaguuuucuuguugcaccauuauauaagucuucuaaggucacugagagcugaugaacaacauuuuuaccuagaauaaaacacugcucauuaaacacccaucuguaacguuucuuuguugaaggcacuauaaaaauggcaaaggauaauggaagaccagccucaaacuauacaucuuuuugagcuauacucauauacaacacucaucuaaucacuugauuuucaaacuaaucuaaucauaaaugaggaaaauuaugugagcaguucaucuaucugccuaagaacacagaggcccucucagaaauccagcaauuaaaauacuacccuuaaaagucacucaauguucaggcacauuucacaaugcuaagcauggaucccuuugaagguuuuacuuauuaggcauuauuaagcaacauggcuaguuacuuaauccaaacauucuuuagcacaguaaauucuuucuaaucaagauuggcuggagaagccaauauugagacacuacugaaauagcaauuucuacuucaguuucaauaguuuuuauugcuaggcuagcacugguugucucaaauuucccaggccuuuuguuauauauuauacaguccaacagaacuuucuguagcaauggacacauuuuacauguacaauacuagauacaauuuuaagugugguggcuacuacagcugcagagaaauuuuucccucuaaauuaaucucaucuuaaagacccauaucuggcuagagcaaaagauugccacauagccgaaguagguugguugagaucacauaaggacagccagguuagagaaaugaaaucaccugucaacgguuaauaagucccuagcuggugauccuuccccuaggacuuuauccacggcccgccacgagcauugccugauuaccaaagaaagucccaauccuuucugaauauccgaauauucuuacucuuuaaguaaggaguuaaaauuaaagucacgacauugugcugcuuucucauuuucacuuuguaagcaaguagguucucacaaauugaaaguccgagcuuucucaacuuuauacagaguacagaaaggaaaaagcaagcuucuggaaacugacggaguccauucuccaaagcagcacaguuaacaaaagcccucaaacucaucuaagccaaagucagucuaccuuucuguagcucauaccaucuuauggcugagcaggccgacugcgauuauagguugguuuuuuaaauauguuuaugugaaaaccaagaggccagaagaagcagcugcugguccccuggagcuggaguuucaggcaguggugagccagcuaucgagugugggugugggaaacagaaccuggaucuucuacaaggaauggcaaaugcucuugacuuaaucacugagcaguuucucaggcccacagguuaauuguucuaaaaacauaguaaacaguuuuuccaagucccuuuaaggagcaaagugaaauuuaauggccugccuauuuguucuagaacugugccuaugaacuaguuuauauuaacuauauauacugagaacaaagugcuauuuuacccuucaauacugucuucccauagacaucuuuuggccaaacacuaaacacauuaagcugagcuagcagagcugaaacaagagucaacagcagcagcuaucugcagacaaugagcuuuucucaggcucugcuugcucaggguuacuuuucuaacagaaagggccacugcacuuaccacuggguucuaagagcaggugguauuauccaagggaggacagggcuuagaaaccuaaguuaguacacuuuguuacccccacuguuugggaaucuaugggguuaguuauaccugcuuuuuggcuuagcuauuuuuuaguuacagaaaaucucaaugacaccagaagucaaagacaguucacggacagaguguaacaucauaccaacguguaaacaagcauuugaauaaauucucaagucuuuuuuuuccgcagcaguuauuucguucuagcugcagguaagccagauuuuucuuaccucuccuuucucuuugcauucuuccuccuccuccaaagaacauaucaaagauauccaugggugagccaaaaccaccaccugcuccgcccucuuuaaucgccugcuccccuccuuuaucauauaguucccuuuuuuuggaaucagcaagaacuucauaagcuugagaaaucuguuuaaacuguuucagaaaaggacaucccauuagaaacaacuguuacaaagcacagcuacgguagacuuuaaggcacgaacagaaagauacacacacugcaacacugcugcugagcuguuugccugugcccuuaccuuuuccccuucauuuggauucuuaucagggugguacuucaaggccaauuuucuauaugccuuuuucaauucuuccuggguggcauuggguuuuacccccaaaacaucguaguaagugguuucuuucaccauuuuuuacagccugaaaccagaaaaugguaauuuuaaaccagcuuuaaacuuuuguagaaaagauccaacugcuucugccuccugagcacugggaucaaaggugugcgccacgacuggcucuuaacggguagucuuuaacuaccagagcuaaagcaaucuguucuuuugcauuuauuucauacuaauacagccuucccuacgcgucuuaaaagguaaaaaaaaauuccugauaugauucagcuguaaacucgaacagauuaaaauauagauuucagggaacgcgaaggaaagccucucucgcagcugguucagacucuacugcacuaacacaugaauuauuuggcuucuuccgguuuccuuuccccagagguuuugcuaguaacccacagcagcacugauagguuccguccacugguuaguacauuaccgcugccuuuguacaucugauaaaggccauacccucgccggaaagcgacacuggacucccggggguggaggaguggcuuaggagaccggcuccagggagcaggugcccgggccccgucgccauccugcuccugcucgcucgcagcuuacccacucucgccccgcaggccuggaagcuggcucgcccucuggguuucccgggccccccggcgccgaccguuaaggcuuccuuccuuucucccucccacccugaucgaaaaggcggaggggggggggaggucgaaccucaacaaagagagggaggagagccaggagaagcgcaagccgcagccuccgcccggcuccucccgcagccccucaccccugccuugcuccgcgcgugcgcagcgcugcccacccggcccgggcggcggagcgcggggguacgcagcaaggagcaugaggcgggaggccaauuggcuugggccuuggaccuccucgaggcgugcgggcgggcagggcgccgggcauucccggcagccuuccgaagcccgaggccggcucaaggaacccgcaguccccgcccacgcgggaccaaccgccuccggcugcgccuuccccggcugucugggguccagaccgcacgccgcgaccgagggaggccggagacucaccggugagcgggccggcgccggagagcggaaaggagcggagcacagcgcagcucagccacacgcugcuccuccaccacccaccgagcguucuggaaaguuccgcccggcccgccgcagccgaccucuuuuguagccgagccccggcgcgucacuugccggaagucccgccccucgccgcugccaccgccccucgguuaccugggcaacggcgcgggggcgggaaguggcugcgcccaagggccuuguggggguggacucaagcccggguucccgagccucguagaauuuucuagaggcuuuuuuucuuauugcgaggaaccagagugcggaagucuugagguggagaggucaugucccagagcccguaagccggggacgagugcuucaggcguugugcgcgcugugcugaaggggauugguggaacccagcccuggcugcgagucugauuuucugcagcuccagcuccuuagcucugagccuugcg

SEQ ID NO: 1835 - RNA, 696 nt, Mus musculus
auucuuuuuuuuuuuuuuuuuuuuuuuuuuuuuuuuuuuuuuuuaaguuaggguccuuuauuggggcagaugggaaaugagaaacagaugucuucagggucugagggaaagccuagagcagagaagccuucauccugggagaaagaacagaucagcagcuuaugaaguuguuagggagugcccaggggaauggugaaggagagguaguccccaagagcgccccagcggggccgguagaucuggaagauggugauccagguggcgagaaugaucacccagaagaggaagcccacagcugagcgccaaacauagccuuugauuuggcucugcucuguguaggcuggggcgaggaacgccucucugaagaaccagaaaauguugacuaaccaaagaaaaggcaggaacgcaaauccaccaagauaguacuuccggcacagguucaacuucuccucauuggauacccgcuccaaguucauaguugcgcuggagcccggugguccuaagggucugcagagcaagacccaaaugacaggcgcaagaucacgagcaaccacgccccagugcgguuuaucccuucugccuggauuccuuugcgggagauuugcgggagaugccgcaguuuucaguggaguuuguugucgauuuuguuuuucuucuccugcccagcccccccacccccuccgcuccccagugccu

SEQ ID NO: 1836 - RNA, 696 nt, Mus musculus
aggcacuggggagcggagggggugggggggcugggcaggagaagaaaaacaaaaucgacaacaaacuccacugaaaacugcggcaucucccgcaaaucucccgcaaaggaauccaggcagaagggauaaaccgcacuggggcgugguugcucgugaucuugcgccugucauuugggucuugcucugcagacccuuaggaccaccgggcuccagcgcaacuaugaacuuggagcggguauccaaugaggagaaguugaaccugugccggaaguacuaucuugguggauuugcguuccugccuuuucuuugguuagucaacauuuucugguucuucagagaggcguuccucgccccagccuacacagagcagagccaaaucaaaggcuauguuuggcgcucagcugugggcuuccucuucugggugaucauucucgccaccuggaucaccaucuuccagaucuaccggccccgcuggggcgcucuuggggacuaccucuccuucaccauuccccugggcacucccuaacaacuucauaagcugcugaucuguucuuucucccaggaugaaggcuucucugcucuaggcuuucccucagacccugaagacaucuguuucucauuucccaucugccccaauaaaggacccuaacuuaaaaaaaaaaaaaaaaaaaaaaaaaaaaaaaaaaaaaaaagaau

SEQ ID NO: 1837 - RNA, 11344 nt, Mus musculus
cccggcccacacuugacugcagucacauagcucacaagcagcauggcuaugcaucuguggcuggucacccugaccuugguuccccuccuuggcauggacaggggugagugggcagaacuuggucucucugaagcuugaucuuagggggugagcuugggugugggggcagaggcaaggccaggagcuuccugugaggccuggccuuucugcauagcucuucugucuguauucauccuaccauaguaggcaaaacacugggagaaaagggauggguucaguccugacucuggaccagaaccugccaaguucucaucccuugagucuguaaaguaggaugccauuucaguuugaagaugucuugagcaauuauggacuggaggcugagaagauagaaggaacagucaggccccagguugacugugggguggugagugcuaagagagacuuguuccaggcccucagggcccuguucuguuuugacaaggugcaguaggggacccaagacaaccacuuaagcauauagugggggccuugggugguuagacauauaccagagguggacuuccucaaggccaggagcaucucagcagucucgaaacugcugucagauacuuuucuuguccuuuaacauagaaaggagcagaacaagaaaagcaccgucccuacagaucuuaaacuuggugugugggugggugauagacaaugaauaguguacaagaauauggcaaaggcuaagaaaagcauggagcugugugauguggguugggagggaacugcaguguuaaaucagggagggggugucucuuagaugcagguuuggggagagcuugaagaaggugagggggugaagguauuuuggacaagaauguucugguggaggaaccagccaauacaagggcccugagguagaagcauguuagaguguuugaggugcuguguggcuguaggggggugaagggcaugguacagagaaagaagacaggagaggaggggagggggauggaaggaauggaaaggugagguggggagaggcagcugagagcuauguuagacaaagucuugggagccaaugugagaaccuuuuccucagagugaagugggagccagugucaggcuuggaguggaguuaaaccuuuaaagaauguucuagcuuguauggugaggacaaacagaacagggaagcagagaagcccauugggaugaaguaggcaagagucacauuauaaagcagugugcagcaggaccguagggccauugacuccaugccccacacugcacugcaccucgugcuggucacaucugggagcugggugauuaggaaggagccugcagucucuggucagacacaggcugccuucccccaugccuguuccccauuucccaagcaccuccuccuccagugggaauguuaagcagccugccuugaagguccuuguacacauuucagauuccagccuugguugaaugaugaagggugcaccugggucaaggcaagggugccugggguuaaagacaauguuucacaccccuaggaagcaauucugacuguguaagguucuggauucucccgcaacacacuucagggcucaauuccugaauauucacuggaugaggcauugauggggagucacagggagccccaagaaacacgaguucauagggaggcagggguggcccagugagugagacaacauuugucuuugugacaaagcucaaauccagguuuuuucaaggaacugugggggaccacuguagggaaagcuucugagccuugggaggaugcaugaccacauaggaggagacuggggguagggccuaagaugcuaugaccucauagaaggagacugggggguggggcuugagaugcuaugaccucauaggaggagacugggggugaggcaucucaggcagcaggucugcaggagucagggaagccacugcuucaggacaaugagcaaugagggacccuugcguccuagggacauugaggacuauaauagauagcaaggccuagaagcaaggcuggagggggggggggucaguuuacacaggcccugaacauguaacuguggagugcugguucagagggagcugagggacagugauaggagccagagaaggggcauccugccuuuuaaauguuugacauuucuguucugcuauauagcugggucucaccugggauuucuaauccuucugcccgccccccaagcuaggauuauaagaccuccaccaccaggcuuacucagccuuuguaaacgcuuuucucucaauaguuaucggccauggaacacaugguguuucuauucaguacgucuuacagaugagccaugacaaugcacacaccuuuauguuccaaaccucuaucaagauacagaacuuggggacuggagagauggcucagcgguuaagagcacugauugcucuuccagagguccugaguucaauucccagcaaccacauggugguucauaaccaucuguaauaaaacuauauuccuucuucuggugugcauagagacagaacacuuaaaauacaugaauaagauacagaacccagcugugcaaagugguacacuccugugaucccaggaauugaggcagaagcagcuuuuugcuguuuauuucuguguuguuuugagacaggguccuacucuguagcccuggcugaucuggaacucacucugcgcaugguccaggcuggccucgaacuuguaguaaucccccugaucugccucuugaguguguuguuucucuugcugugcaguacuccacuguguguauauaaguuucacacuuuagccguucuccugugggaggacauucagcucacuuuuagcuaugaccaaaaagcuugagcaauuuugugacaagguuagauuuacauuuugaucucccauugccaagaugacagagcauaccagggcgauaguuuuaguccccuuuuucucucugccugggaacucuucaagaaaaggucaaaucaaccaagcuugcaguagaugugggacucuggugcugggggcagcuuccuuuacaaccacaguuuucugccccauacagaaacauaguccacuuccccgcagccucuuguacugccaggcuccucaacaugagguggaaagagcucaucucuccaccaggcucuggacagcucugcagaggcauccagaagcagccauucuuccucccaccugggccuuagacacagcucaaggucucucgucuacucgccaugcccaaggucacacagcuuuguucacauccuguaagaggcucagccaagccuucugggcaauaacugugcuuggggagucagacuugggauggcagaucuguguguaaguccuagcucugccuuaucggaucaugucauucgagcucucugagcccuucacaggucagucaagcacuccagcaggcagaccugagccugcauacauuaaggagaagugugggaguacuaccuacccagagugagggauuuggcugaguguaaccaugugaccgguggcccugcagggagcuuuggagcuguguggcaccucagcauguaccagagacaugaggacuggguuuugcagccaccccauugucagaggauaucuaugauauggaggcaagguuggauaaggcagcuccgauccccaagguuaauuccuaggaagggacugauugcgaacagcuaguacucccagcagcucggguugguaccuuaggccugugcuggacucuggcucuuccuucuccuccauucuuccuucugcuuggguggcgagagguguagggaauaacagagacaugcauuugcaguguccagcauccagcuaacugcugauuuuuuuguauuauuauuauuauuauuugccaggacauaaaauacuagccuuucugucuuuauucauguaaccuaacaggaugucagcuuucugguaguccugccaucugagucugucuaccuuuccuggagaaguccagauugacagacagugcugcagacccucuuggucccuugucugcguggaaugggucucuagugcaggugggcaaggagucggugggaauugacagacuugacacaaaggaguguggaucugaauguaauuugucaaauagagcaucaauuuuuuuauacagaagaaaauagggaaguugggugacacaccggcaagguacaaagagguuacucgauucuuacacaaaacagaggaaugcaaacauggaagaacuggcaggaaccaacuggcauaaaauucaauguuaacaacugggauuagaaacagcuccacuuaaucuuagaagccaggggcaagggcuucgugcccuugccauaguuccuacucuagucuauuguauaguccacccccuaagccauuguaaauacuuguguauagguguaacucagcuaucuauaguucuaaguaucuacucugguuccucuuuaggucgcaaacuuccuucuuccuagacaaugguaaauuucuguguaaggcagugacuuagcuauccaugcccaaggugggaucaaggacugccuagaaucuaacuaagcuauaugucaaaauaucaauccuuaggagcacuuguaauaaagcaauauuaggggaaagcacucagauccguuuaccaacuaaagcaaggacauuggagcauucuuuauacaggaugccacgauuccaggagacuaaguuucugugaacuuuuagccucgggacagcgcccagguuuucggggccugucgagcuugucacuacuggaguggauguagcaagacagugcuugggccaggugcccuagagcaggagggguccccagacucugaccuggcagccagagcugacagcaucuugcuuuguucuuuuuguccuccagaacugauggugucagcugggagccuuguuuuccccagaaugguaaggacaucacucuacaagaguccucucauccacucuaggacaucugcccuucugcugacaccuacaguggucccaagguggccaagguggcccccugcaucugaauuucccucagaauuccucuuccagacugaguaggcccaagcuccaagccaggucucagccaucaggaucugccucaauccuguucuccaaggcccuuuucucuauuggucccugucacuuagcacaggugaucugugaagcacaggacaggccacagguucaggccaaagaggucacacccagcacacggaaggcccaguggaugucgccuuuaaccaagagcaucuccucaucccuucacucuaagugggcaaacaccaagcugcccugccagauuccaccuugggucucacacccccagugacaagugguucguuaguccacccaaacccagccucacuuacuuggucccaaagaaccagauacucuauauugccaacucagcuaauccucgugagaagaacacuguuaugcauccauuuucacugaggaggaagcuggaaacagcucacccaaguuuacaaagccucaguggcugauccgggcucucuggagugcaggcuuccucaggggcugaucugggcucucuggagugcagacuucaguucuguuguuuuugaagcagggccuuguguggcagaggcugaccuugugacccuccuccuuccacguucuaacugcugggcucacaguugugcaccaccacgcggaacacuagagaauggguuuccaccacuccccuacacugcccccaccccuucuuugauccaggcuccaaccccagucuuuagucaguucagccugagaaccuuucaguuagaaacugauuaagcuguaagucccacuuucuucagccuucccacuaagacccaaaagaccaugcugggggcugggagagcucagucaguaacugcuugccuugcaaaugugaagaccugagcuugaccucuugcauccaucuaacccuggugcuugugaagcagagguaguguggugguuuguguaugcccagggaguggcacuauuuggaaguguggccuuguuggaauagguaugcugcuuugaguuugggcuuuaagacccucaucccagcugccuagaaaucaguguccuacuagcagccuucagaugaagauguagaacuuucagcuccucuuguaccaugccugucuggaugcugccaugcuucugccuuuaugacaauggauugaaccucugaaccuguaaaccagccccaauuaaauguugucauucaugagacuuaccuagaucauggugucuguucacagcaguaaaacccuaacuaagacagaaauuaguaccaggagugggauauugcugugauuggccugaccaagcuuuuguuuggaagaauguggauuuggggacuuuggauuuggaacgcaguagaaugcuuuaaguggggcuugaugggcuacucuaguaggaauauggaagacuuuguugcugagagugauuugaacugugcagaacuggcccaaaaaguuucagugaagaagaauuucaguauguggccuagagacuguuuuugugguauuuuagugaagaaugugucugcuuuuugcccuugucugaaaagucuaccugaggcuaagguaaagagauuuauauuaauugcauugacaaaggaagucucaaaaaagccuaucagagacuuugcucucugguuaagucucaugaagagcauuuuaaacaagcauagcaagcuuagaaaagaaaaaauauaaaauauauggcucgaguauuaaaggggcaucaggaagugaaaugaagcugaagccuguguucaauauuaaacugaauuaagggaguggugaccuuggggcaagaucccacccagcuaaguuuccaggcuugguggcacaagccuuuaaucccagaagacagacacaagccugauacagagcaaguuucaaguagagaaaagcuuaaaucuagaugugguguuacaugcauucaggagacacagacauccagaucucugaguucaaggucaaucugugagcaaguuucaggagagccaagcuaggcaaugugaaggaguuggagaacagaaagcugguggugauauaaaagaacaaggaggcauguucuagcuccuacaagcagcagaagucggcagcuucagccacguggcucuggcuuuauaaucaagaggaggagauuccugggacaauugaugcugguuagcuggagcugagaaauuaaccaugauuaagaagagaucagcaucacugaggcaaaaucuucugggaaguguuuucugagaacacagcuguguucuaaagauagcccagguuguaccuugugcugcagcuguacuugguaauguguaagagucacgcagggguugcugguuuugaagauaugaaggggucauguagaacagcugaggcuuggcacugugagaggccauggaaggccauuggugaaggugcagccucacuugcaguugacgucccaggacugaucagguugagguuuggcaccaugaagagagccuaugagaggcuaucagugaagccuaguuggaguggaacaccccaguguauuggagaugccaguaccaugggaugaucaccaagaacagcgcagcaguggaguggagucaaccagagagccuagagugcuacagagggcagagauggagaagugacccaaguccuuuugaggagcccagaagaucauguguggaucccagacacuggaacaagaagcuguaacuauugaaguugccuuggacaccccaagauguuggagaugccagagccauggaauaucugcugaagaaagcuccuaacagggaguggaaccagcccaggagaaagaaguuuguugcagucaacaaagaugaaaaaggaguggagaucugaagaccccuuugacaccagacauggagaugcagaguuuggaguuugcccagcugguuuccugucuugcuuuggggauuacaguuaagugauuggaugaaucucagaagagaccuugaacuuuggacuuuuaacauuguugagacugcuauagacuacgggagcuuuggaaguggacuaaauguauuuugcauuaugcuauauuuagguaugacacccacccccagacucuauauuugaacaagccuauggggggccaggagguggaauauaguggcuugaauaugccuagcccagggaauggcacuauuuggaagugugacccugugggaguaggugugucacuguaggugugggcuuuaaaacccucauuuuagcugccuagaagccaguguucucuuagcagccuucagaugaagauguagaacucucugcuccuccugcaccaugccugccuggaugcugccaugcugccucccuugaugaugcuggacugacccucugaaccugugacccagcccuaauuaaauguuguccuuggucauggugucuguucacaccaguaaaacccuaacuaagacagauaggggcuugcuggacaacuggccuagccccuugguaaguuccagacuaugagaaccugucuggaaaaaacgaggugaguggcucccaaggaagcaguuccaggguucaguggccucugcauacaugcacacacauaugcacacauguacgcauuuccuccccaaccccccacguacauaauaaagaccauauuggccuuggucauuucaggagccccuagggagcaagacgcuuccuaggaaugauggauggcuguuuacuaggaucauaguuggaccaggaacagaguuucuaguuacauccacugagaaguaugugaaccagggagcucuggggcacaaguuucuuacacacacacacacacacacacacacacacacgcacgcacgcacgcacgcacacgcacacacacacacacacagcucaacagacauaggcucaaacuuauguauauacaucccaccacgugcacacagacaagcaaacauaccauggaguccugagucccgaguagcugguuucccguuccaagcagagcccccgggccuaugaccacuagccgauucccccacuuucucuguuuuccacagcccuucugugagcacauggcugagcuuccaaacuguccccagacacccaaccugaucuguggcacggaugggcucacauaugaaaaugaaugccaccuuugccugacccggauguaaguuucuucccauccgacacgcuuggauggcccucucucuggugcgugcuugucugaaaggagcaggguuugaccucaucuuccuucccacacugacauggccagaaaagaguccuuagcuaucugucuaccagaaggagcuaaguguaucucaaagcaagcacaggucccaggucaaaagccagaaacugauaggagccagcucacccugcagcagaaguagaagccgcuagaacaaaacaaaacaaaaacaaaaaccaggaaauacaauuccaaguaggggaaagggaauuuggaaaggucuauaaaagaaaguuaguuguuuuuguuugguugguugguuuuuuguggguuuuuguucgguuuuucgagacaggguuucucuguguagccuuggcuguccuggaacucacucuguagaccagguuguccucgaacucagaaauccuccugccucugccucccaagugcuaggauuaaaggcaugagucaccauugccugacuuuaaaaaaaauuuuuuuuuugaaaguuaguuuuugcuuagggaaaucaggaaacuggauauaguagaauguuaagugggugagaggucaugagaugaauagaagcuagacugagaucuugguacauuaauuagaucaccuacuuggucucgguuuccucacugguaaaauuaucagugagacugagagccugguaggaucagggagauauccauggcaauuggaagaaagauaagaugauaggguccuggcucugaaaaagccauaccaaacuucaugcguaggagacauuugggggaagaacggacaggcucagacuacgacuggaugugagaggaaugagaaugagagcaucugcccucccucccucccucccucccucccucccucccucccucccucccuccccuucccuuccucuuucugaaacagggucuugcuauugccgggucuguguaccgcugcccuggcugcugcuguugcgcuggcugggcuaagccgagccaagauggcggagggcuggcuagugagcagagugcagaggaccuucuggagaccauuuucuucccaggcagugauacagcucuugugugacagaugcucucagacaaugaguaauucgcauacacauuuacuccucugaauuggaucuuauauaggauccuaguuuuggaguggguuggggucugacagcagguccuuccuguuggcuuggucugagauuuuagggaugccucaucuacauugggggcucugucccuacgugacuuauggccacgauucuauggggguuggggagcuguggcuaugugucagggaucuggugccagggagcaggcaaagcuccuaucgucccuucaggguccccagcgcuucaaucccuuguuugacuuucccaagcuuccucucguguccacugccccacaugcuauggcccagauucauuugagcucaugguuugguuugguuugaguacuagggauugaacacaggaccucccucaugcaugguuagcuacaucugcauccuuuauuuuuaaacagggccugguuaaguugccuaagucuugaacucauuuuauaaaguucagaaaggcacugaaguuauaagcuuuugcccagccuccugaguaggagauccccugcgguuccaggccuaguacaugccacuuauggccuuggguggcuagugguaucgcuugcucagauggggggcuauaagggcagccuugggagucagugauguuuguggacaguugucuucuggcauaucuugcuggggccaugcuauagguccaagaacagacaggacagagguuugggcagccaucagcaagcagugguagcugaaaccccagaaaccugcaaguucucagaguguuauguaagaggcucaguguauaggggugugcuaucagaucccugaaucugcuucacaucugcccauuucgaggaggggcucagcagcaaaucuagaugaacuggacacggguuuguuuuuaacgaucuuuugcaguuccuacagucaauggccucauucuuaucuccuuugauucuaggaaaaccaugaaggacauucaaaucaugaaggauggccaaugcugagcucagaggugcacucaagccaugaaacuucaugcuggagaacagugaugccccagaggcuaugacaugaaauaaaagaugcagcccaagcuag

SEQ ID NO: 1838 - RNA, 2845 nt, Mus musculus
ucacacuuucaguucagagauuuccuccucacuccguauguaggcuuagccacagcaaacagagauggcgcugaagucaacacagcaagaagugaagcagguacaggugacaagcggcggguaagaaaacuuggaagccacaggaaagugugugggcugcccugauuggagccaaguaucuccuuuagaggaggaccccggggcuaaagccaggcggacaagauucucaaagcgaggcggaguuuucuaguuagguggggguucccagcuggcuggugccugcagggaucuccagcccaagaaaucugcauagaccaccaguagggggcgccaguacaagccucauguagaagggggcagagucugaggguuaagaguugcccccaacacuuacccccaccccaguugucacacgugguggggaggggguucaggcuggcugcugcaggaaagaaagacuugaggcuuguuaugcccaggcuaacugggccagguugccccgaggugcuaacagccuggaaguagagacaggaccaucuucuccuaggaucuuggaggcgugaauucaugcagaugccuaagagacucuccccauucuacuugcagacaggcugcucuccagcauaaacgauuucucuuccaccgagggcagagaggacucgggucuuucagcauccaguuaucgugcacuugcuggguucccucugaaggaaggauccuggaaucccuguucccaaagagcucaggagguccaguguccuuaaaaggcagccugaucaggccuugucacaccuggaucccccacaacaguccagugauuuugagccagcugccagcugauuacacuggagauuggagagugccugaggcugccggaccucuugacuaugccagggguucaagcugagaggccaggcugcaaagggaagggcuggucggccagccccacaugcuggcaaucuaucucacugccugggaaaugagcauauaacauccuacugcuggacucagggucagggacuggcagcagacucuugcucaauagucucucaccuagcacugaaaacuaccaggcaccuaccacacuccauagcaacucaaucuacucugccagcauuggugccgauacccacauaagucuugcacuaaaacucaccaguacaaaugaaagggcugagcugcaguuaagcucacaggaucccgucuacaaagccugagccacaaaggacucaccacacagacacaggaguaccccugaauaaggaugccuccaacaagcuagcacaggcuccggccaggaggcuccuaugcugcuccccugcucucgcucuuaguccaucgagagagagagagggggggggggagagagaaagagagagagagaggauggaucuaggcguaggacucaucaggcaucuuacaugcuguguaaguaagcgcucuaucucugagaugcaugcucaggcuuuucucccauccuuucaugagggugaaagucccucaaccugacuccucugcuauuccacuuacucugacagaaaaaaucucuacucuuguuagauccuuuauuucccggggggggggggggcguuuuagccaggugugguagguagcauucauuuauaaacucaacacuucggaagugagucagguccaagguuauccuuagcugcacaguaagcuugggcuacaugaguccuucucucagaaaaacaaaaagcuuuauucuggaagacuuuuuaaauugauuuagguaaaauucaaaggaaggcugaggauauagcucaguugguagaguggaggcaggaaggucaccccuuggcuacauagcaaauucgaggcuagccugggcuaaaugauaucuaucauaaauagauagauagauagauagauagauagauagaugauagauagauagauaaagucaaggaaauuaucagaugguguaagauaagaagaugggggaacuugacauggaaggaccaggcugacauccugaauccacuauccacucacacugaaugugaagcagacggacuugugaggcuugcaaaaguaucauuuagucagcaaaguggagauacuagauguuacucucuaguccugcucucucccacagaggagcuaccuccccuucagagccucuguacagcaaauggagacagugcagagauccaugggcggacuguguggcacacagccccagcagauacaucuauagcacugcuccugcaucuguggcucagggaacaucgagggagagggggccuaaagaucguaggugcuguggucuuccgugaaacugucuuuccuagaaauggcuauagcagcaugguaaugugaagagggaaacuucaugggguccugugaugguuugaauaaacucagcucccaggaaagggcacuuccagaaaguauggccuuguaggggaagugugucacuguguaggcaggcuuugagguacgaagcucaggcucugcccugugcaggagacccuccuccuagcuacccguaagacagucucuccucucugccuucagaucaagaugcagaacucucagcuccuccagcaccgugucugccugcacacuugccaugcuuccugccaugaugauaauggacugaaccucugaaaguguaaacuggccccaauuaaauguaacucauaagaguugccuugggggcuggugagauggcucaguggguaagagcacccgacugcucuuccgaagguccggaguucaaaucucagcaaccacaugguggcucacaaccaucuguaacaagaucugacgcccucuucuggagugucugaagacagcuacaguguacuuacauauaaua

SEQ ID NO: 1839 - RNA, 10843 nt, Mus musculus
uaagaauuauuuauuuuauguauaugaauacauuguagcuaucuuuagacacaccagaagagggcaucagaucccauuacagaugguugugagccaccaugugggugcuaggaagugaacucagaaccucuggaagagcagucagugcucauaacugcucuugaccacugagccaucucuccagcccuuguuuuuugagacagcauuuuucucuguguggcccugacuguucuggaacucacucuguaaaccaggcuagccuugaacucacgaaucugccugccuuugccucccaaguacuggaauucauccuuccaccacgugaauccaaggaugggacucaggcucaggcaccuuuaccugcugagccuuacugccacacccaucaggcuuuuaagauuccauuuucauaaaaacugggucuccauugcuuuuggucucaguagcuuugacuggccuccaauucagaauucacucugaggacgaacucagagagcugcuccugucccugccuccagaguguugggauuaaaggcgugauaccacuacacgccaucagucuuaggccuucuuucgucaccucgccugcucacagcauaguccacaggcucugacucugcuucucuguggccuugugguggugaccccagccucccagcuugggcuggggcuccccuuacacacagcucugcaagccucauucuaggugcugugagaaaccccaagucaccuaucugccugcgcucagcaugcucuguccucacagagcuuucucauagaccaggcugaaaucaagaggaaagacaagucagguacccagaaagacuuaagcaauuuaauuuuaaaucagaguucaggacaauagaaggugcauacugguaugcaugccugccaagugaacucgacaaggaauaaucgcauucacaguucacagaagggagagaggggugggggugagggcagggacuagguggggugcuauuugagcugagucuaaaaaaaaaaacagucaggauuaggggagaaaagcagggaguggcugccagaaggggauguggaucaggcugagaggaagcauccugccuaccucagaguuccaagagcaggcguauggcacaguaauggguaaugauaggcagcagcaaggagggggcaggacccagagaggccaggcugcagcgcccagcgcucucucucucuuggaccgggauccccucaacuccagccagcccugccuggucuguaucuuuucccacuguuccuacccucagggcacugugccuacugaauggguuccauucauacacacacagcucccucccacugcucagugcuggugcccugacccccaggaagggccacaaucuaaaggccagaagcagcaacagggaaaggcacgcugacaucuggacacauccguccugccagcgggaagaugaagauggagagaaaacaaaaaugaacaagaguucaggcugacucaagauggauaggcaaauggaucucguggauucaguucucucugagcuggcucugucuccuccucugggaauugggguggucagguguaggggacacaggacaccauggccccugccccagagcugaaacaucagaagaaucucacggggcuuucucuggggaugggggauucagugguucaucaggcguccaucugcacugagaguggcuaugccgcugaccugcugcugcacagauccaacacuugucccaaggcgagaaucacacaguccaccucucacuucgggccucuacagccuguaccaggccuucacccagcacagcaaaguccuccaagauugcuucuauguugggcaacaucacaagcuccccaccuugagacaccaccaugcgucccuuuaugcuggaggccugaagaaccagagagcaaauuugaguugaagugucacaaaggcauaccaugagcugcaggguuagggcagugucaaucgauauaugagcuccauacauacacuugacccagagccacccagugaaccacauguacacagcuggcagcacaagacagggucacuggccagcauaccuuaaagggcuggggcuggaagcugcugggcuuccagaggacaccaaucaccucuccaccaugcuggucauagaagaagagagccagaucuucaaaggccuccuagaaaggacagaauggaaucaagauugcccgaugaccuccuccagggcugcagcuccacagaacacuccccaggccagccaguccuguaagaacuuacccggagcugugccagauagagcugaggggggucauagcccaggacaggcaucagagacgaaggcccuggcucagcgagcagaccacggcagaaggaagcaacuggagggucuacagcuuggcggugccggggaauguggcggggagucagguggaucagcacaucauacaugucgaaggguggccggaacacggucuacggaagccuuugaguuacccuuccacguacucauucccaggcauccagccauccacuauaggccguaugccccaggaacacgagaacagcaaaccccagggagaacagccagggccagcuugaguccagaaggaugcccaggauucccaccaggcuucacuaccaggcaccauggcagcuucaaagccuucuccauaugcagucucaccaaacagagcgagcaacuaggcaucgugagaagguucccugaacugcagacuucgggcccugggaguuacugagucagauccuuacccugauguccccaggcccccggggauccaucagcugcuucucuaggauagggagggcuucagccgccaggcucacgagcugcugaaggaucuggaacacagaaaaaucacaccaagacugaccaugcuucuggcuuagguugggccuacuuucuucuuugaguaaaauaaguaaguaaguaaacaaauaaauaauuuagggacagguaagggguagaaccugggcugaggguccauccuguguccacacagagcuucugcgguccugggggguaaugaugaccaugacugggaguuguguucgagcugccaggaaacuacuucgaauccccaccuguuccucagcuggagaugacaggggaggcuacgucagccucccuaaaagaccuuggucuuuccaccguguguguacccagcaacugcccaucacagggauuuuccaauacccucucccaaagaacaaagguuaugaaagggacaccacauucgaguuaguggggugggguguuuaucucccagcuucagccccgaggcagaguuuuccacugcuggucacccccagacuagucccuggccugccgaggccugcccaaggcucucacacaccugguggagaauuaggaaccugacaccuugcucucugcugggacccaagagcuccuaagguuacaaugggaaaccaacaaucccaccucccaggugcaggcacagucuaacuuccuggcuccccacacaagacucucaccuagaauucaagaagcuuuccuuugcucuccccuugcuccacagcccugaguaguaauuuuaucauggaccacauaggcaaagcucucuaagccagacuugauauagccucugccucuuccaucugacaauucucuuccccaagacagaccauuaggcuuagacaucugggaucuaggaggcuuccuggacgaacucacaggguguucaccugcuuacugugccaucuacacagggaaguucuuccaguggucugaccugaguccuaccacuuaccagucagcucaccguugagguugacaaugagaggguuguucuuccaaucaaagguagauaccaaguaaaggaaccgaagaaagccaaccugugggacgcugagcagauagaaagagaaagaaucugaggccugauguccccaaccccucagugagaagcaucugaaaacacccucuaucguguacucgccacccucccccaguuagaauaaagacugcaucacuuagagcaacuucccgagcgaggaaagcauccaggucauuaccugggaggggugaagggcucagggugcaggaagagugaagcggccagcagauccaggcucucgucagugaagcccucacccagaagcugggcacgcacccaccgcuuggccaggcgagccacccccgaguaggcuggguacugcugcuggagucugggggaggaagccuuggcagugagaccugggaacucagagagacccacauagggauggaccuaccgccagucgcucggccucugcccagcacugcccacaugggguacacaucucccaugcucuccuagcaaacgcccggaaguuauuacuaauguuacuaccaguucacaagggagguauuaugcugccuggccuccagagaaucugguagccagguaagcagaaugggggcaggaggccuacauccaagaagagcucacgaauguaaccuuacccaugcagggcacuggugagcagaggcaacagcuuggugucucucucaaggcggagggaggcaggugugucucucagggagaccaugcccucggggcuccgcaccucuuucaggaucuguggcucccgcugauaggccacucgaauccuaaacacgaacccauccuguggagagauguggcaaaggaaaugaaugucaagagcacuugggggugcgcugccaccuggaucccuggccccgcagaccacgaccgacaguuaucuuccuguagccccugaugucccuggagccuguucuguggugaucucucacccuguagcagccuaaccuugaggacauccguguguguggcaguggcgcagcacuguagucuaugcuccugggucagcaccuccgccaggcgcagcuggaaggcggcucggacccgcugcaccgcuucugcauccugaggccacugcccgcugcccuccaggugacaaaccacugaagaacagaaggggugagagaucugauuccgcagccugcugccuuccccacucucucccaaggacccucuuaccagucauaggcuccacauaggcugggcagggcuuauccggccggggcaacagugaggccagcucuuggaggcgguuauagaaggaguaggcaggacggacuggagcuggagggaaaaccuguggaagacaggacagugacuuugagagggagggacagcccagagaugggaggauggggcaggugugagugggggcacuaaccauaaaggacucccugccccccugcaccuuaccucuguguagcgcagcacugggugagcccccugaacggcagacacaguaagugggagacccuccagcccccagagcaggcggcugaggucaucauagcaacgcacagccaacgccaaggccuccucacccgugcuggagaucugaugaagagaagacacucaggaggaagucugggucuuaagaaaccccagcaccaccuuggaugcugccaugauucaggcuauggcaggaccggggcgcccccugcuggacacuaggagaugcaaccuggcuaggguagaaaggguucuccauccagucuugccauagcacuaacuaccccgcaaucacuggcuuagaccccaggcucuuaccucuuugggguuuuggaucaaugcaucaaggaagccacccacauacuggauacaggugucugggaugucagcauggcugaagaacacagauacaaugagggugucaggggcuaugccuaccgaaaauggcugcccugaccacagcagccuccuggugugaagacgcugauacucacagugcuaagaggugggugaccaccugaugaggaauaagacgcuucucaaacaaagauucugccucccagaccacagcuucccggauggcuccguccuggaaacgccugagcucugagcgggucccccagaacugacggaaaucagcagccuggagagaagcaaaggaugggaagagaggccaagaaagaaugagcuggggcguagcucagugauagagggauggacuaauaacgugcccaaagcccugagcucaaucccaagcacugcagacaggccucaacuuagguaucgugaggaagcuccacccacuccuccccacgggcaggcugggguuucacaccucaggcuugucagccucugggccaagaucaauaacacuggucagucccucgggccggaagagaaaucccagggucagggucccagcguccuugugcuucgggggaucuugguugauacuccacuguaggauguaaacagguugaugucaacccaaaggccccaagccugcuggaggcuaaccagcugggcagcacgcugugggucccuuuggacccuauauccagccaacuucccagucuacagggucucaccucugggacugggggccgagagugagccagcagaugcagccggcaccccagacccugcaccaaaauguugguuagugggcccagagcggcugaaacguaguccccuccguuauccugcagcucuggccaaagcuuuagcuggugacaggaugccugcaggcgacucaguggauggagacuggaggguacagggcaaaggggaccaaugagaacccacuagguccgugacuccuccucccuugugacccuacaccaccccaaacucacuggacaacguggucaaaagccuggaucauggguuugggagucaucaacagcagcugaaauccaucgucagcuuugcuguccagcaacgccauagacaguucugccucguacugcaccugggcacaggaugaggaggaaacacagcuguaacccucgcuggcugaaaggcucgcagcccgggucuacuucugccguucuggcacaggcacggcagccugagcggagacguauggaggauccgggaguaggaggaccuguugguaccugguuguaaguggaagcuguaacaucggcacagagguugaggcggccugauggguccacaaacacaaccgcgaaaagcugguggaauucagccagggugggcuggaggggcagagagaagccaaucaggguugaggucuaccugcaggcccauuagcacauaccugcccacguuacuuaacucaccaaggagggaucugagcugagagagaaacugauuccauugauugucagaucgguaguggcuggagugaaccagagaaagguagguauuguauuagaagguccuuuugggaccuggccacagcgauacccucccugccucccucagccuggguggcuacaacugccugccucagacucaguuuucuccucugucuggugacaagaaacuaacggagcucugguggaauaagagaacccccggggacaagcggaaccccuggccuguccacucuaguuaccuuacccagaaacugcaggacacuucucaggaccugguagccgcucauggugguauggaucuuucguuuagauaccaggaaggcaaccagcauggagaugaugaauccguuaaauccacccaggcccugaaagagaagcaugacuggacugagcucaggagcaacccuucccacaaagaggcgaggaaaccaggccacccacaacucaccuuguccaguucccgcugccucagccaaaccuucagaagugccacgccauccuucaggcccugggcagagcccagcacacuugccagcaagugcaugugggucuccagagcuacauccugcaggauccagguguuauagugggggguaggcggcucuacgcaaacaaauggagacuauuagaagagaaggcuccaccaaaccccugcccaccaacacauuucagcaccagugccugcucaccguaauccggacagcucugcccucgguaccaggcagagcgcacauuguucuuaguuggcagcaagcggcagggacggaagaaguccaagggagggcagggaagcaggcgcacaguaacuaggcgcucauccuucccuggguagagacauggaguagugagauucuacaacuccuaaaaucugaguggguccccuuagcacccccucauacuugggcacccaugacuucugaccuccuggccucgaggcuuccagacuugaagaccucauggcccccuccagauuuaccaucccauacugugcacuaagcccagagagugacucccaccauguggccgcagcagcagcgagggcuucagguggcauccacucauguaagagaagcguacgcugcugaagaggggauccugggccaggugguaagcuaagugggccagguaaagggcucgcuugcggaaguaacgcugguucagcccgucuuuguccuguaagauuuccuggaggaaucagggaagagagaaggucagacacauaaguguucauggaacuggggacuaggucaaagcuaggcuuaagucccaggaagaacacacccaauauucagacaaagggcacaaagucccaaagggacccuuugcugauccucuaauagcccccaaaccaugggccuuacccugggcauggucacugccacguccacauugauaucuggucgcauacaaguauccagaagguagcuacccacaacagugaucugggauggaggccggaagcggaaggagcccuucacggcauagggcacuugguggaggggcacucggaccccagcugggagccaugacuggucagugagcuguggggacagacgcaggaaacauauggauucuaucaccuuccucacaaaggugauagaaucuaauacguaguagauagcaugccaguauguuagaaacuauaacucacaaucuuccacaaacgccuucucccucugugaagacaacuugauugacagcuaagccgccaugacuuauuucuauuguuacccauuuucaggcuaggaaugguggcucacaccugcaacuccagcauuugggaaggcaggaagaucagaaauucaagaucucccuugacuauauagcaagcaaguucaaggccagccuggacuguaugagacccugucucaauaaaaaauaaauacacaaaauaaaauaaccauuuuugguuggaaguaaagguucacaacuauaauccuagcacucaggggacugaagcaggaggaccaccaccaguuugaguuacaguacggguuacaaaguuaagauccuauguuaaaaagaaaaaagugggcuggagagauggcucagugguuaagagcacuuccacaggucccgaguucaauuccuaggaaccauauggugccuugcaaccaucuguaacaaugcugccuucugguaugucugaagauagcaacaggauucucacauacauaaaaucaaucaaugaaucuuaaaaaugaaacaaaaaacaaaaccaaacaaaaguggcucaggcccucaaucuccguccuugggaacuaugcaggacaaucaggaguucaaggccagccagccaggggcauguaagacccuguucaaacaaacaaaacaccuacaaaacuuguacaagauggagcuacauuugagagacaaaugcaugaccuguguccugguugagucuucuugcaaugagaaugaucuccuuaguaaccaaguuucguggaacagcaaagagggucucaugacucacugucccaaggccaucugccuuaccucagccucagggacuggaggcacuuucuggauccgcuugguaaccuccuucaggaaauuaucaauccucucuuucuucuucucugacagucugacuuccuuuaguaacuccuccaccuuuagcagggggaagggaggaaucugugagccucgggaccccacggaaaccccucuaaccuaugcccuggccacccacguacuuguaaacgaagcaagguggaguggaacaagaucucggucucacggaggcgauuuagcuccucauuuguaggcuccuuguacagcuccucccgacugagguucacuggcugcaggaggccuucugcagguggcucuguucuugcacgcuuucuugagggugccuucucuuuguccaugccuucgaaggcaaguuccaucaccuaugaccagagagacagaaaccaacaugccaacaugaaaucggggggggggggggggggggguaucuguaucagcugacucaaguuuguggguaaaggguucaucuacucuaguuguucccuuucagugggcguuaagauuuuuauaaaacucgggauagccaucacugagagaaaucugacagcgugaggaugcaguccugcuuagaccugacugaguuugccagucacugccugagguagugcuccaaugcccuccuguuuccggacaccacaaaucuuuugcugagacaggcuuaggccuucccaaauaucaccucuucuccugcucuauccagaucucuccaaggcuagauucccuaaaaaucauuuucccaguaaccuaggccgcccuggaguaaucuuuuuucuaucauaguaggccgcccugcaggcuagguaucaggccugacuaucucaggcucugucgucaaaauaaagcacauuuugagcaaccaaccucuggguccucaguugcucgucggugcugcucuccggcgggggccggucccaucuucacagcaggucucucuccagcacuuggcauccaagccggaucuaccccguagcuucccacgugggccgaaacgccaacuccagggcucaaacccuugccccaggccccacccacugcaguuccauugggcuagugcaugccgucucgcucacuauuggucagugguucaaaggaacccgcccauugugggaggaaccaaacaagguccgccgauuuacagccucgacgccgcacuaaaccg

SEQ ID NO: 1840 - RNA, 1491 nt, Mus musculus
ugaggugaggugggaguuugaggggugguggcuguuuuuaaaaaagaaucaauacagugauggaagggaaagaaugcaagacuucagacauucuguggagggaacucucuccaguaaagguccauaaaaggagcaaacugagauccgcaaagggucagcaggggcuguuugcuuccccgccccgggaguaaguuuuugcugaguggccacuguagauccccacuugcucccucccuuuggccugagacgucagggcaguacaggggcacugaaggaacaugucacgacuccucauuuccagaaucaucaucaucauaacagucggcaucuucuuccucuucaucuucaucaucaaugucgucgucauacaagucgucauaaagcaaaucugagcuguugucauuggaaggcacuuuaguuuugaugcaguauucugccaggguuguggggaccuucacuccauccuucuccgccucagcuuuaguggcugagaccuguuuccugcacaggacaacacaggaaagguuuauaggucuguuuugagagggucucacacuacccacacugcuccaccuucguuuccucagugcugggauuauuaggaaagccaucacacuuggguuaaggcgcuguuuugaagacagucuuauaacugagcaucaucagauucccugugacucacgguucacacuccauacagaacagauaucccacaucacaccacggcucucaucacauaccuuccugucauggaggggcuuuguccuaauacuucagccuuguuugagguaagaucucucuuguucgcugcugcagaaaucagguuaacuagcucaaaagcauuugaaaguucugccuuuugccucccaucucuugcuaaggguugaaggauuacagagguuuuauaugugaggucuguuuucuaagugcagguucagguuugcaggggugcugggaagcacacacugugcagcugagcuaugggcccagcaucuuuuuagugccugucaucugcuagguucccccagagcaccaaaugucauuguuuuugaggugguaggggcagaaugccaggcaggagcuugcagcagagccacacccugccugcaauccuacucacaccuacuacugccuggcucccaucacaaugugcccugucuuccucaggcuuuuccauuauccugugccggcuuggcagguaacagcucugcaacaaaaugucgccuguguaaguguaaaacuuucuugccaaaguacaaaacccaaagccauugagauuggagaaacugaaaacauaagaacaccacuuuccugaagcuucaguuuguugccaggccuuacacagugauguucuuguagcuucuauaacacaagucuccauaguuuacauuaacuauuccuuuacuccuucaucugauucauucagcucagcggcugaccacuacaaccaagcagggcacagggaugugcucuguaauccuaggaccuggg

SEQ ID NO: 1841 - RNA, 81016 nt, Mus musculus
guggguucucuauaggcggcggauaguacgacccugaaauucugaccacaagcaaugucaccaucuccgccgccuccacauaguuccucucgcucagcucccagagcuguguuagccagccggguaaccccguucaaucuucaaguacuggcuccacccucucccgugacguagggaucacgugacgggcagggccgccucugccgccgccgccgcuuuguaagaggcacauuggcagguaacgagcggcggcggcggcgggucccgaguccaacgagagcagcagcgguaauugucacccgguccccuucauccugccucccagggcccugaaccuugcaguguaugcuuucuggaccugggcuaaggucuucugaacucccagcccccuuugggaugccccagcgucuacucggguggaucgggccgagcuucccucgcuggcuucauguuuccguaguguguccaggccugagcacucucuuuccucucccgcucagguugcccugugcuuccugcuccaccccccaccccccauccuaguuggccggccccacccagccccagggggcgccuuccccuccccccccuuuggguuuuuauccuggagggugugguuuucucucccaccucggucccugcacguuggcaggagcuccuccgccacgcugucgccccauccggaccaccuuucagcuuucuagucuggcgccuguccugggacuggucuuagugcccaacuucugcgcucuagucucuccccacuuaaucugaaggcauaguucaauuuuacuacuuuucauuacuguggucuuugguguuaguugaaacucugugaguuuccucuucaugcccuauugaagucugguggugucauaguuuauuuauucuuuaaggugagguaagagugcuugugaacuguaaagcguuguuagaaauucaaacaaauucuuuagccuggugcguuccagcucaguuuuccuagucagcucucccaccuuccccccugcauuuucagguuuaguuacccaggcauagucagcucucccaccuuccccccugcauuuucagguuuaguuacccaggcaugucaacugucaccacuuaggauucguguuuucucuuuggguuggucuuggaagucuuccugcaguuuuuugcuuuaacauaaucucguaguuuacuaccacuaauacgccuuucuacuuuauuuccaaggugcauagucugccuacucuuuacuuuucuccagcaauuguguacaguaacaauuggagcuuuuaggugauucuaugagguacccagagaucauuuauuugaagagcaugccuuuuuuugggagggcguuuuugagagaggguugcacuaccuagccaaggcuggcuuuuaacuugagagccucuugucucagucucucuagcucgcucgcucgcucgauaguuuuuacaggguuucuucauguuacaaccuuggcugucccccacuugcuuuguagaccaggcuggccuugcacccauagagauccaccugcaucagccucccaagcacugggauuaaaggcaugagucaccaugcaccucuugcuucagucuuucuaugcugggauuucaguuugcauggauuacagucaaacacuacugugccugguuacaaugaucucucucucucucucucuuucagugaauaguguuuauauuuauaucuucuauuguaaaguuuuuaagcuuuuuuuuuucuuuuuuuuucuccuauuaaugggcaugcuaauacgcccucugaauuguuuauuuuuguuguuguuuaguuuuuuuuuuuuuuaaccucccuuaaguuuuucaagaaaggaucucugugugguccugaccguccuagaacuugcucuguagaccaggcuggccuugaacucaagagauugucucugccucccgagugccaggcuuaagggcaugagguaccaccaucuggugccuguucuuuuuuuaagaguugguuuuucaaauaaccaacacuaaaacaguaaauaaaccaacagaggggagguggcuaucaugccuaaguucuccuguaguguagcuuagacaucgggaugguucuuuggugugcucuuuaccuaguuuaggagagaaauucuacucuuuggaggugguccaauauaucuugucugccuucagggccuuuuggcuagggcccuuuuccaguugcuaugagauuugucuuacugggcaaagguuuaguuucccauucuacacuugauugcugucauuauguuccugccugauuuuuccuacuuaggggucauuuaaguucuguaauugauccuccccucacucccagugggugaccuuuauguuucccacacuucugaccccucccccguuuguuuccuugcugccucugacuuucaaaaacuaaacauuucagagagagggagauuguuuuguuugaaauauggguggaaguaguaacauggcagagaugaggccaugaggaaggauugugguaauugcucucggggcagcuuccagcugcucugcuuuccucuggacucuaaauguggauuggugagccagggucugccguggggaacuuccuuuagaacugcuuuguuuacuucccuuuccaggugacucaaguacucaucaggggucucucuuaguauuaguuugaguaaauuuuauuguuuugggagaaaugauggaagaacauggcuacaagagugaauuuauuucaaugaaugcacauuugaggugaaguuuuagccaagauacauagcuaggcugaccucaaaauccgccugcccuggucuccugagggcugggaggacaggcauguggcacgcucuucuggccuccuuuuagguuugcuguuuguuuacccuuaaugauauaaaugcaucuagaaaguagaaucccgacuugcaguauauagacuggucuaaagugauuuuacuuuccauuguuagccuugaaauuguuuuaguuuaaaacagggucagccugggagugcagcuuugauguguuacuuuguagccagguugguuucuaacucauugaguagccucaaacuuguugcaguccgggucucuauaaguccaagugcugccaugcucaucuucugauaagaguuguagcuauuuuguuuguaaaauggggaguggagaugaacuuggagucaaaggaaacugucaccaaagagcuugagguaaaguuuuacaaguuuugaccaagaaauccuuuccuuucccuuucuuucuuucuuucuuucuuucuuucuuucuuucuuucuuucuuucuuuuuucuuuuuuuaaaaauguauaugaguacacuguagcugucuucaggcacauacuagaagagugcaucagauuggaucccauuaagcauaguugugagccaccauguguuugcugggaauugaacuuaggccugcugagcccucucucuagccccugcuuuaaauucucuuguaggcacuacuucuuccagaguuaccuuugcuuugccuucauugacuuugggggguggggauggugcuggugauugaauugaggauguacccuguaacagugcuauaaccucaacuuccuucuaguggaaggaaacuuguugaaaauacuguuuuuuguuuguuuuuguuuuuaaauucagggucuugucagccuugaacucuauaggcccacagaugagcuuaaacuaccuauuacacuuccaccucuaccucuuucuuuuuuuaagauuuauuuauuuauuuuauguauaugaguauacuuuagcuguacagaugguugugagccuucaugugguuguugggaauugaauuuuagguucucugcucgcucuggcccaaagauuuauuuauuacuauagauaaguacacuguagcugucuucagauggcaugagaagaaggcaucaggucucacuacaugugguugcugggauuugaacucaggaccuucggaagagcagucagugcucuuaaccgcugagccaucucuccagcccccacuucuaccuuuuacaaggugagauccacacgcaccugucuggaagucuuugaugaggcauugaagaccagguuuugugacuuuuuggccgagggacauaguugcuuguggauggaagucaguuugaguuggugccugguuaaggauugggaauugaggcacacauggaucggggcuugugaugagcagugaguguuucuguuaauaggcaauagccucccuuuaaaaguugguagagcugggugugguggugcacaccuuuaauucugggguuugggacaugggagguagaggcaggacgagcucugugaguuugagccagccugguuuacagagcauuccaggacacacagccagggcuacacagagaaacccugucuugggguuauggagagguagcucaguuucaguugcugcuuuucaagaggacccgacucaacucucaggacugauaugguggcucacagcugucuguaacaaaucucaggcccucuuuuggccuucuugggcaccgggccucuguugggaugaauggagauaccugcauguauacccauacacauuuaaaacaaaacaaacccuuguaggccagugagauggcuuagugguuaaaggcacaugcuuccaagucuggugccaggguuugaucccuggacuccacauagcagaaagaaagacuagacuucugcuaguuguauucugaccuccacuuacacacuguggaacguguucacacacauaaaauauaaauaguaauguuuuaaaaaguuguggggaggggcugggaauggagaaauggcuccgugguuaauagcacuggcuguucuuguagagguccugaguucaguucucagaaacacaagucuggcauguagaugggguacucauguaaauuaaauaaauuuuuuuucuuuuuuagauuuauuuauuauauguaaguacacuguagcugucuucagacacaccagaagaggguguccaaacacguuacagaugguuguuagccaccaugugauugcugggauuugaacucaggaccucuggaagagcagucagugcucuuaaccacugagccaucucugcagcccaaaguaaauaaauguuaaaaaaugaaaaaguuguuaguaauauagggucauggguuaggcucaguaauggaggguuuccugccaaagggugaggccucauccuagcucugagaaaaaaguugcuuuucuuuauuuagacaucuaaaacuuguuucugaagcuuaaaaauuaauaugggggggguguggcuggagaaauggcugagugggauaagagcaguuguuggucuuggaaaggucccagauucaguucucaccacucacauagugguucgcaaccauguuccaaguuccaagagauccaauucucucuucugacugccucagguaccaagcacacacauagugcacauauguacacacaggaaaaauacacauaaaacaaaaucugaaaaucuaauaaaaaauaaauaauuuucuuuaccggugccuggugccuauggaagucagaagaaucaucugauccaguaguacuggaguuauagguguuugugagccaccauacuagugcggggaauugaacacaggucuucugcaaaagcaucagugcucuuaaugcugagcagucuugccagccucaagaauauaugaauaaauauauuuucugagacaggguuucucuguauagcucuggaauuccuagaacucacucuguagaccaggcuggccucgaacucagaaaucugccugccucugccucccaagugcuggaauuaaaggugugcucuaccacugcccagcgagaauauuuuuuuauuuauuuuauuuauaugaguacacugucacucucuucagacacaccagaagagggcgucagaucucauuacagaugguugugagccaccauguggucagugagaauugaacucaggaccucuggaagagcagccaguguucuuaacuacugagccaucucuccagcccugacaauuacaaucuuaaccauauuucacaguuaggcuggggucgucagcauucucagauugguucagugacuguuuggagugucuuuguauaggagguaaaggaagaaaaggggugggggcugcaaaggaaauggggaagaaaguggaauuaacagaggaagaacuaacuauccagcaauucugagcucuccaacuucucuccuguuuguuuguuuuuuuuuuuuuuuuuuuuuuaaagauuuauuuauuuauuacauguaaguacacuguagcugucuucagaccccccagaagagggagucagaucucauuacggaugguugugagccaccaugugguugcugggauuugaacuucggaccuucggaagagcagucgggugcucuuacccacugagccaucucaccagcccuccuguuuguuuuuuaaauguguuuauuuguuuauguguguguacgcauguggguauuggaacacgugugcaccugugagaagaaggcguaggaguuggagcuggaggcaggugugagcugccugacagaggugcuggugucugcagggagcagauccucucucaacuguuaagcuaggucucuggccagagaugucuguguguggcccuuggguuuuugguuuuuguauuuuguaauuuuguuguuguuguugagacaguuucuuuauguagucuaugcuguccuagagcauauauagaccaggcuggccuugaauucagagagaucuuuucccuccaccuccugagugcugggaucaaaggucauucuuggcuuuuauucauuuauuuauuuugaggcuggauuuuaguauauaacucuggcuggcuuggagcuugcuguguagacuaggcuggcuucagaguuucugugguccuucuaccucugcuuccuaaaugcuuggauuaaauuccugggccacugugucugauuuuuuuuuuccccauuccagauagcugucaaggaugaauggcucugaacuaugucuguacuucaagacaagagcugaaggcaggagguucaggucuguuauuuguggugcuccugccugccugucucacaaguguaggaacacaggagugcucccaauccugggaauaguggaucucaucaggauuuagagcaauuguucucaaccugugaauuguguccccuuugggggaguugucgaaagacccuuucucaggguuaccucaaaccauuggaaaagagagauuaauauuacuauucauaacaguagugaaauuagauaugaaauagcaacaaaaauaguuuuaugguuaguagucacugcaaugugaggaacuggauuaaggggucggcagcauuaggaaaguuaagagccacggcucuggaccuuugcuaaagcuuaguuuccuacuuggguuauuuauuaaguugucuuuagaaucuuucuagauuaaaguucuguuguauauacacaauucaguaauaucuuguauuucuguuugcacauuuuaaaaacguuuuaauuuuuuaauuuauguguacauguuuguguguguguuaaccucauguguggguuagcucucguguucaugucugagggcagcggaguuuacaggcaguugugagcuaccuuaugggggugcuggaaacugcaacacacacacacaaacacacacacacaccaucacgccagugugugugcuccccccaucccccuuuaaaaagacaauggcacugcacucguagcuggccugggauucuuguguaccagacuggccuugaauuuacagagguuccucuucugaagugcugagaaaagacaugcuccacuaugccuauuuuaaacaaguuuuuguuuuguuuuuuguuuuguuuguuuguuuguuuguuuguuuguuuguuuuugguuuuucaagacaggguuucucuguagaccaggcuggccucgaacucagaaaucugucugccucugccucccgagugcugggauuaaaggcgugcgccaccaagcccggcuuuguuuuuguuuuuaacuguauuuucaucuuaaauuuugagaggcuguagaggcaugagaucauaaggaguuccaggacagucagggcuacacauaccuuuucucaaaggaaguacaugaggcuggaggugaugcagcucuggaguaguguuugccuagcccuuccucgagucugcuccuagcacagaucccucuuuagaacagcagugcuuggaaaauaucccugcauacuaggguaagccagcaucacgugagccaaaagccuugucaguuaaauggccauuuacucuuguauuaccgcagacgaugguaaugugauagagcuagcagagcaagauguaucuagaccaagguggcuacucuaauggucaggcagggcuugggacagggaaaugacagguuuuauuuguuaaauuguagugauaguugcaaagcuuauuagcaaauacacuaaaagucauuuaauuacauacuuaaagugaacuuuauguuuugaacauacccuaguaaaauuauucaaguuuuuaaaauauugugagauaagcaaguugaacugauaagcaugcauucuguaauuauuacuaguuauagucaaguauuaaaaguccauuugccuuuuuuuuagguuccccacuggcuugggaaaccguauuugaacaagguuucuuaaucuuaaaaugaguagacuucugacuuguacucuuaaucauauuauguuaguaccuggccugucugaaacguguguaucugggaguacagccaggugcuaggugauaaaucaaaguaagcaauggaaaggaaauuuaaucccuuugggguguaaaaggcugugucuugauucuagaaaaggaauaggggugggguauagagauggcggugucuuugaacgguguucuguuccacuagacuuuucacaucuauuuuugcuuuuguauuuauucuauauggagaggaauuuaaaauugguugcacuugaguucugagauuaaauacaauaaacugcuuuuucuuuuaaccuuuuucauucuaauuuuaguagcuuuugaauccacaugaagccuucugcccucugaaguaguuaaccacauacacugagcauuucauuuucucaaaugggcuauccucccagccuucuuucuuuucaacugcuggugcucugacccuccagagccuugccauauuaagcucuugcuuuacccugaucuggcuguuccccagguaacugcaggugcuagcagggcacacuuuguggcaagggggaccgacauaccaaaggacugacucauguauuucaggaauaagaacugaauaguguggagaacaaagggaagcaaggauggguucucugucugaaaagacaagggaaggaugucugaaguuauacugagcaguagagacagaugaaagagagcaagagggaagacugcugacagaauccugaccuggggguagcauuucuuuuguaggugugauaaagugguggaaaccaggucaaaggugaagcaggugguuagagaagaauggagaccaugaguguauuccuuagggaaagagcuuaaguagucauugcuuaggacauugaagauuuagcuuccaguagugauugaaggaaaaacugcagagcuuuuuuuuugaggagacugcagcuuaacagggauuaauuaauuaauuuuuaaugauuuauuuguuuuauguaugugaguauacuguagcugucuucagacacaccagaagagggcaucagauccauuagagaugguugugagccaccaugugguugcugggaauugaacucaggaccucuggaagagcagucagugcucuuaaccucugagccaucucuccagcccuguuuguuuguuuuuaaagauguauguauuuauuauaaguaaguacacuguagcugucuucagacaccccaaaagagggcaucagaucucauuaaggaugguugugagccaccuugugguugcugggaauugaacucaggaccuuuggaagagcagucagugccaucucuccaguucuuaacagguauuuauaauuaccaccaggggauacuuuuuucgguacacagugggaggucccuuauuuaagggauucuguguuuugguguuuagugagagcccucccugguaggugcauaaguagccaguguguuagaguuugaaugggucacaucacuugauuggcacauuuuuuuagguaacugacauuaaaaaaaaaaagaaauaagaugaugaucugaugguggcccacaccuuuaauccaaacacuuaggggacagagacagguagaaucuuugugagguccaggacagccugguaaacagaucaaguuccaggacagccagggguacacacaaagaaaccccaauuuugaaaaaaaaaaaaacgacaaaaagagaaaauugguacaguaaaauaguaauaaagaugcuaauagaauaaaagcaauaugcuuuuaaaaaaaauuguagcuuggguuggagaguuggcucaacaguuaagaguacuggguccuuuuccagagguccugaguucaauucccugcaaccacuugguucacuaccaucuguaauggaaucuaaugcccucuucuggugugucugaagacagagacagcauacucauacauaaaguaaauaaauacuuuuuuuuuuuuuuuuuugguuuuucgagacaggguuucucuaugcaguccuggcuguccuggaauucacucuguagaccaggcuggccucgaacucagaaaucugccugccucugccucccgagugcugggauuauaggcgugugccaccacugccuggcuauaaauaaaucuuuaaaaaagaauuguagcuccuccagaggcagauagauaucuaaguucaaggccaggcuugucuacagagcaagucugggacuagcuagggguacacagagaaacccuguguuuugauuuuuugggggcauggugcuggauugaaggggguggguaguggugaucaaucaacaagcagcaaauuauagcuuuauucuggauuugugagauuugugagcaaaguugaagaacugacuaaaaaacugggaccagcugaagagcugggaagcucaugcucucggcuaaggcaggauugcugaaacuuugaggguaacacacuauaucuagcaaguuccaagguaaccaggcuacaaaaugaaaccuugucucagcccuuccaaaauucaaacaaaaaaccaaacuaaaacaaaaaucaaacugagagagaaguguuuuaagguauaacuuuuuauuuauuuuuuauuuguuuugauaagacggguuucaagacuugagguugacccugaacucaguauauagcuaagaaugaccuugaauuucaaaucuuuuacuuccacagucuagcaccacaccuaguguagguaguuuuggggaagaaacacuggaccuugggcacacaggcaaacauuacccaaugaguuacauccccagcccuucacuuuuugaugguggccucauuuuuguuuuugguuuuuuuuuuuuuuuuuuuuugaggcaggguuucucuguauagcucuggcuguccuggaacucacuuuguagaccaggcuggccucgaacucagaaauccgccugccucugccucccgagugcugggauuaaaggcgugcgccaccgcgcccggcgccucauuuuuggagacaagguauugcuauuuauguagccuauguuggcccuugguauaugauccuuguguuuuagccauuggaaugcugagguuagagcuaugaaccccuugugacaagguagcaguuuuacaguucauuugguagagugcuugccuaccauauagagguggucuuggauuugacauaaaacuagaugugguggugugcauuucaagccagauuugcuauaugagaccuugucauaagaauaauucuagcugggcggugguggcgcacgccuuuaaucccagcacucgggaggcagaggcagguggauuucugaguucgaggccagccuggucuacaaagugaguucccggacagccagggcuauacagagaaacccugucucgcaaaacaaaacaaaacaaaacaaacaagaauaauucuuagcuuuauaguauuaucuauggauuauauacuuuuguuuugaaauagcuuucucaccagcccccucaccccccacccaccccuuuaugggagucaguaucucuguauuccuggcugguuuggaauuuuguacauagaccagauuggccuuggaauuacauacuucugccugcuucugccuccagaguguugggguuaaaggugggugccuccaaaccuggauuaaaauugaacuuuuaaucaauuuguggggcuuuugagguggugaguaaggauacuugcugcugagcccgacaaccagaggucaguauugaucuuugaccuccauaugugcacucaggugugccugugccugcaccacacauaagaaacggauguaaaagguaaguugauucaaggagagacucagacacuuuacugcugagcuaugugcaguacagguuuuuuuguuuuuuaugcaagacuuaagguuuugucuguugucaagcagaguugaaguuucagccauuuugccagagcagagugaccagauuggacauuacauaaguaugaacauaguaaguugagguuggagagauagaugucucagucguguucacaucaggcacacgguacacagacauacaugcaggcaaaaaauaagugaaaaaagacaacaucuuuaaaagguggaaauaaguugcugugagaugguaggugauugucuuccuuccaaugcagugggugagaaggaugugacugcgucccugccucacugggguuuagaaagagaaaauacgcuacauggagaugggcacuugccuucuuccuuuuuuauaauuuuuauuuuuauuucaugugcauugcuguuuuuccugcauguaugucuaugugaaggagucagaucuucacaauuaacagacaguugugaucugccauguguuugcugggaauugaaccuggagaagccagugcuaugaacagcugagcaucucuccagcccuuuuuuuuuuuuuuuuuuuuccaaaacucuguagaccaggcuggccucgaacucagaaauccgccugccugccucccaagugccgggauuaaaggccugugccaccagcccuuauuuugagacaggguuucucuguguagccauggcuguccuggaacuugcucuguagaccagacuuaccuggaacugaaagaucugccugccucuggccuccugaauggugggauuaaagguaucuaccaccaccacuggaucccccucuccccauguaacucuucaaauggucuuccugucaugcauuuguuucuuagacaucuuuacuguuuuaaaucaaugauucacagacuuuuuuuuaaaguacgaaggguauuuuuaacccuaucauuacauuacaaggcucagcagacccuuuuaaaaacaggguuugucacuguacuuggaauacucagacuuaguuagacuggcagcccagcaagccgagggaucuuucugucuccaccuucauagugcuaggauauacagguccugauuuuuguaaauggguucugaggauuaaauauuggucauauacuuaguuacuccagaccauugccucagucccugguacccuugcuauccuggaacucacuguguacacuaggauggccuuaaaugcagagauccuccugccucugcuucucaaaugcugggauuauguguguagcacagugcucagcagggcaagcauauuucugccucuucagguuaggauugaagguagcaugaaccaccauguuuggcaauacuguauuuuagaaagaauuaauggacuggagagauggcucagagguuaagagcacuggcugcucuuccggagguccugaguucccagcaaccacaugguggcccauaaccaccuauaguagugagaucuggugccuucuucugguguacaggcauacacauaggugaaauacuguauacauaauaaauauaucuuuuuuuaaaaaaggaaagaauuuauauugaaaaaggaugggaccaaaauuuuuuuucuccuuuuacucuugucuuuaggggaaugagacaauguaugcuuaaugcuaguggaugcuugcagacaggaagauagcuucuuaauuaucaggggaauccauucuggaacuuggugaaacucaaacuaaggucuuuagagugaaggcuugcucuguaaugauaggguuaaaaauacccuuuguacuuuaaaaaaaggucugugaaucauugauuuaaaacaguaaagaugucuaagaaauaaaugcaugacaggaagaccauuugaagaguugcauugcccuugacuuuggaauuuugguuuuggaaaguagccaucuuaugcugcccagaaguuaugcagacauaacuucugccacuuugagaaaucagccaaggaaaagaaaacaaagaugugauaaacuuauaucaggaaagcaagaccuuagauaugucuucaagucaggcuuggaagucuguccuuuuuuuuuuuuaagauuuauuuauuuauuauauguaaguacacuguagcugucuucagacaccccagaagagggcaucagaucccauuacagaugguugugagccaccaugugguugcugggauuugagcucaggaccucuggaagagcaaucagugcucuuaaccacugagccaucucuccagcccagaaguguguccuuauguccuuagauacaucuucagacaggcuuggcaguguguucuugguuacucacuacacagaggaacugacaagucaggaaaguuagugugugguugguuuuucagacaggguugcucuguaaaccaggcuggccucaucaccugccucugccuuccaagagcuggaauuaaaggcacgugcuaccaugcccuguuuaaaauuaguguuuguaacauuccauuguuaaggaaggaaaauacugcaucuauccaucuguccauuugagacuuugucucaaauggaguucuaggguccuggcuguccuggaacuuauguacaccaggcuggccuuaaacucuuggaggcccccugccucugucucuucaggcuaggauagaagguggcauguaucaccaugcuuggcgauagaaaaaggaugagaccaaaaauuuugggcccagcaugauaguacaggccuuuaaaucacaguacuugggaaguagaggcagguggauuucuaugaacuaaaaaagguuagccuaaugggggacuuuugguauagcauuggaaauguaaaugaguuaaauaccuaauaaaaaauggaaaaaaaaaaaaaaaaaaaaaagguuagccuaguuccaagccagccaagacuacauuauaagacaagcauugcuugauggauugaaaaauuuagugcaugggggggggguaugcuuucacgagugugugcuucuaugagugagugcuugcaugcacgguggcguacauguagaaaucagagagaacuaugugugucccagugacuagacuugguuguaaggcuugguggcaagugccuuuagucguugagccauuuugagauaggucuaacuguguagccuaggugagccuggagcuucuuaucuuccugcuuucaaagucucuugaaugcuaggauuccuuugaaguuugcuuucauauucauaauacugauuacucagauuaacaggguaagugaugugcuauauauuuuaagauuuuuuuuuuuggcuggcucuuuguuuuugugacgggguguaucuuuguauguuggugccugcagaggucauaagaugucagaucccuuagagcaggagucacaggugguugucaacugucuuuauuauguacugggaacugaacuuuguccacuagaagaaagaauaguaaguucuuuuaacuccugagcucucacuccagccccaacauuccagugaugcuacuuggccuuuauuuauguguagccaucacugugaugcaaagagccuuggauuuguagucacuaagcuguuuauuuguucugagaauggaucuuuuguagcugugauuggccuacauauaacaauccgucuucacacuugugaucguuuugucucaaggccccaagacuuagaggcacggguuuauagacagucacuacaccugaaucgcugugccuaguuugcuuacuucuugaagauagggucugaaguagaggcuggccucaaacuuaauguguagcucagagagacuucauauucuauuuguuuguuuuuuaagaguuucucuguauaacaacuguucuggaacaugcuuuguagaccagacuggcuucaaacugcagaccccccccucuccccaaaugcugcgaucaaaauggugggauuugccaucguuuucuuggcaauuauccuauuucauuuucccaagggaggaugugaauuuaagcgcaggcugcugugcccagcauaguauaauauauuccuaaugacaguaucaucuggauauuauuugagaagugcuugucugaaugaauauaaagcacaagguaauuuugggauugggugugugcaugcuggacuugaacccaggcuucaguguccuucaugcaugcaggaggaacacuauauuacacuugaugcaugcuguguguaauguggacuuuuuuguuugagacaggucugugagaaaaaaugguauagauuaguuaugaauaaugagcagccuuucaagggggauucuccaauagaaucuugaagaauucuugauagcugcuagguuagagaggguuuaaaggcugggcuauguggcucagugguauagaaugguugccuagcauaucugauguccuggauuugaucccuagcaccaugaaagacuggagcaauaaaauaauaauaauuaaaaacugagguucaagccgggcgugguagcacacgccuuuaaucccagcacucaggaggcagaggcaggcggauuucugaguucgaggagugaguuucaggacagccagggcuacacagagaaacccugucucaaaaaaccaaaaaaaaaaaaaaaaaaaaaacccaaaaaccugagguucagagcugagaacgcugcguaggagugggacguauguauggaagaagccacaggcaugccaugcuucuccugcucugcccuuugguagcugaagagaaugugggcuguaccaaggaaaaucugauaucuucaaauguucaagaguugcccaguaccauuccuuuuccaugggcacucagcaccgcccaacugauaauacuguguggguguagggaggccauccuuguccaccagcugcugggggccugacccugcccucugcagcuguggagaauaaaaguaucagcuugcucagcuccuggcauuccagcacuagcaguugagccucauaacugaguguuuggcaccccucuugccuuguucucuccagauuggcaguggugguuucuucuugcugucuguuguagacuuuauaaaccaguagagagucuuuacuaaaaaagauugagaagaguggauucugauagaaaaagcaagaaugcagauugaaaauuaaaugaaaguaauaaaacacagcuagucacagaguacaaaaauguagggaguccuugcuggguauuugaaaggcuguggagggcuggagagauagcucagagguuaagagcacugacuccucuuccagagguucugaguucaguucccagccaccacaugguggcucacaaccaucuguaaugagaucugaugcucucuucuggagugucugaagacagcuauaguguaauuagauauaauaauaaauaaauguuaaaaaaaaaaaaaaagaaagaaaaagaaaggcuguggagcuuaguggguuucuggcccagacuagauacuuuugguuagggauaaggcauucagaugaugucaacaguaauugccucguagagagaagccaagauggagacuauuguauuuuuauaauugaacguuugaauaugguguagugcuuaagaacacggacuagggaccagauggauuugaauccuuuuuguugucacuuaacaaacggugacucuguaaaauggaagcaauauguacuugugagugcuggaaaguuuguuuuaauccucuaaagcucuuaaaggucaggcacauacaugucugcacucuugguacuucagaggcugagacuggaggacagucauucugugaggguauccucugcauagcaaguaccagaguaucugugaucuuaaaguaguaucugucccauaguaagacaguguauguuuacugcugucaacauuacuucuuuuagaauuguagggaugaaugugugccuaggaucauccuuacccaaaaugucucuauaggcauucucccuuauuugugagcuuacagaggccagaaguugaugcuggguugcaacucacugguucagaaccauuguuauaggauauauauaacggcuuuaagcuauuuuugccuaaaauuuggugucuccaugaugaaguuuguuuguaugaauuugagagauguagguggcuuuugagacuuuuagcucauucuaaacugagauaucuuaucuucuucuucccaccaugccaagcggggauugaacccagggccucuuaaauccuaggcaaggaaagcuucaccuggggucccuuggaaguaguugucccaugcaaaggaacacaguaacaguuuaaacuuucucuagugggaaaucacuugugucaaaacuugacguccugaguuugaccucuaaaaccagguggaggaaagagcucauugucucaggcagaucugacugccagccaugugccaauggcacuguccuaucacaaauacagaccguuuguaccuuagguagugggagaaaguucccauuuuuguuuuuaucagcaauucuagguuaaaaucuaccacugaaccauaucuuauagcuuauuaugaauauuagaaauuugauuggguuuuuguuugauuuuuuuuuuucuauuuugcuuuucauuuauguuuugaaauuucacuugauagagagggguaacugcaugcuuucuguagcucaagaacccgauauggcagaguuucugacagguuauuuuuagaagucucugcucuugucuguuucuauucuaagaauucucuuggaaccuguuccggaggaguagagcugauggaaaacaaguguaaaugcaguuccuauggucuagcagcugggugcgagccgcaggcgcagaucuauuuacuacacgagauucuguuuccaaaggaagguggaauuucccccaagauugcuuuggugugcuaguugacggcauuuccucagaaucuggucuccaugcccuucacuuucaguuagaagugguaaaagacuuuaaggguucuuggugauuacuuugggaagucucuccgcuccuuuccucccucucugccucccuucuuagugaaugaggggggaaagggugaacgguaugagugauguguaugugggcgugugugugugggugucgcugugcucaaguggaugugugugcucgagugcauguaccauggcauuuaugugcagagcagagauuugaaguugguuuuauacuauagggaucuuuuacacuauauggauccuggugacugaacucagaacuucaggcuuguugacaagugcuaucacuugcugggccaccucaccaguccuugaagcuuauuuuuuuuauuuuuuauuauuuuuuugguuuuuugagacggguuucucuguguagcccuggcuguccuggaacucacucuguagaccagacuggccucaaacucagaaaucugccugccucugccucccaggugcugggauuaaaggugugcgccaccacugcccagcugaagcuuaauuuuaaacgauauagauguaaagaaaguuaagcauggugcuacauaguacuuagaaggcugaaguagaaaaaucuuaaguucgccuagccugggcuacauggugucacuuugucucaaaaaaaccuagcuauaacagaaaauacaaauguuggugaugaaguggauuaugaaaauaaguagagggcuagagcuauagguuagaaguagagugcuuauuuuguauguaugaggccuuagguucaauucccuguacugccaaaaugaauugcuucgcuuaagcuauagaaauauuuuuuauauuuuuacaaugcuuugugguuucaaaaacaaucauuugucuuauuccuacuaauagcuuuaaauucagagaacaggcuggugggauugucaguggcguacuccccuccaugauaaaaacgcacuaacagcauaaaguacuugcuguacaaggccaaaggcugcguucaguucccagauccucuguacaaggaaaagagcugauucucagauguuuuccucugaccuccacauauugacugugacauauguguugggugugaacacacaaaaaucauaaguaaaauaaaaauucaaaaacucagagggugcucuaaaaguaauauaauuaugguaaaaacaaaacuuauucugaguaaugaaaaaguucagagugugaaaguuguuaaccucaaaauaggauacagagugugauucauacaacugagaggcaguuugaaauaagauaaauguuuaaacuagccuuuggggcuugugagauguucuaguuaguuauuugcugcuauaauguaaaaagcagugcagugccggccaguggugacgcacgccuucaaucccagcccuugggaggcagaggcaggcagauuucugaguucgaggccagccuggucuacagagugaguuccaggacagccagggcuauacagagaaacucugucucagaaaaacaaaacaaaacaaaacaaaaaaaagcaguucaauucuauucccuggggccuuuagccuuaagaauauccaguuaaugcaggacgucucuguaaggaaaaucuuuucuggcgaacuagcugagagcucacauuugaucccaaguuucaggaagagagagacugggcuucuaagcccacccccagugacacaccuccuccaacaaggcuacuucuuuuuugagaggaguguuuuaauacaggguuucucuguguagccuugguuguccuggaacucacucagugauccaccuacuuuugccuccagagugcaaggacuaaaggcaugcacccauuagaguucacuucuuaaucauuuccagaguuccauuaacuagggcccaaguguucaaauuaaugagccuaaggaagcucuucucagucaaagcuucacaucugugucuuguaacuuacgacaaucagaucuaauuuggaacauuaggugcagugcugugucucuagccugaaacauguaaacuaaaaugagagggauagcuuuucuuuuagccuuugaacauuccauccugguaagcagcacucuggauauuguccucuggaagaacaagcgcucuuaaccucugagcugccucucuagcuucucauuuauuuuucugagguuggguuucauuuagucuggccugguacuucccaaucuagcugagggugaccuugaacuucugauccucuuagaauuacagggauaugccaccaauauccaguucuaccgggagaugaggauugaacccaggguauaugcuauacaggcacucuaccaacugagcuacaucaccagccggcuggucuuacgaacacuuaagaguacaaagacaagucaaaaaacagaauagguaaaguaaaauaugagaauguagauucugaaaaguccaaaggggagcaguccauaaaaggaaggccugugguaacagggggcuaaagcaaaccaguugguuuugaggucagcuuggacagcauaguacaauuucauagcaaagacaagagaacagaggaacaugggagauggggcgcagggagaagcugcuaggaaaauaauccugggugcuggcauccuguuggauauuucaguagaugaacuuggguagaaauguaacuugucauugugauaugaccuauuuggauuauuccucuuuaugcuuaggggugguuaugcaaaagauuaaaauuauccagaaauuugcauuuaauuuauuugagguagagucucauguagcccaggcuucccucaaauucuauguagcugaggauaaccuugaacuuugccagaaauauaggcauggguuaaucaccgugcuuuaaauagaacuagggguggcuuuugguuuuucgagacaggguuucucugugcagcccuggcuguccuggaacucacucuguagaccaggcuggccucaaacucagaaauccgccugccucuuuuuuuguuuuuuguugguugguuuguuuguuuucuuuuuuuagugccaauuugcacauuuauugcucgcuaagucucagacuguaacacuucucugaucuuucaguucccugagucuucugauggcaggcaagaugguagaaguguuguugcagguccaggcuugccauuguuuucaugcaggaaccacagugccacagaaggaccaaauguacuuggcaugauggcuaauuucaauuuucuucaccauuuucuggagggaggcaccauagcagaucccauguuucuugacagucccaaccaacuugguguauuuagccauguugcuguaaccgaagcccaaacccagagagcaccuaggggugguuuuaagaugcgcuggguuuaaggcuucuucagucggaucuggguuaaagguaggcuaggauaauaaaauccuguccucacaauugcacagcaaauguuccuaacuguuaagccagcucugugccccuggaacucuucuuaaucauuuuguccagugucucaaguacugacacggcaagcaugugccaguguguguguguguauuugugggcauugagugucaaagugaaugaauacaggaguugguucuuuccugcuauaggaguccugggaauugugccuuuaccaacugagccaucagccccagccauaacauuucugauugcaagagcaaaguuaacuuaagauucaaaaguaggugauguagccagcuauguuguauaguauacaucuaguauuuaugaggcccuguccugugcucaauccuuucccaccccccaaaaugauacaaguauaauuuagaaugcuacugggcuaggguuuuuguuuauuuugggcaggaggcgguuauuuauuuauuuguuuguuuauuuuuuuuucauugagaccacaucucucuauguaguccuggcuaguccagaacuuguuauguagaccaauuuggccucaauucaguuuugccugccuuuuccucccggguuuugcagcuaaaggcaugugcugccauacuuagcucuuuuugagaaaacauucugaagcauuuuuauaucuuuuuuguuguuguuuuguuuuguuuuucgagacagggcuucucuguauagcccuggcuguccuggaacucacuuugaagcauuuuuauguucuauuuugugucuccccacuccccgaauuagauguuugauuuuuuuuuuuuuuuaaccaugauuuggaaguuuugcucacaaugccuucuuucuugcagauuuuguauuuuguacauacauuuuguauauucuguauaugaugacuucugugagcaaugaucguugccgaggugcucgggaaaaaccacagaugccaacagcacacgcagcccagucacagaaacaaguggugcagguaagcucccgaaaagccugacucccuuagacggaacuacacuuucauauacuccccuuccuaggagacucaggauuuaaccuugucuuuauagagugacuaauaaguguaggaaugaggugaucaugguaaaacugaauguuguuccaggagaaucauuguguaguuccgaauuccaguugucaccaucuccuauagcaauucuacagcaauuuucuuccuuccuucuccuuuccuucccuacuccuuuccuuucccucuccugcuugucauugucuggcauguaauacuaggaagugaacccagagccucccuguucuagacgagcacucuacuacugaccuguaccccuagccuguuauucuucuaaaugagacgguugaguagagcauggagcacagggucugguacaaaguuaauuuuguacaacauugacuccucaggugacagguuucuuaacagaaacaguaucuuuuucccccuuuauauauaugguuuuuaaaaaaauuuuuauauuuauuaacuguauauuuauuaucuguuuauguguguacacgcaugaacauaaaucacugugguuuuugagguuagacaucaguuagaaagagcuucuaccaugugaguucaggguuggagcucuggaguuggcagugagggcccuuacuuauugaaccauauugcuggcccucagaagcagaaucuuaguggauaaugaaucauuucaauuucagaucccuggcuugauacauuuuuauuguugguuuugugauuugagacugggucuuacuuaggucugccaaccaggucuugaauuccuuauuccucugauuaaguuucuuggaugcuggaguuccagaaguggacuacuucagcugacuuugauaauuuauuguauuaaugauauugggguugguuuuaccaaugagcuauaucccuugucuuuuucuggaacuuuguguaacucauacugaaguauucuguuagguuuugguacagaguagauuuuuuaauauaauuucuguguuaaauuggaucuaaaauuaguuuuguaucuugcugcuguuagcagauaaauagcugcuguuugaguguuuacccuaagucuuuuuacucuuacauguggucuucacagcugaucaagaagaacugcuaugccaagaguuguggcacaagcagagaggcaggcagauuucugaguuugaggccagccagaacagaacaacauaggagacugucuuagguuuuuauugcugugaagagacaccauuuccaaggcaacucuuauaaagaaaacauuuaauuggagcuggcuuacagucauucucaucauggagggaagcauggcaguguccaggcagacauggugcuggagaaggagcugagaguucugcaucuugaucaacaggagauuucagagcacccccacagugacacauuuccucuaacaagaccauaccuacuccaaaaaggcuauaccuccuaauaaugccacuccauaugggcuaaccauucaaacacauaagucuaugggagccauaccuguucaaaccaacagagagacccuguuguugaacugugggccuaggcuguucuuuacgcuucuuuaaggaauugccuuguauuaaggaagaagcauaaguuaguaauaaucacaaauccuaguaauaguguaauaacaauaaugauaauaauguuagucuuuagaaagaaauuaaacaaaaacaaagaguaugagcuuuugaaggugggccaaugaaugcaaguguucauuuauguuagugguucaaaugguaccccuguaugcuuugcaagcagauuugggcuuauugucaaucagauugcagguuggagcagggaauuaauucuuuuccuuuuaaaaggguuuuauuuuuauuguuuccuuuuaggguuugagacaggguuuuucucuguagcccagacuguuccagaacuuucuauguaaccaguggugggcucaaacuuggauuuucuugcccuagccucccugggauugagaguacacuaaaagcuucucacugauagcuuuuugugaacccucuaggggauggcuuagcuuguccaaaggaaaaagcugccgacugaacuguggggaggaguucuugaucuuaggcuucuucuuuuuuuuuuuuuuuuuuuuugguguuuuuauuugcuuugcuuuuuucuuuucuuuuuuuuucuuuuucuuuuuucuuuuuuagagacaggauuucucuguauagcccugacuguccuggaggucacuuuguagaccaggcuggccuugaacucuugcuuugcuuuuuaaaaacaucuuuagguuauaugcuuggacauuuuaccugaguauaugucugcacaaugugugugugcaugccugggaaggccagaagaggcucuccuucugucugucagaucuccuggaauugaaguccugaaugguugugagccacugugugggugcuagaaauugaacccagcucuucuggaaaagcauccagugcucuuaacugcugagccagcuccaacucacuuuuuguuuuuugaggcagguuucguaguugagcugguucagcuuucugugucacccaggcugucuaauugaagaucugccuuuaacccuccagugcuugcuuuguaccaucuuaugucuugcuuuuccuuuuuucuuuucuacaucuuauuuauuuuauguguaugcauaucuugcccuguguaacacaugcacaguuaacagacaguugugaaccacuguauguguuuugggaaucaaaccuagguccucuggaggagcagucagugcucuuaaccaccaagccaucucuauugcucucuuuccuuuuauuuuuaaauugggccuacaagguagccuaguggguaaagucccugcccuacaagccuuuggaacccauguggaggguggacccucugaacccuacaugugcacuaucaugcacauacauaccuuuauaacugaaaagaaaugggguguugucagcugcugugauugcuugguugacucaccauacaaaccuugagcccugaguuugagcccaggaacucacauguuggaaaguaagagagucaguuccuaaaagcuguuuuacuuccacaugcaugccacaccauucacaagccugcauucauacauauguuuacaacaauaauauuaaaaagggggggcuuuuaaaaacuuauaaaaaauuuacuauguuacucuaagauggccuaaagcauuuggacuuaagcugcuauccugucauggcuucacauagagcugagauaaucaaguuucuuuuuuguuuguuuuugagguagauucucuauuagguagcccuggcuguccuggagcuugcuauauagaccaggcuuuaaacucacagaaauucaccuauccccaccuucugaacguuggggcuaaaggcacuaugcccugacugauaauuaauucauaauaucuuauacaucuuuuuauagaauuauuuugagaaucuuuuaaaaaauacuacuagggaaaauuuuauguugggcuaagggcauugcuugcuuggcaguaaaacauuugacuaauguacaugaaguucuagucucaagcccuagcacaauacaugcacacaagcauguaugugcgcacauacuggggguauaaccuaauuacgguaaaguacuugcccagcuucagucuucaguaccauuaaaacugggcaugguggaacaagacuguaauccuagcacuucaggaagugguggcaggaggaucagaaauucaguauuaucuuuggcuguaguguguuugaagcuagccugggcuauaugagaacccagagagagagagacuauaaguauaaaaaauguuuccuggaguuaccuuaaaguaagaaaaaugaagccuuuauuugguagaauacuaagagagcuguuuugaauuuguguaaaccugaguguggguuugggucuaugucuuacuaauuagguaggaugcaguuuuggagcccccccccccuccccguaaugucuguucuuucaaccaagcauuguuuagguaucagcagaucuccucagucagugugucucauccucuuccuuucccucacaccagucccaugaugucaagugcaggcaggcaggcugucccuaagucuccacugccucuccuuuugcuuuuuuuuuucuuccuaccuuugccuccugaguagcuggaauuucacaucugugucaguaggaugugcuugugcuuugguuucuugucguugacauauuugaagaacauaggguaauuacauucuacauugccuucuaaucuggguuggugugcuuuaugauuagaauuaauuacauagucuuuauauaaguagguaugaucuguuauuuucagugcuuggaaucacacacagaaucuuacauauguugggcaaauguucugcuauugaacuagacgguaguuuguuuuuaauguaucaaauuaucacaugaaauaauagggucuaaguuaauuuuaaaauauaaaguggaguauaauuuguagauugcuaucaagaagugguaauuuuuauuguauauuccacauaaacuauaaaauagcuuuuuaaaauuugaggugguuauaggauucuaugccuguaaucccagugugaggccggauaaggcagaggauuacagauuagaagccaagguuggugacaggcucugcuguaaaggcccuugcuaccaagccugacaaccugagguugcuccugugucucacaugaugugauggaggaaggcauccacuccuacagauuauucucugccuuccacccaagugcuguaggggauguacauguccacauagcacaacaaauacauuaauuaauuaacuaauuaauuaauuaacccaagguggcaggugugguggugcaugccuuuaauuccagcacauaggagacagaagcagccggauuacuacaccaggacuuaaggggcuacauagacagaaacccuaucucaacaaacaaacaaacaaacaaaaaagaaaauaaaauuacaucaaacauauagaaaacccauggcuucuguuuaagaagauaugcaaacaauaauauaccuacauaacuuuuuauuuuacuguuuuguuuugagacaguauaaacuguuuagagaagaugcucuuacuaacaucuuucugccuuugcccacugagugcucuauuacgggcaugaaucaccaugccugucuauaaggaugcuuuaaaaaauaaaauaggcacucaguggauaaaggcaauugcugcccagccuaaugaccuuagcaggguuucuagugcccacaugguagauguagagagcagucugucuucuaacauacauauauguauguauauacauauacauacauauauguauauacauauacauacauauguguauaugcauauauauguauguauauauauguauguguguguguauauauauauauauauauauguauauauauauauacacacacacacacacacacacacgcgcgcacgcacacacacauauacacauacacaaagaauagauaacugugauuuuuaaaacauuuaaaauaauaaaaaaguaggccaacugaauaugauagcugauguaggaagauugcugugaguuccaagguagucuccuauugagucuaauaaugaguuucuggcugccuggguuacaaagaccuugucuugaccucugcccccagacaaaacaaaagccuaauccaaaaucaaaaagauagccuuacuucaauaacuuauccaaagauuuucugaaaaacaagucuauuaaaaagaaagcgggguggggggcucacuggggaaucuuccaggguaguuuucuuagaaauaaaaaauuauauauguaugugauugcuuuaccuguguguguauuuauuaugccuggugcccuugguggccagaagagggcacuggagucccuggaacuggaauuacaaacuguuggggagggugcgcugaaguuguuaaaguuggaauuauuaguugacccugcuuuuuccucuuuuuucccuaagcuguacagaccucuugacacuucuugagcucagccugguaacuucccuauuauacucuuauguuugcugcuuuguuuauugaauugaauaauugaauuguguauugaauaaaguaguguuuuauaagguugguagaguauuuuauaaagguaacaaguuagcguuuugacugagacuuauugaaacauagcaucgcuguuguaauaaugugcuuguuacaguugcuaagucuaucagcugugcguccagaaguugacuaguuuguacucuguucagaauuaaaauaugauucacagagauauguaaagaguguuugucaaagucauaauucuuaaacuuaaaaggcuaagucugaacagaucaguaguugacauuuccaugaguaagucaaggaauagugccuuuaucacuagaaauauaggaaugacacuaucaacaugaaaaugacaccuaggcacugagauggugcuuagcuugcuugaggcacugguaaggaauccgcugaaaaucuucgaccaugcucguuuaugcagaugcauuuuuuugauuuauuuauuuauuuauuauauguaaguguagcugucuucagacacuccagaagauggagucagaucucauuauggaugguugugagccaccaugcgguugcugggauuugaacucuggaccuucagaagagcagucgggugcucuuaccuacugagccaucucaccagccccugcagaugcauuuuaagauuaauauuuuauaugauauuuuuauagggucaaggaauaaaauguccuuauaacuuguguguaaauacaggcaguggacauuuaucaaagaauuuuuaagcuuaaauguugcugccucaggcuuggaggcguagcucaguggcuggguauuugaguagccuuugguucaaucaauccuagcauugcaaaacaaaauaacauucuuuauagagcugacauuuguugcucuuguuuucucagacaucuuuaguuuuucguaccccuauucaggaagauaauacacagcuccuggcuuuguuaauuauuugcauucuuggacucucugagauuaaaaaauagauuuauuuuuauaauuuucaaauaagguugugugugugucugugugugugugugugugugugucugugugucugucgauaugcacauguugaguguaagaacacaaucuuaguggaugcccaauccuuugauuacaacucaaguuacagaugguugugagcugucugaugugguugcugagaccugaacucugguccucugaaaggacagcaaagugcucuuuucuuucuuccuaagauuuauuuauauaagcuuugcuugcauguauguaaguguaccauguacaauuaauagcugccggggcuagaagaggguguccaguccuccggaccugggcuuagagacggucaugagguaucauguggaugcuugggaucugacugaaccugguuucuuuuuugcaagagcaacaagugguuuuuguuuuuuuuuuuuucuuucaagauuuauuuuauguauaugaguacacuguaggugucuuuagacacaccagaagaggacauaugauuucacuauagaugguugagucaccgugugguugcugggaguugaccucaggaccucuggaagagcagccaguucucuuacccacugagccgucucuccagcccgcaacaaguguucuucaccacugagucuucucuccaguccccagaaaauuauuuauuaucugucuuguuugucugucugucuaauuugaagcuaucuauauuuaucuuaugagcuguagacuagucuugaacucuguguaacagaggcuggccuugaguuccuggucgcacuucaucuaccuucucuuugcugggauuaugggcauguaccaccaugcucauuucugguuuuguauggggcuggggaucaaacccagggcuucuugugaguuaaauagagagauaguaaacuauauuaccagucuuguauuuauuuuuugugaugcugugugucaguauauaacucaggcuguccuauuaacucucuguccagauauguuuguguaauaauaucacuauuaauuuuacacacuuaaauuguuuccuuuucucuauuucuucacugugagacaaugaagagcucaccuccuuuagcucaugucuauuuaauacuugcuugacucuuuucucuuggccuguuuuagggauguuugcauauaugaaacuccugccucuagcuguuuuaguuuguucuuaaauaaaaacgugcaagcgcugggauuugaacacugcacuuuacugauugaggcaucuccccagcccuguaccuggucagcucucauuucuguugcugcguuuuccuuugaacuccagagacuugucaguuugccugucacugauguggauugugcuuccuuggaucugagucuuugcacucauagauucaccucagaaaugugacacuugaguauucaguaccagaaguaguugaggucauugagacggccuagcagguagagaugcuugauguuaagcccaaggaucugaauuugauuauccuaaccugcgugguggaagaagagacccaaaucucacaaguugucuugacuuguaccugugggcugugggauucugacacuuagacagacacacuugugcacacacaaugaacuaaugagugaaagaaaaacacaacugccuuucccuugcuuucuuaucaaggcucuguacuaauccagguuccuguugcuaaaacauuauuacauguuaaaauuccuguguggggggcaugauuaauguauuuucuacuguacccaaaaaacgaauaguucaagguugugucaguuggguuggacacaguagcguagaguugaguuucaggguccugucuagcagugaaaucuguuuugauuuuguaauuuuuuguuuguuuguuuguuuguuuuucgagacaggguuucucuguguagcccuggcuguccugggacucacuuuguagaccaggcuggccuugaacucagaaaucugccugccucugccucccgagugcugggauuaaaggcgugagccaccacugccccacccucuucucuuuugacaggaucucucuagcucugccuguccaggaacucacgccuuagauaagacuaggcucaaacucagauccaccugcaccuguggaguuaaaggcuuguaucaucagcuuauuuugaucuuagggaaaauguuuuagugucuuucaucauuauguauuacaauugucaauuucuguaguuccuuuuaucaggauaaggguuuucuccuccaugcugaaauuguugaauagucuuuauaauaaaaaaagguuggauuuuauagaccaggcuguggugguauaucccagcacuuaggaggcagaggcaggcagaucucugaguucaaggacagacuggucuacagaguguguuccagggcagccacgacuaucuagagagaccuuuucuuucuuuaaaaaaaaaguugaauuugucaaguacauucugugacuaugaggaugcuuauaggguuuuguugcuguuuuuauugauaaaguauccuuuuuuuauguguuuuuuuuguauuacuacaaucugguuugcauagaguugaaaagugucccauguugguuuugagaguuugugaagaauuuguuguugaaauaacuucucccucccucccucccucccucccucccucuguccguccguaaguccguccguaaguccgucuguccauccguccguucgucuguccauccauccauccauccauccauccauccauccauccaucuaucuaucuaucuaucuaucuaucuaucuaucuaucuaucuaucuaucuaucuggcccagcgugguggcgcaugccuuugaucccagcauuugggaggcagaggcaggcagauuucugaguuugaggccagccugaucuacaaagugagcuccaugacagccagggcuacacagagaaacccugucuugaaaaaccaaaaaaaaaaaaaaaaaaaagaaaaaacaaacccccaaaaccaaaaaaaucuaucuagauggggucuuaaaucaggcuguaaguguaauuaggguuaaaucaggcuugccugggacacacuguggcccagguugcccuuaaacacaugagauccuccugccuuagccucaugagugcuacagaucuaaaccaccaagcuccacuuuucugggaaguuuugaugacuaguuuaguuacuuaaucuauuacgagucucccuuuauaguaguugaugaccccauuccucuucuauucaucuuuguggcuuuuuuuaugauuaaagugugaacaguuacaagcuacagugugguuuguaggucaaaggacaacguuugggugucuauucccuugcugagguaggguuucuuuuguuccugcugucagcauauugcaggcuggcuggucuuugaucuucuggaacaauucucuagucacaucuuuugguagacaugcugagguuauagauacaugcuccugcauccugacaacuuacauauaucucuaaggugucaggugucacgguuguaugguuagagcuuuuacuagccgagcccccuccuuggcccuaguuugugucuuuuucaguauuguauuuuaucuaggcuaauuuggugacacauacuuacuuguucuagguuuccuuucauaaaccccgaauuuucauuuuugucguuuguuugaggcaaggucuuacuuugugcuaggaugucucugaacucacuuucucccucccuccccuucaguaacgggauguuagggauguauuaagcuuugcagucucuccaguaacugugccccuucucucuuacuccuaauauuacuacucuugaaucuugugucuuuguagcuggguauuuauugacaucuccucaacuaugagucaacucuugaacagguagcaaagaagcuagcucaaaagaagagugaccaccuaccuugcuaaagcccuggguucugucucgaggaccaccaaaaaccaaagcaaagugaccccccccccccgaaacuuaaagacucacguuuuccccguuuucuuuucuuuuuccuccuccucuuuuugagauggggguuucucuguauagcuauggcuguccuggaagucucucagucgaccaggcucccuucacccccuucccccccuuuuaauauagcauuuuaaucuuuaacacaggugauuuggaacucaguacauaaccugggauggauuugaauuugaucagauccaucuucucugucucagcagugcugggauugaguguaagugaccacacccagcugggaguuauguucuaauuuguugacaucccucuuucuaaucuucauuuauuuuaguuccucugucuucuguuccuucuuuucuauuugcuuagauguauuaguuugcuguucucucuuuaauuucuuaagguauaaacauaaauauuuuuuucuucuuucugguuuuguuuaguuugagacagggccuuuguagcuugauuggcuucugccucaugauccucccucccugacucuugagugaugagcacugcugugauggcagauacauguuauuuuuaaaaguaaagugugugugugugucugugugugugugucugugucuaucagugcaugaaggcacaaaauguaagcucaggcacacacacacacacacacacacacacacacacacacacacacacacaugaagacaagcaugucaugguugcauaugcugcuuggagggcaauuuuguagaguuguccccucuuuucaccuuuauauguguucugaggauugaacuacaucaccaggcucauuuaaccugcugagccauauuaugccagcccauacgccuugguagagacagggucucacuguguagcccugacuaguguggaacucacuuuguagaucaagcuguucuuauaaagaucugccuaccucugccuucuaagucagugguaggauuauaaacuuuuguuaugcucaucuuuuuauguugguucuaaaauguaucucuauuuuauauguauagauguuuugccugcauuaaugugugugcaccaugugugccuauuaccugcagagaccagaaaaggguuuugggucuuuugaaacuggaguuauuuauaggugguuguuaguuguuaugugggugucgggaaccgaucccggguuuucugcaagaucugccauuauuaaucccugccacuaucaugcacugauagacacacacacagacagacagacagacagacagacagacacuguacuuuuaaaaauaacauguaaagguaaaaugaaaauacauauugacaaugagccaucacagcagugcguaggaauagagagcuccuaucuucuacccuuccuccagacauguucaaucaaaaguaauaggcaauguuuagaugcuaugaaagacaguaggaggcacuguauuaauauaggacaaacuauccuggugugcuucuagcuccaggagcauccaugguuugcuaucauucagaaauggcucucauccagacuccaaauauaaugugaucauuccgucagguuauuguuuucuuugguuguuccuaucuccuuguucauugaucaugcuguugggcuuuugucuauaauaaugguacuucucaggugaugguggguccagggaaugguuaucuggugugcaguaggaauaaugaaaguauauuuaugguuuuugaguauacugggaaagauugcauugacacugucaagaagugugggugcugaauuucuauacagacaucuuucuggguuuaaugcaguaaguaguguuuggcaguuaagcugagguaauagcaugaaaagauugggaugacaggcucggcauuuagauugggcaaaauaggccacagcugcuggaauuuguauaauacaaucacccaccuacaugaaauagaaaggccuuguaaaagguguuuuaugauucagaaacugccaguacccccuuguaucuucaaguuccuugaaaugaguaaaauuuauaauaaaaguugaauggagcuaggcugugguucaguugguauaguguuugggcagcgugcacaagacccugguucaauuccuaguuucacauaaacugggagugauggcacaaaccuguagucuaagcacguggaaggcagaaguuuaagaucaucuucuguauguagugagcuacagccuagcuuaaccuauacauucuuucuuaccaaaacaaaagugagaaaagcuuugaagaaaagcuuugcuguguugauugagaccggcuccugaguucugaucaucuugcuucagguacaugccauacucgaucaguuauuuagaguuuugcagacuugaguucagcauccuaauuuagucaagcaugguggugcacaccuuuaaucccacugcugaggaaauagaggccuguggaucugugugagcuccgaggccagcagagucugcauggugaguuccaggccauucaggcauucacagugaaaucugucucacaaaacaaaacaaagaaugggaguguagggcuaguggaguggcucagcauguaaugaugccugugaucaagacugaccugaauucaauucccaagacucacauggcaggaggagaaugaucucaaaaauauguacuauaguaugcccuucccuuaaauaaaaaacaauaaauauauauuuaauuauaaaagaauauaguuuggcaugguacuucauaccuacaguccugucauucuaaaagugagaauuaccacgaauuugaggccagucuagguuaaagagugacuucccagccagacagguaauaagacuuuguccuaaaaucaacagcgacccaaauaauagcaacaaaaaauucucccucuaaauaguauccugggccuggagagauggcucagcaacuaagaguguuagcugugcaaucugaggacuggagucuggaucccagcacccauguggcagccuggggugccacccaugcugaugaacccagcucagacggggcagagacaaaggcuuuauuggguuuucuggcuuccaucuagccaaggaaacaugagccccaaggcugaggagagacuaacuccuggcccuguucauacuguccacacgugcaaauagacugucaaccugaguaaacaaaauggcuuuuuaagaaagaacaguaacugaagaaauacuuuugaaguaaucuuaauuuuguuagaaacuuguacugagauauggcaggaaguuuauauauuuuaccuauucauuuguugaccuaauccugguauauuuucaaaauuaagauacuguaugggagccagaaauauuggcgcauaugccucuaaucucaggacuuuguagauugagacuggagaaagaguuugagccuagccugggcuaucuaguaagacucuuaucucaagaaagaaaauaaaagaaaauccagucaggcuuugugguacaguuuuauaauccccaguacucaggggcuguaauuaggacuucaaggacugucuggauuauacaaugaguucaaagccaaccuaggcaaucuuaucuauuuuugagauaagaaaucucuaucaaauagcucugucugucccagauuuccuucuguagaccugacauguaguucacagagcucccccugcuucggccucuggagugcuuauagaaaagcaaggcauaugcuaccagccugagcaucuagagagacuuugucucacaacaacaaaaauguaaaacagauuggggaggaaaagaaauaaauauuuaucacugguaagugcuugccuagcaugugggaggcucucgauucaauuucuauuaccauaaaaacuaaacaaaaccagcaaaacaucaaacuaccacaaaucccaagugagcuuuuguaguucugauacugcagugcuacuaauauuuaacugcuguguuacauagagagaaaccuuaaacauugaggagucuguuuucuaaaaacaggauuuagaauaaagaaucguauuuucuguggaauugacugaaaucuccacccccuccccaccccccgacuuauacauuuguacgauuguaagagaauuaacuucagaauuacucucuucagcuaaaugcaugcaguucuuucccuucagaaccaaucagagccaguugggugugguuuguagugucuuaugugcagcacugugacuugguguguagaugcuccugaguacugggagugcaggcacauguauugccacaguuggcaucuugcuuugcuuucuucccuacuuucucaguggaaggcaauccaagcaagcagcaugacccucgggucguugggagggaacgagucccuucggcuguuuaguuggaugguagcuuucuuucuuuuuuuuuuuuuaaagauuuuuauuuauuauuauauguaaguacacuguagcugucuucagacacuccagaagagggcaucagaucuuguuacagaugguugugagccaccaugugguugcugggauuugaacucuggaccuuuggaaaagcagucuugugcucuuacccacugagccaucucaccagcccggaugguagcuuucuuaugcgagcagguuauauauagucuugaguccccaauuaaauacuuccucccucccucccugagauaagaacgcaacaaagcccugggugucuuccuauucucauguagucaagugugaccuugagccuccuguccuuggccucuccggugcugggaugaacguaugcuaccacaccugauuaaucaguauuucugucugugucaugcuuagugguugacaguugucuuugacugacauuccagcaucuguuaauauuguaguugcuaaaaaucuaccacuuuuuuugcuuccuaggcaacagcugagcagaugcggcuugcucaagugaucuuugauaagaaugauucagauuuugaagcuaaaguuaagcagguauguuucuaucaaagaauacugugacuuuuccuuuauucuuagugaaaaaaaaguauuuucuaggaggcuggagagauggcuuugugguuaagagcacugacuacucuuccagaggaccuggguucaauucccagcacucacauggcagcacaaaacugucuguaacuccaguuacaggggauuugacacccuaacacacacaugcauguaggaaaaacauugcauauaauguaaaaauaauaaauuauuuaagagaauauuuucuuuauguaugugaggguuuugccuacacguauauauguguaccacaugcauucuuaucugagggugucaaaggggacauuagaucuccuggaauaguagugauggaugguuaugaaccaccgggcgagugcugggaacugaaccuguguuuucugcagcagcaacaagggagcuuaacugccaggucguuuuucuagccccuucacuaauuuuacuaggaauuuuaaauuuuaaaacuuauuacuuagucugaucuuguauucaauaaugaauuuugggccugugaucaaguacucaauacugguagccagacaaggaaacacagcaugagcgucuuugucuugacagugggaucucaguagugugcuugcaugugaccagugggcuagacauugcugcagucccacugacaguucuguauaccuagauuuagaaaguauaacuuuugagaugugaggaauauauuuuuaauuguaggaaagaaacaacaccuaccuuacuguagaguacuuguuguucacucucauagugaaggggaaaugugaauccagcgagugguuagaacuggugguccugugugcucauguaaagagcugugcuuauguuuauuagaccaagaggucuccuuucugcacuucaguuuauuuacuuuuguagugcuaagaaucaaaccucauacauccgaggcaaaugcucuuaccgcugaacuacagaugcagcccacaggauguguguucuagacaggugcuccugugcuacuacagacaggaaucucaugaaauguugaaaucaagcaguuuuugaacuugaguacauguuaaaauaauuaaauccuguuaauacacaauacuuaugccauagauuuguucaccgauauuuuaggaucguucuaauuaggaagaugcuaagaaguuuguggggcugguuaaagagaaggggaugagauuuacuuugacugcagcuauaagaugugcugaagcugugacagcuguugaauucugcuugugagacuucaggcuguuaguaaguuuguagauaggauguucuaaugcaauuagugaaugcugacuauguucaaaugaagucccaguuaacauuuuaggaaucaaaacuuugcaaauucuaugcuauucacuuaaguuugagcaugauauaggaguucugagaaugcuggucugugcauauguuaugcuguuucauaagcugaggguugugaugaacaccuuucauucuagauucuagguagaagagguaggccgaucaauuaguaaugaguuugaguuuagccuggucuguauagcagguuguuccaggccaguaaccacuacuuaauuuaagacuuugccuaguuuuauuuggggacacaagagacacaggaaucucaaccugcucuuugagccuaaacauaauagagucuagaaaaggccauuggguggaaggacagcauaauugcuguauuugaauagaagaaucacaaaguuaauauugaaugccuuuuucccccccuuuuaaccauuuucugauucuuuuacuagcuuauggaagugacgggaaaaaaucaggaugaaugcaucguggcccuacaugacuguaauggugaugugaacaaagcuaucaauauacuguuggaagggaauucugacaccgugaguaucacccacugguccagcuccagugucagauugcauuuucaguuugacuguggaugggagcuguguugcagggguugggcaggcuguauuuuugagggaguguucugggaaacaagccuggggucauucacauuauagacaagcacuagaggaaagguccaacaggaaccuggcuggcuauuucuuccagcucaacaguuucuaaaaguguccaagcuuguggacauuaacaccaccugagaagcuuguggcuccagacuacuaauggcuacucaucuuagucaccacuucugacuacuagauacuaagauacuaagauaacaggaugcaccaccauacuggauuuaugcagggcuggggauugugaaugcuaggagcacucuccugacuuacauccccagcccuaccuuuuuaaauguuuuuuaaagaaaaagauguauuuauuuugcuuuauguauguggcuauguauguaguaugugcauacauauaugagguaagugccuguuucccuaggaggucagaagaaggcauuacuauccccuagaacuggaguucuggguaguuguaaaccaccauguaggugcuggggacugaauccauguccuccauaaaaaccagcaagcauccuuuguuguuguuuuuccacucagggcuucucuggguaaucuuggaacucccucuauagcccagaguaccugccuccgagugcuggauaacaagugcucuuaacuguugaaccaucuuuccagcccuuucugcccuaauucuuacaucugcaggauuugcuaguuccuucuugcuaaugaauguuaauaaauauuccauaagcaugugguuuugaaacuuaguaauacagacccuuacaacgcacagacauagaaaauaaguuguagugcuuaaaaaucaugcgagaauguugucugcucuauuccuuugaccuccuuauggaaauuugauuguauuugauuuauauuucuaaacugaggaaacuguuucagagaaaauuuaaacaaauaauaugucaccuagaagaaaauacagcgaugacugcauccaacauggcugucuuggggcuggagagauggcccguuggcuaugagcaugaacugcucucuagaggaccugaguucaguuuccagagcucuucugugguaguucauaauggcauguaaucccagcgcgcgugcgcacacacacacacgcacacacgcacacaaacacgcacaugcacacgcacacacacacacccagagggguggggagggagggagagagagacagucagacugucuuuuuauuuauuuuuauuuuugggggguuuuguuuguuuguuuguuuccgagacaggguuucucuguguagcccuggcuguccuggaacucacuuuguagaccaggcuggccucgaacucagaaauccuccugucucugccucccaagugcugggauuaaaggugugugucaccaugccuagcucauacugucguuguuuuaaaagauuuacguaucuuaugcauauagaugcuuucuuuucuaaagauugauuuauuuauuuauuuuauguauaugaguacacuguagcuguacaggugguugugagccuucaggugguuguuaggaauugaauuuuaggaccucugcuagauccauucagccccgauuacucagucccuguugcuccggcccaaagauuuauuuauuauuauaaauagguacacuguagcugucuucagacagcaccagaagauggagucagaucucauuacgggugguuauaaaccaccaugugguugcugaaauuugaacucaggaccuuuggaagagcagucagugcucuuacccacugagccaucucuccaucccaggugcuuucuuuucauguauguauguauguguaauacuugcuagccuuguacauguuaaggccagaagagggugucaggucccugagacuggaguuauauacgguugugaacuacuacuauauggauacuggaaaucaaaccuaggucuucuggaagauuugacagugaaugcucuuaaaugcugagccaucuccccagaccguauacacacauauuaaaguaagugugugugguuuuaauuuuauguguaugaguguuugacugcgugugugucugugugucaugugcauguagugccuguggaagccagauggguuaucaggcuccccagaacugcagguacacaugguuaugaccauccugugggugcugagaaucaaaccuggauccuuucucuggaagagcauccagugucuccucuccucucucucucucucucucucucucucucucucucucucucucucucucucuuuuucuuuuucaauacagggucucacuauauagcccugacuguccuggcacccacuuuuagcuuugaguccauguucaaggcuggucuuacacccagagaucugccugccucugccuccccagugcugggauuaagggugugagccacuaaaccugacaggugccauucuuuucaauguuuggguuuagucacauucuugcuuugaggggaggcuguuacaaauauucacugaguaaaauuggagugcugugagaaagcaaguacuguaacuauacacugcuuuuuaacauuuugauguugaauagaaugaaguuuuugggcuggagacauggcuaagcaguuaagagcacaugcagcucuuucagagcacuacacaauagcucacgacugcucaacuccagucucaggagaucuggcacccguuucugaccuuugugggcucuagucaagcacaugguacacaagccuacauguagacguguauuugugugugugugugugagagagagagacagacagacagacaaguuuuuacuuucuagcccagguuggucuggaauuuacuauauaggguagauugaccucauacucaaagcauucuuaagugcugggauuauagugugagccaccaugccuuuaauauuuaauuaauuaaaauuaaaaaaauauuucuauugauuuuauucauuuuuuucuguggguguuuugcuugcaugcauauauaugugcuggguggcagaggaugucagaagaggguguuggguccucugaaauuaguguuauaaguuacagaugguugaaaucacaaauguaggugccgugaaccgagcuuugguuuucugcaagagcagcaaaugcucuuaacugcugagccaauucuccagccccaucaccagcucugucuugaacauagaaaucucauaacugcgagccagagcuggaucuuuguuuuugucagagagcguaugauaguaaguuaggggcugaacauaucacgaguacucuuguuagcgggugaguggucgugaaggaaauggagcagagaaaaguucuuuuggacuucugacuccuucuaggacauugugggacauaguuucuuccaugcuuccuugccaugggucuuaccugacagugucagcagcuuuguuucuaaugacuaaccaacagcaaugacagucuuggcauacuaacugcaguggggguaacugugcaaacacuggaggguggccagcagccagaguguuucaccucagccucaggugugugcccacugagucuccaggucuccccuugcucaacuuuaccuaacuuucugucauaguuuuacaucccacaaaugggaaagaaauagaauguaaguuuucaaagcugugugaccacuuagugguauagacucuacuuuuugacagacuucaugggagacuguaggagggaagaagaagaauuuuggaagagaaaguucagaaaacaaagaaaacagagagaagaggacggagagagaagcgagucguggacggggaaccaacaaccgcaagggaagaggcggcaaccgaguccgagagugugaguguagcucuucuccuagccguucucacacacccgaagacugggagaacagcccgacuaccaaucacucccacugacacugggucacacagggcagucuguaagauccuguaccgaccugagcugcaggucguucauucuuguccuuucagacuggcuagaaaccaagcaagcugggagugugguggguauaggccuguuuguaugaagcuguuuuuucuuccccuacagauauucaugcuauagacauagauuaaauuaauuagagaugucuaggugugucuucagccccagguagaggcauguggguuccugugaguuuugaggccauacagauuuacauggaguuccaggccacccaggguuacauagugagacccugucacccaccucccccucccaccacacaaaaaaaaaaaaaaaaaauuaaaggaggcagauucagaaggcagaauuguuugagcaguuuccuuugauccauauuuugacaccaauuuacuuggaacagcccaggagacaacuuguugcuguguagggaguacuuggcaaccuguaguaaugaacacauagauuuucaaacagcucacagugagcucaugucuauaauccuagaauuugagagcuuuuaauagaaaaauugugaguuccaaaccaaccugagcuauaucguaaaaucuucucucaaagagcucucccuagcccuuaugaaacuguuauacuuucaauauauaccuugagccggcuuuagcuaagauuccuuuuuguccagcagugaaauuacaggcacccacuucugucccucacucuaaauuuuaaaaguacauauauauuuuauuuucauaacgggugugggugcacaugucaugguguacaugugggggucugagaaaaacuuugggguugacuuuuucccuucaccauuuggguccugggagugaauucaggcuuggcaggagcccuuacccacugagccaccucaccagcucuauuuuuaaaugaaggucgauugaacaauaacaucaagaucgagaaaugaguauuuaaguaauagaaauguauaguuugugcuggggacucacucaggggccuuugcuugggcuuuuauuugaccacacuucuagcacuuauaaaauacuugguuuuuauuguuuuugagacaggaucucacuauguggccuuggcugcccuuaaacuuccugagcuuugccagcccucggcacccaagugcugggauuaaggggugggccaccacaccuggucucaauaguuuaguaauguuuguuagaacuuguucuggggagaaauaaaguucagaagcaggugaggaugaugggaagggauaggauaaauuuaaauuuguacugcaaaugaagccaagcucaugugagcuaagcagcaacuaaaaaguggaguaaugauaucaauaucuauugacuaguuuuuguauggaucuauuggauccaguaugaauaugagaaacagaagucuguccuugccuuuucugguaggaugcuacaaagccugucucuuacacuuuaccuuuuguucugugauguuuauagauagcauuguuuuguaguaaguguuggguuuuaguacuuauuuauagaaaauuuauuuuacaggaggguacauguagacagaaaguaaaaugcccaugcuguauacuguuuuagucauggucugacugacugcccuggagcuugcucugcagaccaggcuggccucagagcucucgccucuguucugaguguugggauuaaaggacugugccaccaugcucagcaccaugugauuuucauuuuagucuucuaucugggauugcaucuggugccauucaggauuuuguuccacaccacccuccuuccuuccuuccuuccuugagcuuuauuguagaaaugcagagagaaaguaagagaaagagagaggccagccauggccauguggagagaggguggaagggagagagagaaagagagcugagaauaagaaaggugagaccuuaagagcucuuuuucuuuuucuaaauacuaggucugauuaugugguucaucuggccuugagcuugaauucacgauucucuugguuuugucauccuaguguuggauaagccuuuggucaugugcuucuagauuugugcuacuuuuuauucaucaugauuucuaaauguuguuuacauuuuaacuucuuuuuaaccuuuuuuuuuuuuuccuuuuuggcuuuugagacaggugcucccucaauauguagcccuuguuugaauuuagaccaggcuggccuugaacuugugggauugcaaagaagaguguuggguuuuugauucuuucugugcauuuugaucuugguuuuguaucucauaaguuugguaagagguuugaaaaugaaaaguugacauguuugcuuuuucuucuuuagucaaaggugaagagaaugggauugacugcagccaaggagacaagccugcggagcggggcaagcgggcccgaggcagaggugaggggggaggaggaccaggccagcugcugccacccuggcuauuaaggaugauuggaaaugcaguaugaaggaguguucucuaagauggcugagaaggaaccccuuagauuaugcccgguucuuuuguuuuuacauuuugcuuugguuuuguuauuuuuggugcugaagguugccuguccuugguaagaauggcuccaucccugagccaucccucagauccuggauuaugucugucacuuugaagaauccuuuugguuauuuucagaugauuuguuuaagccacuuuuauaaucaguuauagugguguacagauguaaucccagcauuuaggaagcugagacagagguaugauauacaugguuacacuaccaacaaagcaaggagagcuuauuauuuauuuggggguuugggguauuuuguuuucuacacauaguuucuccauagcccugagugucuuggaacuugcucuguagaccaggcuagcauccaguucagagaucugccugccucugccucugguauuaaaggcgugcgccaccauugccaaggcauuauuuauauuuuaaauuguuuuaucugugaacgguuugcuugcauguacaucugugugccauguguaugcaaugccugugggggccagaagagggcaucagaugccccuaagaaugaguuagcugcuuagcugcuuuuuuuuuucuucuuuuuuaaggaaaaaaaaaaaggcucauacuguagucugugauugacuacagguugagaagucacccuguagccccagauuggccugaaacucugcuuuauuuaaucauuauauauacauguacaaauacaauuauauucuauaauuguguuuuguuaaaggauuuggacguggcaggggcagagggacaggaagguucuccgcucaaagcaugggguaagucacagccaucccacugcuguaggugcuuccuaguuguucuguuuuaucugccuuugaccugccuguacuuuaucccagcuagaggugguuguacuucugaagggcuuucuaaccauagugaaaauaguguuguuguugcuguugcaguaaaugcugcgucagcacugaagccucugcuccgugcaguuugcuuggauaacuucauuggugugcaugugcugcacagugaugcuacaucauccuucucucuaaccugacaccccucuccuuccucaugaaguuacuaacaugucugcggacaccacauguucccaagggaguaggcauaugugcauaauguccucggcugccagguugaaagccacuuacagaugcggcuaaaucuagcuauuuaacaugaaguguuuaugugaaugauaguguuguccugagugaugguagugaaugcugagcauucuagguagguguuagaguuagcuacuguuaugucuaguuuuucuuucucuuacuguuucuuuugugcauggcaagacaacuugaauuuggaacccuagccuuaaacucauagcauuucuguuuacuuauguucuuaugcgugcauuguaacauggauguagccugugaauccugacagcuaguucuuuuauuucugaaccaucucaccagcccccucuagugauaauacaaagaagugugaacaaaacauuucuuuagcuauauccauauaugaagaauauaauucuacucaaauccacaguugggggugcuggagagaugguucaucagcuaauagcacuugcugcuauuggagaagucuuagguuugguuccagcacccaggccuuucaucaugucuuacagccauuuguaaccccaguuccagggaaucugaugcucucuucuggacucugggcaggcagcaugcacaugguacauauauguacauguagggaaaacacagaaaauauaaagaguuuuaaaguucuuuugguguuaugacagacccuuccuuaaucccaacacuaaggcaagagaccagcacauuuuugaguucaaggcuagcuuagucuacaagcaaguuucaggacagucgaagcuucaauucugacacaagaaggagacacguuuacacuugauguauuuguucucauugggacuuuuuuaaaauaugcaguuuuaugugugggcuugaauguauguuugugugccaugggcaugaaggggccugugaagccagaagagguuuccuaggaacuuuugaauuccaggccauuuugagcuuucgaguggguacuggggauggaaccugucucccaaguccugcaagagcagcaagugcucuuaaccacuuugaaccuucucucugguccuuucauuggacauuuucaaugguguucuuucuagacugggaaggcuuccaggucuucauaacuuuucaggaugccaaagacuauauuguagaaacuugaagaccauuuauacaaaaguagguagaugauccuaaaguaacgucuguugaagauauguacgcuuggcuggcgauguaguugauagagugccucccuagaacaggcaaagaaaauuccguccccagcauaccauaaaacugggaauggugguauaaacuuguaauacuuguaaacuugagguauccacuagagaagaccacuaggacacagcucaagccaauagaaacuuuuauuaguaacuacuccagguguuugagacugaguuguagcccugagcauuucucagaacgggcuuuuaaucacaaaaccuacauuccuggguugacacacuucaguuagccagaaguggaacuauaggagccaaagagcaaggucacuauauuuagggacuuuccccaaagcaagauggagaaggucuucuuuguucuucuuuugacagguggugcugccuaugugcugagguacccaaggccuguguuaaggucugggaaucuauuacaguaucagaaguucaaggucaucuuuaguuacagcguucacagauaaccagggauacaugauacagaccccaucuucaagaaugauaaggcucacucaugucuuuaaucuuaguacuuaggagguagaggcaggcauauuuaugugaguuagaggcuugucagugcuacauugugauacccuguuuaaaaaacaaaaaugaaaacauucaaaucacuggaccuaaagguuaauaaagguccuuguuaccaacgcuuuaaaguucugucccuaggacuuuuaaggguagaaggaaagugugcuguaguacaugugaguaacuaaauaaaacaguuuuguaugggguugguuggggugucacaagccuuuaaacccagcauuugggggcuggggggcagaucucuguacguuuaaggccacuccugguuuacauauucaguuugaauacugccagggcuacauugaaaauacugugucugaaaacaaaacaaaacagaauaacccaaacagagaucuuuauuauaggcgcaaaaaguguauaaaaaauaccuacaucacaguggcuuaaagaguuagccauuauccaauauaaggagggaggacuuuuuauagcaccccuuugaagggacuugagcugauuugguuuugaauauuuucuuuuuucuauuuucuuguuuuuagagucugucuauguagcuuuggcugucaugaugcuugcuauauggaucagacuggccuugacuuucagagaucugccuccccaaugcuguuugguauauuuuauacgguuuauuuugugauuuugaugcuugcuuuaguugcuuguuucuuuacuucaacccccccaggacauucaauccugcagacuauucagaguccaugucuacagauggcugugggacaaaguuggcaguuugggaagcugcucagaaugguacagaugagggaccggguaagugguuuuuuggucuuguuuuguuuuuguuagaagucuuuguuuuguucugugucuguuuuugagaaauagucucauuguaccuuaagcuggccuugaauuuucagugauccucuugucuaauauucuagaagucugggauuucaagacucaucacagccaucuucagagacucuucuaggauugauuagggguggaguaugggcacagugugugucugucuuaucugucugucugugucucugugggguaaugcaugggaguuugggugcuuauaaagaugagaauagggugccaaauuccuagagcaaugguuguagguauuauaauccaccugacauagaugcuggcaacugaguggagggccucuggaagaauagcaagcauccauaacugccaagccaucucuugagucccuagagcuuguuuuaaaauuguucuuaucugaguauggugggucaugccuguaauucccagcacuggggggucuguuaguagcugcugaguucacagccaaucuggacuguggcaugagaccuuaucuaaagaaauguuuuguguucuucuuuuuuuaauauauauauuuauuuauuuuauguauaugaguacacuguagccauacagaugguuguaaagucauccugugggugcugggaauugaacucaggaccccugcucacucuggccccguucgcuccagcaccgcucccucucucccaaagauuuauuuauuauauguaaguacacuguagcuguauuuagacacaccagaagagggcaucagaucucauuacagaugguagugagccaccaugugguugcugggauuugaacucaggacccuuguaauugcagucagugcucuuuacugcugagccaucucuccagccucuuaugcucuuguuauauaagcaugcuggauggagaauacucccaacuccuuuuaguuuauuguuaccuucaaagccucucaaugggaaaucucauugacagccagguguagugucucauaucuauaaucccaacacuugggguugacaguuauuaggcagugugcagcuaacagaaguguaaauggacagauugacaauguauucuacugccaaucaagagucuccugucuagcugauuggggcaaagauuugcuauuucaguguuauucauuacagagaaugcagccucgcaaucccacgugagaacaugggcccaagugaggucuauacauucacaaagaagacagcaaaucuuaauaagucaucaagaauuuguaucuauguucuuguacccguggguguggguucuugugccuaugugcacaccuacagaagccagagcuuggcccaugugucugacuucaugcucucuaccuuuugaucuuuucccccuucauuuugugaaggauugugaguguguacacacaagcuguggagggcagaagacuuuccgcuaguggauuacaagaguguacucaggaucuccggcccuaaugguuugaucaccaauccagcguagucagacauuuaauacuuagaaccaauuacaugaaauaaaaauuaucauaagcauuauaugaguguuguugauguuuuguuucuauuauuuuccauuuaaugguuuugggccuugcucccucuaugagggacugcuguaauacauugacuuuauuuuguaugcugaucagcuucucuuguuuucauauacuaaaagcuuaccuuuuauuuuaauugacagaagggcuggccaagucucacaguaugucucaggaaccgccaaguaaaaguucuuauggacuuaaagguaugaagaauguuuuguuuugaaauuuugcaguuaagcauuauacagaacugaguguaucauuaauugguaggcuguucacguagacuuccugaggccuagguuugaguuugacaccagagcuacauaaggaagugugguccauugguacaguuugaauagguuugaggucagccucaaaagagaagaaacaaacccuuuuuagccuuuuggguaagggcacuggucccaauccugaugaguuugauccuggggcccauaagaaagagaaaauggacccuuacauucaugcuauagcaccuguaaccuucccccacuuccaucacaacauaaauaaaacuaacauuuuuuaaaaguguaaaguuguguggcuccuauauaaugguuuugggcugggugcggugcuugugcacugcaggcagaggcaggcgggucuccucaaguguaaagccagccuggucugcauagggaguucugggauagccaagaucccaucucaaaaacacaacaaaaaagaaagagggagagagaagggggaaggacaagcauguuuacauuggucuuuguguacacacacacacacacacauacacacacacucuugcagcaaucuagcuuaugaaugagacucccacuaugguuacauuauuuggcuuugacaauuacuggggggauaacugcuaaucuacuuuucuaacugcuggccuggcugccuccccagugaugugcccagacacuuacuguuucuccuggcugugcucaugcuccaucugcccucacggcagcuuccucuucccucccaaguccuccuccuuccacucucugcagccccuaaucagguaacucaaaaccucccuaccucuaucuaaucccuccaguaauugucuauacuauuuuuauuuaaccaauaauuuuaaaauaaagaacaagguuuguacaacaaaauuugguaagugugagaguucacucauaggcaaguagaucuuuggguacagaauuuuagcauuacuguacauaacaacagaccaaaucgcaacaguucuuaucuuccucauggccccccucucacuuacuccaaaugggcuucuaguuuuuaagugcuuggccuaaacccagagcauuguauauacuguguaaauacuuacuuaguagcgaacuaaauucucagccagcucaacccaaacauacuguugcaggcugcaaaggaugucuucaaaguuaucccauauguuuugggguauaggacaacaacauuucugaaauguagucguuugcauugaaauucuuauuauaaaauuguaguguuuuagaauugcuaagaauuagagcucaccucuuggcauuuuuaugcggcuggguauguggcaagccaccgcaacacaugcuucugacuuccccugcauuuccugaugcagcaguuaugggguucaugcuuacaguuguuauuaugcauuaugucuuucugcuugaaaaccaacucaagcuucucaccugaguaugcauggccucguuuguguuaauucugggcguagaacaggaugacauuuaaagcaaugagaugcgaacucugaaguaaacuauguguuauugcuaagauuuuuaaaaucucguucucuaaaucuuauggucagauauagauccgacuuaaucuucauaucaggccuugggcagauuuacauuuuaauaguguuccuuuaaauuuuuaauuuuacuuuugugauacaguuuuauauucauguggauauccaugcauguguaagcugaagucucauagcuuuguguuuugagacugggccucucacuuagcuuggagccuccagcaggcucggcuggcggccagcgugccucagaggugagccuaucauccucacucuugaagacccagcacaugccagcauuccagcugauuugugugugauguauggagggaacacacccaaaauaagcacucagagagucugagggaggacaugaggugucuuccucucgcuuucuacccucuucccuugaggcagggcuucugacugaaccagaagcacaccacgauggcaaucugguaccugcaugucuccauuccccaacacugccugccugcccgugcucuagacuugcgugcucuaggcuugcacagcacagcaaggacucuuauccacugagcugucuguuuagcccgaguacuuuuuuuuaucuuaaucauggauacucaguauggauuucacguucucauacuuuuuguuuuuugguuuuuggacacaggguucucuguauagccagcccuaacugucuugacuaauacuuacucauuagaccagauuggccucaaagucacagagauccaccugccucugccaccugagugcugagauuaagggaaugagccaccacugcucagaaauucuuauacuuguauaguaagcaccuaacugguugugcuaacucuucagcccuguguguuuguguuggcaaugccagaaauugagccauuuguuuacuaggcagguagucuaaaguuaagcuggaucuugcccugguauuccauuuuauuuguuuguuugagacaagcagggucucccuacauagcccuuacuaucccagaaauauauauauaccggguuggccuugaacucacagagcucccuccuaacugcugggauugaauguguaucucaucauauuauaguauuuaauuucuaauaauaugcaucagacggaguaaaucauuaauuguauuuaucuuuuuuguuuguuuguuuuggguuuuuuguuuuuguuuguuugguuuguuuugguuuguuuuuugguuuuucgagacaggguuucucuguguagcccuggcuguccuggaacucacucuguagaccaggcuggccuggaacucagaaaucuaccugccucugccucccaagugcuaggacuaaaggcgugcgccaccacgccuggcgauuguguucaucuuuagcauguuuguauguuuucuuaacagcagaauugcuaaaauauuuuuaaaauugcuguuugggaaguaugauuuaaggauauauaguuagggauauuuuauauagaaacauuugauuuuugucagaacuagauguaaagaaauuauguuucuuggauugucaaguaaauacacagaaucauuaagucguuagcguuauggcugacuuugugcuguaucgucucuuguuccgucaggugccuggaagaauucuguggaagaguggacaacagaagacuggacugaagauguaaguguuuggcaucaguucagaccuuucuuccccuucuucuugcugugucacagcaucccugcuucacaaaaggcccgaccacuuacuucaucaucuuaccuuuuaguucuuuuggcuucugucucuugcuucucaaguaguuggguuuuuguuguuguuguguuuguuguuuuuuucuuuuuuuuuuccuagcacauggaucuuagaaagaaauugguauuuuuagguuuuuguuuguuuguugagacucuguuuauauauggcccuggcuguccuggaacucaaaccaaacugguugaacucagagauccucugccuccagggugcuggguuaaaggcacauucugccacacccagauuuuuuauauuuaaagauaauggccuugaacucugcuugccuguugccugggauuaaaggugcuugccagcaugucuggaucuaaaccuaacuggauaggaucuugccccuaaaaucucuuaaucugcuaucuccuagaacauaggauucagcuccaugucacuuccuggcaccccuuuaauacuugaaccauauauuuuauauuuuuccuuucuaagugugcuacgcuuguaccaacagaggccagaaaagacguuagauccucuggagcuggaguugguuagcgaugaguguuagcaacuguaugggaaugagaaugaaucuuuuaaaauuaguaaauaguuuguaggccugagcaccauaaauuguguguuagugggacccgguacgugguuaugagcugugacaagugugacaguuaaggcuucugaguacgagggacccaagacuaaauguguaacaugcccguggcugcugugcagccuugcuucugaacacagaccacaaacauugcuggcucaggcuaggggcugccaagugucaugaauugcagucuguucacuguaaguacaauucuguugucauaugaacaguaaagguuuaccaugaaaauaacgauguccuucucagcauggaaaccuccuuaggauauaacucucucugggcuaucuuccuguuucaauugcucaguaguucauaaaaaugguuaauuuugccuuggaauuacaauacucuuuccaacaauuucuaaaguaucccaucugccauuuuauucuauauauuugggugagguuuuuccaauauugauaauuauaaaagaguaccuaucugugagcucugaaaaauguugacgauacuaaaccuaagucaagauuuaaacauuuuuuuaaaaucauuuauuggugcagaaagaacugagcggcaggcaaauauuuacguaaaaaaaaauaagccucugacuuuaaaaugaaauaaagauuacuaaucaauuaacgaaauagaagacaccaaagcacccacuuucccuaaauucacuguuuuucagcacuccuguugcucucuggugucgccaaaaauggccgacuaaggcuaggaguuggaggcuggucucugucaugugaggacacuccugcagguguacugagcugaggcuccauugccuggggagauucugggaugguuuuguauguuucaguccuuuaaacuuaacccucuggugaccauaaugaugccugaaggaccccagucaaacaugcuuuggguuuguauugugcaaacagagaguaaagguuuuuuucuccuaacuuuccauacagcucucugaaacaaagguauucacugcuucaucugcuccagcagagaaccaugucacaccugggcacagguaaaggcuuuugcugcuuugucuuuuuuuucuccucauucaaagcauaauuagaacauaggacaacuguuuaccuuugagucagauccuuccauuucuccuucacuucucuauuuuccuuuaucucuucuccccacaguuuucggagggagcuucauuuacgucuuauuaguugugugcgguggugauuggaugacaacucuucuugugauuuguuagcaguuugcuagagauuaugcuaaaccuaguuauaacugguuaacuauuuacauugauaacuauuuaguauaguuauuaauuacuauaccauaguuaucuauuuacauuaguaaacuuauuuccugcucuucaaacaggcucucagcuugguucuuagaauucuuccugcuucugccuccagaauucugggucuauaucauuauucuuagcuaaagcaauuacuuauauacugauuuaaagaauaagccaggugguuucggcacaugccuuuauucccagcacucaggagacagaggcagguggaucucugugaguucagggacuagucuagaaacuucuaggacagccaggaccacacagagagaccaugucuccaaaacaaaaguaagcuugcuacauuaaauucuuugguuucaugcauuuguuuagaugaucucuacccuaguuuaagugucauuuugaauagguauauuaguucuaauaugcuuaaauuccagaagaagaggggccuuagagguuagcaugcuuugugugucugugugaagaugcagguguauagagauuacaguacggccagccagcccuguguuguuuuucaggaaggcuguccacccugaaaaguacugcuuuacguuugucuauucauuuguuuguuguugugugcuuguucgugcauacaaguuugugcguguacauugugccuaugugucaaaccgcauuuguggaagaaguuagacaugagcaggcaucuugcgggauucaguuuucugcaucauguggguuucauagaucaaacucagguugucuagcuuggcaggaccuaccuuuauccacugaauccugcugcuugucccuggcccacauuuauauucuuucuuugagguaaguuucucaguggcugggaacuauuaaguagacuaggcuggccugcccagcacagugccaccauacccugcauuuuuucauacagauuuuggauaucaaacucagauccuuaaacuugcaaggacaucucuuuacugacugaacuauuugcaaauguagaccucaggauaauaacacucuuaaagcuguauuggauagucugaaucaguaaugugugcucacuugcaaccccaguguucuaaagggugguggaaaugcaucuugaguuuaaagauaguuucuuguauauaaugagacugaacacaaauguauacauagcugaauuacuuaguuucccccucaugauuuugcuauguaguccaggcugcucucccagcagucagauugucucaggucgauugauucaggacgccaggcuucagugagugcuuacaguacuaccauguccacagucauuuaagcaccuuugaaaauggguuuaaaggucuaugugacuaaucuguucucuccuuaauccaaucauacagacacauaugcauacacauguucuaaagguaauuuuaaaauuaaaauguaauugcuagaggaccugggaaaauguguauguaucuuaaaguagacaaaucugaaucaagcauuuuaaagccaaacuaagugagacaguuaaggacuuuaucauaggagaggaaaugugcauagaucucaauugcauuuaugacuaaaugaauuuucuugugguacuuuaauuuuuuuaagaagguaguugagggcuggugagaugucucaguggguaagaguacccgacugcucuuccgaagguccagaguucaaaucccagcaaccacaugguggcucacaaccauccguaacgagaucugacucccucuucuggagugucugaagacagcuacaguguacuuacauauaauaaauaaauaaaucuuuaaaaaaaaaaaaaaaaagaagguaguugagagggcuggagauggcucagugguuaagagcaauuguuuuugcacaagaucaagguuagauucccagcacuuacauggcaacucaaaacuguccauaacuccaguuccaggagaucugcuguccccuucugauucuccaugggugugagcaugcaugcaagcgaauagucacacauuaaacaaacaaacaaacaaauaagaaaacgcacagcguuaggugugcugcugacuaccguuuaacaucagcacaacuaguccuucugacuggugucuucuacaccaggagcuacagacuccgcugcuguccaagacuguuguccuuagaguuuggcaacucacucuuacuucaguaugguauguguuuuuguucauuugcuuauuugagauaggaucuaaucuuguaacguuggcuguccuagaaccugcauagaccacgcuggccuuaagcucacagagauccacuugcaccagccucccaaugcuagaauuaaaggcugugccaccccugccugguuuaguuccuucaguaugggguuuugaggaauucaccucuuagcaauagucaucaagagcucauggcucugaucuuacaguuauuuuuucauaaauacuaaaaugcugacaguaaauuuauaucccggaaacaaugaugugauuuccaagcacauagcugaugauuccauguggaauuuuaccacugaguuuccugggccaagguaacaacuucuuuccuugucaguaagugaagggugccucauacuaacgguuuuuaaggccuuucucuccccacucccucugugugugugugucugugucuggaguguaaggugcgaauguucccacaugagugugaguggaggucagaggucaguucucuccuucaccaugggagugaacucggguugacagguuuaugugaccaguaucuuaauucucuaagcuaucucacugcuccaaacucuggucuucauucauucauucauucauucauucauucauucgugagauagagucucucucguauauagcacuggcuguccuggaagucacauuuguuuguucauucgauuguuuguuguugguuugugagacagucucucucaguauauaguacuggguguucuggaaguuacuauguagaggcuucugccucaugagugcugagauaaaagggucccaccaagcccagcuauagcgcuuuuacaggagacccugcaguaugguuacucacuugagucuuggaauagaacuugcuuugguucugguaauguugcaagguuuauggucaccauguauaauauacauaacuuguuugugucacuggaauacauuaaaagagaagcuguucaccaaagcuucucuuuuaauguauggaauagaauacugggauaucaccggacagugguggcgcacgccuugggaggcagaggcagguggauuucugaguuugaggccagccuggucuacagagugaguuccaggacagccagggcuacacagagaaaaacccugucucgggaaaaaaacaaaaagcaaaaaaacugggauaucauacauuagaacauugacuuagguuuuggauuauuagccuuagaauugaaguugguuucagaagaguaaaaaugguuguuuauauaagaaaaagaacccugcuagaggcuuacucagugugggaauaaauccugauugacugacugcccaggaccuggcucacuggcauggugagagugucaguuagagagcuguagugagcaaagcuuugcaaggccuccaggagcaucguucuggcgacccucuugcagggcccacucuaugggugacguauuucuuugucuggcuauguuuauuacggccucauucuucugacaccauacucauuggaauauuagguggucuuuugggcaaggucauggggcguuauaagauacucuguugcuagagucuuugcuaauuuguaauuccuuuauucuuaaguauuuuagggagaaaauuauauauguauaaauauguuaugggauagaauacagaauauauggauauuucaaauaaauuuaagauuuaaacuuccgcuauagcuucaugcuuugggucuuaauguuuuaagaauauugguucacucuguuucaagaaaauugaagcugcagaaguggcacaccuuuuuaauccuagcacugagacgguagagacaggggggugggauggguggggacguggaacucuuaauuuuggggcuagccugguguauauagugacacugccucaaaacaaauaaaagccaaagguucaaggggguggaggggagaggaaauugaagaaaucugagcucauuaaugguaucuguaagcuauuacaguuccucucuuugaauuggcaugcaauuacaaugcaccuucuaaagugcacuucacucuuugagucucuaaccuguuuuuggugaccggcuucucuuuucaucucucugaaacuccauuuuccugugguuuugcuuaugacucucuaucuuaaguuuuguuuguccugauguucucuccauuugacuggcuggugcaacuugcucaugacagcugauuguguuugucuuucaugugcuuagcauugaucugguggccuugcuccacaagccugcuccucccacccaagccaccgaagucaacuccuuugaaacaucccagcagcagggcuuuggccaagcccuugucuucacaaauucucagcacaacaaucagauggcaccagggacugcaaacuccacuucugccagcucauauucuccucagaguuugguaacgcacuuuuauuucaaguuggggucuuaaggaguugaccgauuggcagcagccaucaagacucuggcucguaccuugccucuaauuccucaaacagucaguguugucaguggaucuucacccaggaaacagugauguagugacguccaagcacauagcugaugauuccauguagaguuuaacugcugaguuuccuggcugagauaaaaacuucuuuaugaauucuuguuggugaauggugacuggggugauggcauccuuuuuauuagugaguuuuuaaaacuuucucccuuuuuuauuuccugugggugugcuugugugucugaugugugcacuccaugucccacuuagauuagagaagagcguguaggagcaguucucacccuccucugugugugcagacuaucuaggcagcaugggagauuguuuuccccugagauuuuuguuucaaagucuguuucuauucuuaauguuuuucuugucuguguauuccuaguuugcacuuuucuucucuauuguauaaaacaugccacuuaaauugcaaaauaauauguuagaggcccuucccuuggaauguuuuccuugauggugucaccacagauccaugugacuucuuagugccuucaguucaucagaaagaauuuugggauugcuagugaagaugacagucagguagggcuuagaagcuuggaaugcagucugugagggacaucuggagccgguucuagugcugaguaaauauagaagaaaguccuugguuuguacugacagaucaacgugcauuuccucugccuuuccguugcuguuggugugauguuuuucugacuucuggagccucugucugguugcugagaugagaggaagagcuggaccaucaaaucugguuuauguauaaucaaugcauuuuaagagcugugaccuuaaacacugcuacuauguauaaccacugggggaaauuaauaaauaacaauuuaauaauaacauuaaaaauaagaaagagucagaaugugugugauuagggcugaaaugcuguguagguauguauuucauacacaugcauguuaauaauaugcuuucuugugucuuacuaguucagugaaguaacuggaauucagagacccuauacugaguguuccugagagcagagcagugaacacagugaaaguguguuugauaacaguagaugcaccugugggugcugggccagugcgaagaaucacauuuggguagacuugagccagauggacuugagcaggagcuugaugcaggcaggagccgugauugaugggccucagcuguucaugacuuagugucugcugugggagacucuaaauuuucuaacugguauauuccagacuuagaauauugauaauagcuaggcaugguguugcauaccuuuacacuggcgcuugggaggcagaagcaaguggaucucuuauaauuugagcccagccuggucuacagagugagcgagauccaggacagccaggguuauacagagaaacccugucuuggcaaccccaaguggagaagaagaauauugauaauagaaauaacagucuccucuucuuugaucgaccuugcucugagauacucucuggaggacagagcucugcuuuucucuugcuuaguuucgggaugguugcuguuccuagucaucugagcacaggacugccugcugcuaggauagaguaggaacacucagcaugcccugcucuuccuaccugagagaugcucucacuucgggaaagguuugcguuuggcuuugucauuuacauguuuguuuuuuuuaaguuuauuuuggaguuggagagaaggccuagcagaugagcgcacuuauugcucuuguaguuuggucccgagcacucaugaauuaaaaacgauaaaucagugcuaauaacuaaaacaaguauuuguuuucuaaguuugugguaaauguuucacuugucuucaccucacuuagaauaggggaggaagacaguucuauucaguggacuuugacggccuaguggcauuucuucauggacuguucucuaaagaacaccugcuacaguguucuuccuucugaagacacguguguuuacaagccuggggucaaaauuaagggcuuguucucuuuauaucucuuaaagucauccguccuuggcucaggauuuggagagcugccucaaucaaacauggugaacaucuccaacucccagauuuuggacaaguugaaaccgccagguuugagcccauuucccgcugcuucaagcgcacagcagaaugacacugcgagccccccagccaccacugcugcuugggaccucaagcccucggcgccccaacccucaguccucagucguuuggguaaguggauguuuuuugagcugguuuacuauauuuucuucaucggagcuucuguaugugaacaguauggagggacuuguccagagucucugagaauaugugcagcuugggaaaauuaaagucaguggacuuccuguauaguaucugcauauauuuaacaggaauagguagaugcccggcuaaaagauaagagcaaaaauauugcaugguggcuccuaccuguaaucccagcacucagaagacaggugagaagaucuccauacgcuugagacuaaccuaggguguagagugagagccuguuucagaaaucaagcacaagccaguguggauagcuuguuaucugccugugaucucagcacuugguaggcaaacugaucuccaucaguuugagcccagacuggucuagauacugaguuccagguucaccagaaccauaaaguaagacccuuucaaaaaauacaaaaaaaggaacaaagaaccauaagcaguugaggcuagagcagugaauuaguacugaaaaguccugguugaucuuccagaggacccauguggaaucccagcuccacagcugucuguagcuccuuuuucaggcaauccuguauccucuccuggcccggauggacccauccauagguacgguacacagauaugcucguaggguaaacaccuauacacauaacaaauaaugacugcagaccaggcuggccuugaacucacagagauccaccuaccucugucucgaaaguucugagauuaaagucauagcuuuauucuuuauuuguaaagggaucaugugugaacuugauguuuucuauacaaaacuucuaucagcacacaccacacacacacacacacacacacacacacacacacauaccauuaagguuugcuuuccagauauacucgugugaaagcacgugugagggaauggugggguguuucaguccuagaguugauuacauacuugguuuugcacuuaccauaaauggcaggcagauuucugugccucaugaaaugacuugcuauucucaaaguaaugcacgcgagggccacuccuucaguucuaguggaagcuggguucauucauaggcacccuuugccugacagauagcauaauuacagaucugauaaaggaaaacagauguuaagcacaaaccauguuuguguagauauucuagacacagcagaccagucuuauuaguuaaaguauuggcagcuaacacacaugcuggauccagccagcauuuaagcacaccauuaacagcuucugcuguuagcuuucccacauaauuaauaagaagagaagguuaaagauagaaguauguuguuucaguguuccgugugaagccuuuugggcacaugccgcauuccaggcugaaaugaauugauuuagaggagaugcgcugcuuuuguuuuauuucuucuuuuuaaacagggcauuguucccaggcugacuuuucacuugcaauccuccugccucagccuucuaaaguucuaagauuggagucauacauccaaacacccaguuugcauuucuuuuacaaaauucauuucuuuuugcauuugauauccauucaauacaaccagaagaaauuuaaaaaaaaaaaaagguuguaauuggcauagucuaacaauugaucuuguuguauucagaaaugacugguacguucauucauuaccacuuuguuuuucauagcucauccauauaauaacaauugaaaaaaaaauagacugaacauccugaguucagccuccuaaaugugagggaggaagccagugugaaugagcauguguggccuccagaacuaaugagaugcucgugucgguaucucugauaggaaccuuggaauggauuugcaucucuacagcaagcaggaagagcaguggaaagggucaugcuugucacacauacaauguuuacaacauaagguagagagcaacucuggaaaacauguauuuaguguugaccucuggcuacacacacucuacagcaaauugauauauaucuaagucucaccuaauagacaggugugugauagcucuacaucaugcccucucugcaugggaaugaagaacagaucauucaggcaccuuuccaguuaccaaguguguguguguguguguguguuuucucuucccuccuauugccugcucuuuucaaguagagaauucagaaagccugugagucaggauaaacgugcuccaggauuccuacucauugccgauuguuuuccuucuccauuuauagacuucaaaucucagccugaaccaucuccaguucucagccaguugagccagcgacagcaacaccagacccaggccgucagugucccuccuccugguuuggaguccuuuucuucucuggcaaaaccccgagaauccacagcuggagaugguccuucuacuguuagcagacuuuugcagcuuccuaacaugacuguugaaaauauuguaucugcccaccaaccacagcccaaacauauuaaacuuccuaagcgccggguaccuccagcgucuaagguaagcauuccaucaugaauugggaaguagguauaaaaacauugugacgguaucuucaucaaaaugugaaaugucuucaggcauaccauauugcuuugggaggauuuggccaucuuuuagugcuugggcuaaucuuagaaugaacucaugcugagagccagugcaggccugugaguguaauugagaguuaucuuguccuugugcaugguaucucaugguuggaggauguaugauaccugggcagacaaucugucccugaaagcaguagcguauccuugccuaccugcucuccugacaccuccccaauauaauguuaauguggaccauuccuccgugacccauuaaguuguuugcuccacuuccucacuguucaaaagguucuuuuuccucuuccuuuucuuguucucauucguuuuugccaguguagcucaaggaaguuacgucuuuuauaagcccgugagggcugaagucccuguccucugucacugaugagcucugcuuuccuagguuccuguguccgcaguggaaaugcccgggucuucagaugucacagggcugaauguucaguuuggggcccuggaauuuggaucagagccaucgcucucugaguuuggaucagcagcuucagccagugaaaauaguaaucagauuccuaucagcuuguacccgaagucuuuaagguacaaacucauuucuuugguugugacugagcguaguccuuucuuugcaaaucaagccaaaauggagucaagagcucagugaggacaacaugagaagugcuuuagugcagcucgcagcgagcccacgcuugcuugguucccuccauccuugcuacccucugacaaaguaugugucagaacucugagcuggacaugucacgugacuagggucauguaaaauguggcguuugccccucuuaucuuuuacuuaacauuuucaaaggucauccauccugugugggcuucugcugccaagccuuucccugagcagacgggacacauuguaguuggugggcguuuagguucuuuucuauuucccuuguggugaucuugcugcucuguugugugucuaauccuguguguguccucuucacagugagcccuugaaugccucuuucccaaugaccagugcuguacagagcucuaccuacacaaccucagucguuaccuccuccacucugaccagcucggccuugagcuccacuagcccaguaacaacuucuuccucuuacgaccagaguucugugcauaccaggauugcauaccaaagcucugcaagcccacccgacucagcuccaggcucuguugcuguaagugggucuuuggaguuucuuuucuuaggcuauccuccuuugaaguuaaaauacaguuuggcaaauuauucuugaaauuguaguauauuuauugguguauguguguugggggguguuuguguuuaugucugcguugcacacaaguagaagcaagaggacaacuuacaggaguuauucucuuuuuugugugucccagguaucuaacucagagcauuagccuugcgugggaguuggugccuuugcucacaaagccaucuugcuggcccaacuuaauauuuuaggggacaauuugacagaaacacagugccauuucucaaaauaaaagcaguuccuuccuccccaggcaugaccggcugcugugggacagucaucagaugcugucagaaagcauugguuaucccauaacuggcuugucauuguuaaucagcaggcugcauuguugcacacaagguucacagcugaguaagacagaugguugaugguagcucucuccuaauaccuuaagggcuagccaguauauagacaagaaguuuucuagcuuggucuacuugaugccugucauguggagcuguagcaguaaggucuuagaauuugcucuaaugagauccauuagcaguaaugaagauugcuuguauuguguuggggaccucagggacguucuuggcuaaggauuauagaacaggguaucuagcuuccaguacugggaguuuuguuuacugucuuauugcuucugagaauaacuugguccaugcauacuggcuaugucuauucaaacagucucaagaaccauuuuguuggaguuugagagaaaaccaacaggacagacagguauaaauccugucaguugcugggaguagggaaaagaaagaggggcgaggcguggguuucgggagauggauaagcagcuguggauaggagccucugaggaguggcaugaagcccacucagcaccucaagcuggcuguggugggucccuuaaaccuggagcuguaaaccaccacgugggugcugggaaucaaauucagauccucuggaagagcagcuaacgcuuuccugcugggccaccucucccuuggacauuugucacucugagagggacguuagcuucuuucccugcugcugccucuuccugggcgggaucuugagugcacugccgcugcacacucuguggguccucccuuggcuguggaggcggugccaguuuguuuucguccaccagggucuccaguguguucaaagcaguugcuuuuuuagguucuuaauuuuguggacaucauggucaaaagaaagcugugucuuaagaucacaucucauuuuuucaacauuugguuccuguuaugcaaauuacucuuuauauauguauuuauacuaucuagaauuugcauauauauuuuagaauuauauauuauuugcauuauggaauuugcaugaaaaauggaaagugucuuacaguuucauuauauugggacuucaucuuccuuuuaugauguaacaagucgauaauuguuuuagacaugcuuuuagccucuuguacuuuuuauucccuaaauucugauuaugguuuucaaaaugccuacuucuuguuauauacuaaagcuaguugcauugccucuucucauuuauuuccauauucuuuuucuuguaaaacaaaagaaugaaagagauccaggcuggagagguggcccuguguuuagagccccuccugcauccgccucaggccgcucacagccaccuguaacuccaagacucuuccagcuuugacugguaccugaggacaugcauccgcccaaauauacacauaagauaaaguaaaauuguugcaaaagaugagauaauuguuccuuuguuaaucugcugugcauaugguugcugcaguccuaauugagagucgcccuaguguuugucugggcaugucuaccuguuaacuuuuucucuuugcucuuuguagaacggacauggcgguggucgaagucagcacacaguagacaguaagugucucuucucuuuauggcugcuggagaccagucagaggaauguggcuaauguaauucggaaagccccaguugauuggcgauuaaugcuccaaaaucagaacuugccuguuuccccuggaaaccagcgguuuguuuuugagaaggucucacucguagcuguggcuggccuggagcuugugugcagaccaugccgaccuggaccuugugcuagcugugccugccucugucuccugagugccaggaucaaggaugcaugcuaccacaccaugcccccaaacugcuuguuuugaucaguaauuguauccacucaaccacaggcucccucuuccuguuaagacuagagugcguccucacagggaugucuacaagagggaaagcaggucucucuccuaccuggaaaaggcagugauguuuccaagcacauaucugacuuauauguguggaugguaauaaugcugagucuuuuccgaaggucauuaauuguguccauagcaccccugaaacauaaaaaccuuauuaucugugcucuuugauuaaucuuuugaaacaaaacccaagaaaguucccacugugccuuugcaaguugguguuggugugcacucucccugcagugcugagugagcagaccuuucacauuugcccucaggugccuaugcacucuggcagccuggaccuucuucgcuggugccaaguggauggaaaugcucuggggcggucucccacaucuacccucacucccucaugccaugcuuuugaaaggaaaauugucucacuguguacacucagauuuugcccagcuuuucugggugcuuaugucaagcuucuggaaaugggagaaauauguccgagucaagacaauuuaaaggugucauuuucuguuccuuguccaaaccuaucacaucugguucugugguccuagcugcaaggauuagagcugucugaugauaugcuuguacacaguuccaggaaacauaccaugcugugccccuuaacugcaugggaccagauacugacugugucuccccuacugaagaaugcuucuggagcuaaagugguacaugucuuacagcuacuucauccguuccagcuccaaagaagacagacccuuccgcacucccaucugugagcacccugcccggccccgccuccugcacugcacuucugcccuccucagcccagcacacugccaccuugcccucccugaccccggcugcugcugaacuguccagcagcccucucucucagcucagcagguaugugcaccacagugagaaagcauggggcgugucguguagacccaacuuucauauguggccuaggguuuguccuugugauaucccaaacucacuaggaaugaaaaccuugacuacguguaauguuucugcugucaggauccuggggaagcagagggaggggaccgcaagcacacacuuagucccuguccuguccccaguucuuagccuauccacuuuaauaugaguaagaaugauugauaaauaucugacuuagguucacccugacuccaaagauacauuguuggaauagggugcaagaaaaggaguuagcuugucacccagaccuucugguuaggguucuugauccauuuaguucagagcauugguuggaacucagaaucugauggaauucaagcucugcucuuaguuauggucacacauacauagaaccucucuugacuggcaguguucugagcuuuccaggugcauuccugauuugacaauuauuauaacccaaaaaaaguuauaauuuauugaagccaggcuguaucagauaugucauagugaauugcccuguaggucauuucugaccaccaggacuuugccacaggauucuaugggcauaaaguuugauguccaggcaucuucagagauagguuugauugauuuucauuauagccuguuaaaccagguagguguauugcuucuguguauaaauacacuugguuggacaugugagccucuguuuuaucucuuagcucccucucuggccaccagaacagcaugaccucugcacaugcgacacguuccacaagcacgccacacacuguaagugccuaccccuucugcucaguauacccagaccuuccuuuccaugguuaacaggaaacugguuaauuuugaucugagauugauccagagucuuguggcuugaugccuuagaacccugugcaucuucuuaggagaucaggcgugugugcuugaucucaaaggcuuggagagugcucuuuucauucuagggcacaucuggucagcagggacaguuuguuucuuggucuuuuuacuugacacuuuguuaccaauagguuuguuucuaauuccugccuguagauaucuuuaauuguucugcucuuggccuaaaagauauaauuuaguugcacccuauuguauuaaugucaugggggcuuugcuagugguagugauuggaugcccacuuuaaucauccuucaugcuaucuucccaugcuuagagauuaacaauuuucgggaagaaguuuuuagaaagucaggaaguccagaccaggacgcuuugaggagggagcaugagccagggaaugcccuucauuuauuucuuccaaacauguaaaugccuaugcauauuuuuuaaauguaaaugaguguuugcccacguuuguaugugcaccauguaugugccugucacccacagaggucaggaaggguguaucagagucccuggauuuaaaucuacagagaguugugaaacaccaaguauaugcuccggaccaaaccuaggucagcaagagcagccugugguuuuaaucacugcaccaucucuacagcacccuuuuuauuucuaugcaugcaucuacuugugucugugugagauuguagguacccauagagucuaccaagggguauuggauccccuggagaugguggaauagggguauuggaucccccugagaugauggaauuauaguuguuugugagccuucugauguggauguuugaaauaaaacuucucuguagauugucuguaagagucguaccacugagccaucuuuccagcaccucaugaauaguuucuuugucuucauauauauaucucagacagcauuguauagggauuuuuuuuuuuuuuuuugagacaggguuucucuguguaggccuggcuguccuggaacucacucuauagaccaggcuggccucaaacucagaaauccaccugccucugccucccaagugcugggauuaaaggugugcaccaccacugccuggcagggauuuucaauaucuugucuuuguugccuucccauccuuggagagaugccugcccuuuccaugagacuaguuaugccugcaguucguucuucugugguacugggguaggggcugugcucuuccccucuagaagagcaauaaguacccuuauagguugcuugcuugguuggauugucugagaaagugucacuguccugauggcuggaucuggccuugcuacuaaguguuacagugaucccuaagaguagcucccucagcuuacuagagucaccaaauacuggccuuggccacugccggccugucuguucagccauaggcccuucguucugacuguucuaccccacacgccuuggcuuuuguuuugccagcaugccagcguggagagcaccgcauccuccgccgccuucucagcagcggcgaccucugcuccaagugccccguccucagggguuguccugccugggagcaugagcacugugagcagccugugccugggggggaccacugugagcgucccuagcagcagcaccagggccacggccuuggugaccucagguauacaccccaagccucuuaaaaccuccucaauaagugaacuuccagaccugugccucgaccccugagcagaccacgaaccucauugagaaaugggugauccauuguguuuggguuuuucucuuuuuaggcaaagcacccccaaaccugccucaaggggugccuccccugcuacacaaucaguaccucgugggcccuggaggacugcuuccugcuuacccggugaguaggacugaggcugaggugcuggcaccuggcaggcccuccugguaagagaggugguggguuaggccagggcugcgagcagucugucccugucucuaucucauaucugauguauccuucuccuucuaaaacaucugacccaagucccauucuugagugugucuguuuuggcucccucugugucugugucuguggucccuaauguacccaccgauucucuugcagauuuacgguuaugaugagcuccagaugcugcagucacggcugccaauggugagugacagaugcuuagugaggaccucggcaguagaggcucucgacuugcuugacagccacuaugcuuggccuucagaauccucagcuauggaucucccccaaaccacuaugagacgcugugucuaguggugcuaugcuuuguuugaccauugucuuggcagauaaaggucauugcucaucccuggggaaugagggacucuggaacccugagcauucacuguaagacaugcauagcucguaccaaauguauuaucuuauuuuccugcuccauuaaaaacaaaacaauacaacaacaaaaacaaccaaauacuaaaaacagcugaacauggagauauguuccuguaauccuggcauuugagagacuaagcuugaguucaagacuagccuagaagccggugaugcacaccuuuaaucccagcacuagggaggcagaggcaggcggauuucugaguucgaggccaaccuggucuacaaagugaguuccaggacagccagggguauacagagaaacccugucucgaaaaaccagggcggguaaaaaaaaaaaagacuagacuaggcuacauucugagaacaaacuuaucauacaaucuaagacuugugaguugugccuggaaaugucauacugucuuccucucaugcuugggcacagggcugcauucacgaggagagcauugcuguucugcccuaggaggaggagcagcguacccuggcugacuuuauaaaguaucaucugggucuagccuucgcccuuacuuacaagaaugcuggcccaagugcugcuacuacuucaccucguccaggguugucuguccucugacccugggccuaggaauaaaguaauggauacugugggaaagccaccgugagaugagaagcaaggaagcaggggcaggccaucuccacacaagcaagagugcccucuagguagacagucucagccuuauacuuuguagggaaucugucagucacagacacagaauguggucuuugauguucucagaggaugugacugcccgggcacgggcugccugugcuugcugucgugccuacuucuugccuacacccacuccuguugcuggguuccuugucuucugccaggccgcccagagugagccgcugcagguagcgccuccacuugaucgaguggaguccugucugagggagaggcuggcugagggucuguugagucuaacaggauguagaaggaccccuggguagcauccaagauagccugaagugacacucacagcugcaucuguccuuaggggcuuuucuugccucuccacccauaccaugagucuccuuuuccuuggauuuucuggguauacaaguugggcuaggauuucugcagaugcaccauugugugccuaaccacaggacagaagccaucguaucccugcagcugaagugucacaguuguaagccgccacauagguuacuggaagagcacccagcuuuuuuaaccacugagccauuucuccagccucucccuuuucuguuuuaaaaguuauaucuuagaggacaucuuuagagaguccgcaguggaaacaagcuuuacauuuuuucuugggucguguuuagccuuucuuuggggcuaaacugcugccuuuggauuuccuugucugugaaggugcucccuugugggccuccuuccuacuagucuccuuugucuccagcuagucccugcaaguuccuugucauuuggcuaguucuuuuugccucuuagaauucuggcugaggauuccauguuuucuuggaguuugccuagaccugcagccuaaggaaugugagagccauucccagcuauguguucuugacuagcgugacucagcucagacggcccagggcccuggguggugagggccagggcagaguuucuuccuccagagugcagcuuugguggccuguguuugcacuguuguaccugccauucuccccugccauuuagcucuguugcuguagcuaaaggaguuggcagaagcuagacccauggucuuaugccugccuagcauugcuuucugccccucuuuaagucucuuaggcuuggccucuuuuaccauucccauggcuguuccuuuagucucucacucaguaaggaccaguacaguugguuuggccuguagcauuuaccaagucuccguaugugcugugaaaagaguugugagauugauugugucugguucaggcauuaggguuuggcaaucugcccacaugcugucagcuaaagcagagguucugagcugcacacacccaggguacugucauacaugcagcucucuggacagcugccuguucugggaguguggcaucacccagagugugcauacauguucugccaccuggaucugcucucuggggauggggugagaccauugcucagugagucuccuuggucuuuccuaggauuacuauggaauucccuuugcagcacccacagcccuugccagccgagaugggaaucuagcuaauaauccauauucagguuaguuggcucagcgggcaagaguuggggaggugaugggcuguccugucuagccacaggaggccagaagguggaugaggcgggcugaggcagucuuugaaggugugaguacuugagcuggcaguaugagcuauuccuguuuguaacagcuagccuggccuuuccccugguaauacaagggucguuguucuucuaggugacgucacaaaguuuggccgaggagacucugcauccccugcaccuccaacgaccccagcucaggcccagcagagccagucucagacccaccacacggcccagcagcccuuuuugaauccuggucugccaccuggcuacagcuauaccggccuccccuacuacacaggcgugcccagugccuuccaguaugggccuacuauguuugugaguauuuccugggcuauggguucuucaaaaguugaaacuuuggggauguuuuccagcaucuaucagcagcagaugaugcagccacgagcccauugaguugcagccagccuugguucaggggucagauuguauuucccagcuccuuuagauucaucauggauugcacuuaggaaacuagugguucucugcguucugacuuauuuuugccugacgcucaagccaaggcugaucuccucuuugcauuauucuuacacucaaaccucgccuguuuguccaaucaggucccuccaaccucagcgaagcagcacgguguggcccucagcacucccccgaccccuuuccagcaggccaguggcuaugggcagcacgcuuacagcacagguaaggacugcaucacucccaguacugagcggcacaugcucagagagaccugcuuagcccacacaugccucuugugcccugucauccuagguuaugacgauuugacccaggggacggcagcaggagacuacaccaaggguggcuaugguggaucaucucaggcaccaaacaagucgacugguucugggccuggcaaagguaaugucagcuccucuccgggacuggaaccuggaguaguagucuccugugugacagcuguuuuuuuuccuaggagugucaguaucuucaggcacuggcuuaccugauaugacugguuccgucuacaacaagacacaggugaggucgcacaaaggugggcacaguuagaugggcgaagagugcaguucaaccugacggcauugccaucuuuauccuacagacuuuugacaagcagggauuucaugccgggacuccuccaccauucagccugccgucugccuugggcuccaccgggccccuggccccugcagcggcccccggcuacgcgccugccccguuccugcacaucaugccggcccaccagcagccccacucccagcuguugcaccaccaccuacagcaggaugccccggugagcgcagugauggaggcagccuccccacguggggccugggguucuguuccagccuuuauagccuuuucuccucuuccuccucagagcggcucuggucagcgcagccagcccagcucccuucagcccaagucucaagccuccaaacccaccuacggcagcgcuccauacuggacaaacuagacccugaaaaggagggggugggcucugggcaggagggaacacauggagcaccuuccuggagccccgugcccuugcugggauccugagacaacugucagcugagcccugugggaagccugccucccagacccucugcuguguguaauguauuuauguauguacuuguaaaugugauacaagccuggaggagcugggcuguggucacggguagcacacaagugugugcucccaguccagacacccuuaccauagccaaguaggccccacuccgaccccucugccuucagaucuuccauguggccccagcucagugggcugcugggugugccacugaaggacuggugguuuggggccaggucaguaccaaugaagaaucacgacuuaucucauucccugugaaccauuauguuuucuccucuguaauuacuucauccuuguguuugaaaaacugauccuucugucauuugucauggucccucuucuaacaaaucuuaaucuggaaacagaagaaauaaccccuguccagcagaagccuguccgucugcgcacagcagaagccuguccgucugcgcacagcagggcuuccgcuuugggucugguccugcucuggggacuugucuuucuaaccaacauuuaaaaacaaaaucugcacuaggucucagagaugugcagccagucagcucccuuauaaagaaaucaaagaucugcuuccauccaucucagugaaagccugucugcaaucaaaggcucccccaucccaguuguccugagccagguggacagcuguuucaggguuuucucucacccaaacuccaccuaauaaaauccugagagcauuc

SEQ ID NO: 1842 - RNA, 76231 nt, Mus musculus
cgggaccgcgggcgggcgggcgucggcgcgcgcguucgaacuggcgcuuguggcguugccauggggauguggccuggcggacaccuaaggcggguugaccggacgcucugcuagcccggccuuagggcuuucuccucaccgcacuauuucuucgguccucccugaaaacugacugaggaggagccgggauugcccugaggugagaaacgguggcuuuagcuugagcccaggcucugcgccugcgcgggagcgggugcuccugucugcgagcggcgcgagccgagaccgguauuugcgggguaacuagaacuuggcuucucggguucuucgaggguucucgcgcucucucacguuucaucucccugucuaccgccucuucagcaauuaccucgaccaccaccagcuuugaggcuuuucugaguaccccaaaggccucuugccuuugagacacgcucuucagagcgcuucgauuggacuuucgguuguuuugugaacuuccgcaaaccucauucuccuuuuuucucauauaauuuugaccucugagauaagacaagccuuuccacagcgucuuacgcauauuaguuuuuuguuuguuuguuuuguuuuuuuaaggaaauauuuguucaguuggcuuucacucacuacaaauagauucaguuaucuuucugccuugucccauucaaagucgauuugggggcagguggaagagagaggacacccuaaucucauauacaagagacagaaaauucagcguuggcguucccacguugggggcaggaagaccugcucaguguggguggcaacauucccaaggcagggaauucugagcaguaauagaguggagaaagcaagcugaccgcuagcauacauacauuacuucauuauuuacugcuuuucuuuuuuuaaguuuuuguuuguguggcuuuuguuuguugguugguuuugagacaaaguucucaaucagagagacgugcucucuccacauuguagucuggccuacaaguaccucuucucaaaccccuaaauguauuugcuuauaacaggccauucuguccuuauaugcccgaggauuuccucuuguuguuuacugaccaccaacuaucguaacauuuuaucugugcuuuggaaacugaaaucaauuauuugacuuugaguuuuuuucacuuaacaguguguguguauguguguguguauauguauauguguguguguguauguaugugugugugugagcacucaagugaaggucagaggacaacuuugaggaacugguucucauuuuccauguuuuuuaagcagcuuguuucugcugcugcagugcauacuccaggauauuucuaucuuacacacacacacacacacuuacuucucccuaggagugcuaggguuacacaugugcaguaccacaugugaccuuuuauguggguucuaggcauugaauuugaaccauuaggcuuauuauagguuaugugcauuuaccuaccaagccauuuccuugaccuuuauuucaggugguugguugguugguugguugguuuguuuguuuaauuuuauuuguguacuggcuaguuuugugugucaacuugacacaggcgcgaguuaucacugagaaaggagcuucaguugaggaaaugccuccaugagauccagcuguacggcauuuccugaauugguuaucaaggggggagggccccuuguggguggugccaucucugggcuggcagucuugguucuauaagagagcaagcugagcaagccaggggaagcaagccaguaaagaacaucccuccauggccucugcaucagcuccugcuuccugaccugcuugaguucugguccugacuucccuuggugauguacagcaguguggaaaguguaagcaagcugaauaaacccuucccuccccaacuugcuucuuggucaugauguuuugugcaggaauagaaacccugacuaagacaauguguaugaauguuuugccuguauguuuguguaccuuguaugugugcaguaugaaggaaaccaaaagaggguguuggauucucuacagcuguaguuauagacaguugugagacuccaugugggugcugggaguagaacccugguccuuugaaagaacagcuaacgcucuuaagugcuaagccaucucuccagcucccauuuuuuuaaaaacuuuuuuuggggcuagcauuuuagacuguaguccagacuguccuggaacaugcaauauccuguuucagcuucuugagugcugcaauuauaaauauaaaccaacauacucacuuugaaaaaaaugucuaagccuuuuauuacuuguuuugcuugcugugugucuguaugaacagaggguggcuuuuggggaguaggccuuuccuccaggcuuacucaggcuuggcagaaagggccuucaugggucaagcccucuugccugccuuuaaaacauuucuuuucuuugcauuuauauucuacagagagaauucugugaucacucucuucagaaaauauuaacaaugcagccucuguccauucaucagguauccagaauccuguugcauuuccaagacuauuucauuauugacuuacggccuauauagucacaguguuauugcugauuauucuuucuuauaugaaauucauaguucagagaccugcucacuguggaugacaccauuuccuagacaggcaauucuggacaguauaagaguggagaaagcaagcugaccacuagugucuuaguuagggugucacugcugugagcagauaccaugaccaaggccacucuuaaaagcaaaacucuuaauuggggcuggcuuauagguucagagauucaguccagcaucaucaaggcaggaggagcauggcagcauccaggcaggcaugguguaacaagagcugaugauagguugcuguuuuguuauuuguguaaugaaggguugaacuuuucucauaucucgaccucaucuagugucuaugaucuguuaaccuagucucuccauguagacuuagcaaauuuguucaaacuuuguguacuguagguccuuaacaaguuuuguuaaacgaggcugggaaugugguaguguauaccuuuaaucccagcacuccagagacagaggcagauggaucucuguguguucaaagccaauuuggucuauauagugaguuccaggcuaucagggcuacauaagacccugucguaaaacuaacucugucucuccccacucucccccacaauguagacuggccuugacagagaucugcccaccuguaccuccucugcuggaacuaaaggugugcacuaccauuccugacugagguuauuuuuaagucauugcuuucucaacaucauuccuuuguggguaaugcuugauuccauagagacaacuguuuccaaagugguuugacccugacugaaaucauaugagcuuggagauuuauuuguuuguuuauuuuugacuuuucaagacagguuuucucuguguagcucuggcuguccuagaacucaaguuguagaccaggcuugccucaaacucagagauccauuugccucugccucuugagugcaugugccaucacugcgcggccagcuuggaaaucuauaaagacugaucauagccauuauuuucuagguaaacacaugagagaugguuuguuggcaugguuuuauggcugcaaacuggcaaaaaaaucuuuaacaacuuccugagauugaacuagacuaaaauuuuaaaaauaagcuacuguauuuaaacccaacauugguuauuaccugucccaauacuaacccuauuuagagaauaguagaccuguguugacuugagauggcugggcucaacaauuuuguuacaucuguuuuuaggugauuaaagugaauuaauuuauuuuucaauuacaaacagaaauaaccucaaaagguuuuguuuuguuuuuuguuuuuuuuuuuuuaaaguaauauggcaguaauaguguccagaauccaccccugaccgcaggcauuccauugaguaccaucugucuuaguucuugugcagcuguuguuucaagcaguugucucuuguccuuugucuuuuguaaagcucaguuacuauagauagaauaaucccuggagugugaaauaacuggaucucuugcagagagaagcauauacuguauuauuccccuuuuauuuuguuccuugggauuuggacauucuuguguguucuuaaggaucuaguaucuagagguacagaaacacuuuuauaaaacaugauugagaauguuggggcuuguauuguaucuguuuuuucuuucuuucuuucuuucuuucuuuuguuguuguuguuguuguuguuggguuuuguuuguuuccgagacagaguuucucuuuauagcccuucucuuuauagcccuggcuguccuggaacucacuuuguagaccaggcuggccuggaacucagaaauccgccugccucugaggcaccacugccugcaaguuguuaagauuuaaugcuauccugggcagugguggugcacaccuuuaaucccagcacuugggaggcagaggcaggcggauuucugaguucgaggccagccuggucuacagagugaauuccaggacauccagggcuacacagagaaacccugucuugaaaagccccccccccccccaaaaaaaaaagauuuaaugcuauccuaaaggccuuugauuguguuuccccuuggauagcugaaguauuugggauguugcaugaaucaaagaaacuaaagaagaaugugaaugucuuagaacuggccuauuuucacccauuuuucugccuggcaaagaauuauauagaccuuagauuucuuuauagugauugaagaguucuauaagaagcaacacauaaucuugauacauacaagauaacauuagagucugauacuauauuuuuguguuauucgacgcguucucacgaccggccaggaagaacaccacagaccagaaucuucugcggcaaagcuuuauucuuacaucuucaggaacagagugcaagaagcaagagagcaagaagcaagagagagagaaaagcaagagagcgaaaaagcaagagagagaagcaagagagagagagagaacgaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacaucucccccuuuuucuuuuaauaagagcaaauaggccacccauauuaaugagaguggagauagaggucaaauccccaguguguagguaaaggagccauguacaggauuagcucuuaggcuuacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucucgugcaaugagacuagccucgugagauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaaugauggcaagccucgaagggucuguucaaauucagccauccaauucuguaacauauacugaaaaagacuuuuugacaaauuagcugcccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucaucuggaccuguccagacagagccaaggcugucugaauuaaggccaaacccaguucccaguuagugguaaaaagcaggagaauacuugagcauuauacaucaccgucauugggaguggaaaugucgacauuaucccccaacgcugcuuucucuuuauuauugacgcccuggacauuaccaagacgagggacauuaguauucccuuggucagucuggauuuuucgggugagucuuucugguacccaaaauggguugucuucauccugugggaaaacacagacagcuccccuggaucuuaucaagauaggauccgggccauaccauuuauuaucaaggacauuuuuccauuuaaccaucucauugggccuaucuggcucugaacaaugacguucagccgcaguauggccaugagcaucaauaaagagugccaaagacaccgacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacuguuggaauuuuugagacguauaagcugguccauuaucagucuuaaggagucuggguuccccccaagcacuccaugccucaagacaauguugaaucacaugugaggcuuuuucuccgguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagauccucuagauaacaaaacuaauuguaucugcugaaaaauauuggcaacucuacuggaaggcuuaaucacuccagccacuucuaaaagauuuacugcauuuaccacauaacaggaaucugacacaauauuaagggguuuuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggccuuuuccacuuuuuguaaggccugguuagcagcuagaguaagaguccuaggggaggagauaugaggaucuccuucuaaaauacuaaacaaaggccuuaauucagcagaaggaaucuuuaaaaagggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaacuguuuccucacuggcaaaagagcuucuugcacauaaaguuggcacauuguaggacuauuggacauucccugugguaagaccuuccauugauaccucuuaucagguucagcagaauaagcucucugacccguuaacaaaucaaaaguccacucucucugcucuggaguuaaagcagcagcguuugcucgggccugcgccugugcagcuucgugccaaagcgcuuuccauuccauauauuugcccauacuagggagagcggcuuuuacaaccgucugccaaucggcaggaguuagugccaugccagcgagccugucuaacugcgccaagguaaaauuagcauugguuccguauuuacgaaccgacucggcaauuuccuuaaucuguacguauucuaccggagcguggacacgcccacccucggcuccuucaaagacuggaaaugccuguucuauuuuccuuuguuccucucggggaaugaaugagucugcgcacugccucucugcgcauugcugacgcacuacgggcugacgcacuacgcagggcggggacuccgcauagggcgggagugcaccugguagccgauugcccugaggccaauuagcaaacuggccuucgccagccgcuuuuggcuuuuuucuugaccgauuagcuggcugguaaugggcugcuucuuccucccagucuguuuccucagaggaggauucuucacuugcuucagagcuacuaagagcuggcuuccugagcucaucuagugacgaguaucuccuagagaccuccgcuaaucgaucuuuuuucuucucccuuuuuccucuuuuucuucuaaucucucuccagguauuccuaccuaaccuuaacuuuuccucggguucaagacccuuggaaaggccuguauacuuaccguuucuccuuguuccuacucucucucuccgcuuuacuucugauagacuguccugaauuuccucuagaauuuuuagcccugccuuaagcacuauauaacaugugaaaaggaacaaaagggcuccuaacacuagaaaaaguucaaggccaaacauaccugguaaagccauuucucacuuccguuccccagcugaugaguucugaauucggcaguugaauccuucucaacagucugcuuuacgggaaccuuuaucaccgucguuccccagcugaugaguucugaauucggcaguugaauccuucucaacagucuguguuacgggaaccuuauaaccuugauucgcaguucugguucuggaaugaaguaucccuccugcgccaguccggaguuuuuucucgucccggauuucggcaccaauuguuauucgacgcguucucacgaccggccaggaagaacaccacagaccagaaucuucugcggcaaagcuuuauucuuacaucuucaggaacagagugcaagaagcaagagagcaagaagcaagagagagagaaaagcaagagagcgaaaaagcaagagagagaagcaagagagagagagagaacgaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacauuuuugaaauuuugauacuuauucuaggguucauaauacuuacugacuugucccuaccuaaaggcagauagaacucuuagcaaaaaucccucugccccugggauaacuuugagcagaugaucuuuccugaauuauuaaguguauauguauuuguuucacaaacuuguuaaauuugguuuuuuuuuuuuuagauuaccauaaguuucauggcuauaaaugcucagaaauuuccucuuuuucacuagcagcugucauuuaaguugaauauaaaauuggauaugaaaagcaauauaauuauuucaacuuguuuccaaaguccuaacaaagaaaagguaaaauuuccacaaaauagaaaaaucucuguuuagacuccauguuauauaauuguaaugacuuuggcuagaccugguggcacauauuuguacuugggagcugucuuagucaggguuucuauaccuggacaaaacaucaugacuaagaagcagguugggggggaaaggguuuauucagcuuacagcuuacacuuuccacauugcuguucaucaccaaaggaugcaggacuggaacucaagcaggucaggaaguaggagcugaugaagaggccauggagggauguuccuuacuggcuugcuuccccuggcuugcucagcuugcuuucuuauagaucccaagacuaccagcccagagaugguaccauccacaagggacccucccuacuugaucaauaauugagaaaaugccuuacaguuggaucucauggaggcacuuccccagguaaagcuccuuucucagugauaacuccagccugugucaaguugacacaaaacuugccaguacaggagcuuaagaaacuuuaaauauuagucuuccuguuaaacacuguagguuuuguuguggaugauuucaaaccuuuugaucuccucuaccuuuuaaaacuuuauaauauuuuaaauccucccucacaaccuaguuaaccuuuugcuuacacaaagacccuguuacaguuuuggaauuuaaaugauucaggggccuuccccguuuccuuugugccaauucuuuuaaaacuagccaauugagaaagacuguaaagucaggcccuagccaauggggaaaagaccacuuauguuagaauaaaaaccaagugcacucacuuccugcccuggugugcaugcucuucuuuuugaguugugcacccucuugaucaagaguaaaguuuugcuuugucuagacacgucaguugcuuuucuuuguaacuccaaacuuauuucuuacagaagguagaagguuuucuaguuugagauuuuucuggaccacacaguaaguuuuuuuguguuuuuuuuuuuuaugguuuguuuuguuuuuugguaacucaguuuauuuuaugcaugaguguuuuguugggcauguaugcauauguaccacaugugugcuugauguccauggaggucagaagagggcauuggauccccugggacuugagccacagauauuugugaaccaccacaaaggugcuagaaaugaaccugguucucuacaagaacaagugccaggcaugggggugcacgccuuaaucccugcaccugggaggcagaggcaggcagaucuccauggguuccaggccagccugguuugcacagccagagaugcauaauagacccugucucaaacacacacacacaaagugcuucuaauugcagagccaucucuacacuuuuagaagcaaguuucaaaucagccugaacuacauagugagacuugucucagaaaaucaaaauauuuuuuaaaauuaaagauauauacuucagcuaucugauuuuauuuuaugcaagcugcuaaaaaaauagaaacccauuucuaaugacagaaaauagaucagugauugccuagagacagaauugacuguugagguauugggcauuggggcaauggaaacaugauuuagcccucagagcucuuguuccucuugcagagaauuccauuugguucccuccacacaucuggcagcuuacaauagcucuguuuucuggaaaucugacaccuuccucuugccacugaaggcaccagguacacauguggugcaugcaagaaauauucauauacauaaaauaaaaauauuuuuaaagguauugggagcuuuaaggaaguauugagcuggguauaauagcacacaucuuuaauccuggcaggcagaggcagguggcucucuugaguucagggucaaucuagucuacaaagugaguuauagaacaggcagagcugcacagugagacccuguccaaaaaaaaaaaaaaaaaaggaaugauaaguuuugauugcauuuguguguguguguguguguguguguguguacaugugacuugaguugaggagguugaacuagauugacuccaugacaggcugugagaugccaguucaggggggggacuaggccuaaguuucuguuucccagaacugaacaaaccaguuccaagaaaaacuacagcccacaaucaggagcuguccuaccaucuggcccgagguaagaauagucagcaauaguucuggaaaguccucagaaccuuggccaaucccaaagauaccaguaccccuagagagagagccaaccaaucaggauaaagaucaccuacccuucccuggaauuccccuaauuagcuuuaaauugagccugcaagcucaccuugaagugggcauuuugaugaaugcuagaccccugcaugcuggauuucugcagaauaaacucucuuagcuuuuucauacuacuugagccugggaugucauucuucagagauucacagaccuuacauuugggggcucaugugggauugacaauccaaauagucaaacauuuuccaggacagauuuacucccugccaauugguaaguccaggugccugaaugucuuuugucccuuugcuauuaaugaccuuuauauuuggaauuugaagaacccuaaauucucagaaaaacaaucugacuugauagaacucuuggauucaauaauguugauucaccaacugaccugggaugauugucaacaacuguuccagggucucuucucugguaaagagagggaauggaucguuggagcugccugaaaguuuguucugggagcaaaugggcugcccacccagauccgggccaauauugauguggucuugacugggccugauugggaccauaacacugaugcaguugaugaagagaaacucaugguguacuaccagguucucgugggggaggggucucuaagaggcugcuagauggccuacaaauuuguccaaaguaauucagauguguaaggaaaaggugggucacugagaaauuuccuagaaagauugauggaggccuacaggaccuacacucagugcgauccagaggccagagagaaccaaucugccaaaaacauggccuuugucaaucaagcugccccugacaucuuucagaaacuucagugccuggacagcuuuuuggguaacuaacugaauuagauguuauagcugagaaggcuuauaacaaucaagagagcccugaugaucagcagaccaagaacuggcgaaagcgcuguucgccaccacaaagcaaugaaagagagcugaaaaacuugccccaauggaaggggcaaagguaagccaguacccauuaaaggagaaaccagcccuccauuacaaggguucagugugccgauugcaaagagaagggccauugcaaaaaugagugcccuaaaagaaacccaagagagggcccaaagguacuggaguuggaagaacuagaugacucaggaguauuggggcucaacucuacaccaugagaccugaguaacccugaagguagaggggaagcccauagacuuucuaguggauaccggggcacaaccacuggggccacugucagaccagaaaacaugggugcaagggccaacggacaucaagcccuauccauggauuaaccaaagaaagguggacagguaacagacucauuuaugggcaucccugguuguccauacccccuucugggaagaaacuuucuuaucaaaaugggaacccaaauccauuuugguccagaaggagugaaaguccuggauaagaauggccccguccauguuaugaccuugguucuagaggaggacuauaaauuguccccuuggcuuguuccaucucugagccuguugcuccagaaguuucugagagaagucccgaggucugggcagaaaagaauucaauaggacucaccugucauuggacuucaguucuaguucaguuaaaggcuggggcugccugagcccaaaccaggcaauauccaaggccuagagaagccagaaugggaucacccugcacaucagcuggcucugggaggcagagauucugauuccuugccagcugacauggaacaccucucuccuugcaggcaagaagccucauuucuauaacugucagccuguacaggauuugagggggauaaacaagcagguggaagauagccauccuacaguucaaaccacugcacccugcucagcagccuccuucccagguacaccaggugcacugugcucgaccugaaggauggcuucuuuagcuugccccuggcagccaaaagccagccucuauuugcuuuugaacggcaauauuuggagagaggcuuuaacagacuagauaugucugccucaaggauucacgaacuuucugaacuuaaggugaauaccagcggauccacccucaaauaaccuuacuccaguucauagauaaccucauaauuguggcccccaaccuggagacuugccaagagaccacacgagaccuacuacaguagcugagucaauugggcuacuaagugucuguuaaggaggccaacuugaagucaccuaucugggguacauacacaaccuggggggccaacgcaugcuguuggacccccagaagcaauccauccucagcauuccaguuccaucaacccaaaggcaaguacaggaauuuuuagguccaugguguuuuguagacucugggugccaggguucacugagauagcacagccauuauaugaggcuacuaggggcaaagaagauaagauugaauggacaccugagaugacaugccuuuuaagggaagccuuauuggaggcaccagcccuggccuccuggacauucacaaaccuuuucaccuguauguggaugagagaaaggcgauagcaaaaggggugcucacccaaacuuggaccauggaaaagaccuguggcuuauuuaucuaagaagcuagaccugguggcucauggauagccagccugucucuggauuauaacugcccugcuggucaaggacgcugacaagauaucugugggacaagaauuuguuaucaucaccccccaugcuauugaggggacucucaagaauuuaccccgccgauggcuguccaaugcuagacugguauacuuccaggcacugcuuuugaauccccccuaucuuauaagauaaaaccuaucaucugcccuaaccuuagcuacacugcugccagacccauccucagacauauugcuguauuauuuuuggggggugcucaaaaacauuaggccagaccugacugacauaccugagccagaugcugagugcauuuauuucacagaugggagcagcuuuauucagaauggaaccaaauuucccagggcagccaugguugacuuggacucucucauuugggcaacugcuuugccgccaggaacuucagcccagaaagcugaacuaaaagcucuaaccuaggcuuuaaagcuggcaaaggggaccauagccagcauugacacugacagcagauaugccuuugccauggcucaugugcauggguccauauaccgaggggggacugcuaacugcugaaggaaaaaaaaaaucaucaaaaauaagguauuguggcuuacccucaagguggccauaauucacugcucugggcaucaaaagggaucccagaaauagcccaaggaaacaagcuagcuggugaagcugcaagggaggaugcccaggccucuacuaccuacauccugauagccuugccagcccugcacuccuagccaucccagaauauacuacugaggacaaacaagaucaggccaauugccagggaaucugcagaagcgauggaugguugcagcugccgagggcuacaccauccuaucuaaggaguucacuaaacaacucauccaucacaucuaucaggccucgcaucugggccaccgaaaauuaaagaaauuguugcaaggggcaaaguacaaaauauuugacuugggacacuugguugaucagauaaucucaaauaucccaccuaucaagcuuugaaccccucaggcuucaaucaaggaaccccaggaaccagaguuagaggccaauggccaggggccaauugggaaauagauuauacaaaaguaaauccaggaauauauggauauaaauaguugcuaguuuuuauaaauaaucuuuucaggaugaguagaagccuacccuaugaaagaagaaaagacuggcaaagaagauucuauaaaacaucauacccagguacggucuacccuguuugagucugacaaugggccagcauuuaucucuugguuaacucaaucuuuaauacaggucuuggggaacaacuggaaacugcauuguguauacagaucccagaguucaaaacagguagagaagaugaauuggacccugaacgaggcuuuggccaaauuaacccuugaaacuggugguaacugggugugucuucuaccuuauacuuuauguaaggcuaaauuccuuauaccuuauaccuuaggucucauccacuuugagauacucuaugggaggccuccucccaugcugccuaaccuccagucugacauucuagcugaguagaaccaauauaaguucuuggaauccuuggaggcccuccgcagaguccagaaacagcuggcuugccaucugccaggcauuugagucugcuccuuccccuagccccuauugcuuugaaccaggugacaaagucuggauuaaaaggcauaaccacaagacucuggaaccccacuaggaaggcccucauaccgugauccugaccacaccaaggacugugaagguggaugggauccagacauggauccacuacucccacgucaagccugucaggagggagaagacugagcagcuaaggucucaucaggagugauucccagaccacccaucucaagggcagugggggcaccccacauccugcugacccacugaagcugcaacuucagcacuccugcuccugcucuccuguugcuuacagcuugcugcaucagccaauagcccccacuauccccugaaucugacuuggcagauaauaugguaagggugucaacucuaccacccacucugcuaccccgggcacuugguucccuaaucuuuauguagaccuuugugaccuaguggaugagggacgggaccuguuagaucaacagcccuucccugguuauguuuguuaacuugccugggggcuaaaggcacacauggauucaucuuuuacaucugucuggggcacucucgggaccccaaccaguaggccaaaugcaguguuugggaguccuuuuccuauguggcguagggguggaaaucuaccagauggacaaacuggaagccccucauccccaccucauuaaagauggucucaucacugggauaccugggaccagauccuguauaugaaaggacacccagcucccuaggagagaaacuuguggaccuugcuuugaacccccuuacuaucugguggggguaaugcaacaaacuuaaguuuacaaaugcuggcgagaaugccaauuggacugcugguaagauauggggauuaagacuuuauaucucuagcugugaucugggacuccuguuuaccauucaacugcuccaucgagaccucaugggacccacggucccuuuagaucccagcaagguauuagcaaagccaaaccaacugucucccaaaccucugccuccacccacuaucacccuucgucagaacccaccccugcaacuucacuguagccccuaucacuucaagauaccugcugcccccagaagaugcuugguggucuugugccucacucauucaugcccuaauuuuaaaugugacugagauuuuuguguucugguacaacuuguccccugguuggcuuauuauacaggauuacugguuggcuccuccaauacucuggguaaaaagaguugccguggcugcuguucugcuacccacccucucgggcauagggugggcuggcacuccugcauaggugccucagcccugauuuuccagaauaaaauuuauaaggccaugugaauggccauagauucugaucugaaaaaguuagaaaaauccauuacuguccuaaaggagucucucucuccuuccuggcaguaguagucauucaaaauagaagggaauuagacuuguuccuucaacaaggaggacucugucuggccuugggggaacaaugcuguuuuaacaccaacuauaccagggucuuugcagaacaauggccuugcugagaaaaagauugcauaacagaaaaauggaaaaagaacagucucaaggcuggugugaaucugucuuuaacugguucccuugguuaaccacccuuguuuuaaccuuggccgaacccaucauccuuuugcuauuagccuuaacuuguugacccuauaaugaaugcuuuaguuggguuuguuaaggaacagauuuccacugaccaacugaugauucucaagcaacaauaccaacccauggaaaucucaaggauuugagaugagcaauuacucaaggggagaaugagaagguugagcuagacugacuguaugacaggcugugaaaucaguucaggaaacuagcccugaguuucuguuucucagaacugaacaaaccaguuccaagaaaaacuucagcccacaaucaggagcuguccuaccaucuugccugaggcaaggauaguuagcaucaguucuagaaaguccccagaacccuggccaaucccugagauacuccuagaaauugugccaaucaaacaggauaaagguuaccuaccccucucuggaauuccccuaaucagcuuuaaauugagccugcaagcucaccuugaggugaccauuuugaugaaugcuacaccccuguauguuggauuucugcagaauaaacgaucuuugcuuuugcauacuauuugagucuuuggcauucuuuggcaauucuuggacccuuacaguguguggaggugagaggacaacuuucugagguugguucuugccuucaaguuguugaagcagugucucucuuguuucuauuauguacaagugcccucugacuucagguaacucucuuuaggucuuguaguggcaauguuagguuacagaugggcgggccccaugacacuugacucuccauguugguucugcagaugaaauucagaucaucagucaagcacuuuuaucuauuuggccaucauuugacccuuacaauuaaaaaaacaauuuauuccauguugauaguuuguguguguguguguguguguguguguguguguguguguguguguauacaugcauauggaagucagaggaguguacaaugguucuuucuuuucauaaauauggaucagacugaaucaaacacaguuugucaugcuuccugauagggcaccuuuacccacugggccauagcacuuguguuuugucuuguuuuaaauauauaugugucucuauucuacccuguuaacucaguaguuaauucuguccucuauccuggccccaggcaaucacugaccugcuuucuaucauuagaauuggguuccuauuuuuuagaaguuugcauuaaaaaaucagauagccuaauauauauguuuguuuguuuguucguuuguuuguguauaugugugugcuugcuugucuguaugugaaccuaagcccuuauuauuuauuuugaucacuuauuuuuccuuugauguguacguguguauaccugcuugucuguauguacaugcaugccuuauucuuuuugcuuaagauaucuuuggcuaugucuugaauuuauuuguucuucauauuaauuuuguuuguauuuaaaagacagagccauguuauauaaaucuagcuggcuugguacucauguguagcccaggauggccucaaacuuguggccagcuucuugccucugcuucccaagugcugggauuacagccaugugccacuacaacuagagaauuucagguuuucuuuuucuaugucuuuuuaaaaaugucauaagugaguuuguaguuguuacuguuuuugugggguuuuuuuaauguugcaguugagauuuaauaaacauaguaccucauucacgcuaagugcuuuaccacuuuuucucuuuucauuuugaaacagucucacuaaauuacccagacuggccuugaacuugcagucuuccugucucaggccucccaagugcggccugccuuccucucccguccccuucuguccccugcccucccacccaccucccuaccacacacaccuuucugguuuuuuugucauucaagacugguuucucuguguagcccugacugcacuggaacuuuguagacuaugcuggccuuggguuuucuuuuuagagcagguucucguguucaugcuggccucaaacuugcuguguagcugaggaugagcuuaaacuugugauccuccugcaugcgccucccaggugcugaaguuacgggcaugcacuggcacacuggguuuguguauugcuagggaccaaguccuuuggcuuuguguuugcccgguaaguacuguaccacugagcuauauagaucucuaaggucuaauauuuuauauuuugguguuuauaaggauuuauuuuuuuaauccuagcauugaaucuuugcuuuggguuuuauggacauuuuaacaguguugauucuucugagaauccaugacuguguagcccuggcuguccuggaacucacucuguagaccaggcuggccucgaacucagaaaucugccugccucugccucccaagugcugggauuaaaggugugcgccaccaugcccggcuuaucaguguucuaauaguuuucaauguggagagucuuccuaccugucugccugccuuccuucuuuuuguuuuguuuucuuuuuccuuuucuuuugacaguucucuagcugggcacugguagcacacaccucuaaucccagcacccaggaggcagaaacaggcagaucucugaguuuaaggccagccuggucugcauagagaaauccuaucuccaaagaaaaacaaccccaaaaagaaagaaagaaagaaagaaagaaagaaagaaagaaaaaggaaggaaggaaggaaggaaggaaggaaggaaggaagaaagagagaaagaaaaaaguaaguuagguuuuuauauauagucuugauauguagaccagggacuggucuguaacucacugccucugucccuagagagugcugggauuaaagguguguggcaucaugccuagcaagaucuuugauuuggggggggggggguacguauaguaaguugcuuacuuucuugcuuucuuuuuaggauaauuugcucuugacauacugagucuauuucuaauuacugccucaacagcugggagcuagcaguccccaggcuuccacaagggagagcccugcauauuugugguauuaaauaccagaacagccaggauguaaaaaucuugcccaucggucucccccacacccgggguuucacuaauuugcaguucauuuuucugguggugacagcugugagcuacuccauacaccuaggagucagcuaagggggaagugacugggccugucagagggaguggagagaacaagaaucagacgugagaacaauucaguucugaucuuguaugucacuugagagcuguguugcucuugccaaugcacagguucauuauagaucuuucuccucuccaauaaaaggaagagguaaugauagcauugcagucaaaucucaaaaucacuguaguaaauaagacacuagagaaaagagaacauaauuucgcuucaguaaaauuuaggaaauacaaguaauucauaaaucuagaaaguaggccaaugguaguccucauccaagagcagaaaaaaagguaggcaugcggacaggcaugaggaauguuacaggguagugggucuguaucguaauuaugguuccacaggugcauagagcugucauuuagcuuauggacuuauauacuaucacauauacaaacaagaagagggguucuggggcaguuuuaugcacaauaagaaagaacauagaaauagauuauuuaaaaauuugcccgugguuucaagaaggaagcacagcaguacaaauaacuugucgucuuugcucuaaugacccaguaaaauuauugcuacuuguauagugugaauauguaaacacuaaacaaaacagcaguugucaacucugacccccgacuuccuuuaccuugaaacccuuuguguaaaugugcauuggugcuuugccugcaggugugucugucugagggugucgggcacccuagaacuggagcugcagacaguugugaacugccauguggguacugggacuugaacccaaguccuuuggaagagcagccagugcucuuaaccacugagccaucucucaaaccccuuggaaucuuuuugaacuacuuguuguagaggguguuugagaucagacaaaccuccuaaaauauuuuacuuuuuuaucuaaaacaggguuucacuauauaacuuuggcuggccuagaauccucugagaugcauuuuucgccugguaggugugcuaccgucucuagcuucuaaaauauuuaacuuacuaaaagguuguccuauuuuuuuuaauuauuuauuuauuuuacauaugugaguacacugcacugucacugucuucagacacaccagcagaggacaucagaucccauuacagauggcugugagccaccaugugguuggcugggaacugaacucaggaccucuggaaagagcaaucagugcucuuaauggcagagccaucuccaggcucucuuguauuauucuucaccacuuauuuuuuccuuuacuuuuauguugaggaauuccauuuacauccuuaggguuacaauguaauuguauucaugggcaauuauuuuaaauuuuuuuaacuucuacuuuauugcauguguguugugugcaugugugugcacauguaugugugugcaugaggaagcuagauauacuuuccacuuuguuuauugaggcagagccucucaacugaucugagagcuuggugauuuagcuagucuaaguuuaccggcuucccucagagaaucucuguacuugucuccugaguacugugacuacagccagccaacauacuuauccaacuuuuaaauggguccugcggaucugaacucugguccucaagcuuauggggcaagagagcuuuagucacugaaccaucaccccagauuucacgauaaauuacuuuugaaaaaaauuauugggggcuggagagauggcucagagguucagagcacuggcugcucuuccagaggcccugaauucaauucccagcaaccacaugguggcucacaaccaucuguaaugggaucugaugcccucuucuggcgugcagaugcacaugcagggagacuauuguauacauaauaaauaaauaaaucuuuaaaaaacaaauuauuaggccaucccagcagagaaggcccaggcaggaggaucucuguaggcuugaggccaaccuggucuacauagcgaguuccagaagcuaggacuacauagacccuaucucaaaauacauaugaaagguaucuauuucuauuaauguguauauaugggugccuaugugaguuuaugcgacuauauucacguaggugcccuuagagaccagaagaagguauuuaaggagaguuacauguggucauggaccaucauguggacacuggauaacugcaagagcaauaaaugcucuuagccacugagcuaucuguucagcccccuuaaaggcgaauucuuuguuguuguuguuguguuguuuuauuuuguuuucugagacaggguuugucuguagaccuggcuguccuggaauucuguagaccagacugaccuuaaacucacagagauccaccugccucugccuaggauuaaagguauguaccaccaccaccuggccucauucuguauucuuuuaauaguuuaaacuucuucauaaaaaauucuagaagucacagcuacaauuuuagagguaagacuaaugggagagagagaugguugagcauaugauguaaguagagauggcucugguguuuggugcugucuccaaagaacaagcgugucagcucuuacucuuuccuuuucccagucuccaggcuucuuugcuuagaacguaacugcaaugcauaaccuucaccugaauuuaggacggugaguggcuaauuauaacaguaauguggggcuggcaagauggcucagagguucagagcacugacugcucuuccaaagguccugaguucaaaucccagcaaccacaugguggcucacaacuauccgucaugagaucugacgcccucacaguguacucacauacauuuaaaaaaaaaaaaaacuuaaaaaaaaaccaacaguaauaugcuuauugaagaaaagcuuauuuuuagguuagacagggaauaugcaugauuaugcucuuaaaaacuuaaggcaauugaauggaaaacauggaauauguaaaaacaccacaauuaauagagccugaugaaaaauuuuuuaaaaaguaagucccacuaaaauccugaaauaagucauuugauauuacuuaaaauaaguugggcauucuuuaaaaauugaaaguugaaaugagaaguaagucauuuauucuugccuucauguaaaauuuaaguaguguuaggguccaagaaucgcuaaagaaugaugccccacacuuagauaguaugcaaaagcaaagaguguacaugcaggggucuucccauuugggaauggagaucucugguggccucgcaggcccaacuuuuauugucaggagaauuccagggugggauaugugcccuuuuaccuugauugguuagcuuuaucuccagggucugacugauuguacaauugauuaggcucuggagacuuuccaggggguugcauacuccuucuggcuaucucuucuuacuucaugccagaugacaagguguccucagauuggcugccugaggcugugguuggcugaucacagguuccugggccaguguucucauuucugggaagcagaaacuuaggccuauucucauuuuguagcuugucauggagucagucugccucuggcuagcucaguccuuguaguagcuuuaguuguugacagaaaguuuuucuuuuuaauaucuuuaugaguauguuugagugccugcauguaugucuguguaccacuuaugugcuuggugcuguucgaagucagaacaggguguugaauccccugggacuagaguuacugucaauugugagcuacaaugggugccuaggaacugaacucaaacuccgugcaagagcaaaaguacauagagcugcugagucagcucucuagucgccagaaagguuuucuaaggaaaauuccguaaagaaacauagaaucagauaaucaccaguuugugacuccgaaagaaauaagugaugagauauugaucacuaaugaauaaaacuccuggauuaauuuaaagagagaaucucucagcaaggggaucaggcuucaguucccacagacauuuguguauauucugugcaugaaguaugugcuaaauaaauaacauggacagaacauuuugcuagaaaugcagauucugcuucuaauguaggguugccagauuuagaccaaacaaaauucaauuugaauuucaaauaagcagugaaugauuucuuuaguauuaagcuacaugcuuugaaacacacuuauuuuuucuuuuuaaaagaagucagaggaacagaaagaaaaaggggguaaaguuuguguugggggaggggacaugagagugccuuucaagaaaacuuaagcauaauaaucaaguguauggaacucgcuuagauucugguuugaacaaaauuuauuuuuguaaaaagauauucuagagccagaaaguuuauuggguaaaaacauuugccacaaaagucuggcuaccugaauucaauccuggagcucuuguggauaaagagaacugacucccacacuuuguccucugaccuccacaugcacaccauggcauguggcuaucacacacacuuguauauauuuaaaaaauauuugagcugagcauugugguauauaccuuuaaucccagcauucuggauauagagccaggaggaucucaguauguucaaggccguucugaucugcauagcaaguuucacagggcagccaaggcuacaaagagagacccugucucaaaacaaacaaaaauugauaaaaauauuuauggcuauggacugaguauacgaaaacagaaucauaaaggcaggcggauuucugaguucgaggccagccuggucuacagagugaguuccaggacagccagggcuacacagagaaacccugucucgaaaaaacaaaaaaaaaaaaaaccaaaaaaaaagaaagaaagaaagaaagaaagaaagaaagaaagaaagaaaacagaaucauuuuaaauuuuauuaacuauaauaaaucacauaauuaugguuauuauauaaacauuuacacuuagaaaaugaauuuacagaugaaaugacauaucuucaauuuacuuuaaaauauauuucaagaaagaaaaaaugaaucaaggaagcaaguguggcagauuuucguaccugaagagcuauggggugaauaacguguuaugguauuaugcuauuauuauacuaugcuauuauacuauguacuuuugugauacuugaauuuuuauuacuuuuaaaugcuguaggugcuuacugugccuauuuuauaccaagcaccugguagauacuauaaagaaucuaucacaaauacauuugaacauguuuguagaauauauuagcauaccuaauuucaugauguacugaagucuuagguuuuaaauguaaaaagagggcggagggauaacucuguguugagugcuugccuagcauguauaagguuuuggguuggucucuaucuuaguugggguuucuauugcugugaagagacaccaugaccaaggcuacuuauaaagggcaaaauuuaguuggggcuggcuuacaguuucagagguucagucuauuaucaucaagggagaaagcauggcagcauccaggcaggcacuggaggaguugagaauucuauauguuguuucaaaagcaaacaggaggagacuggcuuccaagcagcuagaagaaaguucucucaaagcccaaccccacagugauacacuuccuucaacaaggccacaccuaauagugccacucccugggcuaagcauauucagaauaccacagucucuaacauugcagaaaacccuaaaacaagacauaacacaagagucauaguuguuaaauaauuugaccauguaugucaccucugcuugguuucaauuucuuuuuuccuuuccuaagauuuauuuacauauaugagcacccuauuugcguguaugccugcaugacagaagaaagcaucagacagaagagggcaugagauccccuuauggauggcugugagccaucacauaguugcuggguguugaucagcaccuguagaugagcagccaucuccacagcucugcuucucaggguccuagcagagcuggacuggaugcugguuuaugcccccuaaucuaguaaucuguauuaguacucuuugguuuaccgaguuauuuaaaaugaagaucuaucuuauuugacaucuuaaaauaagaauacccucugccuuuacauuuuuuucuuuuuuuuaaguauuuauuuuuuuauuagauauuuucuuuauauacauuucaaauuucaaaugcuaucccgaaaguucccuauaccuuccucccgcccugcuccccuacccacccacuccugcuucuuggcccuggcauuccccugaugccuuuacauuuuuagaaugauuucuuauugcauuuuaauuuacuuuguguguagacauguguugcauauuguauguguggagaggacugcuuaugggaauugacucuccucucaccacugagccauuguugcuagcucuccaccuuauuuuuuuagacagacuggagcucaccuagacuggcuggccagcauagagggucuuccugucuuuguuccccagggauuacagacauacucuguuacaccuaguuuugcggguguguguguguguguguuuuguuuauuauuuauuuacaaacccaaauguugucccccauucccucucacagaauucuuuucuccauuccccucuccauuucacuucugagagggugccccucacccuguaucccccuacccuaaggcaucaagucucuacaagauuaggcacauucucucccacugaggccagacaaggcuacauaugugcugggggccucagaccagcccauguaugcucuuugguugguggugagacaggauuucucuauguauaccuuuagcuuaccuggaauucacucuguagaucagcuggucucaaaccuacagaaauccacuugcuucugcaucuuugagugcugggauuaaagaugugugccaccacugccuggcauaaccuuguuuuuauguggguguuggagauccaaacuuaaguuuucaugcuuauacaucaagcacuuuauccacugagcugucuauccagcugugaaauaugcuuuuuuaaaaauuaauuauagggucauggagcuggagagauagcucugugauuaaagagcauuugcugcucuugggaagucccagguucaauucccagcacccacaugguaucucaguaacuccuugguagcacauguaacuccaguucuaggggauccaaugacauuuugugaccucugagagcaucaggcacacacacaugauguacagaugcacauauagguaaaauaguaauauacguaaaaauuguaaaugguugcauaguuucaaauuuaaacacaagcauaauacuaggucuugcuucgguaauggagacaucagugaaauacaagucacaauagaaaagaaaguaacuaccaacauuauugccauguaauagucuacuucuuuugcuuauccacuaguauuacccauuccccuuccuguaagagacuacugucauuacuugcacaaucugccaaggauaugccugauaagcaaagauagaguuccauuuuggaucaguuaacuuucucuuuaacaaaugaugccuguaugaacuagucuguacuuagcaauauauugaaaagcuuuuucuuucuucaauaacuauuggagaguuaaguuuuguaauugcuucauaguauuauuacacuugaaagacaacuguaauuuagcuagucuucauugcuuugcacuuaccaauagugauauaaugacuuuguacuucugugauuuuacauuuauacacaguagcuguaggaugcuucuagagcuagguaguggguaguugcuggauagugaauuugccuacaacauuuuucuauuuauguauuuauuuuaucuuaguuuuuagagacaggguuucucuauuguagcccuggcugucuuacuuuguaaaccaggcuggacuugaauucagagaucugccugcuucugccuccugagagcugggauuaaagguauguaccacuagucuuggcuuaaaacuuuauuuuuauauguauuuauucauugugugagugauauguacaaaucacaauaggaaagacagcagcuaacacuucuugguauguaauggccgacuucuauguacauauauuauauguguacgcguuuguauguaugcauauacuugugaugagcagacaccagaagaggacaucagaugccucagaauugaaaauauuggcauuugaagguugcccaguuuguuauguggguccugggaucuaaaccccauugccugaagagcaaucacugcuaaccucugaacacuagcuccagagcccagcgccuugcucauacuaagcaugcacuccaccacugaugucccuccacagccuuuacauuggacuuuuugacagagauagaucaguaaguaaaauuaucaucugaguaaaacuuucaaugcaucuaucccccaaaucuggaaguuuauuuuguuuguuuguuuuguuuuguggcucagugguagaguucaaauguuuuuguuugaaguugcaggaguaauucugauguuuguuucagguguuaaagaagggaugaacuuuuguaaaauggaaugcaauuacagagaagcauguuaaauuugaaaacaacagaacuaacuguagugcucauaaaagugggauggugccgggaggugguggcgcacgccuuuaaucccagcucuugggaggcagaggcaggcagauuucugaguuugaggccagccuggucuacaaagugaguuccaggacagccagggcuauacagagaaacccugucucaaaaaaccaaaaaaaaaaaaagaaaagaaaaagugggauggcugcagcugugcuagaagaacuuccauggcuacuuuaaucuacauauucaaauuacugcuauuuuaaaauuauuauaucuuucucuucccaugauauuauagguuauacaaguguuucaaaauaaaugguuuagucucguuuacuuauugggaaugcaguagaggcugugauuaucagauuugaacugagaaauguuugcuauggcaccaagggaauuggugugcaaaauacagaaucuuaugccgccugggcauagcacuaacagucuguucccaggggcuagcugaaccaaguagagagugcagcugcuuaguauuuacuuaaaucaaaacacugaagggagaauaaguucuauucuauucuauucuuaaaugcuagguggauaaaguaggagaaauacagaaauaauaauagcaaugguaauaacugccaacacuuauuaaacauggaacauugaauguguccuagccauuaugcuggguuuguuugucugucacucagaugggccucagacuugcucucuaaccaagaauaucuugaacuucuaaucugccuguguuuaccucccaaguguuagaauuacaggucuaguuaccaggccuagaguuuugcagugcuugggagcaaaccuauggguuuuuuuuuaugcauguuagucaaggaugauauaaacugagccccaucccucaaccucugguauuucuuuauucagucagaagaauuuagggauucuguugucuuuuuuuccucuccagugucuugaagcaagguguuauuuuauacuccaaaccaacuucaaacuuuguauauagcucuguugcuagggcugaccucaaauucauugcagcccucucucuguuuaagugcuuggacuacaggucuacacuaccaacccaccccacauaucuuugagggguggaggagguacauauacccaugaaggugauaaugaguggaucucuuaguugcucucugacuuugugugugugugugugugugugugugugugugugugugagagagagagagagagagagagagagagagagagagagagggcggggagguggggacagaggagagagagagagcuuuucuugaaucuggcacaggaucuuucuggaacuuuuagacuagacucaggcagucuggcuagccagagccuccuauuugcaccugcccagcaccacagucacacacuaccaugccugccuuuucuucauguuuguaagugagaaggugcuuuacugacugagcugucuuccccaggccccaaauaucuuuuuaaacaaaggaaaaacagggucucauagcccaggcuggccuugagcuugcagugauuccccuaggcucaguguugggaguuuagaugcccagcuucuguggcauccuaaugcaaaguagaaaaacaaugaucuucugcaaacacacuaagugauugugacuuguugcacacguacaccuccucuguaggguugugugauaaugaacaacuacauugccagagcaguggcugcuguguauuaaauacuagauguugucauggugucugaaguuuucaaauacaucauguauucccugguaggggccaacuuguucaugguagaaaaacacagugucuuucuaguaaagacagauauucuagguaagggaaaagccaggaauaaagggauuggucauuuuaguuuugcuacuauguaagauguuuggagguaaagugauagaaaaaaacaaacaaacccccaaacccuacaucuagaaaugaaaaucucauuuuggggaaaagcucuuaagcugucuugaaaagauggguguagcacacacacagcgacaagugaugagaaggaccuggcauuuucguugcugguaagaaugaaaauaguacagccagcuuaaaagguagcuuggcaguuuauuauaaaacuacacaucuuauacaauccaguaauuaugcaccuugacauuacauaacggaguugaaaauuauguccacaugaaaacugcauugguauuuuuagaagcuuuauucuuaauuacccaaaugauaagcauccaaaauguccuucauuaauugaacaaauaaauaaaccaggacacacucacauguggaauggguuuuuagcagugaaaagaaacaagcuaacaagccauaaaaagacuuggaggaaaucuaaauuaugaaaugcaaaggccagucuaaaagcugacaugccacaugcuuccagugauaugacauucuggagaaggaagaucuguggaggcagaaaaaagauacaugccuuuaaucccaaugccugaggaggccguggcaggcagaucucugugcauuggaggucaacuuaaucuacaauuguggguuccaggacagccagugcuacacagugaccccugccccacucuccaucugccucacagaucauuaguuaccaugaagucggugagugggaaggaugaggagacagagcacaggaguuuuggugcaaucagacuucccuguguuacucacauagaaaauacaugaauuguuuauucaaauucacaaguucucuaacacuagauaagaacucuaacuaagcuguaggcuuuggguaaugauccuuuaucaguguagguccauuaguggagaaaagaguacaugugugagacuagauauuuggcaaauuucuguaacuuacuacuaaguuuuucugugaaccuaaaauagcuccaaaaucuuaacaaaggacaaacuuucagaagugaaauuguaguuacuguuauauaacaaucuagccccaaacuugguagcucaaaacaauuguccuuuaauuugcucaaagcucugagugucagugauuuggaccaagcuuaguaguucuucacuugaucucacucgcagucauuccuauggcuguaacugucuagugcagugguucucaaucucugggguucucagccccuuuaggggugaaugacccuuucacaugggucaccuaagaucauuggaaaacacagauauuuacauuacaauucagaacaguagcaaaauuaguuauguggcaauaaaaauaauuucauggucaccauuccaugaggaacuauauuaaaggguggcagcauuaggaagguugggaaccacugcucuuauggcagcccuccaguuggauagucuuaggauggcuucucuugcaccugggucuuuuggccaucaaaguaguagugguagugcaugauccuccggcuauuggcuagacuucuuaacauggcaguagaagaauucucacagcaguagaagcuaagguggcucuccagccuuucauggcagucuauuucacuguauucuauuacucagaagaaguuagaaggccauuguagaugcuaaaggaagagaacuauacucugcccuugauggaagaacuguaacaauuuugcagaggggaaaccuacuacuaacagaugucagagucaggauagggaguguugcuuggacccuuuggucuuuuguuuugccuaauuauucaaagauccuugguuguccuuguuauccugucguucacacacacacacacacacacacacacacacacacacacacacacagucucugucucucuguugucucucucucagaacaaaaauaaauuaaaaugaaagcaauuuucaauaauuaauugaguuuuugaaaacucugaaggaucaaaccauuuugaaaaagagaauauaaggggcuggagcgaugacccagugauuaagagcacuggcugcucuucaagaggaucgggguucaauucuaagcacccacauggcagcucacaacucuagucuauaacuucaguagagauccauugcucuuuuuuagccucugugggcaugucagaauacaugacgugacauacaugcugacaaaacacucauccacauaaaauaaguaaacaauaauuuugaaauucuuuuuaaaaagcuaggcaugguggcucaugcuuguaauccuagugauugggaagucaaggcaguaagacuacacaagcuugaggccagucuggacugcagagucaaugccagaccaggcuaggcuauacaggcuguacaaacaacuaagcagagggcuggggagaccacucaguauguacuauuuuuccagaggacucaugcuuaggugcuagcacuucagcuccaggggauacaacacuguuuucuagccucagagggcgcuacagucacgcacucacaagcauaaagauauugaugaaauaguuuaaaguacaauuuaaguucuuuuuaauauccuuaggaacuugagcuugauuaacaggaguaguggagaccuacucagaauucugacuguaauagacaaagauuuuguauuaauuaccucaucauccguuaguguuuaauuaaauuccuaguguuuuaaugaaagucguucaaauuugcauguguaguauuaauuuucuagggaaauuauuugauugauauuuuguucggguagauaucugugaccaccuuuuagaauuaucuaaaauacugaaugaguugauucugaauugguuguuuuuacuucugucuuacuuaccaguacacagccgauuaaaaaggcauuuuucucugaacuguguuccuuuauaaucuuugagguugcuauuuuauucugcugucuguucugaaagacuucuuagccuuuguucauuaaucuuaggaagcaggugugcaacaugccuugcccuuaaguggaacaucuaaaauuaguccugcuacaaucaguggcugggaacaaaguuucagccgugucuugcauguguuaagcagauacugcaaaguuagaagaaacugccaagcaauaaguaaguggucuauguuaugucugugugcccauauauuuauuuaaacauauaauuaggaaaccuuuuuauuaaacagaugaaugaaucacaacuguuaguucauaugcucuguagaaaaccagcuuugcuuauaaacugugcuguuuauccauuucagaagaaaaauaccuaggaaacuugagaugauaacaguuuuucugcauauuuguuuuguuuagcuuguaaaggaauauaaucuguuucucucuguuuauggaugacuccuuuuucucuuuuuuucucagaauucauauaaaccuggucaggaaauggcauccugguuauaugagugucuuugugaggcugagcuugcacaguauuauccucauuuuacugcgcuuggccuucaaaaaauagaugaauuagccaagguuacaaugaaggacuacuccagauugggaguccaugacaugaacgaccgcaaacgucucuuucagcuuaucaaaaucauuaagauuaugcaggaggaagauaaagcccucgguaucccagagcauccucuucaggcaagcagccuguacaccaagccucgggaauucagaucugggccccgaagacaacugcauuuugauucuccuucugccagcaaagauaaaauggccaacaaugaaacaggcaguuuauccaacuucucuguggaugagcagaaguccacuuaccugaaagugcuggagcacaugcuaccagaugauucccagugccagacaaaaauaagagccccggaugccucugcugcugaugcuuccaugcaaacggaaaccaacgcuccgcucuuuucaucaaauuacuucucuccacaacugggaaauugugauauucccguuauucaaagagucucucaugugucaggguauaacuauggaauuccucauucuugugucagguaauacuuuaauuuuauauuuuugggagaaauaggggaagacagcauaagacaaagacagauuucuucuucaugaccagaggagugcaaauacuccaaauucuuaguaaguggcuauaacauauggaugauaguuagcaaguuuugccuuaauaaucgcaauaaguggauagaagcaaauuuaugaggaacuggaauuuuccagaugacaaaaauccgauguacauuguucauguauaucaaacaaacagcugcuacuuaccaggucuacuguaguccucuagcagaccuguugcuauuacucccuagagugcaacuugauggcuuagugagcucaaggaagcagagucguuaaaccugcuuucugcaguggaaagagucacaccauucacaggauuuuuuuuuuuuuuaagcuuucaaauucauaccagccagaagaucuagagcuacuuaaggccagagagcagguaguuaaauugaguaguuuuucgaacaguuaggucaucugcauacauugaagcaggagccugauucuggcugcagguuuuuugguuuuuguuuuuuguuuuuuuuuuaaauccagcccugaaaaaacauaugacuuuuuuggugauuacaaagaguaaaaccuuuugauggcaauuagagggugugagucagaauggcaguaagcuauuuucaccuagugcuucuagauagacuuuuaaauaagauccuugagaggugaaauacugaauaauacccaaugcuaagagugauagaguagaagauauguuccuuucaaauauaucacuuguuacauuacuaagaaagacacacacacacacacacaccacacauacacaucacacacaccacacgcacauuugguugggguuuuuuuguuuuuguuuuuagagacagaguuccucugaauagcuuuggcuguuuuuugguuguuuuuuguuuuuguuuuuguuuuguuuuguuuugguuuugguuuuucgagacaggguuucucuguauaacccuggcugaacucacuuuguagacuaggcuggccucgaacucagaaauccaccugccucugccucccgagugcuacgauuaaaggcgugcgccaacuuuggcugucuugaaacucacuuuuagaugggcucugaaugcacagagaucugccugccucugccuccucagugcugggauugggugaaaguaccaguagucaugugaaauacuuguucuagcauagcacagagaauuuagaacuauuuuucuucuuuuaauuguagauuguagggcuggagagauggcucagcagguaagagcacugccugcucuuccaaagguccugaguucaaaucccaguaaccacaugguggcucacaaccacccguaaagagaucuaacgcccucuucuggugcgucugaaguuagcuaacaguguacuuguguauaauaauaaauaaaucuuugggccagagcaagcagggacugaguuaguggaguugaccagagugagcagggccaaccggagcaagugggguggacuggagugagcagagcuccuaaaaauucaauucccaacaaccacaugaaggcucauaaccaucuguacagauacaguguagucacauacauaaaauaaaucuuuaauuguagauuguaaauaugaaagguaaaagaccaaacuuucuuuuuuuuacuacuuuaguuuuuuauugaacaacacauaaaauauaaauuacaauuauuuauuaaaaauacugcuuuucagugcuuaacacaucaugacuuagaaugaauauuuuaauuuagauguugccauuacauuuacuuuacaauauuaaguaauagcuaugacaucugacucuggguaugaagauaauuaagauaucuggaggcuuagauguuagggacaagguaagagaugacagaccaacauaaucauuugugucaggcauggcgguacaugcaaacccagcacgcagacaagacagacaagcuggugaguucaagccacagagaaaugcccugucucaaaaacagacgaaccaaaaaguacccacuaggaaaagaacacacuuuccucucugccuuuugaacuuaaaauucaaaccacaggccuuuuguccauaagacucauccuggaauccuugcacaacucuaaaaaugacuggcuggggauagcaguccagggguauuccuagcacuguggcuacucaagaaacaaugcaaaaccucgucucagagccucacaaauaaaaauaaaaaggacuaagcauuuucuguccucuuugaauaacuuccuaugguuugguuauuaguacuaaacaucuagggugaggcuauaguggacuuucuggauagcauuugaaauguaaaugaaaaaauaucuaauaaaaaaaauacuaaacaucuaaagauuuugacccaacacccuuguuuaaaugagaauaaaacauaaaagguagauuuuauaaaggaucagaugauaauaugaaauuaaaagguagacuagauuccaaaaugauaaguuaaaauacucuauuuuuuucuugugaaaaauuaagugcauaugcaaaagaagggaacaccaaauccucacaggcuugucaccaagugccaugccucagauggagcauuaggucgugugcuagccgaaauaaucagaugugcuuuuagaugcuuaaaaccaugcacuguagauagugaaaaguuuguuuguuuguuauaaaaacuaauuuagauccuggcaaaaaauaauuuuccagccacuuagaaggcucagaaaaucagaauuuauuugaaacaguuauaucaguauuuaauuuuguauuaaaguuuuugcaaauuuuguauaucugcuauuaaauuuuuaagggacugugaaauacauguucaaguguaaaggagaggugauuuauugcuaauuuauucuuuacacagaccagacuuaguuaacccugaccaaaguagccugcauucaaaagucuuacuuucagcgugaaaguggaucuuuucuuuuucuuuuuuuuuuuuuaaccuaauuuagagaaguuucuauguaagugguugguucuuagauauaccacacgagucucagcagguaaagcuuguggaaggcgauggggguugaauaacucacugagaccaaugaaagacugcacugaguaggagacugagccaggaguggacaggaucagucauagaauggcucugagaagaaauauaugguuauauucuaaggaaugaauaaacucauaucggggagaagcaauaaagaaguaaguggagcuggggagauagugcagucaauaaaauguuugccguguaaacaaaaggacaaauucaauccccagcgcacacacacacacacacacacacacacacacacacacaagaagccagugcgguaaugugugcuuguaauuccagcacugagaagguagacaguggaucucugaugcuugcccuagauuccagugaaaaauucugucucagaaaacaaggcaguccugcccugaggagaaccacaccuaauguccccuggccucugcacacauaagugcacauacagagacacaagaaaagaaagaaguaaugagacucagggaggggcugagcguaucugugagguauaggagguaaaguacauugaaaccuaccaccuaauuugaaacacuuaguuucaauccaauaggauucaaagagcaagggauguagggucugaggaugucauucaguugguagagugcuuauuuaacaugccccaaaccuuggauuuacucccuagcaucagauaaacuggucugauggaauaugccugugaccccagccugauuuacaagagacucugucucaaaacagucaagcauucuucaaacaagaauuuugauuaaugaucaagaaaaauguuaagugugcaagaauugaaagggaacaagagauauauggauuuggauuuuggaaaggccuuggugucuaaguagcagaauauagguagauuuuggugaccaaccaacuggaguucaggggccacaaagagcacuaggagccaaacacacaucucaaagcuaaaauaacugagauuugguuucuagccgccgccuccuuccuuccuuucuuccuuccuuccaccuuuccauccauuuuuccauccuccuuuuucuucucuucuccuccuucucuuucuccucuucuccuucucuuccucuuccucuuccuccuccccccuccucuuugauagggcagaggaugagguaguguaggucagagaugaaaccagagguuagcuaguagaaacuuucucauugcugacaguuauuguggaauuauuugcaugagcuuggcauauagguggcauaggccuguaaucccagcacaugggagguagagccaagaggcacgaccuagccuucacuacaauagugaguccugucccaaaauuuggguuugaugguacauaccuauaaucccagcacuucggaagcuaggguaaaaagucagggccagccugagcugcauagcaaguucuauaccaguuugagcuacaaagugaaacccugucucaaaauaaaaccaacaaaccaaacaaacaaaaaacacaaauaauuauauuaaaaaccccaaauauauuaaagauacucaaaauguacugacacuuugaccauuuaaguaauugaauccuuuuucuuaaaaauuaaagucuauuuguaaacauauaucaggcagaucaccucagagaauccuuggacugaaauggagaaaaucagaguuuguguucgaaaacggccuuuagguguaagggaaguacgucguggagaaguuaauguuauuacuguagaagauaaagaaacucugcucguacaugagaaaaaagaagcaguugaccuuacucaauauauucuucagguaggauuuuucacuuacuguuucaaacuaauauuaucaaguaugucaguuuuuuacuuuauauuuaaauggugguucuaaaauccaguuucugguucauauaaucauauuuaaugguucuuuguuugcuugauugauuauuuauuuugagauaggaucucacccuugcuagaacuaagagagauccaacuaucucugccucccgaaugcugggacuaauggcaugugccacugagcccaacucuggacuuuuauucuaaguuauugauaccuugguccuucauucuuuaaaacuguagugggauuaugauauacauuguuagaaaaccauaauuccugcuuuaugcaaugaggcucuaccauauauucacuuagcauguuuaugugaauuaguaaaaucaaggguacagaugagagaauaaaaagaauuugagcaguaguuauuggugaccaguuguugagagugaugcuuggucuccuuuucccccgcauuauggaaugugaauguuuugggguuuuguuugagacagaguguuuucucuguguagcucugacugaccuggaacuugcucuguaaaccaggugggccuuagguucagaggucugccagccucugccuccugaauucugugauuaaaggugucagcccccaucacacagcugccuguuugcuuuugagucagaauaucacuauauagcccugacuggacuagaacuugcuguuuagcccaggcuggccuuaaugcacaaaagucuaccugccucuuccuccccuaaaauuaaaggcauaugucaacugaacuuuuuuuuuuuuuuuuuuuuuuuuuuuaacuucacuauguagcccugauuguccuggaauuuguuaggcauaccaggauagacuugaacuugcagcuguccuccugccucuuucucccgaguacugggaucacagacaugugcuuuccaugcucagcagggaaugccaauuuaucacucugcugagugugaguuuuaaggcaggguaugacucuguaguccaggcuggccuggaacuugcuguagcucaaacuggcuuugaauucaugacuuuucugauuaagcaucgugagugcuguuacaggcauauaccaguaugccuaggucuuggguaaguaugaaucuucuauuuaauuauggauaauauauuuucacauuuaacuuagaaggguuuaaucaaauaaugcucagauacauaaaaaaauuuaaauuacaaaaaaaguuugguguugaaaaggacuuauuccaaguuagcaauaaguuaauuccaaguuaguuacccaugcacuacuucuaauagagaagcaacaaacuccacaaaugaaaggaaaucauaugaucguaguauguucagaguuuggagucuuaggggguagggaacugacugcacaagcaugaggagcugagucaaaucccagcccccacaaaacaacugcguguuguggcagauagcuguaacccagcagcuggagacggaaagagacagacgggccuuuuggccagucuagccaauugaugaaccuccggucuagugaaagauccuguuucaaaaaaugagauucagggcuggggagauggcucagcgguuaagaucacagacugcucuuccgaagguccugaguucaaauuccagcaaccacaugauggcucacaaccaucagcaaugagaucugaugcccucuucuggugugccugaagacagcuacaguguacuuauuuauaauaauaaauaaaaucuuaaaaaagaaaaaaaaaugagacuucgagugauaaagaugcccaaugucagucucuugccuucauguuugcacgcacagauguguacauacauguuguaugcguacacacagaguuuggaacccagaguuucuuuuacuuugaaucuaccuucuuagucugccuuaaaaaacacucauauugaacauuaauucuuucucuuguucaguuacaaaaugcagugacagguaacaagaaaaauguggugaucaauaggcugugcuagcaauucacuuagucagcugcgauauuauucuacugcaguaaaucuuuucacacuuaagucaaauuguugaaacuuaccccuucuuucaaacuugcauuguucuuacaaaaauugaguuucacaguggcaucuagaguaauccaauagucuuucuaugggcaauaaauuacuagggcacuguacagccaacccaaucauuuuaacagcuucauugauuguugaucaaugcacagucuauuagguuucaguggaagauacuuacuuugaagauagucuaaaugaucaauuagcuguaaggcuaguuaguuucaugguugcuauagccaucguaauagcuguguccaaucaccaucuacccaaagccuccuuaaugaugcuucagucacagcaauucccuccaggacgcaucauauuaucuuuuguauuuuuccauuauccccaaacacaauaaccuuacuccuuugucauugccauugaucaauauuuauugacuauccauagauuccauggcauuuucucugcuguugaacuuuggaccucugcucucauaggucagaguccuuauuugucaauacuaugauauaaaaauaccacuuuuuccuuucuuuaaaagaagucuguauugaacuugaugcuaaauaaaagugaucccagaucuuuaguuuuuauuuugaaacuugcucaaggaguaaagcugaaaauuugucuauguaguuaaauaaccuaucuuuuccaaucaaguauguccaccacauaccggcuaaaaauugaugcaaacaaacaacucaaaaaaacaaaacgaauuauuuuuucuaaauuauuucuuuuuuguuuuucuuucuucuuuguuucauuugauuguuuuguuuuacuuuuacauuccaucccugccaaauacuggaaauucaauccagagccucauuugugcuaggaaaauauuuuaccacugagcugcaucccaggcgcuacccuacucuccaauuuaaaagagaggugcaucauccauuccuuuguuuguuuauugagagaacgcaucacuacuuaaucugcuggcaugguauuuccucugaagcccagguuauuuacuugugauccucuugcuuuggcaacucaaguucaaagauuacaguaggcgaguacuaccaugcuuagcuagucuuuuacauuucuacagggcucuagaguuggcucagagguuaagaguacuuacuguucuuucagaggauuugaguugaguccuaacaccuauguuagguaccucacaacuauuugcaaggccaguuccaggggauccaacacccucuucuggcuucggugaacaucuggacauaugcguacacaucaucauuguagccgggcguggugugguggcacacaccuuuaaucccaacacucaggcagaggcaggcggauuucugaguccgaggccaaccuggucuacagagugaguuccaggaagccagggcuauacagagaaacccugucucaaacaaacaaacaaacaaauaaauaaauaaauuugaaagggaacuccacgauucacaggaucagcaggauuauuuugguuuuaguguuaagacaugaucucacuauauagcucuggcuggcuuggaacuuacuguauagaucaggcugaccuggaccucacaagauccaucugucucugcccucaggugcugggauuaaaggugugugccaccaugccugacagggcugucuuuaauuucgugagacaaaaaggaauacaugcuuuccggaaaggcacuucuugugguucauugguugggucuuuacuggaagguggguaggagacaaaacaggauauuaucauguaggccugacuggacuagaggucauuauguagaacaaacugaccucacacucacagagaucugcuugccccucccucccaaguguugagauuaaaaaauaugugcuaccaugccuggcccugguugguugauuuuuaagacagccaauacugauuuagauuuaaacuugugauccucuugccucagugucuucagagcuggaacuggguaugcguacccuguuccuggcuuaguuccaauuauuugaauuuauaaaaaauuguacuguauaacucaaaaaguuaacgggggaugucucuuaagugcaauaauuuacaguuugguuuucuuccuguuuucuauauuuucaaauguuaucaauaauuugguugagacagggucucuacauagucccagcuguccuagaacucacgaaguagacaaggcuggccuugacuuaaagagcuccacccaggggcuuagcgggagaguacugacugcucuuccagagguccugaguucaaaugucagcaaccacaugguggcucacagccguucguaaugagaucugaugcccucuucuggugugucugaagacagcuacaguguacuuacacauaauaaauaaauaaaucuuugggccagagcaagcagggccagagcaagaacaacaacaaaaacaaaaacaaacaaaaaaaaguuucaccugccucugccuccccagugcugggauuaaagccauuccuggcuaaauugucucauuuuuauauugauauuuuuaaguauaaagauaggacagauguugaguagguauauuuugaucacuuucuuuggucucauauuuaacuguaaagcaggggaaugaauggaucuggaaaauauauuaaugugguagcccagacuaagaaagacaagcagcauacauauauucucucucugguuuuaguaugugugcuguugaagcgagagaugcaucuucucucucauaugcacauguuaguguuuaauuuuuauauaugggguagcuagaacuaaaagaggagaaggugugaagacauagaugccuaauagagaugaaagcagagagaugggaaaggagagaggaaggaggauaauuaaaaaugauguugacagacagccgaggaguuacugaagacaaguguugggguuucuuuuggagaugguaaauauguucuagaaguagauuaugcugaucguugcauggcccuuuguguauacuaaaaauguauguauauauauauauauauauauuuuuuuuuuuuuuuuuuuuugagacaggguuuuucuguguaguccuggcuguccuggaacucacucuguagaccaggcuggccucgaacucagaaauuugccugccucugccucccaagugcugggauuaaaggcgugcgccaccacgcccagcuuaaaaauauauauuuugaaugaaaagugauaugguugacauuucacacaauucugacuucucauauaccagaaaaauuuaucuacaauguguuguuugcuccucugcuguguaacaaacugguuucgcauggaagcaaauucagguuucuacuccugcauaagaguuuguuucucucuggauuuaauucauucacaauccuuuguguauuguguaauuaaaguauaacuuuuaauuuaaggaauauauguugaaaaugccauaauaaaacuauuauuuugugugcugauuaaaaauuaaccagaaaaaacaugaaugcuaaaaacacuuccugugggagccagagagaugacucggugagugagcaucuugcugggcaccuaugaggaccugagucaaaagcugccugacuguauacacucaacccuacuggggcugugacagccagaucccuggaguucauuucggccaaccuagaaauggcagugugaaacucggacucaaagcaguaaggucaagagugguagaggaagauagcugauguccuccucuggccucuguauagacacuucuauguauacaacucucaccauccccaacacacacacacacacacacacacacacacacacacguaggggcggggguguguugaacugcuggugguguaccuaaaaugaccuugaauuccugauccucuugguucugccucccaaaugcugggauuauaggccugggcagccaaaccacuccugcuuuuauuccauguuaggcacugaagccuugggguuuaugcaugcaaagcaagcauucucccaaaggaacuacauauccagccagauuguuuuaucauucuuuagauucauucucuaacauuccaauguuuggugacuuuguaaaugguaaacuuggcucugugaucucaguuucuucucaaaugaccuaauuuccauuccaauguaauguaauaguacauaaaaggccauugaaccugggaaagagugagccaaauuaaauuugccaaagugcaguuuucuggaucuguauaugcaguuaucuaauugaauaaauagagcaggcucaaaaugagggagaagauagguccuuaaucucacucauugugugauaacugucauucugcuauagucagcuuuagcuuacuaaacuuucuuacucagguauagguaguuaugucaccaucauaguaaaccucuaaguuaugcaaaaaaauauauagcuuuugagugauugcuuugcagauccaguguaaugagaucuuaucucuuucucagauuacccugauuuuuuguuuguuuguagcccuucuguuauauccagucauuugccuuuuuguuuuguuuuguuuucccauuguugucaccuaauuugacccuucccauuuuaccaaugaaugacuggacucuagucucauugugaacucagauuagucuugcagugaaauagcuuagaucauccucuccuuuguaaaauucuuuacuguauccucauuguuucugaauuguuucuucugacucuuaaggcugauguccaggacuccuagcacuuaauccuagcucuguauucuagcacuguaucuaucacucuuccguuugccagaguccuguauuucagucaugcuggauguuugcuguuuuccuacacagaaacuaguuaauuccuugugcuuucuuucuuugacguuuugcuuauacuuugucugucuguaucuuucucccuccucccaucucuaccucucacaccaccaaauccaaucucauauuuucuuucccaagaagaaaaaauguguuuccauuggauuauacccucccuccacuacuacacaagacuuuacuagaagggacuugaggaaagggguauacagaaacucuuucuguucaguuuuucuaaaacugcucaaaaacuuauuguuagaauaaaaacagggcuugacguacaguucuguugguagagugcuuucaugagacucuggguuuaguccauaacaccacauaaaccaggcagggcgguacauuuaugucauuccagcacuuaggaggccgaggcaggagaggcagaaguucaaggucauccauccuugguuguauaacuccagagucaacuuggacacauaagaccaugccucaaaauaauaacaauaauaaucaaacagauccauuaaaacaaaaauugugacuuucccuauagcuaaacacuuaauaacuccaacucgaauuaucaggacacugaggcggcgcacgguaccacagcuguuaggguacauacucauuuauuucaccuuucucuuaaaguucugcucagcaccuucaggaguggggugggauaauucuuuaccuuugggcuccuucaagcuccuguuacaguguacacacaccagcuaacaguuaauguuuacgaaacgucaaguuaagcuauggagccuucagaaugaagguugaucccuggaauucagaaguugauccuuagaauucacgcaacuuuucauauaaauugauugcccuugccaaguccguaagauaauccuuauagaauuaauuuacuuucccagacuguacuggcuaguuuugugucaacuugacacaggcuggaguuaucacugagaaaggagcuucaguuggggaaaugcccucacaagauccaacuguaaggcauuuucucaauuagugaucaagggggaaaggccccuugugggugggaccaucucugggcugguagucuugguucuauaagagagcaggcugagcaagccaggggaagcaagccaguaaagaacaucccuccguggccccugcaucaguuccugcuuccugaccugcuugaguuccaguccugacuucuuucagugaugaacaguaauguguaaauguaagcugaauaaaucccuuccuccccaacugcuucuuggucaugauuuuugggcaggaauagaaacccugacuaagacaccagacccaguuauauugaucaguuuaccucccuaagagagaacaaaaguucucacuggaagagcauguacugacgaggugggaagcaggaaaggacaguccuuaacaguuacugguuuuucauuucucugagcuugucagucgguuacuuccuauuagaaauguguuaauaaaauagugguggugaaaaugcacauguauugcuauaaaaaucaaguuuauuuuucagcauguuuuuuauuuugaugaagucuuuggugaggcaugcagcaaucaagauguauaccugaagacugcucacccccucauucagcauauuuucaacgggugagccagaugcuugcuucuccuaccucuaguuuucuauucucugugaacuccauucauauaggaaugccuuucuagcucuuuugaauuaaauaggaauuuaugcuacaaccuaauaaacuuagacugcucuagauucguuugauuuacuaaacauugaguaauuugcaacaaaauuuccuuuuacccuggaaauagugucuguuuccuggcuaaauaaaagcucucaauagcuuaauuuuauaucuucagaauaaaagauguaagaguuuguauuuagcuugaacuuuggaauuucuaagcauuuggaagacugaggugggaaaauagacacaaguucaaggucagcuuggucuacauggucagcuccaagggccuaggcuagccuguacugcagugagagcugucacaaaauaaaaaaaguaaaacacagauguaaaggaaaagagacaaaaucucuagaauacaucaaagcaucuuaugugguaagugcuuguuggugugugugugugugugugugugugugugugugcgcgcgcgcgugcugggaauugaacucacugcuuccugcaugcaaggcaagcacucuauaaacagcuagcuagcucaaguggucuucaaaguccuuauuuucucauauuguuguauuauguuguauaucaguugucuuaugaaguauaucaguucuguaaaauaauuccuuuaagaaaacauauuuuggguuggggauguuuuuaaguuuaaauaauaaggauucuuccaggauucuuuuuucuuccugacuugucauuaaacuucucuauguaaauaaucauucuuuaaauauuuauaaauaauucuaauuauucuuccccuagaggaagugccacuugcuuugcauauggacaaacaggugcggggaaaaccuauaccaugauaggaacucaucaaaacccaggauuguaugcucuggcugccaaagauaucuucaggcagcugaaaguaucccagucaagaaggaaucucuuuguguggaucagcuucuaugagaucuacuguggacaacuuuaugaccuccuaaauagaagaaaacgguacuagauaagagugagaaagaagccugugcucuguacuugacuguuggagccggagcuccacagaaucccuuugaucacaugacuuuaaugagaggcauuugugaaauagcagucucuggcauggagugaucuuucuucucccucuuucccuuuucuguuuugaggcugucugacuuacagucuugucuaguauaaaacuuguuuugccugggcagccuugaacuugugaucguccugacucagcuucccaagugauggaauuaaagucuuuugucacuaugccuagcuuggauacauaguauuuaaaguguuaauucagcuagaaaaaacuguuccuuagccaucuacuaagaccuuucccgugcugaggauugaaccuagagccuuacacaugcuuuggaagcugccugccucugagcuacaucuccaguuccugcuagguuuuuuuuuuuaaagaacaguauuauaguaucuaucaagacuccucuuuuuuuuuuuaccuaugaaaaagauaacuuucaaaaagucaggaaaucaacacguauuuaaauauuuucccuuuaaauaauguuagcauaaacuuaaugacaguuuucugaaacuggcaaaaaauaagccuuuuucuacacauucaaccuuguaaaaauauuuauuuuuauuuuauguauguggguauuuugccugcauguaugucuuugugugcaacaggaacuacuaaguaauacacuaugaaagacccacacuuacucuguaaggucuuaugcuguggggccuguuuauuuuuauaucugguuagccuuucugggguuucuguaaaaugcugucccugaugauacucuuucauauauuugcuaauacgcacacacacacacauacaaauacauauauauauauauauuuuaagauuuauuuauuuauuaugucuaaguacacuguagcuaucuucagacacaccagaagaggccgucagaucucauuauggaugguugugagccaccaugugguugcugggauuugaacucaggaccuuuggaagagcagucagugcuuuuaaccgcugagccaucucucuagcuccguauuauauuuuaccuuaugcuuuugaauaagauauuuugcaaguaagguauggcagcucauaccuuuaaucucagcacucggaaggcagagacacaaaggcaaguuugaggcuauccugauuuauauagugaguuaguuccaagcuagucuagacuauacacuaaaacucuguuuuggggaguuuguuguuuguuuaaaaaaaacuaaacuaaaaagaacuagugagauggcuuaguuggugaaggugccugcuaccacgccugacagucugaguuucaucccuuaaacccacauaguauaauaguggguuccuucuaaggccuauguguccuaugugcuaaguucccuuccuccucccuuccuucuuuccuuccuuucuuccuuucuuccuuccuuccuuccuuccuuccucccuuccuuccuuccuuucuuccuuccuuccuuccucccuuucucccuuccucuuucucuuuuuaguauaaaaugaaguuuauuuggggcauggcaagaggguugagaagggaguagaggcagagaaagaggagacagagaagggcaaaggcgggggagagggggcaagugagcagggagagacgaagaggguacauucacuucuuuuugaggagggagggguguguuugagacaguuucucuguguggcccugguuguccuggaacucacuuuguaaaccagcuucaaacucagagaucugcccaccucugccucccaaaugcugggacuaaagggaugugucacuaugcccagcuuaaauucacuucuuaaacuaggaaauaaagccuaaagcauucuuaaguaaauccuaaaugcauaaaauaaguuguuuucauaggcuuaccuaaaaaaggauaaaaauauaauuuuuaaaaaauauuuuuaggucugaagagauggcucagcaguuaagagcacugacugcucgcucuuucauagguccugaguucaauucccagcaaccacaugguggcucacaaccaccuguaaugggaucugaugcccucuucuggugugucugaagacagcuauaguguacucacauacaugaaauaaauaaaucuuaaauauauaaaguugaagaggguauuggauccucuggagcugaaguuuguauuuaugagucacccgacaggauucuggcauucaaacucagguccucuggaagaucaguaaguguucuuaaccauugagccaucuccagaaauguuauuuuuauguaugugucuaccuaugugaauuuaugugcaccauguaugugccagguaucugcagaggccagagggagucagauacccuagaacuguagguacaggugguugugaacugccugauguggguacugggaacugaaccugaguccucagcaaaaccaguaaguauucuuaaccacugagccaugucuucagccucagaaacccgauccuuacucagaggacuuacagaucuagcgguacauucugugcugccuccuaggagccuuucuggggugaggaucucagagcccaaguugaggcaguguauucaagggugauguggggagguggucucuucuuuuuuuaaagauuuauuuauuuauuuuauguacacugccgcugucuucagacacaccagaagaggguauuggaucccauuacagaugguugugagccaccuuaugguugcgagaauugaacucaggaccucuggaagagcagucagugcucuuaaccacugagccaucucuccagcccugguuucuucuuuuaugcagaaguguauuucugugccuguuuucugagagaucaugggcacuggcaagacacuuuuccucuuaccauucuguaaaguuuggaaauuuagauugaggaaaaaauauuuuuuauuuguuuuuguuuuucagagaguguuucacuguguagcccuggcuagccuggaauacaccauguagcccaagcaggccuuaaacucacagagauaugucuggcucaccacuacaagccccccuccuucccccucuuuuuuaagaaacuaauuuauucucuuucaauaucucucucucugccacagaauagaauuucauucuuagccuuaaucaguaucuuacuaaaggguaaaaguaauuuuggaauauugagaagauuuaaugcuugcuguuguuauaccugauuuaauaucaauggcaguucauaaucaugugccacccaguuugcaggccuggaguguucagaugcagcaccccccaccccuugccuuuuuacaugaaucacauggcucuacucuuaguacuuaggcggcugaggcaggaggaucacaaguugcaggcuagcuugaauuacauagugaaacccugucucaaaacaaaauaauacaaaacuauauaucaggaauccuucuguuacaaguuuaaacaaaaacaaagcuccacuccuacugucuauuuagggaaaugauuggcucagcuaacucggaaggcuucaggauauucugagccaucacuccaggauaaugguacaguuacucugcaucucucucuccuuuuaaguguuagcuguauccugaagcuaguucuuuguagauacaaauggcugcugcugcugcuccuagggcccacaugcuuucucuucaagagagaaaaggagagcaccuagcaagcaaagacccuuuccuuagcuaccacugcacuaauuacuagcugggauuaugccauccagggauuggaauaugucuggguuuuaugcucauucuuuugguuuuaaucaaaaaugcugauuucuuuacaaggaaggaccaccuuggugguccgcagcuggcaguggagaagucaggcuggagagggaggcauauccaucccauccaaauggcagaaccacuguauggugggaaaggcaggacacacccaguaucauaccagcuaugcuuuugcaucugcaggcucuuugcaagagaagauagcaagcaugugguacagauagcuggccuucgagagcuccaaguggacaguguggagcuacuccuacagguaacuccuuccuccuccuccuccuccucccccuccuccuccuccuccuccuccucuuccuucuuccucuuccucuuccuccuccucacacccagagcagccucuggccaggcaacugugauggcucagaugaaagcagauggcaguggcacuguucacaguuguguagugugagccaucuuaugaagagagcuuauuucuccacggugccagagagugggagguagggcaugugacacaaagaaauguguggcaaagaugcucuugagcuggcuuuaaaggcugugauuguauuuucuguggcuauaggcuuaggagaaaagguucuuugcuaaaggcaaggguaauuguuuuaaauaaauuuuuuuuuuuuuuuuuuuuuuuuuuugguuuuucgagacaggguuucucuguguagcccuggcuguccuggaacucacuuuguagaccaggcuggccucgaacucagaaauccgccugccucugccucccgagugcugggauuaaaggcaugcgccaccaugcccagcuuuuaaauaaauuuuuaauaagcaauacuuucacaugcuuugaaaauccaaagaauuaggaaauccccuuuccauucccuuuuccugaggcaacuaauuuuauuagcuuuuauguaugcuuccaaaggaauuuugaagucuucuucuuuuuauuagacauuauccguuuguuauaacaaaaauacuauuuucucacaguuaugcauuacagaaauauaugaaaagauagagcccuuuuaccauccccagcacacacagacugacuacaugacauccauuaauugcuuguuguuuuuuuugcuuguucagagguaauuuauugauuuauguacaaauaucuuucuagcaaaccuucuuuuaauaauccuuagccuggcauuuuuggaggaggagaugcuggggaccaaagccagagccugcaacccuaagcaagcacucugccacugaguucugggcucaauccuggcuuuacauuaguuuguucauagaucuuuuucuuugauuaaaaaauaccuuaacuuuuuuuuuuuaagcuaaggucuaauuaaggucuuauguagcucaagcuggcuucuaacuuaguguacaaccaagaaugaccuugaauuucuuacuggaaugauugcaggagugagccgcuauacuuaguugguuguuucauuuguuugguuuuguuaaggcaagguuucuguagagcccuggcuuuuuuggcacucacuguguagaccaggcuggucucaugucugccugccucugucugccaacugcugggauuaauauauguaccacuacacggaccuggguuauuauguuuacuuaacuaaaauauuuguagccgggcagugguggugcacaccuuuaaucccagcacuugggaggcagaggcaggcagauuucugaguucgaagccagccuggucuacagagugaguuccaggacauccagggcuacacagagaaacccugccuugaaaaaccccccaaaacaaauauuuggcuggaggauauuuugguccuuuuugguuuuuguuuuuguuuuuucaaauaccaugugauuuaaucacuguaaaguaagauccacacuauagcucaucuuucauaggagcaaacugaagcuaagauuggaagcugguggacagaacugggagagccagcuuccagcccagaguuagcaacucucaagcaacacccuucucaucguacuuuauaacucuaaugaauuauuuggaucauuuuuucuuaaagcaaaaaaagauacccaaugaaucaauguguuuauggcaguaucuccuggguugugugcuuaaaacugagcacuuacagagcugaucaccacaaauaaccagcuggggacacgccuuuaauuccagcacuaaggcagaggcaggcagaucugugugaguucaaggccagccuggucuacaaaacaaguucuagguuagccagggccuaauaaauaggaaauaauaaguaaauaggaaagacauucugauaucaaucucugacuuccgugcacacuugaagaaauaacuuagaagauucuuugagcucaggguuucagaggguucaguuguggucacuugccccauaaacuuagacaaaacaugguguggcaaaaagcagauguucaugacacugagaacagaaaccagaaguagagacaggaaguggccaggaauaauagacucaaaagauacacucccaaugaccuguuuccccuagccaggcccuacuuccugaaguuuccuuaagcucccaaauaacuccaccaccuggggacaaaguauccagaccauaaguuuauggggaacauugcccauucaaaccauaacguucuauucuaguuccaaagccuuguggcuguuucauaauacaaaugcuuuuauuuuaucuccaguugaccccaaaucuuaacaguugauuccagaaccaaaaguuauucugucuucugagacuaaagauaaacucuuacccaaguuucuauaaaagcagaaggaagcaucugaagaaauagccagcacccacauggcagcucacgacuacccggaacuccacuuccaggagaucuaacacccuuuucuggucucgauggguacauauguguacauacaugcuuguaggcaaacauacacauuaacuuuuuaauuaaagaaggacuauacuuccaguauucaauuguuacagaaugagcauucccaccccaaaaggaaagaacaagacaguagcgaagaagaugcaaaccaaagcauagacccagacccagcaaagcaaaauauuaaauccuguggugcaugcgauggcaugauacagcgcuaacagucuggacgucugauucacgguuuugcuacuuguaacccacauguuuccugagcuggcuuugcucuuugccugcagcuuucccuaguaaucagacucaggcuugcuugacagauacuuuacccgcaggguuaucuucccagaccuuugucuuuguagugcacuaaucccauccucccaacucacccgccuuccccgccagcuugggucugcuuacacuccuccgcugcuuuuuguuccugaucauuacuauaaaucuggcugaaauuauaaccaugcuacagccccaacacugcuuucuugaacuuuccugucagcuuagucaauuaccuucaaauucugccuucugcaaaguuucuggacauguacaaaauauagacaaauucuuugccaaaauauaacaugaauggcucuguccuaucccaguagugucuuuguucucaucugaaauucauagacagucuucaccgccugcauucuugucagcguuguuccucggaacucccaccaggaucaucuguaaacucugccuaccacauuccaggacuccuaucauggucaccugcaaucuauucaccuccaaacuuuuuuuuuuuuuuuuuuuuuuuuuuuuugagguagucucacuacguagaccaggcuggccuugaacucacagagaucugccugccuuugucuucuaaacgcugggauuagugagacaugcuuuuuguuuugguuuuugagacggggcccaaaguauucacaaggcugguuuugauugagcuugccauguagccuaggauggccuuaaacgugcugauucuccuaccuucaucuccuaagggacaggacuauagugugcgcaguauuagaguucaaaaccaggguucauacauguagggcaggcacucuaccaacuaacuguauuuccagcccagaaauuugggagguuguuuuugguguuuugguugguuuuguuuuuugauuuuuggagacaggguuucucuguguaacagagcccuggcuuuccuggauuugaucuguagagcgccugccucugcuuccugaguggauuaaaggcauguaccaccacacugggccagaacuuauuuuuaauuaguuuaaaaaaaaaaaaaaaagccaggugugguggcacacgccuuuaaucccaggacuuaggaggcagaggcaggcggauuucugaguucgaggccagccuggucuacagagugaguuccaggacagccagggcuacacagagaaacccugucucaaaaaaaaaaaaaaaaacaaacaaacaaacaaaaaaaauuaaaaaaaagaaaagaaaaagaaagaaagaaugaaugaaugaaugaaucugcuccuacuugaugagguauuuugaaacuuguugauuuugauucuguauuuggaccuuuaauuuggaaaauuugacuguguuuaauaugaugcaaauuaaaguugugggagaugaggcagguggugauauguauguauaugacuguauuuuuauugcuuggaggcuggagacugagacuucucuccuuuuccacuccuuuguggccaaaaggucccaaucagucuugacucccacacagggguaagggaguauuggagucaagggacauuguaggcacagggaauaacucacuuggaguuccugaaugucagaccuguccuccuucacgccuguggccugauagagcagguggaugaggucgucaugcugugaugugcaucucugucuuuugauucagucacuaagauagaugaauaccaugagaccuugcuuuggagccaaguuuugcccuggggaucuuaggcuagauucaucaaagauauuaaaaagaguguauaagauuaagaaguaaauuagcucuugacuguccucccucaagauuaguauucuccaugguucucacugcugcugguacuuacucuuuaugacuuagugucugggccgccuuccaccuggccaucagaaagugcaguauucuaacaaaauggcaugccaggucucuacugcuuacuuagccaacuuuuuggagccagaagacuuuguuuucucccagagaaagucauccuguggauuuuguucuucaggugaucuuaaagggcagcaaggagcgcagcacaggggccacuggugucaacgcagacuccucccguucccaugcuaucauccaaauucagaucaaagauucagccaagaggacauuuggcaggugagcuggaacuauguggagaauugcauugucugccucuccauaugugacuuugaaauauauaugcucaaccugggacacccugccaccuuggcucuucauugcagggauaaagaguaguguuguuagcccugaaauaaaucauuguauaaagugccaucaguugauuaaccaugaaguaaugaccuauuguuggucaacccaaaguuauuaaaagagacauugauugcuucuaaugugaaacacaguaucagcagggaaacagcaaggaaugcaucucggagagcuugcaggcuauaaaugggggugggggaauccauucuucuugaaagaagacauaggacaauuggaugcauucauugccucucuggugcuaucuuagcaaacucugccaugcugauggaugagccugucucaccucugaguaaugagucauucucuucuucuucacccuuucuuguuagaaaacagccaauaaaacuuucuauuuaauuaucuaaguagucaccuaacugauuuguauuauggucaccaggcccuuguggggaaaugcuuuauuaauuucagucauacguucucacaaauggacggguugagugaacagugccagcuccagcugacacaugagcaucuugggaugguuuuggaaggcuaacaauaaugccuugucuuuucugaggaugagcucugcuccaugucuucccgagguuacaaaaugucagcuaguauggaaauaaaccaaagccccaaagaaguuguuccugcuguguuuuuuuuuuaggaucucuuucauugacuuggcugggagugagagagcagcagaugccagggacucagacagacagacaaagauggaaggcgcggagaucaaccagagucuucuggcugugaguugcuuagacucuaaaauucccuuuuuugagagauuuugcccuaacgugaagccagucacugaggcuggguaaaucaggacagaagcaugcucucaucugacaguggaaguccugagcuggacggcagguccaggcagccucugcacaaugcuaggccgcucuucuuucucccugccuccuuuccucaaucccuaccaguuagaaagagaaauguuucugcaauugcugcaugguugagaaagguuuuuccuacucucuaaaacuuaaacuauauuucaaggaugcaaauguagaaaguaguauaucucagauacuugucgcauaguuucaaguuaucaacacuugaagacuuaaccagggccaggaagguggcucaguagggugaagguacuugcugccuagccugacauccaggggaaaaauagcaacucacauaagcuguacucugacugccacuuugugccauggcacacaugccaccacacagaugugcacacaaaauaaaucaauagacaaacuaagaacauaagcagccccauccugcccauauuuggaugacuuuauuaucacuauauguguaugugggcacauaccuacauggcaaauguguggagauaagaggacaacuuuugggaguugguuuucuccuuccaucauggauuccagggaccgaccucagguggucaggcuugugagguaagagcuuuugcccagugagccaucuuaccaacuccugguuggauuaaaagaagccccauucaucaagccauuuuuuaaauacuccauaagucucaaagggaugcuuuauuuuuaauagaccuguaauaacauuuaucauacuuuuaauguuaccucuuaauaaauauuuaaaaaccucuuguugacucauaacuauuuuucauaaucacuuccccugagccugcuuuguuuuucuguagcagcucaaucagcuguaaauguucccacauucuagacauggauaacugcaucccauggugcugaguaguggguuagucuguucucuacuagauuuccuaaaacgugguuagccuguguauauuuuugcugucuaauauggcuagguuuuauuuauuuauuuauuuauuuguauauagguguuuugccugcauguaugucuguguacuaugugugugcccaauacaggcagaggcuagaaggcaucggauccucuaggacuggaguuacagacaguuguaagcuacccugggucaguuaccaaaaauagcauacacaauaucaucucuucuggaugaucuuuucaaugauaaaaugguagauacuggacugauuuauaauaaggaagaauauugcugagcaugcuugugcacaucuauaauaccauuccagugcucugaacagcugagcccucucucuccagccaccacuguaacuggucuuacuugagaugucucuaaaguaaaauacacacaggauuuugaaaauuuguuaucaacaaagcauauaaaauauuucgauggauugaaugaacaggucagguacagccucccacccaaacugggugauucugaucauauacauuauacuacauaaacuuacuacagucccuccucuuuaaagugagaugguaagggcuauugagauggcccgcacuuaccacaaaagccugacacuguuugcccagucugugaaacccauguaaaaguaaaaacugacuccacagaguuguucucugaccuucacaggaguacuacacaugcacaucauguguacaagcauauauguauacacacaaaaaggaagaugguaaugugaaguaauugcuauuucagcccagggacaagggaccgaggugcauauuuuauauaucaaacuaaaccuggccuccagguucucccaacaucccucagucccuaccuggcauacccuuccuccagcccugaacuuucuaagccaagagcagcuucccuguccuuaaucuaaucuaaugugguuugaacuggcucguuagaccugcagagaaauaagcuaucacucaguacuucccuuagguuuuucauugcugacacuacgaccagaagcaucgugaggaaguggacuaggccuauagguuacaguccaucuuuggggaaaucaagacaggagcgccucaggcaggaaacuggaggcaagaacugacuuagagaccucagagaaagacugcuuacuaguuaguuuccuguggccaucucauucuccuuucuuacacagcccagggccaccugcccaggguggcaccacccauaguggccugggcccucccacaugguucauugaucaagaaaaugcccuacagaccuaucuguaggccagacuguuagagacauuuucucaguugagguuccuccucccagauaucucuagcugcuagagcuagagucuagcucauaucagguugacagaaacuaacaagauaguaccauuuuuccucuggugcucuugauuucuccuuccccaaacaguuuauauccaaaucuuggauuuauaccuauaggucuacaguaugagagggagagggaaguagcuuaaguaugguaucuacuugagcaccuacauaguugugacaagagagagaacaaguaagccaggguuaccagugcauaagcccagggcuggagggcggguuucuggguucaguaguuucacuauggacugacucagagcuaaucaggauggccgucucuaaguuuggaguccuuagcaagacagcacgggaugauguuuucucauucuugcuugguuucaccuauugaacagggcaguugucuuucucuuaggaaaauugccugugugugguuuguuugccuguuuguuuuuacaaaaucuugaggcuuauuuuuauuucucauuuaucuguaugugugaauauguaugccacacauuugggugucugaagaaaccagaagaggacguuagaucccccagagcuggauaaaauuaacaguaugggugcuugaaacuaaacucuggucucuagaacagcagcaggcaaucucggccuggacagaaagcucagagguuaagagcacuggcuguucuuaaagaugaucagaguucaauucccagcacccccaugguggcucauaaccaucugguuccaggggauccugugccuuuuuuccuuauggugcaguagcauacauguaggcaaagcacucauacacauaaaauaaagagaaaccuccuauggauauaguaucuggcugucccuuacuucagugucuuauugauaggucuuuuacucucgcacuuuacagcugaaagaauguauccgagcacuggaccaggaacacacccacacgccuuucaggcagagcaaacugacucagguaaagucaaacaaaacagccuugaguuuguucugccuuauuccuugcuccuuccuccauuacuuuguuaguuuaaccaagcauccucuacuaagcagccaugaugcuaaauguacuggggagaaaagaagguaggugucauuuucccuccaggaacucucuguguacucaggcagagaugucugcaacaccagggcaguugcagccgcaagaagguagccaugcucuucuuguuagcacggguuguaguuccaugcugcucugugaugaaguacacuggccagcaucccagcucagagcucaucccugagggcagucagcgcaggaacuugaaacagaaaccacggagcaguguuacuuacuggcucucucccagacccaugcuuaggcaagcuuucucucuacagcccaggucugccugccagggaauggugcagcucauuuauccggguccuccuaucucaguuaacaagacagucacccacaggcuagucugaucugagaaaucccuuaagacucccuucucagauaacuccaggcuguggcaaauugacaaaacucacuaggacaccaccuuucuauagucguccaguguaaagaaucuuaauugcagaugugguaccauuuaccugaagcugaggcaggaggauuacuuaagcccaggaauucgagaccaaccugaauaacauagcaagacugcaucuguaaaaguauaaauggugguuugugucuguguucccagcaacuuaggcggaggcagaaaauuguuugagcccauacacugaagaucagucuaggcaauauaaugagauccuaucugucuaccccuggccaacaaaacaauggggaauaggcacaaaugguagcacuuguuugguguacaccagaucuuacauuuaauccucaacacugggggaaacacacacacacucacacacacuauuuaguagaguuacuaagucuuuguaaauaagauaaccacaauguaguuucaguuaaacaaguuaauggcuucagauuaaaagacuacaacaggccgggcaguggugggcacaccuuuaauccuagcacuugggaagcagaggcaggcggauuucugaguucaaggccagccuggucuacagagugaguuccaggacgccagggcuacacagagaaaccuguccugaaaaaccaaaaaguaaaaacaaaaacaaacaaaaaaaaaaaccuacaacaguuuaucuacaugugaggauagaaaagauggcaggaagauauuaaaagcaagauaugcugccugacuguucugaaacauuguuucuacauagggaaaguuuuuaaaagauaaauauuguauccaacuaugaauaacuauggauacaacuauaaguuaacugcccauuuauaagaguguacacgaggugaccgauuacucuuuuuauagccguaagacugcuaagggacugugggggcacucagcauggcguguguguccgucagcccagcuacucagaagagcaauccaggagcauugcuugacccacacaucaacccaccucagcaacaacaaaguacuacguagaaacaccgcacaaauauuagcugugaugggucugggggcagggacuaaggauugagccuucucauucuaggcaacugcuauacuaaugagcgcauccccaguuuacauuucaugcugauauaagaguauucuuguuuuuguuuuuuuacaugaaccagucagucaccuuuuauuggacacuagcucucugucaggguaugaaggcucagccccaguugaauuccuuccugaauuggagcagggcaggagguuauguucagccaugcagugcccuccauagugaccccucuucagugguacuugagccaccacuucugaguuccuuguaagaaauguagcugaaaaccacacagacugccagcagcauguuaauucuggggaugccgcccuuccaaacgcugaugcacucguuguaaugcuggucauaaccucuccgagaggcuccugcagugccugggagugaaauccgucaucacuacccagcucagcagcucuccaaguuuaaccuccguggcuucuccuacaguggcaugagcaaugccaucuugcaguccuggugucccaagaguauucuugaguuguacaacuuggccuugaacuugggauccuccugccuaagucuugugagcaucuaggaugauaggccugcacuaccaggcccagccauguuuauucugaguaauaagaauauaggaccuuuuucuuucuguugucuggaaaaugaccaguagauauuaagucaggccuuuauuggcugcagaguagguaagggaauuugaacuuguguccucaugcuugcuuauuagcaaguacucugacccacugagccaucuccucagcaccauaaaugucagcuaguucucuagucguuuguguuucucugaagacuaccuuuuguuuugcuuaucaguuauuugcauuucuuuuuuaaacauucauauauaugucuugcuugcaugccuagggcccagagaccagggauuccuuggaacuggaguuacagaugguugucaauguccaugugguugcugggaacugaaaucggguccucuucaagagcagccagggcucuuaaccacugaaccaucucuccagucuaaugaguuucuucuuuuguaaaaugucuuuugugaauagagcaagcuguggccagcaucuucacacagaaguagugaauaugcccuuuguucauugcccugucuccuguuuuggauagguccugaaggacucuuucauuggcaaugccaaaacuugcaugaucgccaacaucuccccaagccacauagccacagagcauacauugaauaccuugcgcuaugcugaccgguaaguuggcuauaggauaucagguuguucugggcagugguggcaaagacagguggaucucugaguucaagucaucuagccuggucuacaggggaagaaagggggugucagauuaugucuaggucccauguauuuguacacaucccuuccagauauagugagcugacauugaacuccacagccuucuuggagauacugagauuuuugaaaaguaugaccuaaagaagaacccuccuugugugugugugugugugugugugugugugugugugugugugugccgaaaaagagggagagagagaugccacaugucccuguugaggaauugaugccucaguagguuuucagugucugcuaggacaugguaauaugguagacacaggaagcuuuucuuucugcugaccucagcacuguguauaggagcauguugguccagaggaccaauuuggacauaucaaaaagaggcccaaagaaaaauagggacuauccaaggacuuauuaaagguugguggcaggccgaacagugguggcacacaccuuuaaucccagcacuugggagacagaggcaggcgaauuugaguucaaggccagccuggucuacagagugaguuccaggacagccacggcuacacagagaaacccuaucucgaaggaaaaaaaaaaaguugguagcaaagguagcacccaccucuuuaagaaaaauuacaguggauguggggaugugugaaugucagaugacaacuucuguuaguuaaugccuuuagcauaugggucucggggcaaacucagaucuucauaauugccagcaagggccuuuacccacugagcuaucucacugcucuuaaagcuaacacccacuaauuaacugcuuggucaggcuucuuucugagggguaucugucagcacuauucccauuucuacuuauaguuaguaucuuacagaauuaaaaacauuugaagauguuuuagauuaauaaauaaauuaaucuaaauuaaaucuaaauuaaaauauauauauauauauauauauauaucaguauuuuguccguaugcaugauguauguguguguacccuaugugugccuggugucagaagucagaaagcacaauauuaccugaaauuggaguuacagaggguugugagccaccauguggguccugggaacuuaaccugggggucuucugcaaaagcagcagugcucuuaaccucugagcuauccuuccagcccccagaaguaagaacauuuuugauuaucauuugggggagggggugcuacugguaucuacggcauaaaaaucacauauuauccaauaucuccaauaaauagagccucuaugauaaacaauuuuacccaaaacagaaugccaguaaugcuaaguuaggcgauggugaaaacacacaucaucuuucccugugugggacuagcacaaccugcggcauuuuggagguuuugcuuucugagcugcagauuaaggggaauucaccuucccagagaagcgcuacaggguauuguuuguaagauuugugggauuguaggugaaggguagacaugaauuccugaguuagcccaucuucaggagcaggcucugcaugaguauaguaagguucucaguccuagcuugucccuuacgugggucuguagugauuugcagacucuucagucguguauuguugugugcaugcuuauauucucaggagacacuugucuuaguucaaguauagcacucauguuaaaggagacugccuuuuccucuauucucugccagaguaaaaaagaacuuagaauccuagaccgacuuuuccuuguuguuuguuguuuagcuguaggaaaggagucacagacacagauaaauacacaguuaacguuaaauggucauuuacagggugaaggaacuaaagaaaggcguuaaguguugugcuucagcuaccagucagaaucagacaucugcaaacgccucuccaaaacgaauucagagcuccccugucacccuccccggggacaagugcucccccaaaaaaguuaagcugggacuucagcagucacuuacuguggccccaggccccacaaaaguuaaagcccauccuuuggccagccauguucccaacguccccuuuaccucuggaccuaaaaccccugguaaaaaaaguaguucccgagggagucccacuccagagugggacaugaaggcuagcccucgcaaaggaacuacgagaucuggccauucgauaaaaaagggagcagagucggcaccacugugcucugagaaaagucaaauuggcagcaagauugcuguugggugggagggcagggccucagacccaggagaaggucugcugcgugucaggcugcccacgagagggaagaaggugcagccaguccagccagugcagaagcagcuccugucccgaccucggcuccuugcuaacagccaccacuuagaagccacucaggacagcaaggugggcacaccugccgggcuugcccccgaagccuggacaaaccccauucuacagcaaaaggaaagggaggagcauuugcgauucuaccaccagcaguuccagcagccaccgcuccucaagcagaagcuaaauuaccaaccccugcagaggcuuuuaugccagcacaggccuucagaaggucggcuccagagugagacuggcuuuccccuccacucuaacccugagaaccgugauggagcccaggcugaggaccuugaugacagugacuucagugaggauucuuucucgcacggcuccagucagccggccaugaaacaggggagcacagccuuggaaaggagcggaaguuccuucuuccuucaucaggacagggagcacagcccugaggagcaggcagcagaaaggcagcaauguuugcuuuucagcucugagacggauggcaguaagaagcggccagcugacagcuggguguauuccagggaccccaucaucagccacagaagaggagcacucagucaaagccacagcccaaguaugguaugcccagacuggagcaaggaggaagacucugccuccucaggaccuucuccuaaggacaaccgggcccagaaaccuuccucuucacagguagauuuugugcaucaccaaaaaccgggugaagcucaagucucugacaucagacuggaggccuucacaagugagguuccugagcaagcugagggcagcuugucauccccauccccggaaaaugggcugucuuuuccacugucccauguggcuguuucuggauccccagaccaaagagacagagucugcacaccauuaagagaagucagugaaaacagagugacucacacuccaggaagagugaacagcagcacuccuuuccaagaggacucuggagagcagauacagauguguucugcaaaugcuucuggacucauggcuccccucacuaugucccuccuggagacccccugucaugaggaccuuucguccuuggagcaaauugcccaggauggagcuggcuaugguuucauggcugagauuguaggagggccagcagcaggacacacagucccaucuuaugaucaagaggcugcuuugccagugucuucagcuacugagugccuauggcuaucuucaucucccccugacaaucggccuaguggugaucuuccagcucuguccccgucacccauccaccagcauucaccugacaaauugcccgguagagaggccuaccagaccagaaggccaauacucuugccugagaaucauauggguaguaagcuauaugaugaccgugcugaagagacugaacuggggggcucccucacauuccccagaaagccguccuccaacauacaugccggaguacccuauucuacaccuuuccucaccucauguacaggaaguaguaauggaguuggccgucccugggcccaggagagaaaacauccuacagggguuagcugccaggagcuuguuuccucuacagauuccaacaagccucauuacaacgaggacaucgcauggcucaggcacaggccaaucucaaggugcuuagauucagacucuccugugguccccagcuguucuuccaaggccuugaggacauauuguccacuuacaccggagcaggcacaguaaguuggacuuuguucuuaagacuugagccccuucaguaccccaugcccuuuccuauuugcuuagacuggagcuugccucuucacugggagagcuuacuguucuguagucauuagaguuugaccugcuuagguccugaacccuccacaagcaaaaauaagagcagacuuaguaccaaacauacuagucgucacugucuuacagccucugugaagggagcuguggggaacaggcaacccuugugaagcagcaggggaggcagggaugagcuugaaaaaucugucugucugucucuuucucccccuauaaccugugggcacccccuggccccuugacuaguucuaagaacagaacagagagagcaaggagcugccagcuggucuuaaaacaccaggaagaggcuacaagcuccuaguauagaaaugaggcucaguguucauaggcuguucuucaacauguucccaggcaggugauuauccgugcacacaaagaacagcuggaugaaauggcugagcuggacuugaaggaggagaccuuaaugacccagauggauucuaauguaaguaguacuggacagauaugugggcuacugacaacucauugugcuuuguucaguggucaucuguuugccaugguguagauacaacaacaaaguuuugcuguugcacacuaacuguugaggccuuguggcccucagagggucuagguggagaugggaauggggucccucccuaugacuacuguagcagugaaccaccuugcuucuugcaaccugaagacccaaagcacuguaaguacccuuuuuccagaauagucuucacuuacaaagugucucaaaagugucacccaguccauagaaacuucuaagguuuuccccuggggaagagggacuuggguucugaaauguuccuaguucaaugaacuagggagcacuuuuuacucuuguggaggacucagguuugauuccuagcacccacauggugacucauaaccaucuagaacuccagucccaggagaucugauguccucuucuaaauucuguggguagcaccgggcacacaagugauguguggacgaaacauucagacacaugaaaacgugaaaaacaaaaagacaggcuagaaaagaugaucugacagacagccgucaagugaaaaggcuccaguuguguuguuucuccucaggauuuugaagauuuugugacccagcuggaugaaaucauggcuuugaaguccaggugcauccaaagucugagaagccagcuacagcucuaccucaccagccacaggcccgcugcagcccccgaaagaacuguggugucuuagagcaugucucacucuggauggacacugcugugcucucuggggcuggaagaggcucugccagggccuuccuaaaaacgaccccucccuguccugccccuagggucaaccuagccauacauggccuuggaugacccacuacucagggacagaccucaucucaacucccaacuacagggccaccuguaacaaaguacuaggcugaaagccuucauguccccuuuuauuuggggcucagaguaguagucacuuugccaaccugcaucuguagggacuuggucuauuaacuuuguagauguccuaaauuugaggauaagacuaggauguuuaauguuaacuuggacaucggaggucagagguuagggagcacaaguugagccaacagccuuauugcugacagugccuuucugucuucaaagacacugguaccagccaggcagucaggugaacuccuucccagcagggaguggaaauuuaguuuuggaaauuauaaaaugaacaacucuuuuuuuguuuugguuugguuguuuuuguuuugguuugguuuugguuuuucgagacaggguuucucuguauaucccuggcuggccuggaacucacuuuguggaccaggcuggccuggaacucagaaauccaccugccucugccucccaagugcugggauuaaaggcgugagccaccacaccuggcgaacaacucuugauaucuuucuuaagagcaccugagguccaggguaugcuuuuaguuuccuucccugcaauccagcuuugagggugccaacagcagcacgguuuucucauuaauuuuucuuuuuugcuaaaacagcaggcccaugucagugucugccagcccucauaguucuuguggcagguccuagcuccugucuaugacuccucauucccagugccucugaaugauuaaacaggcugggagaucucaggcaagucuauugccaaggcuugagugguccaagguacuaggccagcaacacucaagggccuuugcuacgggugucuugggacugagucuacagucagcagucugaaucuucugacacagcaacaaacacacaucucuucaaaugaguucuugcuguauugcugugugugcaggacagauguuaccagguacccucaaaucauucucuaccuuauuuuugaagcaagugucucccuguugaucuacccagacugauuagccaacaaguccaaaauucuugucucucccuucccuucucagaccaccgcuccaggcuuucuuuugagacagugccucucuaugcaguccuggaguucucuauguagaccagcucacaaaguaguccugccucacaaaugccaagauuaaagauguagcauacaccauuacaaccagcuacuccaggcuuucuacgcaguucuuaugcuuguaccacauacacuaacugaaccaucuucccaucucuuguaucaccuuuuaaacagagagaaccccaagggaaacagccuccaagaguccguuaguuucauaggucuuccugaguuaaccugagauucaugugucacagccugggcccugaagccauuaccacauacauuuaagaacucuaugguuuuaggauguuauauuuaaaaagccaagauaagccaggugugacacuguucauguguaaccccagcaucugggaugcugaggacuaaauucaaaggaauuagccgggcagcagaggauuauggucuaaaccuggacuauagugaggucuggcucuauaaaagagcugaaaggcuugucuggcagccacgggcagugcuugaacugaccaccagauggcagccuguuccuagcuuaaggccucucacauaaccacuaaaaaucagaggccauucccaaccaagaacaccaaaaggaugugggauucuacuaaagauaaguacuagaaauuuuaaggaugaacugucagcuauaggagcaccacugagagccggggaagcacuuuaaccuugccugugacugguaguagucacaagcaaagggacuugacuugucauauuuuaaaggauaccucaaaaccuguauaccccuucuccacuuuagcaagaaagcauauacccuuguuccacaggcugcacuagaccagguuuagagagucuguauuuauaaaacaaaaaaaaaccaaaaaaacaaaaaaaaaaagaugagacaggauggccagccucugagucccauaggcccucagugggaaaaggauacugauaugaaagggacaacuaggcucuguuccaggccagaaaugacugugcuacccguaaucuacccacuguccugagucaaaccauuuuucaaaauaaagagguuaaggcagcauggcauaccuuuuagauuuuuauuaguaguucucugaagaaucaaaauaguuagcaaauuacuuuagauucaagacuguauuauauccuuuguauuuagaucuuuaauauuguagaacauaauacaaacaaaccaaagagacugguuucuaugccuagguguuauucauugugucauccuaaagcagggcuggaggaggcuguucaagaacuggggguuagugcugagugacaagucguggccuguuuucucacccaugugcuggaaagggccaaugauacucaaaacugacagcuuccuagcacaggggcuccaaugccccgggcagcagaggauuauggucuaagccaaaagaaacagucuggacaggggcaaaugggaacugccuggcagaagaggcagacuuugccccaugaagaaaagugcaucuuuguaccgcagagacacuccagaaccaguguaacacuagggcugucggggaaggcgggcccaggaagacccucucaguugcauuccacuuggguuagagcccagucugacaguggugcagcagagaggagaggaaaggaucuagccccaaaacagcagcagucugcuccuccugucuucccacucuucuugguagccaggccagguuuuggcugagaacauuagagaccccagaaagaaccaaguauuccuucugaaagcccaaagugggaaggacacuucucaaaacacagguauguuuaauauggaaggaaccaauagagagcauauaugcccaaaucuuccuacuuucccccagcucaggccugggcucacagagacuaacaagugucaacuccacauccgaccuucuaacccccaaagaaaaucuggaagcaugucccgucuuccccacaagugagcugugcagagccuccuuggggaaugguggugcuguggcagggccguagcagggccaggucucagcuggcuccagcccgggccaugaggucuuccagagcauuguccuggucauuguuguguaauagcaaaacuuccuuaaugucuuucaguucaaagcccauuuccuuaaauuugcucauuaacugaagaaacuccaucaucua

SEQ ID NO: 1843 - RNA, 2706 nt, Mus musculus
uaaccuaauuuagagaaguuucuauguaagugguugguucuuagauauaccacacgagucucagcagguaaagcuuguggaaggcgauggggguugaauaacucacugagaccaaugaaagacugcacugaguaggagacugagccaggaguggacaggaucagucauagaauggcucugagaagaaauauaugguuauauucuaaggaaugaauaaacucauaucggggagaagcaauaaagaaguaaguggagcuggggagauagugcagucaauaaaauguuugccguguaaacaaaaggacaaauucaauccccagcgcacacacacacacacacacacacacacacacacacacaagaagccagugcgguaaugugugcuuguaauuccagcacugagaagguagacaguggaucucugaugcuugcccuagauuccagugaaaaauucugucucagaaaacaaggcaguccugcccugaggagaaccacaccuaauguccccuggccucugcacacauaagugcacauacagagacacaagaaaagaaagaaguaaugagacucagggaggggcugagcguaucugugagguauaggagguaaaguacauugaaaccuaccaccuaauuugaaacacuuaguuucaauccaauaggauucaaagagcaagggauguagggucugaggaugucauucaguugguagagugcuuauuuaacaugccccaaaccuuggauuuacucccuagcaucagauaaacuggucugauggaauaugccugugaccccagccugauuuacaagagacucugucucaaaacagucaagcauucuucaaacaagaauuuugauuaaugaucaagaaaaauguuaagugugcaagaauugaaagggaacaagagauauauggauuuggauuuuggaaaggccuuggugucuaaguagcagaauauagguagauuuuggugaccaaccaacuggaguucaggggccacaaagagcacuaggagccaaacacacaucucaaagcuaaaauaacugagauuugguuucuagccgccgccuccuuccuuccuuucuuccuuccuuccaccuuuccauccauuuuuccauccuccuuuuucuucucuucuccuccuucucuuucuccucuucuccuucucuuccucuuccucuuccuccuccccccuccucuuugauagggcagaggaugagguaguguaggucagagaugaaaccagagguuagcuaguagaaacuuucucauugcugacaguuauuguggaauuauuugcaugagcuuggcauauagguggcauaggccuguaaucccagcacaugggagguagagccaagaggcacgaccuagccuucacuacaauagugaguccugucccaaaauuuggguuugaugguacauaccuauaaucccagcacuucggaagcuaggguaaaaagucagggccagccugagcugcauagcaaguucuauaccaguuugagcuacaaagugaaacccugucucaaaauaaaaccaacaaaccaaacaaacaaaaaacacaaauaauuauauuaaaaaccccaaauauauuaaagauacucaaaauguacugacacuuugaccauuuaaguaauugaauccuuuuucuuaaaaauuaaagucuauuuguaaacauauaucaggcagaucaccucagagaauccuuggacugaaauggagaaaaucagaguuuguguucgaaaacggccuuuagguguaagggaaguacgucguggagaaguuaauguuauuacuguagaagauaaagaaacucugcucguacaugagaaaaaagaagcaguugaccuuacucaauauauucuucagguaggauuuuucacuuacuguuucaaacuaauauuaucaaguaugucaguuuuuuacuuuauauuuaaauggugguucuaaaauccaguuucugguucauauaaucauauuuaaugguucuuuguuugcuugauugauuauuuauuuugagauaggaucucacccuugcuagaacuaagagagauccaacuaucucugccucccgaaugcugggacuaauggcaugugccacugagcccaacucuggacuuuuauucuaaguuauugauaccuugguccuucauucuuuaaaacuguagugggauuaugauauacauuguuagaaaaccauaauuccugcuuuaugcaaugaggcucuaccauauauucacuuagcauguuuaugugaauuaguaaaaucaaggguacagaugagagaauaaaaagaauuugagcaguaguuauuggugaccaguuguugagagugaugcuuggucuccuuuucccccgcauuauggaaugugaauguuuugggguuuuguuugagacagaguguuuucucuguguagcucugacugaccuggaacuugcucuguaaaccaggugggccuuagguucagaggucugccagccucugccuccugaauucugugauuaaaggugucagcccccaucacacagcugccuguuugcuuuugagucagaauaucacuauauagcccugacuggacuagaacuugcuguuuagcccaggcuggccuuaaugcacaaaagucuaccugccucuuccuccccuaaaauuaaaggcauaugucaacugaacuuuuuuuuuuuuuuuuuuuuuuuuuuuaacuu

SEQ ID NO: 1844 - RNA, 5008 nt, Mus musculus
ggaacaacaccccacccacccccgcccacugccuggcugccugguaaagguagucuggcucccgugguuuguggaggcaagggguggagccucaccucggcagaggaguagccagaggaagaguaucuggacaugucaaagucaucgucgcuggccaugagaagagcgagagagaagagugaguaauuuagagagauuaaacagaaaacgcucugcgucuuugcuauacccgcccccucccaacaguaugauuuaaauaacccgugcuuaguaugcaaauauauguuugcuaaggcagguuuccuagcucgaccuuuaaaugguguggcuucuuaaguuccuucuggagagaacugcuaccacucuuuccgcucguccucaggcuguuuuaauuuuucucccccuagguucaaaucccccuggcuguucggauuuuccaaaagucuauggcuagccagaugcuacccuggcauaggguucuucccugagaaggggacuggcaucaggcauuccauuaggcugucuagagauaucaguccaucguggggcagcagcugucucagcacacagcaaacugugcuggcccccaggccucucucugaacaauccuuuaaaacaaccaccaccaccaccacgaagccaaaacccacccccuugggagacuuuacccauggagaguugguggcugaagaacacagcccuuguggcagugugacagguguggccuguuacaagccauccgagcucacacagcaucauguggcuugccuagcugcccccagaccccauacacaccugucugugucaagagcuaccaguggcuucucaucagggcucugguccagcgaggaguagccuuuauuagggacgaccagccuggguaaagaguggggaguuggagugacaaccgucagccagagcauauaaacaggacauuagguccucccccucacugucaucucccccauuccccugaggagggagaggguggagaccagcaaugguagguguugacuggugaggucccaguggggcagagaggaccccuaccucguccgggccaugacguuguucuucuuggguugcugguugacagggcugcccaugcugccguucuucagggaacccuuccgggccagcucccguugcuucucugcggagaacacgggaaagaagcuguguccugcccagcggcugccaggcccugcugcugggggcgaccugaucugggccuuuccugcagacgcguacuucuguagugaucccacggaccgccaggcaccugacgcucgguggacaugcauaacugagguggacagacagcugaaaagaggaggcugacccuacccugugggaaccacaguuacuaugucaggcagccggccugugcuugaugucaaggaauggcuagagaggaagagaugaacacagaaggcuggagcagucagagaggccuucccugaggaaaguauguacaaaagcaacccaagaggacauagcugcgggcgugaacggaacggagggagaugagguaauaaagaggugaacuugggaaaggagccauucaucaguuaauuauucacugaacaaacacuagaaucgcaauuaugcaucaaguacuauaccacagggauggaaagcuuccaguaguuauaaacucagagcaugcacagagacccccaucucaagaaacaaaagaaagcaaccaaaccccucagagugcaaaggccuuggccauggggcugaggcacuuugggauuaauggggacggaaaaggagcuacuaaggguuuccuuagcaggaggggcagaaaggggcugugggcaggauugggcaggaggcugaggagcccagucugcaaucuuuccaggggcucagagccccugcacuuguggggcuggacaucugcugacuuacuacgugguacgugcgacuccggagagcugccuggaaggaggcucagccacucuuucuuacuaaugucaaguaaagccaugacgaaggagaaaggcuugcucuguggcagaaacaugguggcaggugugggugugugacuucuucguguaagggugggaggagccgucacagcacccgugagucacuugaaaaugaucucugauuuccaagucuuugaagcgcugucuccuacccucuaaccucucugccucuauuuuaguuuuccaggcucuucagcagacagcaacugccauuaccauaucaagccucuagggggugcacuuugccuuacauuucuuggugauuuucuuuaucuuaagugagacaaguugugaauguccaugaguuuugguggcaauucuauggugaaggaaauaaaaaugcuauuuuaacagcaugcuaacuuuguuugaaaucaugaaaacaaacggagacaauaagcugacaaggcucaaacuacggacuacuaugcaaccauuuaaaagaaugaagccauucucuguaggacaucauccaggggagggagcaaggcucacaaaaugugcacaauguaaugccgcucuugugcucaaguacaaaaugaagcuacaagaaccuggaaugguugccuguggagagaguacagaacuuguaugcauuuaaaauacuuuuauuguugcauuaaaacaacaauaaacaaaaguagcuguacuuugaauagaauguccuaggaaggcaagcaaguccaucaaaagagcugcuguuguguuuagaaaaucaaccagggggcugccugggugugcgcuagaaggagaacugcaagaccuguuuuauuuuuuugaauucccuaaaggcacaggcucugugggaaagaauccugauagcucgauaugcaggggagccugauaagagauaagaggcuccaucuuagcugaggaaugagguuuuuggugggcagauagagccugaguucugagaagaacuaaggacagugacgacuguaucugacugucauaucugucuuguguguggcauguuauaauuucucuucaggaaaucaacucuuuggugggagucugcuauugucuucagcagccuuggaucugugagauuuugguccaugaagggagaggggcggugcucagcagcggguggggucagaccuggagucacuggagcucugggcagcugcgggggucaggcgaucucacagcagucaguggacaugggacccacccuaagacaaggauaaugcaauacuuggaaaggaaaugggugcugggguucuaaggaagggacagccucccuggacagaagucacccuggcccugaaucugucccucacacauagcagcagcugcccuaucuuuggaggcaggcuccuuuuggcuggcccuauccagugcugucuuggguucucugcggugccugggagugcggaugacuuacuuggagguugggaucguccagccugagccacuucaacuguagcaccuugcugucaacccaauccaagagcaccuucuucacuccccacaucucccucauccccgacacacucacccagcuucacuuggagcggggaugguuuguaauucauggcuacggacucacccucccgggcgucacagucucggucugagauagaggcugcggcuggauccugugggggggaagcagagaagacaggcaagcaugugacuccagggguugcucucaacccugaagcaaaccuucucaucugcccucuggguuucugggagcauuuacgcuagcagcaggccagccagcauucagggagggagaggacgggucuacuaugugcuguagaagagaggagacgauguccuacucccgaccaacaagaaucccaaguaagcuaggcugcuccagaaaaccuugccugaaacccacagggcucccucuacaaaggcugguacaagcuguuuuagagaagagucugucaaguuccucugagcuugcagguggaucgaggucagagcagguacuccagagagcccuucuuucucuguuucaucuuugcagggucuagacgaccaacuggccaaucuaagcaaggacucaagacuaaaaagaaggggaaaaaagucgagugaggacuucugaaguucucagaugagcucuaagcagugucucccgauggaugggaauggugccugagaagacggaccugacaaaccagcggaccacguggcuuugugcuguccugaaagcaggacacgugaugcaggugacagggaggacaggcaggcuuucauucugcuugugcaaccuuugcacucuccccugcacuaucucucaauagccuccagcucugggccagaccccgugcuucccagaguccuuagcuagcccugcuaucucuccaaaaugcccucgauguacgagggccccugucuaugccaucugugacaagcaccuccuuuuuaaugggggggacaaaagauuuuauucagguuacacaccacuugcaucuacauuugaaacugguuuacaaucauuucucuauuauaugcaggcauaugaguuuaguugcaauccuuuuucugacauaaacaaagauauuuuuaauauuuuucauaauugucagauucacaauuauaaagggagcuaaagaugagcuucucuuagaaugaaaaacucucauuuucaauguuuuuauacucaggccaguagguuuggcuuagcaguugaguucuugcagaagaccuagguucgcuuccuaauaccuacagggagguccagagccuuccgauccaaagccgucugaugccuguggcgccaggcacacauguggugcguaugcaugcauacaggcaaaaugcacauacaaguaaaagaaaauuugaaaaguuuuuauucuucucaaauuucauacagaguauuuugauccuauucaucccuacuccuccccugacuccucucagguccucccuuuccuccccacuccucaaauuucugucccuuuuccucucucucucucucuuucuuuuucuuucuuucuuucuuuuuuaacuuuuuuuuucuuuaaaaaaauaaaaaaacuaaccca

SEQ ID NO: 1845 - RNA, 17687 nt, Mus musculus
aaacuguuuaauauguuuuuauuaacagagagagacaagaagacagagauugcaacagauaugucuggaaacugauagggugugcacacacacacuaaaggcuucuuuuggaaugggguggcuccuuggaccccggcuuacuucuccagguccucuccuugggaacuggcccuggggcacuagccagcuuucccauucuaaccccaacaagggucuccguaguggaggaccucccuucccuuuagcauccucuacaugccucugcuuucccagcugaacugguugccggggggggggggcagggaggacaagccaggggggcauuugcauagcaggggaguggaauggagauaaggcauauggugaggaaagggaugaagggaagggcaucauagcugcaggugaaggggaccuccgaagggcagcuccucuuucccuucaccagagauuacuacaggaaugaggcaucagagugagguaguguguaacaucuaccucaacccuugaucccagagcccugaaugccagcaggaggcucuaggaaagccugagucagugagucaagcuugugauguguguucaaacaugacuggcccccuggaguauauguagaggacccuuucuggguggaugugagugcaugaucuuacaguacauacaagucuuagcaucucugugucucauuugcuucccaagagcugugucuggauguacaaguauguauguccuuccucauacagcagguacuuaauaucugcaugguauacgcugcugucugaauaugaguuccagcgaguagagagauggaugugguccugccgcgcuccuguccauccacagaucuuccuucaggccuggcuggucaggagucuuggccaaagagguaggugguaagcucaagccggaggccccgggcauaggcccgaaggguauagaagagugugagguaguccugggugcugaagaaagugucggcuagugcaaagaacaggguagacggaauaacaccccggccguacuccaccauccacguguuugguccccacuccagagccguugcuucuccaggcccguguacaacugucucuccugggagacagacaggauaagaaaccucaugaggagcccagcucugcccuggccuuccauacugcauuugucuagccuaugggcuaucuauggagaggaggggaaugaaaagacaguuucaagaaaagaaaaaguucuucuacccuacuggccaagcugcuugaucagaggacaaagaccaaaacaccuaauaccaauggcaucaccuggccccuggaaggccacccaacccagcuacaggcuaacguauagaauuauggcaucugcauuuccaagcugcacucauaucugguggaaauucugugugguuacagggcuugccaggcucucugagaaaugcgccuguucagucacaaagugugaugcuuaaccuuacaccagcaagcccacgccuuuuuuucuuuuaaacagauucagagguacauuaaaaaaacaccaccaggaguuugcuagccagauggcucagcugugcccuggcuccuacuccagaggacccagguucacuucccagcacccacaugaaggcucacaacagucuauaacuucagucucugggaucagaugcccucuucuggccuuuaaggcaccaggcaguuaagggguugguguguguaagcaaaacccagacgcauaaaaacaaacaauaacaaaaauacaaaaaccccaaacugccacucuaguuuaaggaaacaaaugccugucuuaacuuuuggguauaacccagauaauugcuggguuaaacaggcugauaaaaaaaaucaaguucucuaugacuggaaacugccguguucuguuucccuuaacagucgaaagcaucaggguuccuagcucgacccuaacgaaacaccuguggcuuaccagggagggaaggaaggaaaucacugguaggccuucuaaacacgcccuuuccaagucuuaugcccgucccuaucuagagggcgcccccucggacagaacuucccuacgcaccuggguagaagaccucacuuuucguggugcccucuuuccauugguggaaggugccagagaugauggugucagaaaucucagcccaguaucguccugauugacaguaaaauagacaccgaccaucagggaauccuugucaauacacggcccagccaaaccuuggaauggagggcaccggcccucgaacagucccagccucccaauccgacccaccgccaacacugacccgaauggccaugggagcccagggcggugccgaagagcagcacguacucagacagcgaggcgugcagaauacacauggcgcccauccagccgcccgcguucacaaauacccacugcagcuccucauccggcagcacguggccugggugcagccuccgcagcuccacgaucagccgagagaaggcaagcucaugguccagcccuggugcaaaaaggagaagcgcgggugagaccagcccgcggucugagcuuggcgaggaccagcccucggaaagcgcggcuccgcuccgugucggcccaccccacucuccgcccucaccggcucacccgcauacugucgagcaagcugcgcuauuucuucucuagagaagacgaaguuuugagugcccagccacaaccaggcggccuggaucagcacugcgauaauagucagaaucagggugauccaugcccaccgccgucccgcggcccacggcauucuagcgggcagccuggcaccaccaacguaagaccgaacuagggccacaggcuguggguucacgacucaaaagccgcugccuacggucgcccccgccaccgugguacggcucgccggggccaaucggaacguccgggucaccuagcaccgccucuggauugaaccauuuucuagaggggagagcguaggguuuaguggcuuggucugcaagagaggugagaggcggggccucgccuccuggcugccacccuguuggguucaaucuugguguccccaagcggggagacccagaauggauuggcccaccugagcuagcgagcccagaaguagagcuuucuaggucugcuagcacagaagcagguugaagauagugccacugggaaccuuaggaaagaagcggugauaucugaaguguccaugagagagagagagagucaaugggaacuauuccaggagucaaagagcagaggagugugagacagcauacaugcauuuauguauauauguauguguacauauauuuguaauauuuuagacaacuuuagcuagccuauagacuaggauagccucgaucgaugccucuccaauacugggaucaggggcgcgcaccaccaugcauguuuagcuuaguguuuucuccgauccuaugauucauucuauguucugaagcacaaaagugugaaagaccuugaaaaccaauagauuuguccacuggggagcuaugggauucgauguugacacagaaugauucugggcuaaauagaggaggggagcaaaauuggacuaagaucuaagacagagagcccauaugugucagcauuuaagaguaugcauugauagcuuuaucuguaacauagacuaaauuaaaaaguaucugcuucguagcccauaccuucauuaugauuaacauuaaaugaauuaauuuuuuaaaguaauuagugccuggcacaugguuaggauuauacauguuaguuagaaaaagacaauguaagacauguauugcuuguaauucuagaacgugggaaggcaccaagaucaguucaaggucaccauagcaaaagucagcagaggccucaggaaaccaugucuaaagcaacaacaagaacaacagccaaacccauaaaggagcuagaacacaaagaacugauggaaugaaauccaucaggcaaauauaagggagggguucacgaaacauggggaauggcuuuucauggcauuuuuauguggcagagacauuucuuuuugcuuuuuuuuuugguuguuuuguuuuguuuuguuuuguuuuguuuugagacaggguuucucuguauagcccuggcuguccuggaacucacuuuguagaccaggcuggccuugaacucagaaaucugccugcuucugccuucugagugcugggauuaaaggugugcgccaccaugcccggcuuuccuuuugcucuugagcgaccaaaauacauucuauaaucucuguauauggggccauguaccaggugguuuuauuccagauaauaaaauggaaacagaaaugcuguaagacauuuucaggucuaguuucuaaaaauaugugaaaucuugaggcuggagagaugccuccgugguuaacagcacuagcugcucuucugcuuuuccagaggaucuugauuugauucauagcaugcauaugguggcucacaacuguuuguagcucaguuccaguagauuugacuccuucuagccucugugggaauuguacccacaugauauacuggcauacaugcaggcaaaacaccaauacauauauuuaaaaaaaaaagaaauucuguccucucucuuuucaccuuugccaauuucagaagacuuauuguugugugacaaaauguuuccugaggaaacacaacacacuucagauagggagccuaugacaauugaaaguacagauaccaccaaaauccaauuuggugaacuaaugaguuuuauugggguuacuugcuggacugugggugaggaguuacuugcaggaacagaaaucagagucaaagacagcugcaucaccaaagcccagcccagcaugggugacagcucacaaaaccuggaagcagccugaaggcucuacagguuguaguguccuuuucaagagacucuagucuaaaccucucccaagcagcuugacuagucuguuucuucaggacuagucuggucucaagauacuuuuuugcagcuuggcuucacuuugucuaaaugggacucucagcauuuauugcuuacuauagcagggaggagucuaguaaauuuggucaguuucagggacuuccugaagcuguuuugaguugguuuccauccugcuaaaggaauucuugcaggauggauuuuaauacuacaaguauaauauagugguucuucuuggucaucaacuugacuacaucugaaacucaaaaaacaccugugaggguuuauuuuguucuuaauuaaaucauuugaugugagccgggcgugguggugcaugccuuuaaucccagcacucgggaggcagaggcaggcggauuucugaguucaaggccagccuggucuacaaagugaguuccaagacagccagggcuauacagagaagcccugucucaaaacaaaacaaaaaacaaaacaaaacaaaaaaaccaacaacaacaaccaaaaaaaccccaucugaugugggaagacuuacuucugagccagaucguugagauaggaagauacauuauuaauuuuggaccauaccuucugcuggcagccuauauaagggacacagaaguaggagaugugccuccucuuugcagaccugccuuugcucuugauggcaaguccauuccuucucuggcauuagagcuuacuucuuugggauuccagcauauacugaagacaagcugagauaucagccucauggacugaaaaacugaauucuuggaccuuccauugguaggcagccauuguuggacuaucugggccuuuaagccauucuaauaagucuuugcucuguugccuuucacuugcccauguugcaauauauugugcuacagagaccagaggcuggggaggugaacuguuguguauuuguuaguuuugaguaaucuaguugaggaugaaagguugaggaaacguguuuugaaacagcugcuggcuucuauguuaucccuaaguugacaauuuucuaagaccacugagaccucucuaguucauugcccuuucacauuccaucauaaauacaguuccucauaaauaaauaaucccguccucucagccuuaaccacuagcugugugauagacaguaacauggcuccagucuauaugacuuaggguauguaaucuuaguugcuguaagcaaacaauacccagagcucagagggccuuucuguagcaggcuucugccccucauuccauguagaaacgguuucugagauguccagaccuacaacuccccucuuugaucuuucagccaccuucucaaacacaguccacuaaaaaaaaaaaaaaaaaaaaaagaaaaaaaaaaagaaaaagaaaaggaaggaaggaaggaagagagagagagagaaagaaaggaaagaaaaagauccuauagcuuugagugacucauggagggaauugaggggaugagaaugacagccaucuucuccaaaugucacaguagagguccuauaucuggggucugggagggagagcaccaaguagacccuaucuagaccauucuuccuccgacaagggaucuggaaagacacagaaaaggaagagauaugucaccugaagagcaucaggagucagcaugaucuaggagugauguagaagcauggguguuccuguggagauacagugccaccgucuagucacuaaagacagcaggaaggaaugccuguucugcuuuccugcccucauucucugcuguacuuugagcagccaccagauugcuuaaacucacauuucaguucuugcucucuggccucacauaauggccucuucagauuucagccugagaauucuagggcagagaucaauaaccaaugacccaauuuuuguagcucaguugccaguaugcuuggcucugcuuggccugccaaaguacaauggugauaccuaucuauaauaccagcaguugggagauggaagcagggagaguagaggucuaaacuuguccuuuuauauacagaguucaaggccagucuuggagauauaugacucagucucaaaaggaauggaaacaacaaugccaaaaaaagcucccuccaaaacaagaaaaauauaacaacaacaacaacaacaacaacaccaccacacacacacacacacacacacacacacacacacacacacacacacaccuucucuggguguccuggaaagauggcucagugguuaagaggauguauuuuucuugcagaggauucccaguacccacaugauggcuugcaaccaucaguaacuccaguucaaggauacacagacauagaugcuagaaauacacacacacacacacacacacacacacacacacacacacacaaagaaauaaaucauaaagagagaaaauacauaugaugccuuccagacuuuucagucuagggaucaucacauuuguuucuuuguuuauuuauuuccccauuuguuugggacagggucucuccuaaaaaguuuuagcugcuuaguguugugauaaaaauuuaauauuaacuggggguuucuuccugucuuggauaauuuagucuccagauauguguccugugcccuggacuacuuguggccugacccuaccugcucuuggggguuggaggugagguggugcagagucaacaucacaaacugcaggaacugugagaaaugccccagcaaacuaucugaacacugcugcaagcuccuuuaauacccuccacuugugcccccacuggucccaagaaagcaucucuucuaaacagcagcguccaauuggcuggcauugucugcaccagcaauccuuggucucucaggcaguccucauuuagguccuccugcaagagaugcuuuuguggcuguguggcacccguuguuuacauagaggugguccagcaguuccuguuacaaauccagccauuuguuuuuagauuuugacagccuaguaggagcugggaugccauugccucaacauuguugaccccaccuuggaggauucccaguauacuggacugugccugucuuagguuguccugucuuccaggaucuuaccugucauugaauaccagcccuaaaagagauaucaguccagaagcaugucacacacaggggagauaaggaacagccuacaugguggucucauggaucucugccauccauguuuagaucacuuccuuaggaaggucacaaucaggauuuuugagagcauucagcaccuggagggucaccuuauuuauggagugcugccuggagauaugcuguguuagacacuuaagcaaaauaauuauuaguaugauuccucccaucauagcauaaguggcuauccacgaggagucaaacauccucuuaauauugucccgcacuuuucucaagaacccagcgucuagggagagcacagauaccuuggucacauugaggcuggguauguuuucccuuaacagcccauaauaguuaagggauuugucugaccggguacauuuaaaauacugagccaacuguugugaggcuuugaggaguuauguaccugguaagggguuaguuaggcagauugagugaaaucuggguucacaugccgguagagacaugucccuaauaagggccaacucuucugcaaguacaucaauauauuguuguaaaaugugaugacgugauugagauguugauuuuauuaccuccugugccugcaguaccucagcugacuuagagauuacagcauugacagucucugccguaauggcugucugggucaagggaacagcagccguuguugcccggcaaugccugcaguaaugacuacagugagggcagcuuuaauaccaaauucccucuuuccaugguguagcaguuuugagucugggucaucaaagugauaacauggaaguaagauugguauuuaccacaggcauccaaauagcagcugguucccucaucaggauagccauuguuaaauacuccauccagcagauggucaggagacauuucucacuggagcagucaaggcugucucugacaauggagguaucagugaccagaaagaaaaagagggguuggacacagacugggguggcuuuccagccaaccugccugccaauggucacauucaugggguuucaucccaguccacauuuucacggacugguuuaugugggaagaugucccauuaaagagacagucacgcuuuaggagaguaagggaacauaaaucaagacaauuagaggggcuacaagaaucccaauugcucauaaugaggucauaguggaaucuaaugggaucccuguuaacaugggaaggaucaugugagguaaaccuccacaugccaugugggguuagaugacaauaucggguagucccuaggaaauuuuacaccuagugcaggcugucaguguuccuaagggauaggaagucccacaaaagugggcauuugagggaaccuaagacaacaaggcaggguuggacaugauaugcuugggcggauccuuuggggguuugggaucaguaaggggaacaugaaguuccaugccuaacauggugccauagguuagauuaccaugaagguccccuguggucauguuguguaguuggauacaaaaggccgauggagaagacguuagugguaaagcagagaauuuccuccauuauuguugggcauugggcagcccccuuuuaguucccacacauggugucuucuaaucaucauguaguagugacuaaguccaugaagggcaaacccaaacucacauuggaagagaaaggaacaggguaggcuggggaguuaauugccacaggcaaaagaauggggggcagggacaccaaagccaagagcucaucggcccaaccaugcugaagaaaaauuaauaaacauaguauguauauuauguacauuacaucuccacauccuggucuuuuucuggcuccuucaucgccuccugguccauagcugggcaacaucucucaaggguauccauguugaugccauugaguccugaggggaaaaaaagcauagccuugcuucuugucagaaggggagcagacauuugccauugagaguauauugagucucuccaucuaaccaaugggagaggagugucccucggcaaaaaugcccaauguuugugagcgggcucagcccuuucucauagaaggagagaaaguucacauggaacaggaccucuccaccauggcuagguguggaucucuuuuggauucuggggaggugaucugagcaagugcucccuuccaggagugaucuggucuuucuacaacugcauggccuugaggauuauaggguaucccaaagaaguggcugauccuccaugaggguaggaaggcuaugaacuguugagaugaacauauucguuaggguuuuacugcugugaacaggcaccaugaccaaugaaagucuuauaaagaacagcauuuaauugggacuggcuuacagguuuagagguccaguacauuaucaucauggugggagcauggcagcauccaggcaggcaugguguaagaggagcugagaguucuacaucuucaucuggagacugcuaggaaaauacuugcuuccaaccagcuaggauaagggucuuaaagcccacacccacagugacacaccuauuccauaggcuuagacaaaccaucacaaugagugagcauguccauugucagucuugaguguccaaggcacuuccauuacaagcauugcugauuucauggccuuaauagcaugagaggccuuuucaccugccauggccaccucuuauaugagggccuugcaagaauccaccacaacauguacauaccuaagcuuaccaaaggcugaguaaugggugacauccauuugccagacugcacugaggaguagaccucuaggguuaacuccugaucugccaaggggcccaauggugcaagcgguacacguguugcaugggagcuuacaagauguuuacauugugauguaggcaauucagacaagaguuuauguaauuucugguguaacauucuggcuuguuccaggaauuccaugccuacagccauagucagggcauugguucucuccuugcauucugcuaaugugccaggcaguuuagaaugugaucuuaugugugagaugaaccauguuugugcccuauucucaagagccuucugaauagaucacacgcagacauguacagggcuguuuugcucuuuaauauaggagaaagauagguuacugacagcuuguacugcauauuggcuaucugagaaaauauuaccuggcuccuguuggcaacucucaaaacuuuucaggaguccaaauaauucaccuaguugcacugagccagaauuagggagaauguaaguugugucuccucucucccaucuuuggauaagaaccccauaucugauuuuauuagcaccagaaaaggccauaguugcuguacuggcuuguuuuaugugucaacuugacacaggcugggguuaucacagagaaaggagcuucaguuguugaaaugccuccaugagauccagcugugggguauuuucucaauuagugaucaagagagaaaggccccuugugggugggaccaucucugggcuggcagucuuggguucuauaagagagcaggcugaggaagcaagccaguaaagaacaucccuccauggccucugcucagcuccugcuuucugaccugcuugaguuccaguucugacauccuuuggugaugaacagcaguauggaaguguaagcugaauaaacccuuuccuccccaacuugcuucuuggucaugguguuucugcagaaauagaaacccuacuaagacaguugccuugagaauggggcaagagcuagguaugcuaugggguuuaacuguaauuggcagcuggaacaaagcaguaagacacuugucugauggcauguaauuauucaacaagccugugcaccccacuaccauuuauugaaagcugauggaaucugcccagagugguugaaaauauccuaaugagaaugguagaauuauucuugucugguucccuguuguaaguucuccuugcuaagacucucaccuuaagggaaagguggaagucaaugucaaacuuugaggaagccuuaaguaaaucagagugggccuggugcaaccacaugagaagcccauucugccauaacacuccuaggacgcccucaagggaccacagaagggguuuccccagauuaugccuugccagaggugguacagaauggagccauggcuuucuguaguagguugguagccucagauguuaguuuacccuugguggagggguugcuaggcuuccccaagagagaaaaaaggugccucaucuccuggucuggaauaggcaggaaagguuugagccaguuaacaguuccacauaauuguuguaguuccacgagggaguaggagucuuuugccacaauggagaaggccaggggcuuaaucuugucagaaauagaaaagcccaggaaggcauaugggggaacucucugaaucuuuuugggagaaccuucaaguugaguuuuuccaaguugaccaacaauugagaggacacccuucaagaucagacaaccagggugugcaagcuuaauaucaucccuguaguggguuacaaggacaccucagggacuuccuguauggcuucagccacauagagcugacaaaugggugggcuauuuaucaugcccugaggcaggacuguccacugagauguuuuaaucagcuuauucauauuaggcucucauacugugaaggcaaaauggcaucuauccuggggagacaaaggucucuggaaaaaaacaauccuuaauauaugggaugauaacacuauauuuggugggauagcacuaggaugaggcaaucccuuuugagugguccccauuuugugcauguguucauaauggcucucagauccuguagaagcuuagaucucccugacuucuuuucaaugacaaaaauggaaauauuaugucugcugguugagggcuccaagugacccaaagcuaauucuuccaagaacaguuccuugagagcagaaagcuuagguuccaaaauggucagucuaguggaucauuuugcauuauguccucaaaaaaggugcuauuauccauuguaaggacagcacccaugucuuccagaauauaucuuccccaaggguugcagggaauguuggcugcaacagguguaaaagaucccugauaguggccugagugacaggguuaauguaugcccuauggccaguuagcauaucaaagguaauguuaaguuuauauuccagguuaauccuagucuaauucucagcuaaaucaugauaggcagaccucccauuaagaaacacagcaggguggagcacugccuuaaggagauuauaccaauugucacagcucuggaggugcauggcccauugcuucacuacuuguucaaaauaaguagaaucugggccagaauguuggcagguuuucugauuaaugccaagucugccagaggcaugggaauccagggcuuagucuccacaucagggccaagauugaccgggaagccucacuauaugccugaggggaaugaggcccccaggcgagaggcacaggagugaccaauggaaggcaaagucccccuaaaccaccacagggguaagcuggggguaccuccaauggggcaggagaagaagggcuuaugagugagggaccugggacagaagggcuagaggguggcuugaagccuuauggcuggagggcuggagcagaggcgcucucauccucaucacuaaaaucaaaccuguuugccuagaggaagugggauggggucaguaauggaaaggugaauauuagccugauccaggcagugauuguuauggacagccaccacuuccucuggggaagaauucuuaagacuggcgaugacugcaaggaggauggggacaaagaacaagggaggggugaucccagacuguaccucaagcuugugggcgaggaagagaacacacauccagaggucagggucccacauguucuccggcgauauccagggggccaauauagcggccuccucccaaaauuaguccaggucaugaaucuuaaccuugagaccaggaguaaccagagaguuuucagaguccuaaucugggguuccuugaugguggagggaagagagcccaugucaacaagcacaaaggaaacaaaugacaaacagauaugacaaacaugacagaagaggugacgaaagucacauacuaagcaggggauucccuuagguguaacucaaagcucuuaugucuggacgguguacccaggaaggaaagguguuugggagccgaucccugguaccauuaccugggaaaacagacccuaugucagguaccauuaugaauccagacaaacagugaaaaugagcagacaaagacagacagaaaagauggugagaugcacugcaugcucaccaaagacagagaaaaguggagagauggccaccauaagcucacccucaaauugaauggaggccaaaagugaggucacugggacagauagacugagaagacaaagaagacaguaaugagguccaggcacucaccuucucagaaacccacaacagaaaacauaaaacacuaaggggccagcucaccaaagaagcaacagaacggggcacagugaggagaagaagaaagagcagaucaggucaaaccaagagcacaguccuggcaucaacagacaaagacaaacccccagaaaaggagguuugcaagcagucacaaaaugagggcgacgaagucauccauucaccauccuagucaacagauguuuccugugcccuggacugcucacaaccugcuugaggguuggaggugaggugucacaguggcaucaucgacacagaccuugggagcaggugagaaucuuuucagcaaguucaucugaacacugcugcaagcuccuuuaacacacuccacccgugccccauuggucucaagaaagcaucucuucuaaacagcaguuccugauuggcuggcauugucugcaccagcaauccuuggucucucaggcaguccucaauuagguccuccugcaggaggugcuuuuguggcugccuugaccccagcguuuacauagagguagcccuacuguuccugcuacacagauaacaaaaacuaaaccuuuauauuuguaauaagccuaagacagcaguagagcugggcauaucaacccucuauggcuauuuugucuaaacuaagggaugugacuugcuaagucccauuugggcugcucuuacuccaacuggucugcccucauggccaguucucaggauccuaccccauagugucuucucccucuccuccccccccccccccgccuccuccuccuccccuccccuucccucuccucuccuccccauaccccccucugcuauauacccucaagcugggggaacugaaguccugccuauuucucuucuucucuccugcccagcuauaggcuguaggcaucuuuguuaaccaaucagggauaacuugaggggcaaggaugcauagcaucacuugguauagaugagaauguccuugucugugggagugaccagaccuugggagccaguauuuaaaauauuuauuuauuuauuuauuuauuuuauacauaugaguacaccaccauugcuuucuucagacacaccagaagagggcaacagaccccauuacaaaugguugugagccacuaugugguugcugggaauugaacucaagaccucuggaagagcaguuggugcucuuaaucccugagccaucucuccagcuccccaccuccccagccaguauuuugcaucauaauacauagcaacagaccaaaccucaacagccuagaauguucuauguagccaggcuacucauugauaugccugucucugcccuucaaauacugauggccuuuugcuuguuuuugaaauuggcuucacuauauuggccaggauggucuagaacuugugggcucaauugaucuucugcuucagcuucuagaguagcugagacuauaggcaaaugcaucacugugccugguauguaugcacaaacgcauacacgcgcgcacacacacacacacauuacugucuuuugguuuacuuuuuuuuuuuuuuucgagacaggguuucucuguguagcccuggcuguccuggcacucacucuguaaaccaggcuggccucgaacucagaaaucugccugccucugccucccaagugcugggauuaauggugugcaccaccacuggccguuugguuuacuuuuauauagauugggccuuguuauguauaacugcgcaggcugaacuugaacuuguaaguuuacugucucuguuucuggagugcugggauuacagguguguaccaccacacccuauacuuacucaguucucuuuaucuaaccuuauuucugcuccugaggcuagaggcauaguuacagugaaauacucacacauccgggcaauaccugaagggccaggcugcaggcuucaucuauaguaugaucaaguuccucaccuccacccccucuccacaacuugcaucuuaaccacacacagcagcuccgcaggugacccaggucaugaguucagaaugcugcuggucuuugcacagggcgucucuaugcuccacacagaaccuaggugccuggcacacgguuaagaugcucaguaaaaacgaugucuucugaacaggacagggccugaugugcaaacacaagaacucacuacaccugugguuaccugcacaaaacaugagaauggacccauagagguuucuuaccgguuuggggggcggugcacucacgaggcuccgcccuuucugauggacuauuggcaguuaaaggcugcuggcaggaguguccuugaguggugaagcugauaugucaugcuccaauaaauagcccuaaugucgugcaagcaacccgaauccguggcgggacgaauggacacagcaaccaguuuucacagaugcucuccagagaaguagcuacaauccggugugcaggagaaucaucaaaacaaccuggggaagugagcguggcggucccgagccccgcccucaaguggcaggcugugcccccaccgucacguguuggcgacuagccaaucauccagggugggcggggggagacauggaauggggcgcucaccuuguguaccuuaggucaauucguguggccucacgucgcauagcggagccgauccugagcagcgccagcaggcuucagaggcggacgccauggcagcgaccuuccgggcgagcgguaauugcugggcggccuggacccgcuacggugcggagccgagccuuccuuuuccguaggaaguucuagucccagagucaaggucggcacuccuacccgaggccaggguggcgggcgagggaaggaggggcuugcaggccguguggcacggaaagcguuuaacccuuuaacuccccuccgccagccuauagcuucuagaaacacugcgccgaccgagcgucccuguacuugggccugcuagggcauuagagccacucggggaagagagagacagggaguuuugcugacugauccuugucucuccccagaacaccagcauauucgcuacaacccgcuccaggacgaguggguguuagugucggcucaucgcaugaagcggcccuggcaaggacaaguggagccccagcuucugaagacagugccccgccacgacccacucaacccucugugucccggggccacacgagcuaauggggagguaagcccgaauacacagccaccaacugggauaggaaaaaaauccuuc

SEQ ID NO: 1846 - RNA, 3974 nt, Mus musculus
ugaguggugaagcugauaugucaugcuccaauaaauagcccuaaugucgugcaagcaacccgaauccguggcgggacgaauggacacagcaaccaguuuucacagaugcucuccagagaaguagcuacaauccggugugcaggagaaucaucaaaacaaccuggggaagugagcguggcggucccgagccccgcccucaaguggcaggcugugcccccaccgucacguguuggcgacuagccaaucauccagggugggcggggggagacauggaauggggcgcucaccuuguguaccuuaggucaauucguguggccucacgucgcauagcggagccgauccugagcagcgccagcaggcuucagaggcggacgccauggcagcgaccuuccgggcgagcgguaauugcugggcggccuggacccgcuacggugcggagccgagccuuccuuuuccguaggaaguucuagucccagagucaaggucggcacuccuacccgaggccaggguggcgggcgagggaaggaggggcuugcaggccguguggcacggaaagcguuuaacccuuuaacuccccuccgccagccuauagcuucuagaaacacugcgccgaccgagcgucccuguacuugggccugcuagggcauuagagccacucggggaagagagagacagggaguuuugcugacugauccuugucucuccccagaacaccagcauauucgcuacaacccgcuccaggacgaguggguguuagugucggcucaucgcaugaagcggcccuggcaaggacaaguggagccccagcuucugaagacagugccccgccacgacccacucaacccucugugucccggggccacacgagcuaauggggagguaagcccgaauacacagccaccaacugggauaggaaaaaaauccuucuuccuuauuacuacccuucgcccacaagggggagcagugcgccuccuuuugggucauuuccgggcaagcaauuuugauccuuugaguggggccuuccucgcccccguugcagccuggauagcccuugaauuccgucagguaguauuucuagccuauucuugucaguaggugaauccccacuaugaugguaccuuucuguuugacaaugacuucccggcucugcagcccgaugcuccggauccagguacccucaauuuaaccacuguuggggagaagggagacugggucugacccggguaccugugcuacagagaguaauacuccuuuauuccaggacccagugaccacccucucuuccgagcagaggccgccagaggaguuugguaacuuuggguuuccccucuuacaaccuccagcccaggucugaagacgaagaccugagcuugggcccugcccuuagcacccaauccacuucccuaugucauuuuucccucaccaccuaguaaggucaugugcuuccaccccuggucggaugugacgcugccacucaugucugucccugagauccgagcugucaucgaugcaugggccucagucacagaggagcugggugcccaguacccuugggugcaggucugugagggggagguguaacuuugguuugggggagaaccauuacugcuuccacaggguauggugaggagggguugacuugaugucugugugacuauugaauaucucucuccuuucuacccaauagaucuuugaaaauaaaggagccaugaugggcuguucuaacccccauccccacugccaggcaaguaugugacaggccuuaauggcuuucuuggcugaguccaccggcauuguggacaggacuacuagauuaagagauagggcaaaagaaauacauugguaauucggaggcucagagauaaugggcuggccugcucuucuuugugcuugcccuuugacagguuugggcuagcagcuuccugccagauaucgcccagcgugaagagcgaucccagcagaccuaucacagccagcauggaaaaccuuuguuauuggaauauggucaccaagagcuccucaggaagguagaccagaccuuuuacccucacagagagacgugcuuuaaagggggauaggacauuagcagccaccuaaaggaauauuaugguggcuuaggguaggugcuagugagagccuucuguuucccugcggccugugcccuucccccucucacaugcacgauucacuuccauucugugcguccaggaacgucugguccuaaccagugagcacuggauaguucugguccccuucugggcaguguggccuuuccagacacuucugcugccccggcggcacgugcggcggcuaccugagcugaaccccgcugagcgugauggugagucuccuggguaggacagugggacugggugcuggauagaauggccuugaugggaccagcgucucuucccugggggugaaaaucaggcucugauuccagaucucgccuccaucaugaagaagcucuugaccaaguacgacaaucuauuugagacauccuuucccuacuccaugggcuggcaugguaaggcuuuugggguugggauagccccaauaguguuucugggcuucuagguuccggcuuagggaacuagaaucccuacgaggccuuaaagcacuuguuggcuuuaaaacaacuguccagcgcaugggugcugggacugagagaagagagauuuggugaccccguuacugauugcuaccuaaugccugagcucccugguggaaaauaccuggagcuguaauaaucuucaggguuagcuuaggggaggggcuagacugaaggcugacaaagggccucccagaucaccucugucuucuucuugucaggggcucccacgggauuaaagacuggagccaccugugaccacuggcagcuccacgcccacuacuaccccccacuucugcgauccgcaacuguccggaaguucaugguuggcuaugaaaugcuugcccaggcccagcgugaccucacucccgaacaggucaggacucacauccugggucgucauauccguucaccucauuuccucacgggaucucagcagucuugacccugaagagccucauaaaaaucucugcauuccuagaacucagucgccacucaacuccacccccuggugacuccagcuauccugaacuaaucuucccaucccauaagcccuccucaguauuuccugggcccagaacgccucgguacaauuccaggugacccuuacucucccugauugcuucuugucccuuuauaggccgcagaaagauuaagggcgcuucccgagguacacuauugccuggcgcagaaagacaaggaaacggcagccauugcuugacugugaccacaucagggccuugaaucuuuguaccugacagaccugggaccuggaguucgggcagaugugacaucaauaaaacugcgucucacauuuuaaccauguuuucugacaccagaggaguaguguggacucuuacauuccggaguuuggguaaaggcuaagugugacuccaaacacucuugccuacggacuuugaaaaauuuggugcaagaauccccuucaccaagccagacaugauggugugugccugugauuccaccacauuggcagcugcauuaggauugcgaauuugaggccaguguggguuacuuagcaagaccuagucucugaaaccgaagccaugcuggaucucauguuacaggucuguaauccuggcuccccaggacacugaggcaggaggauugcaaauucaaggcuagucaggguagcuuggugagacugucugguacaaaggaccugugaaauaggucagugguagagugggugucugacacauguaaggcccuguguucagcccuaacuauagagaagaaaauccuaccucugcucaauguucacuauugucuccaauccucuucacuugugauauggauagcaugcuaauuuaggaggcuguuuaaaaaaaucuuauguucuuag

SEQ ID NO: 1847 - RNA, 10008 nt, Mus musculus
agggaaccugaggcuguguggacgccagggacaagggccuggacacuuucaggccugaagucccugggaggacaggccuucaggagaggucuaaggaacgcagcaguuucagguuuuguccuaggaauccuacucuggcacccuccucuaaguuccagacgggacaggaaguguccagaggagguggaagugauuggcaguuggaggcuccaaugggccgagaaccccccugcuucaccucucucuuucuauuggcgcugggaggagccgcccccacugccugcgcucagcacuggagggagcagaggccggggcagagggugagggcggagggcgcuggcggcggcugccgcagaaggugagaggcccuacugggacccggguguugacucccaaguccugccaagagggggcggggcaggguggugugugaucugaaaggcagggagugacagauggacuaugagugugucucuguguguggcgaugucagugugugugaggcucagaaacuggugucauuggugugucugucagcgucugucagugggcaauuuuucuuuagguguuuguuugggagaagggcugugaccacaccgggggauguguuuugggaagcuucuguagggucuagauuuugucugucaggguggcugguuuguguguguguguacuaaugugugacuucaguaauagugcaacagugagacuugugaccaugaugugucuuguguccuagccuagacugugugggagugaagcuguguuccucuguucaggaacugcuuaaguuguggagggaaacugacuuuucuacccagccugcagcaacagacaagauccaccccccaagccacauggcuuuccuucuuccucuguucaggagcuggugggggcugagaauggucagugauagagcacuugucuggugugagccagggccuagguuccaucuccagggcugagacaguaagucccaucacugggccacauguauccaaagccucuggauuccugggguugcagauguggcacaucuguuuuuguacgccgcugggugucaaaccuagggcucugggcauguuaggcaaacuccaccaaccgagcuauauccccggugccccggucuucugguguuucuguuuucaugccuggcucugcuucuuuacaucucuuucuccguucccaugauuaucuuccuggagagauuuuuaugucucuucgcagcucccccuuaccccccaggugucucauguuucugcuuuucugguucugucuacaggcugucugucccucagugucccucugucugaguuuccuacuuauucuuuguuucuggccacacaaggacuuguagccuugcuaugacacugguccaucuuuacuaagagcuccuaugagcuccucauggugaggaguugcuuuuagggauuauaggguaaacacacacacauacacacaugcuucgugugucucugugucaauaggaccucuaguaggcuaagcuguuuaaaugugucugugugucucugugugugacuguaucugaggguaacugugugucuuguguaucuggcaccaagggaucaaaggcauuuccuggugcugaggcccaacugguggagggggaaaauagaaauggcugcaaccuccugggaaggggggggggggcuggucucuggccuuuccuuacauucuccagugugaaaccuguuuuccccuggaaacacagccaucugugccccaaggaaacauugcuggagaguggaaagaacaggaaggaguaugucugugugcuaauucuuuuuauuauguccacauguguucaagugaauaucuuugcuuuagucaacuaccuagugauucccugaguaaguaggcuuuggugacucugugaaaacaaaggaaaucuuccagcaacagaagauuucuagaagagcuaccccccucuccuccuugcuaguccugguugugucucuggcuuccuuuccagccugaggugggaggccucuuuccuucccaggcccuguggugggagggaaugagagagggaagaggaagagguggaggagggggccugcucagcucuaaggcccagagggggcggggcucgacaugggaaggaggggaugguucuggggucccacaacucaguggagcgggagacaguucuuagccuguaggaggaagucuuggaggccaugggcacucagucacugugauuaucaagguagggugggacuaaccaggguaaauggggcgggacccgggugggggcaauaagacagucagggggacacagauaugugaaggccuuguucugcccugcucuggagagguccuguggcgcuuugacugagagcuuaccaucuaccccuuucugacuaccuuuaguuugcugcugcuccccgccacccgagucuuuucucccagccccaacuccuucuggagucccugcugcaccaaaccagaccucuugcauauuggccccugacuccauugccuuugcucaugaacacuuuucuucccccacccccugcacuugguacuguggcccccugcaucaggcgccugcuccugcaggcuccuaguuccccucccuucucagccaccgcgucuccaucuccaucugcuggcuccucgcccgcucccagccucuggcaggagccagggcaucuggauccgcuuaauucugcagccccagccugcacccuagcuccauccagccucacaggcuugagaccaacaagauuucaagccaggcccaucugaguggcccaacuacgagagcaagaagccaggccuaggccagaggcuuggcagcuagaggagggcagggccucauguugggaauauggggggcauuugggcccaucaugucagcucccuaccugcgggugaugagguuugcuguauguuggccagaggugauaauuagccuuggucagguuaaaggugaaugccagaauucccagcagcugaaucguauggguuaaugggaguggaggagcuggugccaaucuuuggugccaggggugggcgccaaggaugguguguuguguugcggggguggggggugagugcuagcacagucuguugccucuggcuuuuguucugggccuuaagcccaggacugggaugaacguguguguguguguguguguguguguguguguauguguguguguguguacacauacacaaggacaaauacaacacuggguauauggcgagaaaugggaguucagguuagguuccucagucauuuucaauagcuucauuucucuugguauuucaguuuuccuuaaggaagccccagcuuuggagagggauaagccgggcuuuaguucauagaaggguaaguccuuaagugucccucucuccacagaugagcagcagcugcucagggcugaccaggguccugguggccguggcuacagcccuggugucuuccuccucccccugcccccaagcuugggguccuccagguaagaaaaugccucucuggcucccaaguguaacuucaugcuugggcacaaugaccccacccagggcuuggcagccugcuccucacccugucguucucguaaaugggagaggguauaaaagagguaauaaccgccuuuuauagggguccaguauggacaaccuggcaggcccgugaugcugugcugccccggagugagugcuggguaaguguccaccugucuguucaucucauccuuuccugacccugcccagcucuuauguucccuccuaaacucgcuucuucuggcuguaauccuugcuuguguguccuaacccuccaaauguauuuauucaauagaaagugcugcuaaugcuggggaugucauuggugccaggccuguacaaagccuugggggugggcgguggcuugauccuuaguacccaaaaucaucccucagugaaccagccgguauguuuaaauaccugcuaagugccgggccugccguaggcucugagacacgacaaaggcaagacgcuugccuucaagcgcuuucaucuuaguggggaaggcaggcagcaagcacucaagaaacuuggucaaaaaggagcagcaauggccagguuaggguagcuccugacgggcagcaguuuguggagaugcccugaggugggggugaccucagugcuaaggaacagaaagaagagaaugcggccugugcaggaggaaguuggggugauaagguaaagaaggccacgggagaccacaagggacuaugugaagggaauuugggcuugggcuuagucuccuuucuuucuuguuuuuauuuuauucguuuauuuaucuuggcauuugagagugaucuggaacucacuauguagcuccaaguggccccaaacucaugaacccccugcuucagccuccugggaugauucuuacacaccaccaccccaggcacagaaucgugguuugauugcaagugugcucagagaacaguuguacagcccaaccucgucucucucugacucaucuccucaucuuuccuccaggacuccaguguccugguuucgggauggagauucaaggcugcuccagggaccugacucuggguuaggacacagacuggucuuggcccagguggacagcccugaugaaggcacuuaugucugccagacccuggaugguguaucagggggcauggugacccugaagcugggcugugaguuaguggaagguggcagugaggggccaugggauuccccaaggggaccuaggauucgugcaagcccucugggauaggauggagcuagggaugucuuggucuccagcugugcccucugucuccaguucccccagcacguccugaagucuccugccaagcgguagacuaugaaaacuucuccuguacuuggaguccaggccaggucagcgguuugcccacccgcuaccuuacuuccuacagguauguguggguguguuugguaugugugccuauggaauugggguugcugacaugagauggguaugggaagcagggagggagguucugacaaauucucagagaagguaggggccuucuuucccuccuaaccucagaugguaaccuuuuuaccaggaagaagacgcugccaggagcugagagucagagguaggacaugacagagagacuggggacucuuaacuugugaccuauuuccaaaacccaagacgacauccuccauucuagggaaaguccauccaccgggccuuggccguguccacaggacccucuggaggccucccgaugugugguccauggggcagaguucuggagugaguaccggaucaaugugaccgaggugaacccacugggugccagcacgugccuacuggaugugagauuacagagcaucugugaguaccccaggcuccuuccagacccaugucacagagacuccgcacagacuuacacucaccuugccccagcuuccaacugguccucuccuuuucauaaagacagagucgucacagauggcucuguacccuaaaggcucccgucauuaccuacacauccuucccagcugccuagcucacuccuguuucuggacccugucuaugcugaaggcagcccguucucaugcucuccccgccuaggggaaagccugcccccccuuuauuuucuuaaucugagugugggagggaagaaggcaguauauguagguuggaauuugggccagcgaaucuucuguggauggaaagaaaaaucugcuuaucacucaaagcuaucaaaacucuguuuuagcauugcugcuuauaauaaugacagacagguccugaggcucaaugagugaucaaauucgacauuuccccuccuuccugggacggaucugacaaaagcaccuuuacacacacacugugggaaggaaugaguacccaucacuuacccugaacuuugugucuggcuaucucuagugcguccugauccaccccaaggacugcggguggaauccguaccugguuacccgagacgccugcaugccagcuggacauacccugccuccuggcgucgccaaccccacuuucugcucaaguuccgguugcaauaccgaccagcacagcauccagccugguccacggugaggucugcagugugucucggucuucaucuucuaguguugucucugguguuaagagaucagauauucugcaucgcuucuaggcacuggcuggucucagaagaccugauucccuuucuauauauguguuccccagguguugagcugggugcuggaguuguagcggguaggacugcuguccuggguaacuaaccauaaugcaagccugucuguggaaaauagaaauggcuuuuuaaaaaaucacuuggagggauugggaaaauggcuuaguguauuacagaacagccacuuauaagcaaggggaccugagucugaauccucaguccacauaaagccaggugaaauagcagaguuuguaaccugagugcuccaacagcaagaggggaggcagagacaggaaaaugccuagaaguucaugggcuagccgagagcaacaaaaaaccugucuucaaacagugcagaaggcagaaagacuuaauccugcguucuuccucugaccaccacacguaugcugugacacaucccaccauacacacauaccccaccacuacuaccaccacauacacacacacacaucacacacacacacaaacaccaccacaucacaccaacacacaacccacccccacacacaaagaaagagaaggggugggagagaauaacuucuaggaaagggcauaccuuuuaccuagaagacccuccucguauccauacuccugugucuaggugaaaauaguuuuaucuccacauccagaaaugucaaagauuuuuuggcaucuguccuaggaagcugucccuuuaguuuauaaucugcauucagagcugccugccuacaggguaccucaauacacauuugacagguuaucucuguuagguauagucaccccuauuuacaaacgaggaagcugagacauggaggcccacaguccacucaguaagucacuuagaguuuugaacacagacuggcugacaccacaggcccucuaaguaaccucuacaugcuuccauuuuccaaaucccagaccuagguuuugucccaucagccacccaacguggggucuagacccucccuugcagguggacagggauggcagcgugggagagggcuacucuucgauggccggggcugggcggguucuuuacuuacauugggaccacacccugaacagccgucuuuaccuccagguggagcccauuggcuuggaggaagugauaacagaugcuguggcugggcugccacacgcgguacgagucagugccagggacuuucuggaugcuggcaccuggagcgccuggagcccagaggccugggguacuccuagcacuggugagagacagaaacaaagacaaaggguggggcccucaccccaaagcaacuauccacuggacaguuuuacacauccccuuguuaggggccuucagcacugcuguccuauucaauagccuugcuggucugcagccuccucugacuuuagucccucgucuccacgucuccaccucugcacauuuagacccugugucugcaagucuacaagccggauccccagaagcuggccacacccuuugaaacugccuccuaggccccuaccucagcuuuagguucuagcccugcuccugcccuagaaaggcagaggcuucugugugcaccucucagguuucaucuuucuucagguccccugcaggaugagauaccugauuggagccagggacacggacagcagcuagaggcaguaguagcucaggaggacagcccggcuccugcaaggccuuccuugcagccggacccaaggccacuugguaagucugauggauugacagagcauguggaggacuaaaguccuagacagaagguggcaucauugcucucccagggacauguggccuuucucuuuagaucacagggaccccuuggagcaaguagcuguguuagcgucucugggaaucuucucuugccuuggccuggcuguuggagcucuggcacuggggcucuggugagugaguuccacugguuccuuagcuguacugccccgcagccacuuugaugcccagggaccacagccauucccacccucugcugacugcccgcugagccugcuggaguuuggaaccacgucuccccacccgacugucuucucugucaugauuccucuuccuuugcuaaucaauccucguggacgagacaugguauuagggagacagcugcucuuuuaugcuucaggcugaggcugagacggagugggaaggauggaccgcaaaaaccugggcucuuggcacccaugaucccgguggaaaagcuuccaggugaguagcacuugguaaucuaaaugcuugguugagugucugacuuaagaaccggacacccuauuaauuuuguggguuccaggaaucacuggaguugggucuuccucccaagugccuauucucagaaaugggucucuucccauuuaaaagauugggacuuauaguagcucccuucauuuuuagggcgucagaaccgauauuacccuucccccacuuaaaugucuuggaucaaugcuugcuccucucccagauuuaaaaaauuaaaucuuacuguuguguguguaugguauguguaugcacacacacgugucauguguugggagucuuucuaccuuugcaugaguccugggggcugaacacaggucaucaugcuuguuugccaccccuacccuuggccccagaacuucaucugcugccuuaucuucaguguuagggcucccucagaagcgggcuccuguguugggucuggauccaguccuccuguuaugcucucuguuccuuuaggaauuccaaaccugcagaggaccccagagaacuucagcugauuucaucuguaacccggucagacuugggugguuaaaaggacaggcagaaagaggcggggcaguggaucccuguggauggaggucucagcugaaagucugagcucuuuucuuugacaccuauacuccaaacuugcugccggcugaaggcugucuggacuuccgauguccugagguggaaguccaccugaggaauguguacagaagucuguguuccugugaucguguguguaugugagacagggagcaaaaguucucugcauguguguacagaugauuggagagugugugcggucuugggcuuggcccuucugggaagugugaagaguugaaauaaaagagacggaaguuuuuggagauugucgucuaauguugcuuuauuaguuuugcuguuggggguuugaguacauuuucuuuuguaguaccagauuuaaacuggguacagucccuuggagccuuuucccuuggcguucuaaccaccgagccaggcugcgguucuggggaugaacacagacacugcgccgagccaggugaagccugagaagggaaaaguccaaagcuaggcucacauuugggggaugagcuuagguaggguucaggggcuagggguaaaagccagaugaaaauccggguagguauuagaguuaguaaaggggcuagggaugaauauuggggguucggacugagggcagaguuagagguaucaaaguugggggcagagcucacacgacagccuggaggugacaguccccaucggccuccugcaguuccauguggacaauccuccucagcagccugcuugggaguggcugucuauagagcugaguacagcagcuagugcuggagggcagaggcaaggcuggagaacaauagggccacacuucagagaggucuggacccacaagcugcucugauuacauagcuagagguccaacuuucugggcccuguucccuguaguccccucgcucagcauucauucuauggccucugagaacuuaccugcuucaggagccgggcucagaagcaacaguaacagcgggaggcugcuggcgggggagagccccuccaucaugcucacucagc

SEQ ID NO: 1848 - RNA, 5433 nt, Mus musculus
ccucucccagauuuaaaaaauuaaaucuuacuguuguguguguaugguauguguaugcacacacacgugucauguguugggagucuuucuaccuuugcaugaguccugggggcugaacacaggucaucaugcuuguuugccaccccuacccuuggccccagaacuucaucugcugccuuaucuucaguguuagggcucccucagaagcgggcuccuguguugggucuggauccaguccuccuguuaugcucucuguuccuuuaggaauuccaaaccugcagaggaccccagagaacuucagcugauuucaucuguaacccggucagacuugggugguuaaaaggacaggcagaaagaggcggggcaguggaucccuguggauggaggucucagcugaaagucugagcucuuuucuuugacaccuauacuccaaacuugcugccggcugaaggcugucuggacuuccgauguccugagguggaaguccaccugaggaauguguacagaagucuguguuccugugaucguguguguaugugagacagggagcaaaaguucucugcauguguguacagaugauuggagagugugugcggucuugggcuuggcccuucugggaagugugaagaguugaaauaaaagagacggaaguuuuuggagauugucgucuaauguugcuuuauuaguuuugcuguuggggguuugaguacauuuucuuuuguaguaccagauuuaaacuggguacagucccuuggagccuuuucccuuggcguucuaaccaccgagccaggcugcgguucuggggaugaacacagacacugcgccgagccaggugaagccugagaagggaaaaguccaaagcuaggcucacauuugggggaugagcuuagguaggguucaggggcuagggguaaaagccagaugaaaauccggguagguauuagaguuaguaaaggggcuagggaugaauauuggggguucggacugagggcagaguuagagguaucaaaguugggggcagagcucacacgacagccuggaggugacaguccccaucggccuccugcaguuccauguggacaauccuccucagcagccugcuugggaguggcugucuauagagcugaguacagcagcuagugcuggagggcagaggcaaggcuggagaacaauagggccacacuucagagaggucuggacccacaagcugcucugauuacauagcuagagguccaacuuucugggcccuguucccuguaguccccucgcucagcauucauucuauggccucugagaacuuaccugcuucaggagccgggcucagaagcaacaguaacagcgggaggcugcuggcgggggagagccccuccaucaugcucacucagccuagagguuucuuccuuccuuccuuucuuucuccccugcuccccagcuuuuaucuagcugugcuuugccucgggcacuaggugagucagacacagguggugaugcuuugcuuaucuugugaagcugagcucuaacucuuggccuguugucagugacccaauccccugccuggacugccauuuccccaugggcuucuaagcccugaacggagaagaauggagagagcuagcgaauaguauccggggcugacauuacagaagcucagaacagccgugguucacgguggcgucuccugauagucauuuaugcucacacccauaaccacacauucacagucauauguuggucauguaacucaugaagucacgcccaugaaugugugcucgcggacagaaaugacacagauccaguuauaccuaaaagcuccacuggaauccauuugcauuuccacaaucaucucgcugaaccauauuaguacacauacacacuucugaugggaguuugugaguggguaggaacagaaggcaggccagcacugaccugccuucaucuucuccucccuacuaccuuccccgccccgccccgcccugcauuuuucuaaucaggagaaauugaugggacccuaaaacagacucuucuuggguaauagggagauguuuaccauuaaggagggaaacugaggcagaugcgggagagaaauaaaaguacuuuggugccagguugcugguguuaaaacaggugaaaguggguggacguaugguagcacgucuugucccccaguacucagcaggcaaaucgaucucugugaguuugagacuagccuggucuacacagugaguucuggggccagccugagcuacguagugagauccugccucaacaaacaaacaaaucaacaaaacuccaagaagacaaagccccuuucccaaaucucaccuucuugcuucugcuuagucuuguuccacggaugccagcuucucagugggaggcugggggcuuccagacuuagucucuggcuuguuggagacaucggacucaagaacaaaguuaggucgucucguuugauucaaauucuaccgucuuuccauucugggcuugaaggaacauacccuuccgaacccagcuucagaaauacccauuuccccaaaccccaaacaccuguacccacccuacgcuuccuuccaucagaaauaaguauguacuaauaugguucgguggaaucaauguggaaauccaaauuuauugcaguggggccuugggguauaccuggaucuguaugcaaaauuccuauucauuuugagucaaugcuuucuggaaaguuguaaacggccuagaguagggguguguuuauugggcuaauggccuaggcuccuaaucuggggauuucaauucucaaguucugcucuggauuuaaaauauaaaccgagucauaacaccaagaauccaucccuuaucuggagacugaauuuccugcucugaggccagccauccucuggaguagagaucuugggauaggacuuccacugccuccgagcaguuucuuuggcuaaacugaaaaggccuugcuuccuccugaccaggguuaagacucauaggcaccuuuuggacauuuucucagaggucuuaugacagucugggaagauguggacccagggcuagucaaagcauuugaaggugucuucgaugcagaaauugugagggaauggcuaaaaguuugcacacuugaaggucacccacgagccagaggccaugcauccucaaguuuugguacccgaagcuucucucuuacgcccggucuagaucuuugucccagggcuuggguguuucaccaaaaaagaaauucuaaggaaauucaccucgccugccccgcucaccccacuccaccauccugucuacacugcuugccaugugagcuccccuggguuugucaauccagagaucuuuggaaggcagaaacauuuuccuggcuuccuucucuccuaauuuuggcuucuccaaagauauggaggccaaguccucuuuuccagcacagugugcuaugacagaggcagugccaggcuaaaagucagcuuugagcucagccaggauccaggcugucuccauagcauaauccucaggugccuguucuggaaugggagucagugugucuaugugguggacacuaugaggacagucugacucucacccacuguaaggguuaacggguuccagagugauuucgguggacaaaguaaucaugggguuaggguagcaggauucuuagcaaacugcuaguucuugcugauaccaaggacuuuuuaaaacggugauggggcuggcaggauggccauggugccaagccugaaacccugaauuccaucccgggaagccauauggaugaaaaaacccucacaaagggucauauccucugaucucugcaugcacaugcauuguggugggcacacacacacauuacaaacacacacacacuuaaaaaauuaaauacaaaaacaaaaaauugggaucagauugggggagccaguuugggguuuuaacuauagaaaggaccuuggacccucaacccuugucacucuccugggguacacugcuggagacagcuucuagaaacugguccuuccucucacugacagcagacuccucaacuuuggcuaaaauguuuuauauccacucccaggaaaagaggauucuccagacaucuggcaaaguuauggcuagaguuaggugguaacagcugaaguugugggaacacugauaagugggggaaagauguggccuacucucagugugggugcuuuuggggagggcguggcagagagccagucacugauaguaauuacaagccugacccuuaggagcaauggaguccuacacaugcaaaggcuuccuaccagggagggaugcccuguggguuaacaaacagcagguguggagugggauucccagcaccaaaggcggcugcggcgcuaaagucagggaggcagugggcgugacuuuaaaucuuuaaugcaccggcugucugugcagcagcggugggggugcgacagaggagaccacgacccgagcgcuggggagcaggccucaggccgcucgacaaacagcucauuaggccccgcagaggcuccagcuucugcucccgggggugcgccgagcuguagggcgacccgacaaugacaugaggcggggcaggggcgccuggacucccccacauccguccaccgacacugaaccucguucaugcccccacgagaucgcagcccccucaccuccgcucccugcgccacauucgcagccaaggaaaaaaguagaagcagccccaguagauccugcaaagacaaggcagagccggaccgggaggggcggggcugacccacagaccucaccucuggaaccgagcccuccagaaagccccgcccccaagggcuggacagcagcagcccacgccccucgagggcccgcucugcccgccccgggacguucaccuuccccccacccccggccucacaucccuccuccgcuucucccgccuccacucacuccuccuccgcuuccagcgccaccucguaucuccucaaucgcgacauguccggggcuccgaacgguuccuguggaacagcaugauaggaacacuuauucccagucgcaaguccccuucgccaucauuuccaggacgagucugaauaguccucagguacacugaggcagguggcccccacccccggaagccaauugucacaucgggacaggaugggauggaugcuauggaaaucacuagaaguuaaagcguuaggaggaggguuaucuagggacccgaacuuggagucaccaaagagggaggucuagcggcaggggagcugggacauuuaggcccuggauggagauuuugaggggcuggagucaccugaaggggggcucaggggucggcacagccuaaacuccccgcccucccuggcuccgccccggaaacggaccguuaacaauuacaucacagggauaccuucgcauucuauggguggggcuugcguaucacccggaaggggaggaaccagg

SEQ ID NO: 1849 - RNA, 9561 nt, Mus musculus
ugggggcgggcucccggucccgcugucugcggccggcgggcaggcgacuccugucccgaguggaggcggcggagccggagccgggggagggggcagcggcugauagaaggaccgcggcggcgcccgcagcuccucaccggugagggcgcugagcgaggacucgggggucccgggaguggggcgucgagaagagagguccugguaugggggguugggacaccgugggcccauagucuccucugucguaggggugaggggccugggagcucggggucugccaggugcuggguaucugcgacaagggucggguugggucgggucggauuggguugcgccgggcggaggcguuucugagcaggccagccagccagcuggggugacaucaccgaccccccucccccgcgcgaacccccuuccuuccucucccugccgcgccuuuuguccgggccaggcucggcucugccccgccccuccccgcccaucugcgggggaggagacuccccgucagugacuucauugaguagguucuuggggauugggcuuggguccuccccagagaggcgagaggagcucacugacucucaggcccucacuaucacaccugucacagguacacacgcugccacucaacaacuacacacugucacugccagccucacugucacacagccgaacaggcgcucacaucauucagccagacacugcugcaccugagagcagguggccacuggauccucucucugcacucuacaccuggggaccggguccagcucccugggcacgauacaggccuugcugggucacggccucugggaaucugaggagguggcuuccagagcuacagcgucccaagcaggcuccgguggagcgaucagaggugaggggcuuggcugggcauguuuaagcgcacagugcuguccugcccacccccagcagcacccccacugcaggcucgaggagcuuuccggagcuucccacacuucuggggagaagacuucuuagccagcuugauguuuaaaauucagcuggagcccuuaaaacuucgagcguggacgcugaauggguuuguaaaguuucgguaagucccuccugagaagggcgcucauacccaugccaagucagauucuccacaucagccauucccugcauugccuccuuccuuccucccugucauccucaucuccccccgguaugugcaugaguccccuugaccucaccuguacuuuugaaugaauuguaccccaugucauucaucucucucucaaacucauguuuccacgaauaucuccaauauuucagcucuuagguucucccucccaacccaucaguaacgugugguccacuucagccuuuuccuuuugucaucucucaucccuguccgucagacccugucuccucccuguacuugauggucccucuugcuaucuguccucauuuuuucuuucaucccuagcucuaccuugacauacucauucuucaucaaaggcagagccaugccuuggggcuccuuugucauccuaccacguggcuuguggggagggagagggaaggaggguggaaagaaggagggaaaggaggcagguccugagaguuugcccugugucuguagaggcaagagaauuaugggucuagagcagcuagcaggugggugccggagaggaagcuggcugugguggggaagagauauugaaggacuacaaacggugggugggcugguaagcugggucacugcccucugccuggaagccgcuggaguucccugggcacccuguugcugcuguucuagguuucuuccuguccugggggagagaaagugugggcugaggcaaagauggcagaccacccaucucccucucagacugcuuuuaaugccguuuccgaaaauggcugcccuccuccagaugaucuuucuucucugccucccccaacucuaggcucccccacaggcgugacaugcugguguggggagaugggggaguacccgccuuuauagugccuucucuuugucagagugagguggcuuucaguaccaugagucaaccuagccaccugcagcaggcaggagcuaaggucacucucccugccuaucuggggcccccuuaacugucacagcccucacuccugccaggacgccuuguacacuuuacuacugugagguagucaggggcagaaaggcaggccucagcucuggcugccaggacauuguuagaaagacucugguucucccuguuuuacaaggguuggcuacaccucaaaaaggcuaaaggauggcacguggccacuccuucauauccccucccuucauauccuccucagguccacugauggaagcagguuaagaguaggaacccuggcuugauguccuugggccccacuuaggaguauuagccuagcauggagucagauccuaaaauguaaggguagguagaggaggggcuugcagcaaagggauuuaagacauggagguuaguguccauggucuccuggcaccuaggcuuuaagaaggccguuucucugaugguuuuguucacugccuuuggugcuuaggcagcgcagacaagcagucacacuucaguguguaaauacugggaaaugaguaaaggcaauguuacccuggcugggggagagagugucccccugcuaacgaggguguuagaaacagcaguuuccaaaggugugagucacucugugaucugagucacaugugaggcuuagcauagucugggggacaaggacagagagaucugggguccccgguggcagaaaagacuccaaacucccauaccccaauucagcuggcuggagacuggagccuguuccccauccuaggcuccugacccagcuguccucagcccgggcaucaugccugagguguggcguaggagagacugugaagcucaggugaccucacucagugcacugaccuucgccagcuucugugugugucugucaguccacagugccauuucgcucagaagggccucucggggguccucaggcuggccccaagggccugggccucugccuagccccaagaaguaggccacaaucuucagccagaagcugagacggaaucauggaaugguucaugucagaacgggaagacaucaucuagcccaaaacuuucauuuuacagauggggagacagaggcccagagaauaggcaugaccugcugaaggucacacagggagucauuuaaggacugcaggaucaucaggagugggccugggcuguagagaguagggcaucaaagacuggcccugggcucuuucaggaacaaggagcccagcaccgguccaguggcugugaugggaaaagauuauuacaagauucuugggaucccgucuggggccaaugaggaugagaucaagaaggccuaucggaagauggccuugaaguaccacccagacaagaacaaagagcccaacgccgaggagaaguuuaaggagauugcugaggccuacgaugugcugagugacccuaagaagcggagccuguacgaccaguauggugaggaagguaaggagacagagcaccagaccccguuugucuggagcccugggugagcccugguucucggagcagcagcagcguugagggaggcaaguucccucacuuaccuggccccgacucacucuccuccccaccacacucuucucccucccucauccccuucuggcccuagagaggccuggacacugugccagaggccucccccuccccccaccuucuucccuucccagccuuauuaguccugccugaagugcccgcugcuucauuggcugaucagaaagguuggggagagagagagagccugugacucucugaggacggcauuuacauucaucagcauaaaaagucuggccccugacuagccagccagcgaauuaacuccuagaguucugaguggaaccgguuauugccaccccccccaaccccccuuaggauggcagaggaaguggcagggguccaggaguggaaggggagauguugcuggcaucuuacccucucccuagggcagcugguggcccugcacagggagggcagcaggaaaggcccaaauaaagucccugggaggguggcuccucccagcacaucccacaggcaugaugcagcugcuaauucugggccugccccucggggcgccugccacccgccagccaugggcaccugucaggcuauauuaagagacauugucacagcugaggacucuccuuacugggaagaacuguccuuccuccuaacgacauccuccgcucuuucauuguccccuucgcuuuccccagucuacccucagaaugaaccaggcuaaaugacauguacuauuccugauuaagugcaggggcucaagagaauguucuuugugucaccucuucauguuguguccugcucaucucugccucucuccucccugugccccaucuucccgacccccccgccgacccccccgcacccccacccccgcuuuagucuccaugcugcgagcucaucccauuuuucccugauuauucccagacuugucaauucucagagagaccaggcaccugcucaaauccccagcauccucccagcuaaguugggaggaugggaaguauugggagugggaaagaaggaagcagugcgggcaccacacccccguguggccagucucagaacugcauucgcuccugcccuuagcccaaccuuugauaggaagaugggagaagcuacccagaaacuuccucccccaccucaaucgggacaaagcccaagugaaggcaacacucagacucggacccuaagccuagacacugaguucugggguagaucaagugcacugugacccagggaaaaccucugagacugaaggaaggagaaguagccuugagaagucaguuauauugccguccacccugccucuuccucaacagccagccagaaucauuguaccagaguuugugugcagcacuggcuuggcuugggacaaguuguucccugcuugaaguggggugggugguggaguaggacuccccacagugagaaucaccccccuguugucaucuagccagccuccugcucucucaccaagcucugccuagcuucuuauacuugcuucacagcugcccuucaacagggagaaagagcagacccucucccccaagucuuaagaaagggguuaagaggcagcugccacgagccccggagugccugcuacuuacauggccucucuaaugaaacccaaaucuguccuuguggccccaugaaacaaaacaaaacaaaacaaaacaaaacaucauuuaagcccagguuaccaagacaaauugaaauuuuagauaaaaggccucacaaaaagcugagaauguagccuagugcuagagcacuugucuagagcagcgcacagcccuaagucccacccccagcacuaaauaaacaagccucagugagagaggcccuuccucuagccuggaccccaccccugaaucuacaggucccagaucagucuguguuaauccacauccuuccuacagcuccaccaagcguccaccaucaaagcgccauccagaaauccaagucccucugacaagagggagcagcuggguuaucccuugcuuggugccauugacuuguggugguugcuccacaagucaaugugggauacagggcugguaugguguuacucuagggcacugguccauuauagucugugucuguacaauaugggaaugacagucccugaagcuguacaauacuagaucacaauaugcaaauaaagugacugguauuuuuuuucuagagaaaauagcuccucauuuucuuuuuuuguuuggguuuuuuuuuuguuuuauuuugguuuuuguuuguuuuuauuuuucgagacaggguuucucuguguagcccuggcuguccuggaacucacucuguagaccaggcuggccuugaacucagaaauccgccugccucugccucccaagugcugggauuaaaggcgugugccaccaugccuggcucagcuccucauuuucaugucaaugaguuuucuugauuuuugagaacucuugauuuccaguuugagcaaacuguagggagagaggaagcagaguggaauuagggcuuccuccuaaacuguauccacacuaaauucaggacaacucacugauucgccuccucuguggccaaacccuggcugucucguagagauaugggagucagguguggccaacaaaccaaccuuuaugaggcgucuuuggacugugagugggaauaguuauauaacuuaagucaugucuucuaagucucccaguccugacuuucccauguauggguuaacucagcuugacgggacucucaggaugcagcuugucuugguuugcuuuuugagacgaggucucaguauacagcccagacuagccuaaaacucucaauccuccuacucagacuuuauagaguacugagauuacagacaugcaacaccaugccauguacacauuccuaaauagauauccaauugaguagaaauuaaccucguccaaagccuuucuuauucugucagcgugguccucucuggggguuagagacugcuugcuucccucagcccaggagccagcauuuaguggcagagggaagggacugggguggggcgaggauggaccacacugccccuaacuucucguccccuuuaggccucaagaccggcggugguuccucaggugguuccgguggcuccuuucacuacaccuuucauggggacccucaugccaccuuugcuuccuucuuugguggcuccaaccccuucgauaucuucuuugccagcagccgcuccacucggcccuucaguggcuuugacccugaugacauggauguggaugaagaugaggacccauuuggugccuuuggccgcuuuggcuucaaugggcugaguagggguccaaggcgagccccagagccacuguacccccggcgcaagguacaggaccccccuguggugcacgagcugcgggugucccuggaggagaucuaccauggcuccaccaagcggaugaagaucacaaggcggcgccuuaacccugacgggcgaacugugcgcaccgaggacaaaauccugcacauugucaucaaacgaggcuggaaagaagguaccaagauuaccuuccccaaagagggcgacgccacaccugacaacaucccagccgacauugucuucgugcucaaagacaagccucaugcacacuuccgccgagauggcaccaacgugcucuacagugcccucaucagccucaaggagguguguguguguguguguguguguguucgcacguguguauguaugugcuugugugucugucuuucugucuguuagagggugauaggaaucauuuccugccugccugccauggucuuuucccguguacaucaucuuccucccucuccacucuuugccuacuuuucccucacucuguguuauuguuuuccaggcgcuguguggcugcaccgugaacauucccaccauugauggccgagugaucccuuuacccugcaaugauguuaucaagccaggcaccgugaaaagacuccguggggagggacuucccuuccccaaggugcccacucagcggggagaccucauuguugaguucaaaguucgauucccagacagauuaaccccacagacacggcagauccuuaagcagcaccuccccugcuccuaggcucugcccuggccagucuggagccuaccacagcaauacccccacacucaccccaucucacguggacccggcuggauguccacuggacacuggcacuuuucuaaaaugcaaagccacugauuuucaggagacuguuccuguucccgaccccuuucggagcugggcugcuuugggggaaugggagggcgguggggaagagcuagcccagaccaggggucaauuuucugucacgugcuuugaauccaguucccacugcaguggcuggagagagacuugagagcuacucggagcuauagauuccuuguccugccuguaaauagcaugcccuccucccucugagccuugcuaacacuuuuccucucccuucccuuuggcuuccuccuguuucuggagaaagaggauagaaaggacaccgcuucccaccccaccccgggugggucuguaguguccgaggccacugcacaaguguccgugcacacgaagcauuugccaaaauggucucugucucuccgggagacaagaaaggacaggagauaggaagggaaggcccguuaccugugaacaaggcuguucuuugagcacgagacacuuuucauuuggggcagggaagugagccaacacucaggagccuccccaacagcugcccugccugcaccgcacagaguuggaggaucugucccccucagcugcucuggggaguguucaaggguggagagaagaaaaauggggcugaaccaucccagcuaagagguggggcaggacccauuucccagccagcaucaggaaggaaaagggcuuuggggucagguggcagcuguuccccaccaagagauucaggaucacagguuuccccccauaucucugaacucagggccuagccaccccaaacuuccaagccccacuuuugugauaugugaagcugcuucuuucuuacuuggaggcuguguuggaagcguccagccccucucugccugugugacccccaccccaccccaccccacucccacaguuguauagaagucgaauagugaaggagcugggagaaaacugcuucagcuggucuuggggugggguucuuagguuuucucacuuugacaagccccugaauguuuuuauaguaguuuuuuguauuuuuuuguaaugacaguauuaugaaaaaaauaaaguauuuuaaaaauauagccucugcgcagaagcaguaacccuggugcaggcaggaacacagagccacugucagccuccuuccaggguccugggcaccccaggaaagccggucaaccuuagcauaugcugaggcucaacucuucuuccuauaagcucugaccucuuggaauuccagaacauauaccccaaacgacaacgcuagaagccacagcccagcugccuaugaaaaagacacccucgauugugagaaagagggcccagccccuucagaagcugucaacacgagagcuaacacacuugucuaaauguucucuuugaauuagagacacuguuccuugcaggacguggagggcuuucucacugaugagaauaggcacacucccaaaaauagagccuggcuaccaagugcgcuggagacggcucagcaguuaagagcacugacugcucuuacagagaagccaaguucaguucccaggacacaucaggcggcucacaacugcucacggggaucuaacaaguccagccucgucaggaaccugcacucaugcacacacacuuauaaauaauaaaaaaaaaugaauuuuuuuaaaguuugggcacaaagaagauagauagaauaaagauagauagauacaggugaaagguccuggcuggggaccugggcuccaugauggacauuaaacacaguuccugcuccuugaaccauaccau

SEQ ID NO: 1850 - RNA, 9561 nt, Mus musculus
augguaugguucaaggagcaggaacuguguuuaauguccaucauggagcccagguccccagccaggaccuuucaccuguaucuaucuaucuuuauucuaucuaucuucuuugugcccaaacuuuaaaaaaauucauuuuuuuuuauuauuuauaagugugugugcaugagugcagguuccugacgaggcuggacuuguuagauccccgugagcaguugugagccgccugauguguccugggaacugaacuuggcuucucuguaagagcagucagugcucuuaacugcugagccgucuccagcgcacuugguagccaggcucuauuuuugggagugugccuauucucaucagugagaaagcccuccacguccugcaaggaacagugucucuaauucaaagagaacauuuagacaaguguguuagcucucguguugacagcuucugaaggggcugggcccucuuucucacaaucgagggugucuuuuucauaggcagcugggcuguggcuucuagcguugucguuugggguauauguucuggaauuccaagaggucagagcuuauaggaagaagaguugagccucagcauaugcuaagguugaccggcuuuccuggggugcccaggacccuggaaggaggcugacaguggcucuguguuccugccugcaccaggguuacugcuucugcgcagaggcuauauuuuuaaaauacuuuauuuuuuucauaauacugucauuacaaaaaaauacaaaaaacuacuauaaaaacauucaggggcuugucaaagugagaaaaccuaagaaccccaccccaagaccagcugaagcaguuuucucccagcuccuucacuauucgacuucuauacaacugugggaguggggugggguggggugggggucacacaggcagagaggggcuggacgcuuccaacacagccuccaaguaagaaagaagcagcuucacauaucacaaaaguggggcuuggaaguuugggguggcuaggcccugaguucagagauauggggggaaaccugugauccugaaucucuugguggggaacagcugccaccugaccccaaagcccuuuuccuuccugaugcuggcugggaaauggguccugccccaccucuuagcugggaugguucagccccauuuuucuucucuccacccuugaacacuccccagagcagcugagggggacagauccuccaacucugugcggugcaggcagggcagcuguuggggaggcuccugaguguuggcucacuucccugccccaaaugaaaagugucucgugcucaaagaacagccuuguucacagguaacgggccuucccuuccuaucuccuguccuuucuugucucccggagagacagagaccauuuuggcaaaugcuucgugugcacggacacuugugcaguggccucggacacuacagacccacccgggguggggugggaagcgguguccuuucuauccucuuucuccagaaacaggaggaagccaaagggaagggagaggaaaaguguuagcaaggcucagagggaggagggcaugcuauuuacaggcaggacaaggaaucuauagcuccgaguagcucucaagucucucuccagccacugcagugggaacuggauucaaagcacgugacagaaaauugaccccuggucugggcuagcucuuccccaccgcccucccauucccccaaagcagcccagcuccgaaaggggucgggaacaggaacagucuccugaaaaucaguggcuuugcauuuuagaaaagugccaguguccaguggacauccagccggguccacgugagauggggugaguguggggguauugcugugguaggcuccagacuggccagggcagagccuaggagcaggggaggugcugcuuaaggaucugccgugucugugggguuaaucugucugggaaucgaacuuugaacucaacaaugaggucuccccgcugagugggcaccuuggggaagggaagucccuccccacggagucuuuucacggugccuggcuugauaacaucauugcaggguaaagggaucacucggccaucaauggugggaauguucacggugcagccacacagcgccuggaaaacaauaacacagagugagggaaaaguaggcaaagaguggagagggaggaagaugauguacacgggaaaagaccauggcaggcaggcaggaaaugauuccuaucacccucuaacagacagaaagacagacacacaagcacauacauacacacgugcgaacacacacacacacacacacacacaccuccuugaggcugaugagggcacuguagagcacguuggugccaucucggcggaagugugcaugaggcuugucuuugagcacgaagacaaugucggcugggauguugucagguguggcgucgcccucuuuggggaagguaaucuugguaccuucuuuccagccucguuugaugacaaugugcaggauuuuguccucggugcgcacaguucgcccgucaggguuaaggcgccgccuugugaucuucauccgcuugguggagccaugguagaucuccuccagggacacccgcagcucgugcaccacagggggguccuguaccuugcgccggggguacaguggcucuggggcucgccuuggaccccuacucagcccauugaagccaaagcggccaaaggcaccaaauggguccucaucuucauccacauccaugucaucagggucaaagccacugaagggccgaguggagcggcugcuggcaaagaagauaucgaagggguuggagccaccaaagaaggaagcaaagguggcaugaggguccccaugaaagguguagugaaaggagccaccggaaccaccugaggaaccaccgccggucuugaggccuaaaggggacgagaaguuaggggcagugugguccauccucgccccaccccagucccuucccucugccacuaaaugcuggcuccugggcugagggaagcaagcagucucuaacccccagagaggaccacgcugacagaauaagaaaggcuuuggacgagguuaauuucuacucaauuggauaucuauuuaggaauguguacauggcaugguguugcaugucuguaaucucaguacucuauaaagucugaguaggaggauugagaguuuuaggcuagucugggcuguauacugagaccucgucucaaaaagcaaaccaagacaagcugcauccugagagucccgucaagcugaguuaacccauacaugggaaagucaggacugggagacuuagaagacaugacuuaaguuauauaacuauucccacucacaguccaaagacgccucauaaagguugguuuguuggccacaccugacucccauaucucuacgagacagccaggguuuggccacagaggaggcgaaucagugaguuguccugaauuuaguguggauacaguuuaggaggaagcccuaauuccacucugcuuccucucucccuacaguuugcucaaacuggaaaucaagaguucucaaaaaucaagaaaacucauugacaugaaaaugaggagcugagccaggcaugguggcacacgccuuuaaucccagcacuugggaggcagaggcaggcggauuucugaguucaaggccagccuggucuacagagugaguuccaggacagccagggcuacacagagaaacccugucucgaaaaauaaaaacaaacaaaaaccaaaauaaaacaaaaaaaaaacccaaacaaaaaaagaaaaugaggagcuauuuucucuagaaaaaaaauaccagucacuuuauuugcauauugugaucuaguauuguacagcuucagggacugucauucccauauuguacagacacagacuauaauggaccagugcccuagaguaacaccauaccagcccuguaucccacauugacuuguggagcaaccaccacaagucaauggcaccaagcaagggauaacccagcugcucccucuugucagagggacuuggauuucuggauggcgcuuugaugguggacgcuugguggagcuguaggaaggauguggauuaacacagacugaucugggaccuguagauucaggggugggguccaggcuagaggaagggccucucucacugaggcuuguuuauuuagugcugggggugggacuuagggcugugcgcugcucuagacaagugcucuagcacuaggcuacauucucagcuuuuugugaggccuuuuaucuaaaauuucaauuugucuugguaaccugggcuuaaaugauguuuuguuuuguuuuguuuuguuuuguuucauggggccacaaggacagauuuggguuucauuagagaggccauguaaguagcaggcacuccggggcucguggcagcugccucuuaaccccuuucuuaagacuugggggagagggucugcucuuucucccuguugaagggcagcugugaagcaaguauaagaagcuaggcagagcuuggugagagagcaggaggcuggcuagaugacaacaggggggugauucucacuguggggaguccuacuccaccacccaccccacuucaagcagggaacaacuugucccaagccaagccagugcugcacacaaacucugguacaaugauucuggcuggcuguugaggaagaggcaggguggacggcaauauaacugacuucucaaggcuacuucuccuuccuucagucucagagguuuucccugggucacagugcacuugaucuaccccagaacucagugucuaggcuuaggguccgagucugaguguugccuucacuugggcuuugucccgauugaggugggggaggaaguuucuggguagcuucucccaucuuccuaucaaagguugggcuaagggcaggagcgaaugcaguucugagacuggccacacggggguguggugcccgcacugcuuccuucuuucccacucccaauacuucccauccucccaacuuagcugggaggaugcuggggauuugagcaggugccuggucucucugagaauugacaagucugggaauaaucagggaaaaaugggaugagcucgcagcauggagacuaaagcgggggugggggugcgggggggucggcgggggggucgggaagauggggcacagggaggagagaggcagagaugagcaggacacaacaugaagaggugacacaaagaacauucucuugagccccugcacuuaaucaggaauaguacaugucauuuagccugguucauucugaggguagacuggggaaagcgaaggggacaaugaaagagcggaggaugucguuaggaggaaggacaguucuucccaguaaggagaguccucagcugugacaaugucucuuaauauagccugacaggugcccauggcuggcggguggcaggcgccccgaggggcaggcccagaauuagcagcugcaucaugccugugggaugugcugggaggagccacccucccagggacuuuauuugggccuuuccugcugcccucccugugcagggccaccagcugcccuagggagaggguaagaugccagcaacaucuccccuuccacuccuggaccccugccacuuccucugccauccuaagggggguugggggggguggcaauaaccgguuccacucagaacucuaggaguuaauucgcuggcuggcuagucaggggccagacuuuuuaugcugaugaauguaaaugccguccucagagagucacaggcucucucucucuccccaaccuuucugaucagccaaugaagcagcgggcacuucaggcaggacuaauaaggcugggaagggaagaagguggggggagggggaggccucuggcacaguguccaggccucucuagggccagaaggggaugagggagggagaagagugugguggggaggagagugagucggggccagguaagugagggaacuugccucccucaacgcugcugcugcuccgagaaccagggcucacccagggcuccagacaaacggggucuggugcucugucuccuuaccuuccucaccauacuggucguacaggcuccgcuucuuagggucacucagcacaucguaggccucagcaaucuccuuaaacuucuccucggcguugggcucuuuguucuugucugggugguacuucaaggccaucuuccgauaggccuucuugaucucauccucauuggccccagacgggaucccaagaaucuuguaauaaucuuuucccaucacagccacuggaccggugcugggcuccuuguuccugaaagagcccagggccagucuuugaugcccuacucucuacagcccaggcccacuccugaugauccugcaguccuuaaaugacucccugugugaccuucagcaggucaugccuauucucugggccucugucuccccaucuguaaaaugaaaguuuugggcuagaugaugucuucccguucugacaugaaccauuccaugauuccgucucagcuucuggcugaagauuguggccuacuucuuggggcuaggcagaggcccaggcccuuggggccagccugaggacccccgagaggcccuucugagcgaaauggcacuguggacugacagacacacacagaagcuggcgaaggucagugcacugagugaggucaccugagcuucacagucucuccuacgccacaccucaggcaugaugcccgggcugaggacagcugggucaggagccuaggauggggaacaggcuccagucuccagccagcugaauugggguaugggaguuuggagucuuuucugccaccggggaccccagaucucucuguccuugucccccagacuaugcuaagccucacaugugacucagaucacagagugacucacaccuuuggaaacugcuguuucuaacacccucguuagcagggggacacucucucccccagccaggguaacauugccuuuacucauuucccaguauuuacacacugaagugugacugcuugucugcgcugccuaagcaccaaaggcagugaacaaaaccaucagagaaacggccuucuuaaagccuaggugccaggagaccauggacacuaaccuccaugucuuaaaucccuuugcugcaagccccuccucuaccuacccuuacauuuuaggaucugacuccaugcuaggcuaauacuccuaaguggggcccaaggacaucaagccaggguuccuacucuuaaccugcuuccaucaguggaccugaggaggauaugaagggaggggauaugaaggaguggccacgugccauccuuuagccuuuuugagguguagccaacccuuguaaaacagggagaaccagagucuuucuaacaauguccuggcagccagagcugaggccugccuuucugccccugacuaccucacaguaguaaaguguacaaggcguccuggcaggagugagggcugugacaguuaagggggccccagauaggcagggagagugaccuuagcuccugccugcugcagguggcuagguugacucaugguacugaaagccaccucacucugacaaagagaaggcacuauaaaggcggguacucccccaucuccccacaccagcaugucacgccugugggggagccuagaguugggggaggcagagaagaaagaucaucuggaggagggcagccauuuucggaaacggcauuaaaagcagucugagagggagauggguggucugccaucuuugccucagcccacacuuucucucccccaggacaggaagaaaccuagaacagcagcaacagggugcccagggaacuccagcggcuuccaggcagagggcagugacccagcuuaccagcccacccaccguuuguaguccuucaauaucucuuccccaccacagccagcuuccucuccggcacccaccugcuagcugcucuagacccauaauucucuugccucuacagacacagggcaaacucucaggaccugccuccuuucccuccuucuuuccacccuccuucccucucccuccccacaagccacgugguaggaugacaaaggagccccaaggcauggcucugccuuugaugaagaaugaguaugucaagguagagcuagggaugaaagaaaaaaugaggacagauagcaagagggaccaucaaguacagggaggagacagggucugacggacagggaugagagaugacaaaaggaaaaggcugaaguggaccacacguuacugauggguugggagggagaaccuaagagcugaaauauuggagauauucguggaaacaugaguuugagagagagaugaaugacaugggguacaauucauucaaaaguacaggugaggucaaggggacucaugcacauaccggggggagaugaggaugacagggaggaaggaaggaggcaaugcagggaauggcugauguggagaaucugacuuggcauggguaugagcgcccuucucaggagggacuuaccgaaacuuuacaaacccauucagcguccacgcucgaaguuuuaagggcuccagcugaauuuuaaacaucaagcuggcuaagaagucuucuccccagaagugugggaagcuccggaaagcuccucgagccugcagugggggugcugcugggggugggcaggacagcacugugcgcuuaaacaugcccagccaagccccucaccucugaucgcuccaccggagccugcuugggacgcuguagcucuggaagccaccuccucagauucccagaggccgugacccagcaaggccuguaucgugcccagggagcuggacccgguccccagguguagagugcagagagaggauccaguggccaccugcucucaggugcagcagugucuggcugaaugaugugagcgccuguucggcugugugacagugaggcuggcagugacaguguguaguuguugaguggcagcguguguaccugugacaggugugauagugagggccugagagucagugagcuccucucgccucucuggggaggacccaagcccaauccccaagaaccuacucaaugaagucacugacggggagucuccucccccgcagaugggcggggaggggcggggcagagccgagccuggcccggacaaaaggcgcggcagggagaggaaggaaggggguucgcgcgggggaggggggucggugaugucaccccagcuggcuggcuggccugcucagaaacgccuccgcccggcgcaacccaauccgacccgacccaacccgacccuugucgcagauacccagcaccuggcagaccccgagcucccaggccccucaccccuacgacagaggagacuaugggcccacggugucccaaccccccauaccaggaccucucuucucgacgccccacucccgggacccccgaguccucgcucagcgcccucaccggugaggagcugcgggcgccgccgcgguccuucuaucagccgcugcccccucccccggcuccggcuccgccgccuccacucgggacaggagucgccugcccgccggccgcagacagcgggaccgggagcccgccccca

SEQ ID NO: 1851 - RNA, 9257 nt, Mus musculus
gggagggaagucucagcagugagaacuugaagcauggggcugggaagauggcucagugauuaagagcauguacugcucuugcugaagaccaaaguuuaguucccagcacucagaccuuguguugaaaaacaaccaaaaauggacagugagucuggagagagggcugaguggcuaaaagcaauugcagcacaaagugcauuguacaaacauacauauaauaaaaugcucgguggucccugggcuuuucuucuuucaugcuucuguacacacccagucaucaucccccucucuuagaccuugcccucauuuaugaauuacugaaccuccuaucaaaguuuucagccccacguuucuugucgaacuucccugcuggugccggcaggcggcgacaaaucuccugguagggcgcucugucaggcuugcacaccucuguggugccagacagcgagcccugccgcugcacuuccgggcgcggauccaggugagccaaggucucccuguuaccucuguuacugucaccccuaggacgggugucucagcuuacugccggggugcccaguaucagagggagcauguccagguguuggccggguucccaccggaggagacagagcugccgggacuucuggaucccagcuuagcucaaugggcuuuauaccgggcuuccuggggacgucguuccuucgguuuuuucuugagccuggccgcccggaagcggagcaagacuccuccccgucguuuccucgguucccgccaggcggcgccguuuacucaauccaguuaauccgugugguuucugucuauugccacccuggaaauguugaguuaguccgaagagagccauugaaauggacugucagagaacaaucuaccuaccauuuggaauagucuuccuccuagacugugguuugacagcauuagaucucccgguuggauaugcacaggcucccgugcucacccccagaaccugaaucgguagguguagccugggcgucagguugagauccaaggucucagccucucaccgucagaugguaugacugguagaaacagcugcaacgaguuagcuaugguuuguuuacguccugaaguuuauagcaguacgugauuguuguugggcauuguuuugagagccaaaacguccaugguuucuucgcaccccaaugaacauucucuucucucccaggaugcggaaggugucugugcuccucuucuuagccugggucuguuuucuuuucuacgcuggcauugcacucuucaccaguggcuuccuucucacucgucuggagcucaccaaucaaagcagcugccaagagcucccaggcccuggucccuugccguggggaagucauggaaagccuggggcuugcuggaugccuucccgcuucuccagggugguuuugguacugauagacgcucugcgguuugacuuugcccagccucagcgcucgcaugugccuggggaaccuccugucuccgugccuuuucugggaaaauuagguuccuugcagaggauccuagagagucaaccccaccauggccggcuguaccgaucucagguggacccccccacgaccaccaugcagcgucuaaaggcucucaccacuggcucgcugccgacuuucauugaugcuggcaguaacuuugccagccaugcuauaguggaagauaaugucauccaacagcucaacagugcaggucaguaugugccucuggggacuauagaagcuggggagccaggacuucagguacccagccguauauuuggcuaugguguagggaaacagagaguagaaauagaugggaucuuguguguagaaaggcccagagauuuuuguccucaaugaagcuucuaaucugcacaaaauguuuguuuguaacucgugggagcauccgauuaaggaagaaaugaagauaggaauuugcaaggauggagaaaaaaggguagagggauccaaguuauguucacucacugcuuaugaagagagcaggucaagggcacugcauugcgcaugugucuuuaaucccagcacucaagaggcagaggcaagaggaucucugaguuccagaugagccuggucuguagaguaagaccugucucaaaacaggaugugugguugggauaguacucucaagagugugcucgugcgugcgcacgcacacacacacacacagcguauggaugugacaugguacacuuauggaggugagaagacaacuuuggaaguugauuuucuccuucuacccuguggguucugaguauugaacucaagugguccggauugguggcaagcucuuugacucacugagcugucuccccuugcccuuuguguuuuguuuguuuguuuguuuguuuuuuucuagagucuucucuuauaaucuccccuguucuggcucucacaugaacaagauacgaucgauccgauuccccucuugucucuacaggaaggcguguagucuucaugggagaugauaccuggagagaccucuuccccggagccuuuucucaagcuuucuucuucucauccuucaaugucagagaccugcacacaguggauaacggcaucuuggaacaccucuauccuacccgugaguaagaagcgcucagucccucacugaccccaggagcuguggaggguuccuuuagucugcagacucuggguccagcagccuggggcuuauaccacugggugcagaggaacaucaaagccugauggagggaggcgugggcuucaccgcccugugcucaguguucuccccuccacaguggacggcgguucgugggaugugcugaucgcucacuuccuggguguggaucacuguggucacaagcacggcccucaccacccugaaauggccaagaaacuuagccagauggaccaggugauacagugaguguggggugcuggcugagggaggggguugcauuugagaaucucaggauguaggauuccacgagggaaaaaaaauccuguguggagccuggaugaauucuauauauguauguauuuugagacaggguuucauuauguagcuuuggcugaccaggaacuugcaauauaagccagaccaggcuggacucaaacucacaaagauuuguuuucuuguucuuuuugagacagguuuuguguguguguguguguguguguguguguguguguagcccuggcuauccuagaacucacuuuguagaccaggcugcccucgaacucagagauccaccugccucugacucccgagugcuggaauuaagggcuugugccuccacugcccggcagcucuggaauacuuuauacaaguuuuuccuucaaaacguagagacaucauccacuuugaacaacuugguguguagcucuggcugcagaguugugacugaagaggugucuuuuugacagaaguuuagacccuggcaauggaagugaguggugggggugaauggcccgagaagaaucuuuaccucucccugcccucucacacguguucuugacccccaggggacucauagaacgccuggagaaugacacacugcuggugguagccggugaccaugggaugaccaugaauggggaccauggaggggacagugagcuggaggugucagcugcacuuuuccuguacagccccacagcucucuucccuagugucccacccgagguaaggccugggucgcaccucugcuggucucccuacauugugauccccuuauuguaggcuccccacaccaggaucugguccuaacagucauuuauuuuuauuuauguguguaugauguauguaggagguaauugcacgugugcgugcugguaugcacuugugugugcgugugaggcagaggaugucgguguuugcuccuaauuuuacugaaacagugccucucacugaacccggagcuagccugaagaccagaaagccuccugccucugcccaccauggcacuaaguuauaggcacgcauggucacagccugcuuugacuaucucacccacggaaccaucacuccggacacccccucccacuauucuuaccuaggccuggcgacgccguugacacuugaacuucccuuccaggagccggagguuauuccucaggucagccuugugcccacgcuggcacugcugcuaggccugcccaucccguuugggaacacuggggaagugauggcagagcuauucucagguggcagugacuccucccauccucacuccucugcgcuagcccaagucucggcucuccacaucaaugcccagcagguaggugagaggacuagacuucuggguaacgaagcgaagcaugaggacaaaaucgacccuauugccuuuguucuuguccaaaugccuuucuccuauuagccuucccuucccccaucuuggauagaauuugagccccagguuucuagauaccucucucguguaacaucuccgcggcccccccccuccccccguuuguaucucuggccuucucugucaggugucccgguuucuucauaccuacucggcugcgacucaggaucuccaaguuaaagaacuucaucggcugcagacgcucuucuccaaggccucugcgcguuaccagcacuuucugcgggauccccaagaggcugaggcagcgcugagcacauugacugcugaguuccagcaguuccugcggggagcucgggcccugugcaucgagucuugggcccgcuucucucugguccgaauggcagggggcgcugcucuuuuggcugcugccugccuucucugccugcuugcuucccaguuggcagucgccccaggcuuucucuuccgcccacuacugcuaauaccuguagccuggggccuaacuuggaccauccuguaugcuggagucucgguaacuacugggucgaagauagacuuagugguucugggggcuguggcugcagccgguucacuccucccuuuucuguggaaagcuuggguuagcagggggucuaagaggccacuggcuccccuacuuccugucccuagaccuguccuaauauuacugcucauucgcuuggccaccuucuucucggauagcuuuguuguugcugaggccagggccacccccuuccuucugggcucucucguuuucuuccugguugcucagcuccacugggagggucagcuacugccacccaaaccacucacgaugucccgccuuggcucuucugccccaacagcgcccccacggcacaguggcgcgcaugcccuguggcuuggaauuggguugcuuuuauuuacaaggcucgcugggcuuuuucaccgcugcccggaagagacaccugccugucgcuccucucccuggcugaguccucuggcaucuauggugggaggucgagccaagaauuugugguacggagcuugcgugggggcacugguggcccuguuagucgucgugcgcuuguggcuucgccgcuaugguaaucucaagaguccugagcccccugugcucuuugugcgcugggggaugccucucaugguacugggcacggcugccuacugggcacuggcaucaggugcagaggaagcaccaccacgccuccgggcccuggucgccggggcaucagcugugcugccucgggcugugauggggcuggcugccuuggggcucgugcugcugcucuggaggccugugacagugcuggugaaagcuggggcugcuacuucaaggaccaggacuauccucacucccuucucaggucccccuacuucucaggcugaccucgacuauguagucccacaaaucuaccgccacaugcaggaggaguuccagggccggcucgagaggacuaaagcucagggucccauaaccguggcugccuaucaguugggaagcguguacucggcugcuauggucacggcccuccuccucuuggccuucccacuuaugcuguugcauguagagcgggucagccugguguuccugcuccuguuucugcagagcuuccuucuccugcaucugcuggccgcugggacaccagucgccaccccugguaaaugcagaccugagcccugaggcaucuggucuuugggagugguuucucacccuuaucugccuucaccaugccaguccccccccccccccccccaggaggacuucgggacugauuucuuagagaaacgcacucucuccuggagcgcguuccuggcugguuucaguuacaaaagugauacauugugaacguguuaucacagagugagcuauuugugagaaagagauugagcgcugguuuugugcuaugauuuauaguagcgaggagauuagaacagcaguacuggcuguagggaaguuugggguagcacgugaccgcguacaaacuuccgugcugggguggaugguccuggcaccgaggcugucgguuggggggugggauggaauuguaaagaugucugucuuuucuuccaggcccuuuuacugugcuguggcaggcagucucagcuuggguccuucuggcuacccagaccuucuacuccacaggccaccagccugucuuuucagccauccauuggcacgcagccuuugugggcuucccagacggccauggcucuucuaccugguugccugccuuacuagugggagcuaacaccuuugccucccaccuccucuucgcagguaccucugugcuuucccuccccgacuucuguucacuccugcuuugugggaagaaaagagaguguuggcugggggcgugggggugggggaucuuugaagcuccguggccccaagcucuuugcagccuaagccaccuagggugcuuggggaaccaggguggacuuggcccaaagauccucccuugaugucagcccuauccucccggaggcaguaggcugcccacugcuccugcucuggcccuuccugugugagcgucaagggccaaagagaaggcagccccucccgggaagugagucugaagccagaguccggccugaggaagaggaggagcugcaggagccacugauggagaugcgccuccgggaugcuccgaaucacuucaaugcagcccuguugcagcugggccucaaguaccucuuuauccuuggagcucaggugggugcaggggagagacagcagagccggugaccuuuccccgagcgugcgcuauacacuuuuucuuucuugguuuccaauacuuuguggauccuugauggagguucaggcaaaugaagcgauugcucaaauugagagcucaaauggcagauuugagaccuggccugaguuuucuucuucuucuuuuuuucuuuuuuuucuuuuuuucuucuuuucuuuuuucuuuuuggguuuuugagacagaguuuaucugugcagcccuggcuguccuggaacucacucuguagaccaggcuggccucgaacucagaaauccaccugccucugccucccaagugcugggauuaaaggcgugcgccaccacgccggcucagaguuuucucauuccacuccuagaucauuucuauucuguaguguagcucugggcucuggcauuacagacacuggaaaagcugacauuauuauggcugggauuccuuucuaaacugugguccagaggcagaaaguauauuacugggcucagcaguuaagagaacugacugcucuuccagaaguccugaguucaaaucccagcaaccacauggugacucaaaacuaucuguaaugggauccauuaacuucuucugcuguguucugaguucgaggccagccuggucuacagagugaguucuaggacagccagggcuacacagagagauccugucucaaaaaacaaaacaaacaaacaaagucuucagaaagaaagaaaguguauuacugacauuagagggcagagucugaaugucaacauuacagaugguuggugaccugcccgccuucacaugagucagggccuggaccgggacaagcacucaguuuccugacuccugugccaggcuuuuuccaguggcaaacauugcucaucucuuccuccucuucgcucuugccaggcucuguagcaauuccuccuugccuugcuuccuccagaguaacuaccccuccucucuccccucagauucuagcuugugccuuggcagcuuccauccuccgcaggcaccucauggucuggaagguguuugcucccaaguaagugguuucccgugagagggaacucuucgugcccuagguugaugaugguuggccucuuuagagaaccuauugucuauguccugaaauacuccaccauucuccacagguucauuuuugaagccguagguuucaucgugagcagugugggacuucuccugggcauagcauuggugaugcgaguggaugucgcugugaguuccugguucaaaaaacuaguucuggcccagcagagguagcccaggcugugcucguuggcgucuggccauggagagagcuggggacuaauccggccugaccuguacuggugcuggauucugcaagagacuccgacacaccucuugagccacccuguaaccagagacugcucaacucugggacuuuauuauuuuauaacugagaaucaucuggagcccgagcccgagcccgagccuucccuccuggguuggauacaucugacggacaacaggggcggcuaccaaaguggaauaaaagaacaaugugaauguuuuauguagcuaagaucugugaggugcucgccaagucaggcucagcaagcaugaggagaugcgucaugucaggcagggcuugcugugccagacaacacuuuggcaagagguugucuggauucacugaccucugcccaaauuguucuaguuaucccauuugucucgcccuccaccuuguuuguguuuggcuauucugugcuuuaacugauugcagggaagacaagcccagcaucaugaagcacacagacauguuucuaacacacaguuugaagcacuauguuucuuccccugguacccucucuguucacaacugcagaagccucucucuagguuuucagccugggcuaccuucauugcauuguuuugcuuuuuuuuuuuuuuuuuuuuuuuuuugguuuuuuccagacagggcuucucuguguagcccuggcuguccuggaacucacuuuguagaccagguuggccucgaacucagaaauccaccugccucugccucccaagugcugggauuaaagacgugcgccaccacugcccggccucuuuauuuugaaaauaaucuuacuauguaagcucuagcugguuuggaacucaguauguaaacaaagccggcuuugaacucacagagauccaccugc

SEQ ID NO: 1852 - RNA, 3776 nt, Mus musculus
cugcuuuuguaaacccuaguuuauuaauagcuuaauagucuacacccucugcccuuuaagaccgccauaccauaagggcaagcuguccuuucccguguguccccaagccccugcaccacugugcagcuggcaguucagcagaccaugccucaauccccguacagccgagguuucucuugacgacaggaugacuucacuucacaugaagugaauccuugucacgcguggagaaucaacuccucacaccgaccuggacugaaggguggaaguggacggccaaagacgacccgaguggcuuuccuaacuucaucccccaaucaaugaggacaguuucccauuugccacuggucacuuuauuacaugauuaguaaguucaaauaaaaaaauaaaaacuaaaauuuggccgggaggcuggaaccagaaucuuuuuugagagcagcucccggccccuagacucccuggccgagucaucucuacuaacugagcuugacucuacccaguucuucaauacucgugucuguagccuggacaucucuucugcucuggcuggaguucugggcuccgggcacuggggcuuuggugagagccccauagacacccauggccuaaagagaaagaccagagagaaagagccguuaagaaccauuugaagcuuugucccaaaacacaaaggggccggucaacucuugguuuuucuuucuuuuucccuuccuucuuuucuuuuuugagacacaguuucucuguguaguccuagcuguccuagaacucacucuguagaccaggguggccuugaacucacaaaacucugcuugccuguggacuaaagcuaugugccaccaacaccuggcuuuaguuuuuccuuuuucuuuaucaucuuucuccuauuuuucuuucuucuucuuccuuccuucuuccuuuucuucuucucuucuucucccuccuccuccucuuuuuuuuguugagacaaguuugcauuguguagccugacuagcuucuaacugugaacuuccuacaucuccuccugaguguugguauuacaggauugcacugucacacccagccccuugguuuuucuuauccuucaagccucaguuuucugagccuugcaaacaauucuaagucucuuacaucaaaccaucaaagcagggcggcucccaacacugacacaggaaucugcaggaguuaguggaaaccuucauucuuagcuccugacacuguuauuguaugcuuaucuucaaagagcucuaaccugagccaccauacucgugacgucgcugggauuggagggcaguagcacuguguuggaauccuuggccaguuuggagaaugcgcugacauacugcucagccacagugagcgaagcugcugcaucuccauucuguagccacagugcauaaaaaucagaggucagagauuuggggagaaaagagaaagguuacguuccuggaaaaggggcuauacaaauccuaacacaaagcucacauaaucuggcuuaauggagccacgcugucaggaacuccccauaaggauagaagagaaaagcccuucuacugucuauucccaccccacccacacccaucagccucucacauguugagucagagccccagccagaauucgaaucgcuucggcuuuagccuuggccuuggccagaacugcacuggcuucuccuaaaagaaaaaacaaaaaaaccaaacacaguaguuugacccaugcaauuagagaagcccaaagccucugucccagccguuaucuuuaaagcccugggcccugcuccucccucugccucucacccacugcucaccugccgccugauuuaucuguucagccuuuucugcuucggaggccagaaucugggccuguuucuuccccucugccacauuaauagcugacucucgugucccuucggacucuagaacuguggcccgcuuccggcgcucugccucuaccugaaagccccaaugacccccaucaaaaagaaggcaggagaaucucuaaccaggacuuacauacaacucuaucucccacaauaggggauucuagucccaguggaacuggaguaacccaaucuguuucccuaccugcaucugcauagacucuuucacucgagguggcacauggauguccuugaucucguaucgcaggcaucggauaccccagcagucugcagccugguugauggcauccacaauguuggcauucagggacucacgcuccuagaugaacagaacuugugagcagcacaagucagugucucuaucaaaagccuaaacugggaaggccccuggcuaaccuugcuccccaggaaagagucaacaguuuaugcacuuaagcccuuacuccagcccagauccgcuuacccgaaaaacuuuguccagagagaguuugccaagcucugaucucauagucgucugagcuaacugggugacagcauacucugggucuuccacaccguaacuugccugaaagggcagguauaggaucagaacugaagaugcaggauuuuaaggaagaggcaguucagaaaacuagauaaacccagggcagauaccuuguaaggauccaugaugcgcagauaaaggacuccaucuauuuguaguguuacauugucugcaggagcaaacagaagagaaaaaaacugucggucagaccucuaagucccaaccagcucuuucuccuaagcccuggaucuauagcaaccacauccuagcgcacuuagcacaucccugucaccccaucgcucucaccaagaguuacggcugacugcucaggcacguugauaacaauuuccuugagacucugcacauaccggauucggucuaacacggggaucaggacguucaggcccugagaagaggagccauagauucucagaagggugaggcuaguaaacuugaacucuaagcuaagucuggaguaaguaguaagucacguauaaacauagagaagcaaucccuccuaucauggccucaaaggcuggggugucacugguagggaaaccuaagaguacaaaaagauaagacuaggcuuaugaaugucaagaauggaagccagcaagagcugcugccuuuagaguaugguagcuccaggaaugaagccuaugggucacuaggguauuaggaaagcggggaaacacggaggugguguucaggagacugggcucugcuagaacugguccucgcagguuagaagugcagacaggccccgacggaagucccacuuccacacgaguaaacgaucagacgaucuggcuggcugagggcgggcaagagagguucucaccgguuccaggauccgguggaaucggcccauucgcuccaccacccaggccuccugcugaggcacaaacaggaucacgguguuucggggcaguccagaggaggcgcggcgcggaacgcggccagaagccugcaccgagcccugaaggaagacgagaguaggcuggggaccaggcgcggaucccuaaaucccucucccuagaucucgacaccccccccaaggguccccggagagugauucacguggggaccaugaccugugaccacaguccuucccccaaaguuagaagcccacuccuucccagcucaagacccaggugaugucggucccgagccucuggugaagguugccucgcucucacccucagcaaaagggcuccagugccccgcgccgcgcgcgccagcauuucccacagccucggcgaccuccggaaccaacgagagguggggcagagcggccucuugugaagccugaacccgagcccuuccuucagcugg

SEQ ID NO: 1853 - RNA, 14253 nt, Mus musculus
uggccggggugggaccucagacgaccugcagccaucacuuugucuccuccgucaucugcuggggccgccggcgccaaucacagccagccgaccggggccaaggagcgugugcgcccuggugaggcaggcgggagaaggggcgggggauaaaagucacugcguuuggaggggacaguguucuugugaaaggaaccuggaaaggguuccggcaggcuggaaucuuagggggugggucccgcugaaaggcggagagaccaaaagggggcgggaaacagggguugggucucgggaaagcagaggauccugggguaaugcaaagaagacgaaaggggcggagucacggggcguggucagggcuaccgaggcggagucugagggauuaaagaaccagggcaaggggaccagccccgggaaggugggaacugggacaagggagagggugggccggggcguugcggaggcggggcucugacccaaggggagagguuugcaggcccaggcugcaaggagggcugcucagucacuaucccaauccacuaccuucucaagugcaacaggacccacggaacuacagguguggggcggggugcgugugaaaaaagagacgaggccgaaggugggcuugggcagaccugaaguagggaccaccgcuagcgaagaaaagaauuuggagauuguugcuuuggagugggugaggcgggauugggggagcaguugggggcucagugugugagcaaagagguguacucuaggggccguugugggggaagggcgggagugcuuugugaaagugggagguacacuguuaaggacaaggaucacugucugcauguggaggauuacaggugauacuugagcgauuugaaggaacuucgggagaauggggguauaugugguggagaagggcuggcauuaccccguaugggagaggagauaggguuguguagaaaaagaggggauggguugugggguacuguaugaagggcagggauuguaucccauucugcugggggagaaucucaguacuucuagaaaguaacauuuugcacuguagggaguccaggaagacaucuguggucuguguucuaggagugaggcugcuggaauuagcaaaacaaauagccagucuagugcuacugcugcugugcuccugaccccaccuucuggcauggguacacggagagcaggcaggcccugcugccuaccaggguuugugugacugugucuuuauccuaccuugaaucuguagcuaauccagacuaggguuccuuccccaaagugucuccagggacccuucugucacuggguuccugucaauccccaagcuaguuccuguuccuaccgaagccugcucuggucucugcccacccccugcccugcccuuauguucugggugugcucauuucccacuuccuuccucacacuggggccugcucggguucuugccagucuaggaucuaugaccugcuccugacucuguauucaggggccagacacccuguaacuagcauggaggcucagaucccacucccacuacuaccaccacgucugccaauaaaucccaagugacugguagcccccuuuuaccucuugccagagacugauuuuucucuaccuuuguccuucccugggaagccucauaggacccucagcaauucuggagguccucuaggagaaaugcugagaaguaccgagaaagucuuaacuguaugcucugagagguggaacacuauaauaacccugaccugggaaggauauaaggcucuagcccaguuaggggaugaggacagaaugggcucccuacaguccgagcuuagacguaaaccuucagaacagacaguagggcccagggacuuguccugccacuguucuuucugccucuagguuggcuuggaggggguggggaaaggcugccuuccacaccgugacugaaugagugugacaguauugcugaaagggggccccgagccagccuucucauacagccacccaguugcugagucuggcugaaaaagggaggggugcucaggacagacaaagccuugggguaggguuggguaaagaagggcaggcugaagccuuuugaggaggcacugauuucuauggcaacacugcuucccagccgcucucuaucagagaggggcgggcccagggcagaggcauucaggcuuccucugggcuggggcauuucgugugaguggguggggcauaaagagaaaaggcagcaguuugcuaugcugaguauagagccuuucugcuucagugccagcagcaggaaauucaguugcuuaagcccauccccugugaugaacaaaaaugcacagcagccaguaggauuauaaagccagagcaauagaugcccuccauggucauuguuuaaaggaaucauuguuuguuuauuuuacauuugagacagguuuuugguuguuuuuuuuuuuuuuuuuuuuuuuuuuuuuuuuaguagcccaggcuggccucaaacucacuauguaacagaugaggacuuugaacgccugaucuuucugaguucaucucccagauguugggauuauacaugugcaccaccaaaaccagcgugugugguaaaaaacaaacaaacaaacaaacaaccacagcuggucccuaaagcugcacagugaaagcacaggagguaagguccacauuucacuagugcugcucauuaucugacccucuguucacuacauuuuauugaguaccuuuuauaugccagccucagagaauguuaguacaaagagcagaguugcuguucuuauggagcgucuaauaagagaagaggaagaagaggagaaagaggaggaggaagaggaagacaaggaggaggaggaaacuauguguauguuugugaaaaaagaagucccuagguggugguacaugccuaugaucacaaccgucaggagacugagucggguaaaucugaguucgaggccagccuggucugcagagugagucccaggacagccagggcuacacagagaaacccugucuuggaaaacaaagacaaaaacugaaguaagcuggugguagcugcuauguauuuaaaagggacguaggcaguaagggacaugguucuguguguaaaaacaccugccagccugaucugauuuuaauccuugaccccauugugaccccauacugaccccauagugaaaggagagaaacagauucuccaaguugucuucucaccugcccucacacauccauacacgauaaugaagaagaagaagaagaagaagaagaagaagaagaagaagaagaagaagaagaagaagaagaagaagaagaagaagaagaaucuuguuucuuuuuuaaagagagggccuuacuauguauguagccuuggcuagccuggagcuccauauguagaucaugcuggccucaaacucacagagaucagccugccuuugccuccuuugugcuaagauuaaaggcauaugcaauuauucucagcaguaauauuuuucuuugguuuugauuugagacagugcuucucuguguagccccggaugucucugggauggcauuuaaaggcaugagccaucacuaggccugguuuuaaagguuuuuuuuuuuaaaaaaacaaaacaaaacaaaacaaaacaaaacaaaaacguaauucagcauucgggaagugagaacagaaagaucaagauuccaggaucagugggggcagugguggcgcacgccuuaaaucccagcacucgggaggcagaggcaggcagauuucugaguucaaggccagccuguucuacagagugaguuccaggacagccagggcuacucagagaaacccugucucaaaaaaccaaaaaaaaaaaaaaaaaaaaaaaaaaaccaaaaagguccaggaucauccccauccucugauguauaguguguuugaggccgaaacuacaugagaucuugucuuuaaaaaaaaaauuuuuuuuaagucaggcucuguccaguagcacacaccaguaaucucagcauugcagagauagaggcaagagauagcugaaauugcucagucugagugacuagaaacucugucucaaagaaacaaagcaaaaacaacaaaaccucccaguaaccuguaauccuaacacuuuggaggcaaggcaggaugauuaugaguucaagggcagccuagguuauauagcaagaccuuggcuuuaaaagaagaacaaaaaaugcaagauaagaguuuagagcaacuagguaugacgccaugcaugagugaccuguguuccuuuccccagggcauacugaggccuggaacuuuuuuuuuuuuuuucuuauccugacuccuuuaguauucccccucugaucuuuguagaaaacuaaagcuugaaauuauaguuagaacaaaugagggcugccaagaauuuuccuaagaugugagcuuugcuaagacaaauagauucucauauugauucuucacuuguguuuagggcuuugagacuuuuuaaaauccugcugggcagugguggcgcacgccuuaaaucccagcacuugggaggcagaggcaggcggauuucugaguucgaggccagccuggucuacagagugaguuccaggacagccagggcuacucagagaaacccugucucgaaaaccaaaaaaauucugcuccuucguagcagggaauucaaucuuagggagcuggggucuuuuuuagggaguuccuccuacucaguagagguaaggagaaagcauacuagaggucuguuguguacuuguauuaauuguaaaacccagagaggaaguagggggggcccucuuuuuacaguccaguaauaaacuaaugguccuggggacucauagcauaggcaaagcauuggcuucuacuuccuuugguucugcuguuuguucccuguuucugugaccgacagggagaaaaggccugaguuggugacaaccugucugacuugcugauaaguucagaagacaaaguagacaaggcuauccauuuucucagguuaucucgagagcacucccuguaaaaagugucugugaaugcccaguccucgcaaaaauuccguccugguuauuuacagagcuaaggacaaagguuagggaugcugacuauaaugcugcuuaauuuggcuggcucugggcugggcccggggcccugugacucagggggagcuuggugaguuucgagggagcugugagucaugaagacgaacuuggucuccaucugacuuugggcagaaggccuucuaacucacuucuuaggaugcucuguuuccucggagcagaggccugucagcaaagagugcuccaaagccuggucucggaaggguuuugagagucccugaaaugucagccuccuggggucucuaacaaagacaaaaagggggugggagaggaugccaucuuucaguauggauagaaauaagguacgacuguaguaggucuuuuuuuccugcucuuguagaaagcuuacucgauagcaacccuuuuaccuggagcuguuucgggaugugggggcgaaugggcuuggggauauguaggguuggguuuggugugacuuggagauuguugagauuuaucugugaacacacuggagcuucauauuaauuuacuucagaacaggaaguguggaggagaaagguuuguugagcccugagagaaugaagucugaaugggguuaaaugacagggcagagaauugcuuaggacuuggacagaaaaaggguuaaggaggugggcggagcgacauuggguaggccugcccuuauguggaccaauaggcgugcgcuccuugaagagggcgugacucacgcuugagguugcugagaggcuggccuccacugggccaaugaacauaguuguugcccauagaggguguggucugaggggggcguggcagccguggucgcagugcuggggguggcugggcgcugggcggggcgggcggccccaucagcugguaggaaauggccugugagucagaggggcagcugagucugcggcgcggagccggggcggccccggggagggaccgucgcagggaggggugcaacagcagcuagaggggcugcggacgccagagcccgcuaguguugcacacgaagcugaucagggaagggccaagcagagcaaggcucucagccuaagccacccuuugucuggguugggggcccguaguaggggggacugguuauccgaggggagggaccgggacggggacgggaccgggacggaagggcccggagcagcggccaccgcggcggagccaauuugggagcggggugaguguguacuagguggaaggaucagaucuccaaaaccucugcaggguauggggccugucccagacugugaagaagggaugagaaccgaccugggaggcuaagcagggggugggaggaaucguccagaacaaggaguccaggagucaaggugagucuccccgucugaguuuggagggguuucugaggucugcucccucucuauuaaaggugaagggcucuaggccagagugagagcgagugugaaagcagagauuaaccuuucuacucagaacaguggucuugggaacagucacccuagcguguguagacuugugugaggacaaaauguacagcagugagcagcaggacucugcccaggauaagaguggaaaacacauggguaggaauucuuacccuaaccuuccuuaggguaaaaaugggugucuugagagugaagggaaggauagaaugagccuagguguucuucuuguaccacaaccucucccaccucccaggucuaacaaguaucugaggguacagaccucaugguauucugggacuuguuguuuuugcuggccuugcucucggcauguugggagcuguaguccuuggcagccacagucuggcacagcuguuuaaugccagcugcugcccauccccagcauggagggcgagguuuggcuuauacuggcuugucccuucucccggcaguccuaccccaugagucagcuugaagcuggguggcagaggagugagucuucgagcgucucugggcagggagggaacuaauaggacucuggauuaaugagcagaugccagcaugcuggggucaaguagggcaucaugucaucaccuggcuuccucgaggcaagggcucaggagggcaacugagaugaccuggaaauuggggugcucaggaaaacgcccuucuugaacuuuaaagcuuggguggagacuaggaggggaagaaaggagaacaggucauacucucacgacacugcuacuacuggcguucuccgcuuucuagccaucucacccacaugaaggacuggaauguucuuagggucucauucggaagggggccuggugaaauggcaagguguggucugaaaggaaggcaauggcugauguaggagagucccuacguguaaauguccccccucucuccgucuccugccaccacaugaacugcugcaguuccccauguacaauuaaucucuccacucuucacccauacagugugucucuacacugucaggcugcugaccagaucacuggugcuagcucggauuuaggcuuuuuuuuuuuuuuuuuuuuuuuuuuuuuuugaaucuugauguguguuucuccugagcuugaaguugggcuggggaagaaacacaguccuguccucgggccugacauaaucagaagugaacagcagugucaucggguuucagaaaguaguuagugauuugccugucucugccuccagaguguguggacuaaaagaugugugccaccacuccccucaacuuguuuguugguuuuguguuuugucugagguaggaugucucauaaccucaucugaccuuaacugucugguguagugggaagucuggcuguaaccugguuuuuguuuguuugauuuugacagaggaccucucaacauguagcuagacuggucuagauccuccugccucagccucuagcacuauguuaaagggcaguaugguugguagugcucacaggcugcugaccaaauaaggaugacaguggggacagcuggccuucaacuugagagucuggucacugaaauauuaguggucugugaagaccauuguugugcuuuggcaacaaagaaaugcuuuagcuuuuuuuuuuuuuuuuuugaguauugguugugcccugcgggaggggcauggagagauacuccaguuauuuccaguuggcugcuugcugcuuccuuaucucugguuugcagggccuggggggaggggugagaacuagaaaguaucuucugacugcguucucuccuuccaccacuuguuuuugguuagauuucuuuuuguuucggggaggucuuuaggggauggggguaacaguguagcccuggcuguccuggaacucacucuguagaccaggcuggccuugagcucagaaaucugucugccucugccucccaagugcugggauuaaaggcaugugcuacccaugcccugcuggauuucuucuauuaaaaagacagauuucugaggaacguuaggauuuuaaaugugcagggcuggcuuggagcugacuugaguucuguaguugugugaugggguguaccuaccugcaugaccucugcccucagcacucucgaguggcacuugccccuuuggauagauauaaggagaugaguuguguaacuggguagccuugaguaagagaaguacaguauuguccuguccaccuacaaccugacauggaaucucuggucuuuggggcaucuuauccccuauuacucagggccaguuccugagcuggagacccugacaagugguucaucuugucucuacucauuucucacauccuuaauacagucagccaagacuugcuucucuguugaguccucagguagcccaauucuucugcauacgcccuaggucuccagccugccucuucuguuucugcagagcuugucccaaagcggggaagaugucuuggugugugugcugauauaguagccuauauuaguggaggaauuuuaccauuggcugcacggauucugacuuauauuuucucuuuuccuucaggguccaacugagcccagaagcugcacggaaugguggcagccaccuugccggugcagugggcauggaccagacugcaagcuagagggacaagacaucagacaggaagagaggacacgcgcccaggcuugaggcuucuucaucgggguaacguccaggaaaguggggguggggguggugcuggggguggggauugcaaguccauugagaaacuggagcuguaaugugccccuccugggagugccaagaguggucucugacuuccauuggucuguccagggauaugggcaacuuuaccuccccaaacugcucaaggucaucuguggaccgagggaggaucugaaacugagcugaaagaaagaagacuccuugggucucaugaucuccuguuuuucuuuccuucagauguccccaggccccccagcccaggcccagcauaaaggccgugugggggggccccccugacccaaggggggcuucaugcgccacgugcaggcggagcugucuccauccucagagccagaggcuggcccuucacagccuccagucagacaggggacccuccaggguggccugcucaugggcuacagcccagcagggggggcgacaucccccggggucuaccagguauccaucuuuuccccuucagcuggugccuccgagccuccuagggcucugaagcggccggccccucccaccgaggguccccgggagcugaagagaggcccugggcugggggccagagagggacuacccccugaagaaccaucuacugugggacucuugagcccagagggacugggucugggacuggguguggcuagccagcauuucucccaccauggccucuguguuguggagcacggagguaauaccaccucaccuuggacuucagggacccagaguacacccuggcucucaucaaaugcuuccuucaauacuuugcacaccagagacugggcuuucccagaucaagggggacaggggugccugggggagacuccagggccagccccuucaggccagcugcacacacuugacacugauuugcacaaucuugcacaaauaggggguaagagcccaguggcuagggugggcaacgggagcaaccccuggccuagggagucccauggaacugccaaugggcacagucccgagcacacacccccuggcccuggaccuccuggccccugccccaccaagcgaaggcugcugccugcuggagaaacccuugaugucagcucugaggaugaggggccagccccucggaggcgccggggaacccugggcugcccucuugcugccaauaguucugaugccaaagccacacccuucuggagccaccugcugccugggcccaaggagccuguuuugguaagccagugggcaaguuugucuauuuuuuuuucuuuuguuuuuuuuuuuuuuucuuuuucuuucuuuggagacauggucuuauguaucccaggcaaaucuaagguuuucaaagaugaccuggaacuacuucuccaccuuccaggugcaguguuggacucagaaaagggggaggcacugggagggcucagcaggccuggccccuuccggagaguucgaagggaacuucugggaagagaagccagcacaccuaguguaugugguucuguagaucgaauguagauugaacccaaggcugugugccugagucuuaggacagccugcuacacagacacuccaaaaaugaaaacucagcuaggucuccagccuccugguuuugcuuuuuaagagaaagucucaaauagccuucaaacucucuauguagccaaggguagggucaucuuccugccucuaccuccuaacugucaccuuguauguuaucacaccagccuauucucaucuccuuuuuuaaaaauaaagauuuacuuauuauuauacauaaguucacgguagcugacuucagacacaccagaagagggcaucagaucucauuaugggugguugugagccaccaugugguugcugggauuugaacucaggacccucggaagagcagucagugcccucaccugcugagccaucucaccagcccucucaucuacuccuaagcaaacauuguuuagguagagguggaggaaaccuauagagauguucuucugagaacuuauaauaaguccuugucauuaaauaugucuggccuucauaaagucucuguuuucaauauuuucaccauaggacccaacagacugcagucccauggggcggaggcugaaaggcgcccgucgccugaagcuguaaguugaucagauucucccucucgccuggccaugaaagugaaggcagaagucuguaguuuuuuccaacacuauauguaguagaggcccuggggaauggacaagagugguacccaaggacugggaacaggaauacucaggauacucaagccaacccuugugucccuucucuucccagaagcucccuucgaacucuccggaaggggccaggccugcugagcccucccagugccucccccuuucccaccccugcugucagccggacccugcugggcaacuuugagguagcuccuuuuggacuuuguaauuaaggguuccugggaggaauucaaugguggaaugugccucaaaaaacaaaggaaagacuuggcaucguucucagaugugucuacuccacccuaauaccaggaaucacugcuucgaggacgcuuugcaccaucuggccacauugagggcuuuacugcagagauuggagccagugggucuuacuguccccaacaugucacgcugcccgucacugucaccuuuuuugauguuucugagcaaaaugcgccggcccccuuccugguaugacauaaaucugaccccaaaauuaucucagagggcuuggguggcaaaaggcauuucuuccauguucuucuucuaggagugagucagguuaagaagggaagaauucuaguauaggguagagccaaguccagggggaagugcuauagagcuuuuaguauuuggugcucaugacugacuuuucuagcuccugcccuggcuaaugguuuauggucuuccuagggagucguggaccugacuccucuggggaggaaggguuacagugugcccaaggugggcaccauccaaguggugagugacggagugcugggcgcccugagggaguugaugugggaagagaggagaaucagucaguaggcccuaccaaccuggacuguccuguccccagaccuuauuuaaccccaaccagacuguggugaagauguuccuugugaccuuugacuucucggacaugccugcugcccacaugaccuuccugcgccaucgccucuucuuggugccugugggugaggagggaaaugcuagccccacccaccgccuccucugcuacuugcugcaccucagguaagcccaggacccggggagagcuggagaagcucggguagccaucuguccucugcccucaacaaucuccccuuucuucuccaucauccggaugcugacgugcucacacugucuuccccucagguuccggagcucucgcucaggccgcuuaagccugcauggagauauccgccugcuuuuuucccgccggagccuggagcuggacacggggcuccccuaugaacuucaggcugugacugaggccccccauaauccacguuauucaccuuugcccugaucgcaagcauccugaaccuaggugggcccaaagccugccuguccuaccauccuggacaggguaaacuguggagaaauggcgagagccccuucaggcuugaauuaaaguccucaucccgcucacgcccaaauugacuauuuggguguuuaaagcuucgguccuuccauacccugucugcucuggguacuucaugugccuguccccucccuuggguuucccaggccagcuuagguaguuagggaggaaccagagcuacccugagauugucccaaguucccaggcaaguaaugccagcguugccucccuguccugggcaggggccacuuauuauuuuauuuauuuuuaauuuauaauuuauucaaauuggauugccuuggugaccucccaaaccugauaauuggcaucaccccacucucagauauugcuccaaccucaggacuugaagaagcugaugucggggcaaggggagagcugcucuccucuggcuaagggcagaggguuuauuccagaggaacugagucacuuagccaaagacucagcuucccucggcuuucucuauuccuuuucccuuuccugcccuucaacccaucuucgaaagccuguaugugugguguguguguguguguguguguguguguguacagcugugugcgugcauacaaacuuggguuuguguagggugugugugugagagagagacagaaugugcauguauguguaacacagggguuuagccaccucuuaccuagggcucagacucacuugucccucuccuccugccugugucuccuugcuuugguguccugacugaggaagguguccagggacagagucaggccuaaggacuggggaaccuccucucaccugaccagacucugacccaccuaccucagcugggaugaggggugccccucauucagucacaugguucccaguuacuccacuccucacuuaagacucugacccagccucaacccuuaacucuuggggcuuggcugaggggaacaagcauuugcugaaacuugaaaaacaaaacaaacaaacaaaaaaaugggaaaaauuguaccugguacauuuuuuaaggaaaaaaaaaagaauaaauucuuguuuggaaacuugaacuaaccucuacuuuuuuuuguguucaagaggauggagauguggggccuaaagggagcuggaauucuggcaacaagcucaaacccaugagaucuuaggcugggaugagcugagucuuggaccauagucuuaguccuuuuuguauaaggugcugggggcuggguggguaaagugaagcuacagaggcuaaacucugagaaucuggauucuuacacugauucuguaguuuagccccaucagaaccucagugucuguauauguaaaaugaaggaggaggaggagaaugagaagaaggagaugaggggggauacaggccucuuaaagcuuguauuugagagagugucagagaccugagcaagguugauguguuucagacaaaaaugaaaggcugaggcucuuuguuucccucuguauguaaggggaucaugccugaccguuucuggcuca

SEQ ID NO: 1854 - RNA, 4322 nt, Mus musculus
aagggggcggagaguugguuaagaaaggcuuccuuccuuggguuagcaagaugguuccgcagauaaagccacuugucuugcaagccugacaugauggcaggaggccuauaaggaagggagagacaugucuagaggggugggagcuugugcuaccaggaagcauacaaaaauccugacaagaccgaaaugcucagaauauuuagaaagaaggaaaaugaguaagagcugagauugguguuggagaaagguauccaugcagcccccaagcugccauuaacagcauggugcucucugcuccuguggcuggugacagccugaguuugaucccuggaaucuccauaaagguagaagaggacugauuccauaaaguuguccucuggccuccacaucuaaacacauacacacuuaaaaauuaaacuucaaagaaaauugccuagaagcugagucaaagaauaaaauggauuuaggacaguaagauaaugaaaacauuaaauaccauggcgguuuacaaacauuagaaaggaaagugaagggcuggggagaugacucagaggucgagagcacugguuguucuuccagaggaccugaguucaauucccaggacccacacauggcagcucacaaccgucugaaacuuugguuccagggauucugauacccucauacaaauauaaugcaggcaaaacagcaaugcacaugaaauaaaaauaaccaaguuuaaaccugguuaggucccucaaauaaaguuccuuggacccuucuguauagauacuaccuuuuauuuagaucaggaaucaucuagaaggcucucaaagagaagaugggauagcaggguuaccuagagccaugggauguagcuguaugugucaggaauaaaaauaacucaaugcauucaauuaaccuagacacccacacugguggaugcucguugcaucauuuuagauaccuggaugaaacgaccuuauucuuuuauaguugcugaggcuaugggaaucuccugggaaugggagcugcagagcuuaaggcugucugcuauucugugcugcgugccuggagacaccagcagagucaaggacacugggagaggcuugguacauggucacuagauggacagauugggagcuccauccguucucacucuguccugauucauaaagaaucaggcugccugugaaauccacacucauaguugucuuccacauggccugauguaagaacuggucucugucacgcucuucaaaagacuuuauuuuacaucuauuugguguaugugugugugugugcacaugcaugugccauggcacacacagggggcagagggcaacuuguaguagaugguucucucuuuccaccaugucgauuuugggguuccaccucagaucaucagauucgguggcaagugucuuuacccacuaagccaucugaccagucucuauucaaaaugguccaugucucuucuuuguccagaauuccaaucucuuuacugugauuauuaaccaaccccuccccguggggcuucuaccucugcuucaaagaugggaacagauuuuacccacauccauaguuccuugaggcagaauuaugacaucuguccucacucgcuggagcgagagcuucucagauaggagccuucguuuucauuuccgcaucccuaguccacagcccagugccuaacauaccguagguauuaaacaaauacggcgugcaaacaugaauggcauucugggcaacaagacggagauucacaaaggcagugcagaguuuggagagacgaaugaauaguuuagcucugggagcaaagcucaagugaaagagugcuugcauggcacccauggcccccuggagucagucuccagcacugaaaaagaaacaaacaaacaaagcaaaaaagugcaugcgcgcaggagcacacacacacaaauuaucugaccagaacauuagguggaagagcaagagacaagacugguuucuugggugagguuuugaagaccuggaagucgggaaauaaaaugaucagacuuuggcaggcaguggggggggggggguaaccauuagagucucauauguagauucaaauaaucaugcucaaauuugccuucuacuuagcugugagccccuccaccuauucaccccuaggcuccuccagggucuuaaccugcccccuuacccaagaccugacugggccaggauacaugcauggauuucuugccuccucagcccaacuccacgggggcccagcuuccuucuuuccccugcccugccagggccgggaagcaggccaggccuagcagaggccaggagcuggguggugccagggagaaccuauacagugccagguggugccuuggguuccaagcugagcuggugauccugauaaccuucuuucugccuaugaacacaccugccccucaccccaacccuacccauuaccgcaccaauguccaggcuuugauaucggggagggggcauagggccagacagaaccugugggacuuuggcuccaucucuacaaaagggcacugugagucagccugcuccccucaaggcuugcuccuccccuacccagcuccuauuuccgaugcacguacagcccguccacaguguguccugggacaccccagucagcugcauggccucccugggccccagccccugggccccuuugucgaccccagccccuacugcacagcugcugcuguuccugcugcuccaagugucugcucagccccagggccuguccgggaugcagggggagcccuccuugggagacaguucaucuggggaggaugagcugggcguggauguucugcccagugaagaggaugcaccugaagaggcggauccacccgauggggaggauccaccugaaguuaauucugaagacaggauggaggagucccuuggguuagaggaucuaucgacucccgaggcuccugagcacagucaagguucccacggggaugaaaaagguaaguggucauuaacuuccaaaucuaggcucagguaaguuuaugccuuguccucccccacuccccucucuuccccgaaaugcuagcugagagcauucggcaauuauacucuaauagguagucuuuccccccuaaaaggagagaagaaaaaaaaagccgagaauagggggaaauuaaagaggaaauagaacugggaauggacagagggggaaaauaagugugugugugugugugugugugugugugugugaagagagggagguagagagaaugagagacagacagacagagacagacacagagagacagagacagagagaugaaaagggaagagaagggggcuccuggaagacacacaaggagcucacagccguuacucaccuaugauuugcggugugggaaaagacagguggaggaacuuugguuugcucugggggcggaggaugagauaaggucuuauuguguagaucggauuggccuugaacuaguucugcccuuuaccuucuucuuccuccgaguucugggauuucaggugugugcgccaccgugcuuggcucuaagccaggaacuuuagacaggaaagagagaugagugggaaggugggugaguaagggaaaaagaacgaugauuuggaucucaaacugaagccgugccuacagacccuaguuugcaaacuaucgguagggcuacugauggcuccugcagugaugguggcgguggcggagucccagcuggugguaguccacugugcuucacaccagccuugcuacauuccuuucuauuacgugcaacacucuuguaagacauccggggcugugaggcccccugccagagcgggagggaauauuuuuuuauucugggcacugggaagggacugggcuguaagagugggcuuauuaauucuucucauuuaugcaggggguggccacagucauuggagcuauggagguaagacacggccggcuacacagacccaaucugggagcccagcccuggugaucugccgcaccaacauucccaguaguagcccuagacuggacccagguccuacucuauggccccccucccgcgccccgcacucccccacgccagucccuggagcgcccccccuuccucccaccccaagcguccugacuccaccccucacuuauccuaacgguucuuguccaaaucgcuagacuucuugcaccuuuuccucucaucccaggcacccuacucuggccccagguguccccagccugugcuggccgcuuucaguccccgguagacauccgccuggagcgcaccgcauucugccgcacucugcaaccccuggaacuucuggguuaugagcuccagccucucccggaacug

SEQ ID NO: 1855 - RNA, 6708 nt, Mus musculus
cacaguguguccugggacaccccagucagcugcauggccucccugggccccagccccugggccccuuugucgaccccagccccuacugcacagcugcugcuguuccugcugcuccaagugucugcucagccccagggccuguccgggaugcagggggagcccuccuugggagacaguucaucuggggaggaugagcugggcguggauguucugcccagugaagaggaugcaccugaagaggcggauccacccgauggggaggauccaccugaaguuaauucugaagacaggauggaggagucccuuggguuagaggaucuaucgacucccgaggcuccugagcacagucaagguucccacggggaugaaaaagguaaguggucauuaacuuccaaaucuaggcucagguaaguuuaugccuuguccucccccacuccccucucuuccccgaaaugcuagcugagagcauucggcaauuauacucuaauagguagucuuuccccccuaaaaggagagaagaaaaaaaaagccgagaauagggggaaauuaaagaggaaauagaacugggaauggacagagggggaaaauaagugugugugugugugugugugugugugugugugaagagagggagguagagagaaugagagacagacagacagagacagacacagagagacagagacagagagaugaaaagggaagagaagggggcuccuggaagacacacaaggagcucacagccguuacucaccuaugauuugcggugugggaaaagacagguggaggaacuuugguuugcucugggggcggaggaugagauaaggucuuauuguguagaucggauuggccuugaacuaguucugcccuuuaccuucuucuuccuccgaguucugggauuucaggugugugcgccaccgugcuuggcucuaagccaggaacuuuagacaggaaagagagaugagugggaaggugggugaguaagggaaaaagaacgaugauuuggaucucaaacugaagccgugccuacagacccuaguuugcaaacuaucgguagggcuacugauggcuccugcagugaugguggcgguggcggagucccagcuggugguaguccacugugcuucacaccagccuugcuacauuccuuucuauuacgugcaacacucuuguaagacauccggggcugugaggcccccugccagagcgggagggaauauuuuuuuauucugggcacugggaagggacugggcuguaagagugggcuuauuaauucuucucauuuaugcaggggguggccacagucauuggagcuauggagguaagacacggccggcuacacagacccaaucugggagcccagcccuggugaucugccgcaccaacauucccaguaguagcccuagacuggacccagguccuacucuauggccccccucccgcgccccgcacucccccacgccagucccuggagcgcccccccuuccucccaccccaagcguccugacuccaccccucacuuauccuaacgguucuuguccaaaucgcuagacuucuugcaccuuuuccucucaucccaggcacccuacucuggccccagguguccccagccugugcuggccgcuuucaguccccgguagacauccgccuggagcgcaccgcauucugccgcacucugcaaccccuggaacuucuggguuaugagcuccagccucucccggaacugagccuauccaacaauggccacacgggugaggugucuggggcgggaccuauggaggggaguggcaaucaagcugugcacuuaggaguucugcuggugcucacgcucacguguggguagacuucucacuugccacuccccacgcaguacagcugacucugccgccggggcugaagauggcucugggaccugggcaggaauaccgggccuugcaguugcaucuacacuggggaacuucagaucacccaggcucagaacacacagucaauggucaccguuucccugcugagguggggacugggcugucccaagaagaagcaagaggguaugaucagaggucuggccacuaucugauccuuccauccucucuagauccacguggugcaccucaguacugcuuucuccgaacuucaugaagccuugggccgcccaggaggccuggcaguuuuggcugccuuucugcagguacccuauuugacauucacguccuguggguucaugcaucuggcuagcagagacaccauuccaagcacaagcgcaagcuggucaauuagcucucagccccauucacuccuuuguucauucacucagcaccagcagggaaccaggaagcagacuaacacaaggcuuccuuuaggaggaaggcugucuugacagucauaagugacgaacacggaaaaaauaauggccacagaggaggcgaaacuuaaaucuuucacugaugggaaacaaggaggaauacugcacagagagaggucagcgugagcaaggcuggaguauggaccaguuagggagugccacagcaacaagcuaugcccugggaagagccauuucucugcugcuucuguggccccucacuuccccuucaugaagugcaguauucagugaccucuuuguaccuguaauaaucaagaacguacacuccaaggugggaggaagccaggaagugaggacgccuaugagacuuaccagugugacauucacagcacaaaguucagggaaguuccucaggagcaggcgggcaggcgugaguuauuaaagugaacgcaaaggcaguacaaguauaacauacaugauggucuucuucaggaaaccacggcgugugugugugugugugugugugugugugugcgagagagagagagagagagagagagagagagagagagagagagagagagagaguguaaauagugaugagugaaacgauggaccuagaucuugagggccaggcagccugggaaacuuucuccccuucaguuugccauugcuaauucauuugcaaagcaagaguaauagaacuugaauaagauuguauauuccccagcauccuuagaggugaggaacggggaaagacuaugggaaccccaucccaugcccaggcuuccagcuguaguccuagaaauggguaucaauuggccuuguacuauaucccguguucaccccugcaggagagcccagaagaaaacagugcuuacgaacaguugcugucccauuuggaagaaaucucggaggaagguugguggcuugcccagugaacaaugaacauagauggagggagcugagggugaacuggcucugacuggugauagcuaaacugaugagaaacacaggggauagggaaacuacuguccacaggcuugacaauuagaaaucaaagccaaacagaaaauaacauuagagaaaacaagcaaagcugagucuggccgugguggccucccuggucuauagagugaguuccaggccggucaggguuacacaguaagaccuggccucaaacacaaacaaaacaaaaagcaaaauagagaaaacaagccaaagaaaauguuuaaaauuuauaagacugaguauggaaagcuaaacuuuuuuuguuugagaacugucuaucauuuauacauaucaaauauuuauauauuuuuucuuauuuugguuuuucgagacaggguuuuucuguguagcccuggcuggccuggaacuuacucuguaguccaggcuggccucgaacucagaaauccgccugccucugccucccaagugcugggauuaaaggcguggccaccacgcccagcugaugaaugauuuugagcaggucauggaagagcaugcugauaauaccaacguuugggagguuggcuacucaccaagccagccuagguuaccugaaaucauaaagacuagggcuagggcugaagagagaaggcucagggguuaagagcacugacugcucucccagagguccaaaguuuaauucccaaccacaugguggcucacaaccaucuguaaugagaccugaugcccucuucugguguguccgaagacagcuacaguguacucauauacauuaaauagauaguauuuggaagaaaaaaaaaaaaaggcuagggcuauagcucugaguagagcaagaacauagcaugcaugaagccuuagguccagagcugcaaaaacacuuuagucaaaaagcuuguucccuuccaugacugagccauuuuaaaccucacucuacuagacuuuuuagguguuuugauaaacuggaacucauagaacuuuugugucuguuucuuaucguugcaaauauuacauguauuuacaaguuauucuacuugucuaucuguguauccacgggaaugugcucaguagauagaauaaccccccacccccccacccccaguaccccuccuccccgagcuacauuccaauuccgcuuuauuccagucugggguuaaccgcgucccccccuuccccaccccccgcaccccuccuccccgagcuacauuccaauuccgcuuuauuccagucugggguuaaguuagcaguuguguauucagaugauugaagguaccacaggagggcuuaugagcuuuuggcuugaggcuggaaagauggcucagcaguacaaggccuccucuaacugcccgaagcccuuuacuuccuuuuggauuauccacacauaguaagaagcauugaaacuaugcuugucccgaaagcuuccaaggggcagcaguggggggggggggggggaacggggccgaggaggcaggggugaucuaggugagaccucaacacaaucccaauccguaggcuccaagauugagaucccagguuuggauguaucugcacuguugcccucggaccucagccgcuacuaccgauaugaagggucucugaccacaccucccugcagccagggggucaucuggacuguguucaaugagacagugaaacugagcgcuaagcagguuagaauggggcgugguauugaccugggguguuggaaaaugggaaugugggaaaaaacgaggaaggggucaugcaguaaagauagacagaggguugggguccccuuguuucuuuuugucuugagccuguacuauccaucgacccccacuuccccagcuccauacucucuccguuuccuuguggggaccucgugauucucggcuacaacugaacuuccgagccacgcaacccuugaaugggcgaacgauugaggcuuccuucccugcugcagaggauagcagcccugagccaggugcccaguuaucugauagcccacguugacauauccccagucagggguccugccucuuccugugucuucauuuguaccagccugucccagguacucaugggcccugguucuaaugucuccuuuuaucucuucaguccaugugaauuccugcuucacugcuggugagucugggucccuuguuccuggugccaguggcgggagggggccacacccuuuuaguauuucagcccaggagcuagucuuuacuuuuucuguagaauaaacuugauccccaaaucgaugugaucggucaaguaagagaccuguaccucuggcuuaguugucugaaugaggcuccagaaaucuccugugagacccccucccccaaggcaccuuucaccuagcugcuggaagggagaagagugcuuuacccuucucacuaucugccuccauucuccagauggccuguucugccgaccgaggcccugggggcugccugaacacucacuggggaaagggucaggcaggaguaugggaagccagcuugcagggaauccccuggcauccccagaagcagcugccucuccccuuccaggugacauccuagccuugguguuuggccuucucuuugcugucaccagcaucgccuuccuccuacagcugaggaggcagcacagguaucuaugacccuccuuggcauagcauucuuguauaacccagaauucccggacugcaaaugagcucucaugcggagucggcuuucugauucucguuccuuguucuauaggcacagaagugggaccaaagauagaguuagcuacaguccggcagagaugacagaaacuggagccuaauaaggagaaaccagcuaaaggaaucuggaaaccuuguccuguccugccuguuauacagccuccuuuuuaaccacuacgaaaucauuuccaucuuuuuaacuuucuucuuuccuuaaaguacugugauaggagcuaaccgugaaaaaacaagauugggcucaauucuugcuggguuuugaugguuuugaagacaggguuucucuguguagcccuggcuguccugggacucacucuguagccuaggcuggccuugaacucagagauccgauugccucugccuucuuagugccaggacugaggguauguaccacuaccaccgccaccccgcaauucuugcuuuuauucugcagucaaaugcucuaccacugagcuacacaccccuccaucuuacuaugcaggcagacuggccuugcauuguguauguauggugauggaguuugaagccagggucuuaccuacuaggcaagcguucuaucacugaccuaagccucucuagucccuucucuugaacccucuauucuccugucccagccucuugaaugcugggauuacaggaaugcaccaucaugcuuggucaucccaauuauuuaaaaaaaauauauaaaucuuccuaguaaaac

SEQ ID NO: 1856 - RNA, 31182 nt, Mus musculus
cugucacucuaaaccgcacccgucucucagcuucuguauuccucagcuuccaacacaacggaaguggugcacauagccccguggaauccugggacuuggaguucucuccaacucggaaguggcuccugggcugcgccacgucccgggggcuaugcaaauuauggggacguccuuucaagcuucccacgccccagggcggggauucugaggauccuuguccgccuucgccucgagcuauuaaaaaaaaaaacuuaagcguuuaaaagggaacuccagcuuaguucgggcguucucuccagagcucugcacgcucgcuuccugcuggggaggggcggccaggcuucgcgggcgcccgagcaucgagaacuacggccagagcagcuuccugcagucuccgcuaccauagagcgcgggcccagggcgccgccggcgggugggggacguuuccaggacggaaguggccgagagugugucgaagggagggcgaggccggagccccaaaagcgaccgggagaaggagcggguagcgggcccagggcggggcgcagagccgggcagcgcagguaggccggacgggcugggccgagcuucuagguggggcugcgggaucgggccagcccgggaagcggcgggcggggcccccaauccuccugcauauccugugucugguuagggaggucaggguccaguauguuucgguuuggauuuggaauuaagcuggccuuguugcgagaagcaggcccuuucgcggggguagacaguucucugucucggcuagguuuggggacggguagaaaugggguggcagugaggcacuggguggcagugaggcacugggcggggaugggcuuugguauuagccgauagugaguaagugguuaggaaaacuuggggugaguuuggguuaggugccgucgcguuuaggaagcaaggaucccuuuagaaguuaagaaggugaacuacauucuaaacauuugcugcacgagucaagucuguuucgcauaugugacauuuaaacugaggucauuauuuucugcaaugaccagcauuaagucagaguacaggaucggguuaaggaucaacaggaauuggcuuagaugcccguuuuagggauuaaaggccggugucauggucaguauuaagaauaaacagugaaaagguuaauuaagaaccaaguuacaaaugagcuuuagaacugcaggguggggugggagggaguauuuaggguuaaauuugggggauuugggccuaaaaauaaaagccagauuaguaugggugucuucugggaaaggggugaaugucaauguauagggaaauaggaaauaaagucagcauuaauguuaggaauuggugauagcguuagggguugaggcugcagcuacagcugagcugguaaaauguaagaaguuggcaggaaguagcuaccuuuguuuuguagugaguucucuuauuccugugcaguuacagaggccucuuuuacccaaagaagugcuagagcucuggaccucagcuagaagugccaggacucugcuuucucuagucuacugccuaagcacaaggcuuccagaggccaccaccacugggagacagggauuucugggcugugauguuuacgaggugggaggugggaaauggaaagagacccaggagucagacaagguccuaagugaggauggggaauaggaagccugugacugaggggaagcugaccaagggaacgcugucgacuaaaugaugacaguuugacucgagccucccucauucuccacacacugccuucucucugucucuuugcccucccuggucccacauugcauaccuuuacaguuccuuacagauacugucguggucuuuagcucgucuccugcuguucaucugaaccauuucccacccccacaccccugucucugucucuugauccacacauccuacuuuacuucaugucccucaaaccugagcuuucccaacaucggagagcacuuucucauacuugcauaccaccuggucagcugcugaaccccccccccccccgccaccgggcucuucccauguguacccccugguuucugagccuccuuuuacuucuagguccaguuguggauccccuucccccacuccccgacagaaaagaggaaaugauacccaaagaggaaacuuggucuuacugaucccacgcccagccaggccacugaccacacccccaugucacucccagcuugacccugccagugaccacaacacuguccccuccccaugcugccucuccuuccaacccaggguugccuagccgcugucaguguucucucacucucuccccacuagcccaauuuagcagcuuaccacaucccuagcucuucuggagcuccugacccggccuccggccucccugucauccccgguuuagucagcauccauggacucaugcuuuucccuccccaccugcucaguggcucaucaugugucuguucccuaccaucacgcuccuggucucuuuuucuacacccugugauccccagccacagccuaauacugucaguaaccccaccucugugccccugcuacagauacuuccuaucgcaucauuuaccacccagcgucauucccacauccugacuuaguccccucuccuucccugguuuauuaaacugaagcugucuagucaguaaauggguacuggucauaggaagcugauuuuggcuucaguuuucugaguccuguaugucaguucuacuuuucuucugaauggcaacuuccucuccauacagcuuuaacucuggcuuuauuaucgcuuauacuaauacagucuccuccuaacuuggccccagaguugcccgaaaacccagugcuggggaugucccuguuuaaagcuuccuuggccuccuguuccccuccagucaguuagguuccucauacugcucucuccgcuuuugccuuuccaucuuaacccugacguccccaccgcugcucccuugcaggugccccgugcuccagccagcuugccuccucacuuuccugggcauuccuccgagaucuccugccucucaaccuuugcuagugcuauucucugugccugggacgauaccuuugacucaucuucgacugaccuaauggagagagcuugggcuuuggaggcagagagaccuggguucggauuuuggcuucacagcuuauuauuuggacaaguccuuuggaaaaguauuuaacauucuggagccccagcuuccuaaccuguaaaaauggagaugauaacaccuaccuugcaggguuguuguaaggauuaacugaaauuauauauguaucuaaugcaauuaacauauagucaauaaaugacacgucgcuguaacuucuuauuaucuucauauuuuuaaaauucuaacuucagaugauagcuuccuuggauccuucgcucccuuucccuagccuccggggcucccuuuucugggugaacacguuuggcuccuuccacagccugccucuguuguaacucugcauuuagcuuuuccccaccccugggaggcuggcagccugcggaaagcaaggucuagucuuacucaucgagcuuccuggccuucccaccaugggccuuagagaaugcauggagggaaaagcauacagugaaggagagaggcugggagccggcacuggggcuggugcacuguggggaagcugugugcacacgugcugccuacaacagauagauccguauagcaacagcacaggcaguuuggcgggagggaguccuguguguaagcuaaggggccuuggugaagagugagaauacauguaugacugugaagacagaccuugugcuggaggaggucagauccagccucucagcugcccgguccagccugaaaggagcuuccagcagcccaaggccggauaugucagucucacccacaagccccucccccucccagcgguugaggacucagaggccaaauuugguaacagacugcauguuauucccccaacccucuuacauucugacucugucuucagcuuucuuucucccuuugucccuuuuaacucccugucucuguaguucgccccuguagguaccugcacugaugauauucuccauguaccccaaaauuccuuagcccuaguauacuugcauuccauuccuugcugggauuugaccuccuguccuccacacccccccuccaauugcccaaggccuuuggaaugcaucucaggaauguauugagggaggaggaguucucugggaaggggacauggaguggguguuguugcucuucauaaagccugauaaaaggggacagaguucucagagcaagacacgaagcagguagcuucugcuccuaguuccugggcucuuguucuuugccacugcuagucccgacucaguguccaguuccuucacucucaauuaauuguguagauagcuacucagccuggaggagggcaggcaugacucaacucucuuaucaggaucuuaccagaggaagaaguggguauccauauguccggaggaaaugggggcggaggggcacacaugcaguuucagcugaggcuggaguccuucaguacugcucugguuccguggacuggugcuucucugaccagcccucacuccacagccaggucuguccacugcugggaagguucccuagggggaaggaagggagagagcugggacugagggggccgggagguccucucauuugggguaaaaauggagaacaagccaugcugcuuuucucuguaauccugaacuguguguauggccagaaauuuccuccuggucauugauccaccuuucccaaucccuuuuuccucugccccuuccuaauuucccugguucucaaaugccuuuuguauugugaugccugccuguucccugguuuuuccccuggguccugcuuacccccuuggaguagccaguugucagguagggaagggggugggggcugcaucccucucuuuuuaguuaagaggcaccuaguccaguaccacacugggucacaucaucagcugcugggcagaccuguugucuugggccuguguaccaccagcugcucauggugucugaaagguuggggaaaugggcuuggcuuugcaaaugccgagcuacgcugaaagcaccaucuggaaccuaguuaaggugggggcaaucuggggaggccaugcaugaugaagagugcaagagacugcaguaaggccugagucucagugucugcacuguuggucuugcuugucuugaaacuuucuccucuccaacaaguauuggcuaggucauuucugaggucucuggacagagaaucacaauucuaccgugacugcagagcucauugggaggcccucccuguguguaccauucagguuguaagaaagcaggaacaaaaguaggucucccugacaugcuagccacaggcagucugcaggauucuggagccccugggaugcugcauuuugccaagaagaaggcaaaagcuauaagagggagggucacgugaugggucagagcagugcucagaaaucccaggaaagaaugggagacaaagaaaaggaaaaaacugaccccggaaaaguaaaaaaacaaggcagaggcgggguugagaaagaggugagcagaaacuagaggcccaaggcacuuggaaccagagaggcacaaauuccaguggugcgggcaggacaguguccucaggugacacugcauuucaggccugcuauuguacucuagagaccagcuucucucugggaugucuuaaguggucuagacuggcccauuugauguaaguaaucuuucaccuuuugaaauuauuaaauaggacggacagcuuacuauuauuuucugucauggugacucccuuaaaaauccucucucugggacucugaggcacuucggugaggguguauucuaaugcucugaugcuacuggccagguaucgccaggccgaagagcagaagcugccaccaugguugcgcuuucgcugaagauuagcauugggaauguggugaagacgaugcaauuugagccaucuaccaugguguacgacgccugccgcaugauucgugagcggaucccagaggcccuggcuggcccucgugagucugacuacugaggugguggggcaggaauccgucaucccuccuucucuuggucuugagcaguguccccguuguguucuaaguuccucaccucucaggccugugcuccaagguuuccuuuccucuuuaaguccaaggugaugggagaaaauaauguacaaagccagagguauagcuguuuggccacagugaaguuuuuauaagucuaagaugaucuaccaucucuuuuagccaacgacuuugggcucuuucugucagaugaugaccccaaaaaaggcaucuggcuagaggcugggaaagcuuuggacuacuacaugcuccgaaauggggugaguaacucccaucacuggccguccgcaugcucuaugugcugucucacuuguucccagcacccauguuggucucugccccuccuaucucuuccuuccucauaccaguuccuuucccccauccugggcuuuucaccagccaagcuagcacaccccgguacacccaugugguuuucugacacaggcagccaaacacccuccuucuagaugaaccacccuagccuucaauuuacuuuccuucuccuuggcuguguaaagggaacuaguuuaaauaggccccggccaccucucccugccccuacaggacaccauggaguacagaaaaaagcagagaccccugaagauccggauguuagacggaacggugaagacuaucaugguggaugacuccaagaccgucacagacaugcucaugaccauuugugcccgaauugguaaggggucuugguagggcaaaggccugggccaggagguuccaacucugucagaagacuuuugcgguuggggaguuagcaaaccaucccuuuuccccagguaucaccaaccaugaugaguauucacugguucgagagcugauggaagaaaagaaagaugaggggacagggacccugagaaaagacaagacccuacugcgagaugaaaagaagauggagaagcuaaagcagaaguugcacacagacgaugagugugagcaguagacacguccugggaaguguaggggagaggagggguggccguuuguuucguauuuauccugaaucaucgaacuuaaucuucuaugaggaaaggcaggcacugaagaaguaaagaacccagacacuaggcagcaaagagccaugugggguuggugcagaggguccugcgcucuguguucuagugaacuggcuggaccaugggcggacacugagggaacagggaguggaagagcaugagacguugcugcugcggagaaaguucuucuacucagaccagaauguggauucccgagacccuguacagcugaaccuucucuaugugcagguauggagaagaguuggcuggggcgagguggagcaagccauaguuaacagggauaucccugcacccauacacuguucccuucuguguucuccaggcacgagaugacauccugaauggcucccauccugucuccuuugacaaggccugugaauuugcaggcuuccagugccagauccaguuuggaccucacaaugaacagaagcacaaggcuggcuuccuugaguaagugacccauguccccuacccuguuauggcuugggacucccccuuaccaccgugaccccguggaccugucugcaccccaagccuucuccccuuauuuccucuuccaaaguuugaggguugacacgcaugggucaucgcccuuucagccaccgucgcccuucauccccucacuggccccaucugaaugggacugcucaguaucucugcccucccccuguaauuuguguucaguaucucugcccuuccccuguaacuuguuuuuguuugcuuuagggucucugaggaaugcuauaugagccagaguaaaauaggacauuuuccuuguggggacguuagauuuaaaggguucccaaaucuuauucacggauauuucucaggauccaaagacuuugaugaaccuuucuaguuuccuaagugcauggucauccuuguagggagcuuccucucuucuuggcucccucuuuuucucagaaaacuaagccuccaguuuaaggguccucaguccccuuaccacagaaggcacaggucacucaggagcucauguugagucuccacucuuucagaagccagugcagaccaguuuccucagucuugcucagagaugauacuguccuagacauuuccucaaaccucuaggcccacaguucguggcccacaugccccgaugcuauccacuccaugcugacccucccuuuucugguguagccugaaggacuuccugcccaaggaguaugugaagcagaagggagagcguaagaucuuucaggugaaugggguaggggaaagucugggaugaccugggagcuuggcugcuugauucuccuggcuaaguggacccuccuccuccaucucugcucaccuugcuuuacuccccaagcuguucuccugccugucucaugcacagaaagcagaagauguggguuucagccccagcucagcagcugugaaauuuccauuugggguuuugcuuuuuguuugagacugggucucucuuuggagcccaggcuggccuccaaagcacagcaauccucuuaccucagccuccugaggguugggguugugaauaugaguuaccaugcuuggcucaaccuaguaucuuccuugccuuuacucuguggaagccaaauaggagcauuacugagcuauuacaccugaaauuacugugagauggaaucuuuguccacauggaaaguguuauccccaucugaauacucagccccaaaggccuugucuuuugaacucugauggcccuggacccuccuacuucuuaacucucagucccaucugcagagcaucugcgagcucuuuaaccucauuucuuccauuguugcuucugcuccuuagccagcccacguugcaucuccucaucuugugccuuccuaaacccucccgugugcccauaauacucugucauugcaguuaacauccuaguguggcuccuucauugaaguacuacuccuacacagcuaacuuuccccauuuccuacuugaaggcacacaagaauugugggcagaugagugaaauugaggccaagguacgcuacgugaagcuggcccguucccucaagacuuacggugucuccuucuuccuagucaaggugaguucugaccuucuuauggccuucuuuaugucuaaauucuugcccuuuccugucucccuaaacuccuugguuugucuuucccaucauggcuuccuuuuaccgugcacauccugucuguugucaguccuuuccucagcuuaugccucuauccguaguagagcuuugaccugggccuaucugugagcacaguuguuuagcccuccuggccaucucagcguccccuugugguccagagcugcucugagcauuucccauacauuugaccuuuaacuuguaacaccaauuccaaccugucuuucaggaaaagaugaaggggaagaauaaacuggugcccaggcuguugggcaucacuaaggagugugugaugcguguggaugagaagaccaaggaggugauucaggaauggagccucaccaacaucaaacgcugggcugccucucccaagagcuuuacucuggugggugcuuggauuccagugguuguucaagagcaagugcacaggucuuucccuuccuuuaggguauggugcauugaauaugacugcaggacagaguuagguauuguggaaaguggaaguuagaggagauggagacguucuuacagagugaaugguauguaaauggcugggugacggauacacucuuuaaauccagcaauucagcagagcuuggagaguucuauugcugugauaaaacacccugacuaaggcagcuuacagaugcaggguuuaugaucccagugggaugagagcucaucaccaucaccgugugggagguggggcagccggcaagcauggaggcgggaacagcugagggcucccauuuuaaacugcaaguaggaagcagagagcaaacugggacugcuuaaagucuggauuucugaaagccugcccccauggcauaguuucuccagcaaggacauaccuuuuaagcauccccaaacaguacagccgaguguucuaaugccugagacuguggugcaggggugagaaugggaggcauucaaacuaccacgggguguuguaaccucagcaauaaagcacuugccuacuuauguaaaggugggaguucagucccuaguaccacaaaaaguaagaaaagaagaaaaaaaaggaaagaaaagcauguugggcauagucacguguguaauccuagcacuuagcgcucugagacagagggguuugcugugcauuugagacuaggcuggaccaaaugugaggaucagaccauccagggcuauuuaguaucaaaaagaggcagauaggggcuggagagauggcucagcgguugagagcacugacugcucuuccaaagguccugaguucaauucccagcaaccacaugguggcucacaaccauccguaaugagaucuggcgcccucuucuggagugucugaagacagcuacagcguacuuacauauaauaaauaaauaaaucuuuaaaaaaaaaagaggcagauaaaaaggaagucgacagaaacguagcuaugccagcaagcugaggugacaugaacuguaaggaaaagcuaauagacaagccucccuucuuucagcaccagcuauuuauggcuguucuuucccucugguuuuauaguucugagguuuugaauugaaaaaugauaucaacuugauagagugccagauaaugaaaauagaaaugagagaugcuguuucuccacuuuggaucuuuuuugccaaccuucaaggauggucauuuaauaaacaugcugcuaucgucccaguuguagccucuggggagggguaaagagucuaaaugacauguauaugaaacuguagcagaaaggccacugcucaagcaaaauauccccucuaaagagggagauaaggaaaccaaugguugagcuguagugauugcucggcaauuaugagcacugacugcucauccagagguccugaguucaauucccagcaaccacaugguggcucacaaccaucuguaaugggaucagaugcccucuucuggugugucugaagacagcuacaguauacucacaugcauaagauagauagauagauagauagauggauaucggauggauggauggauggauggauggaugaguggguggaucgacagauguuuccaugauggguagauucuugucuccugcucagucuccacccugucacucuaggacuuuggagacuaucaggauggcuacuacucaguacagacgacagaaggcgagcagaucgcacagcucauugcuggcuacauagauaucauccuuaagaaggugagugcuuccacccagccugagccuucucgggcccucugcucccuaagccaguccucuagaaaccggacccaaguucuagaaaauggccaccgacugccucuuacuuaauggccucaacucuucucccuuuuuuucuucuuacagaaaaaaagcaaggaccauuuugggcuggagggagaugaagagucuacuauguuggaggacucagugucacccaaaaaguaggaagggaguugggcugauccuguuccuugaauagggaaagaaaguuggacugcacagaaccacugggugacauccuuagacaguuuaggcacauucaggugcuuucaggccaggacagguguugucucccuaggaacuggaguucccugugacuggaacagugguuguaagcuguggaucugaguucugggagcuaagcucuaguccuugcuagagcagcaggugcuguuaacugcugagccauggcuccagcucaugguucuuucacuaggcucaggcuagaacaagacuucauuaaccccaagucaugaccccuuuggagggaucauguaucauauaaccugugugucaaauguaaaauacauuucaguuucuaauagcagcaauauuacaguuaggaacuagcaaugaaauaauuuuacgauuggacgaugagauaugguuagggauaugguuuugguaugguaaccacaacaugaugagaacucuguuaaagggucgcagcauuaggaagguugaaaagcgcugcccugaguccuagggcugcagagguauuguaguuuuuggucgugucuccaggucaacaguccuucagcagcaguacaaccgaguggggaaaguggagcacggcucuguggcucugccagccaucaugcgcucuggagccucugguccugagaauuuccagguggggagcaugccaccugcccagcagcagaucaccaguggccagaugcaccgaggacacaugccaccucugguaagaaugccccaccucugccguggcacacaggucccuuccugagugucaugaguaaacaguuuucuauacuccucuccccagccucuuacuucauccucgaagcguuccauucuggucucugcuccucucucccuaucuuuuagacuucagcccagcaggcgcucacuggaaccauuaacuccagcaugcaggcugugcaggcugcccaggccacucuggaugacuuugagacucuacccccucuuggccaggaugcugugaguaugggguagagaagaagccaugguuucaagcuggggcucuaaggaguagagaggguaaguaaaccagagcagacccuaagguuucgccuuggucucucaggccuccaaagcuuggcguaagaacaagauggaugaaucaaagcaugagauccacucccagguagaugccaucacagcuggcacugccucugugguaaaccugacagcagguaggcuggaugccacccuguguaugugggaaggggugggagagcgggugugcacagcaugguguguggugugcuccaugugugacuaccuugacuguguggcaaguuguggguguguccgucucuaacugcaaugguacuuccuccccguguuccaucucagcaucuuccucucuccgauuucugucuuuaggagauccugcagagacagacuauacagcagugggcugugcagucaccaccaucucuuccaaccugacggagaugucccguggggugaagcuauuggcugcccugcuggaggaugaaggcggcaauggccggccccuucugcaagcagcaaagggccuugcaggggcugugucggaacugcuucgcagugcucagcccgccagcgcugaggucagaggccacagggcuguggugaggguggacacaggguuccaccccgagaaggcagugugacccaggagcuagugagaccuguggguccauggccagcgucaagcagcuucugacaggugugcacucuccacagccccgucagaaccugcugcaggcagccgggaacgugggccaggccaguggggagcuguugcagcaaauuggggaaagugacacugacccccacuuccagguuggugauaaacccagcucccagagccccacuccuaggagagaaucucugacccgaaaucuagagcuuaguccuucuuucugugaauugaccuauccaaaccagcccaaucauguuuccagauaugauacugagaacuucuagucccaugggggugagaauucagaacaaauguaauccccugguucaauuugcccuugaugauguucuuagcccugacuccccuguacauagcccagcuuuaagcuaucucaagacaccccugccacacugaggaugauguccuucgagcuaccccuucccuucccccaccccagccaaguugccucagcugacuuuucacccuggauuuccauacagauguguguacccagaggggcuggggcuccaucuucccccgauuccccuacgguaacggucucuggccugggccuucccagcuuggucuucucugagccgcauacacucgcuuccacgccucuuccucacccucccaggggaacagacaugaugggagauggggaggccuagacugacaggguugaagaaaagaaaucagauaggguaggacagggucucgcucccaaaccugcagaugacuccuugcacccugagauugaguagcauggagauaggaaaugcccauccaguguaccgccugcuccucccuccccaucacuguccgaguguauccgccucaugccucucucccuuugguauagauucuguuucuguuggugaggguuuguucucggugagcgucucuccuucugggugcucaagguagaggggcuugggauagguucuaaaugcuugugcguauacuguccucugauuggaaucagcgggaauaaugaagccgcuuacgccugugagaaguguccguggguucuaucuaaguucagucucaggucucacuggccacuuucuugcccucaggauguucuaaugcagcuagcaaaggcaguggcaagugcugcagccgcccugguccucaaggccaagaguguggcccagcgcacagaggauuccgggcuucagacccaagugauugcugcagcuacgcaaugugcucuguccacuucccagcugguggccuguaccaaggugagcccagauuugcgguauccccugccucugaauaauauuaccagcauauguacacaaaccucucauucuaucucugacuccuggggccucagcaccaccccagugacuaccaggaaaacugcagagacccaucucacagcuccucuguugccugcaugucugaaauucuuuucucauaggugguagcaccuacaaucagcucaccugugugccaagaacagcuagucgaggcugggcgacugguggccaaagcuguggagggcugugugucugccucgcaagcagcuacagaagauggacagcugcuucgagggguaggagcagcagccacggcugucacccaggcccucaaugagcugcugcagcacgugaaggcccacgccaccggagcugggccugccggucgguaugaccaagccacugauaccauccucaccgucacugaaaacaucuucagcuccaugggugaugcugguaagaguacucgccuccggggaaacaaaagccccggcaugggucccccacacccaugggcauaccuuauagauccagccacccagccucugaggaucagcacaguggccuuucuagcucugucccucugggcucauuggucagucuaaagccuccacuuccccauugguaaagcagaaguauaagccuuguucuguuuccuuggcgcacuuuaaaaagagaccaaguuuaugcgcaguaguagguggcaaggugcaugguuaagagcuagcuaggcuuguaaacagggaaggagacggggaaauuagccucuccacuucagcuuccuaccccgaaccacucaaaggagacugccucauccucucaagacaugcacuagaaauacuagcuggaaacuggcccuuccucucaugggaccucaccgggagaucuguccugagaucuuaacccaggaaccuggaccucaggggaaaucguuugagaccuuugccagucucuucucuguuccggaaagcccacucacccuccucccuauccucugucagugucucuggcuuucuuaccugcggcucuccuguguucuaggggagauggugcgccaggcccgcauccuggcccaagccaccucagaccuggucaaugcuaucaaggccgaugcugagggggagagugaucuggagaacucuagaaagcuccugagugcugccaagauccucgcugaugccaccgccaagaugguggaggcggccaagguacaaagucgguuucucuacagacccugaaggggaggugggaguggagagggccagcuagggccuugucugaugggaugacccaccccaggaaagcagaaaguagaagagaauagauaaggaaacugccaggaagguccuggcucccagccugcaggucggccaccagccaagcauauagccaugugacugacucucacagugcacucugaccauggggguccgcauucuucuuucauguugaaggucugcuguccccacuuuccuuggguugcugccacaucugcuugcucucuguucuugguacccugugaaggcagagagccuuuugguuuagaggucuccacuagccauacagaauaggaucacauuagacauugacaccccagguguaaagaccaucagaggggaccacccgccaaagguccccugggcuuugcaacugcuacagauuccugaggucccuucuccagagagucuuccccuccccaggccugccugcucacacugaguuaaucacacggagaguucuguaggacaggcguaguuccagugaaagauucacauccuaguggcaaugagguacccggggaccccacaaccuguccuuucugaaacaguuuucagcucucagcaguuaaagccucagugaagguaauucgaaauuagaucaggaaaacaaaugaguuuuaaacuggacuuagaggauugagaaaagaguguauuugaaucaaagugaugguggaugacgcuccucucagggagcagccgcccacccugacagugaggaacagcagcagcgacugcgugaagcagcugaggggcuucgcauggccaccaaugcagcugcgcagaacgccaucaagaagaaguuggugcagcgccuggaggugaggcuggggaucugggcagggucuggaaggauaaaugguggauacagugggaggggugccagggauggaugguugccuuaggguguagugagggccugggaaugccuggccuucucauuccucuguccucccagcaugcagccaagcaagcugcagccucugcaacacagaccauugcugcagcccaacaugcagccucugcccccaaggccucugcgggcccccagccccuacuggugcagagcuguaagguaagccuccaaggggugugcgggaguguggagcagugagaaggaggguuccagaauaugguacucaugacguuuugaccuucaggccguggcagagcagauuccguugcuggugcaggguguccgaggaagucaagcucagccugacagcccuagugcucagcucgcccucauugcugccagccagagcuuccugcaggcaagacacuccacuucuaagaccagacccucccaugucuccaugaccuuaaauuucccagucugaauaucugcuauuagccaagaccaaaccugagugcuuacuguauccugaccagugucuguucaaagcuagagggagguugacauaccucauuugcaaauguguucuccaacagccaggugggaagaugguggcagcggcaaaagccucagugccaacaauucaggaccaggcuucagcaaugcagcugagucagugcgcaaagaaccuaggcacugcccuggccgagcugcgcacugcugcucagaagguauggcagccaucuagcugugggacagaaggaaggcgcugcccagagcaccugggcuggggagaagccagacagaguagccucuaagacggaggacuguaaccucugcugcucacugccacaggcucaggaggcauguggaccuuuggagauggauucugcacugaguguuguacaaaaucuagagaaagaccuacaggaaauaaaagcagcagcucgagauggcaagcuuaagcccuuacccggggaaacagugaguagucuuauaaagcgcccucguucaaacccugaacaucucagcagugcuauagaaccaucauugaaaccgccagccuuccccaagaacuuucucagaugcccccuugcuuccuccuccuccuccaccugagccuucauaccccccccuuaucugcagauggagaaguguacccaagaucuuggcaacagcaccaaagcggugagcucugccaucgccaagcugcugggggagauugcccagggcaaugagaacuaugcagguaugucugcagggcuaggaauagggcuggggggacuuguggguaaggggcugauagagcaaaccucuguucucuguguguucccagguauugcagcucgggauguagcugguggacuaaggucacuagcccaggcugcgcgggguguggcugcgcugacaucagauccugcagugcaggccauugugcuugacacagccagcgacguucuggacaaggccagcagccucauugaagaggcaaaaaaagcaucuggacacccaggggacccagaaagccagcaaaggcuugcucaggucagaggucgggaaggggcuccuacugaccgcuugcuuagggcucuucacaaggccugccuaacagggcacacgcucuucuguuuccuguguucucaggcuggcuaauagacguguguguuaaacuaaggcacaaaccucccugagcagcagguugggguguuuguagguguuuuggaauggguuauugcuguguguggcccuaaccucagcuuguucagcuauaaaaguuacuucuccuuccaguuuuagugucaggacagcugguuaucuccugugacccaguguaaaaaggggcucucccaaauuacucccucuuuggcaacccuguuucccacuucagguagcuaaagcagugacccaagcccugaaccgcugugucagcugccugccuggccaaagagacguggauaaugcccuacgagccguuggagaugccagcaagcgacuccugagugacucgguaagaggaccgggcauggcuaacggaggacuuugugucucugggcucauccuucgacccugccgucccagaucugugucuucucacuaucccaggcuuugcaccacuccccggccuucccuuccuaaacucucccuucccaucaccccccucaucucucugacguccccucuggccccgcagcuuccuccaagcacggggacauuucaagaagcacagagccgauugaaugaagcugcagcuggguuaaaucaggccgccacagaacuggugcaagccucccgaggaacuccucaggaccuggcucgggccuccggccgauuuggacaggacuucagcaccuuccuggaagcugguguggagauggccggacaggccccgguacgaagggucuaguugagagcaaaguaggguauugagaaucuaggucugcccugcuuccuucaugucuagucugauagaacuggauacuugggaaagggcguccuuuuagagacaggcaugacagaguaauguaugcuucccuuuaacagagccaggaggaccgagcccaggugguguccaaccugaagggcauauccaugucuucaagcaaacuucuccuugccgcuaaggccuuguccacagacccugcuucucccaaccucaagagucagcuggcugcggcugcccgguaagcuggaaagcccagcucuggggagcugugagaaggccaaagagaagacauuucaugagacacucugggcauagcaguaguaaagcaaaagaaaaauauauacaaucccaugcauacgggacucaggaaagaugaccuacucacucaguuccacacuccccucccccaucagggcagugacggacagcaucaaccagcucaucaccaugugcacccagcaggcaccuggccagaaggagugugacaaugcacuucggcagcuagaggugagccuucagcaugggagcgggacugaggagccggccggggcugagggagaaucaaacuucaugucacucucccuacacagacaguccgagaacuccuggagaauccaguccagcccaucaacgacauguccuacuucgguugcuuggacagugucauggagaacuccaagguuagugggacgaggagcugcagagacagggacauggaaggugauguaacacuggugcucagugggcaugaucagagccugauuccacucuuccuuagguccuaggugaggccaugacuggcaucucccaaaaugccaagaauggaaaucugccggaguuuggagaugccauugccacagccuccaaggcucucuguggcuucacggaggcagccgcacagguaauuuccuaagguggacccgagagcagcucuugcuucccaugcaugcccuuucucccuuucaaagcuauaaaucaagaagcucaugugagaucugggucucccuggggggggggggugcggagguuggggggggagcaguggucaucagaagcuguugaaugcaacaguccugguugcugugacugcucggauuacacugaccagcugugaggcuuuuacuacugcugcuggggauugagcuaggauugagcuagagcccuagccgagcuacccccacccaggugaagcacuuguaucaguuacaggggagggagugucagggguaggguuacuuuuaauccaagcaccugcagaacaaguggaucucugaguuugaggccagccuggucuauaaagugaguuccaugacagccaggaccacacaaagaaacccugucucaaaacaaaaauaacaaaaaacuguccugaggguuucuuugaagcuguuuuucuuuccuagaagccugccugccauuuucccucacccugucccuuugucugacuuccacucuccccacucagagccaguggcuugacucuuauuuuuuauuuuuuuaaugugugcgaguauuuugcuagcauguaucucuguaccaugugagugccacgugccuucagagaugaaaagauggugucagauuuccuaaaacaaguuauggucuugagucacuaaguggcugcugggaauugaacccaggucuucuacaagaacuagugcucuuaacugcugugcugucucuccaggcccaggcuugaccucuaaaacaucuuccugguuuuuuguucuucucuuauuuuucgggaaacauacagaagaaaaagcaaagcugucauauguuaauugcaguaugaauugacuauuaugaugucuucccauuauuaaaauuagaaaucuuuguauccauccauugccaaagcucggugguacuguugcugcuaaggccuuaacagccuuacuucuagaauugucuuuuccucuuuuuccuuuuuuagcaggauaguccuuggcuggccucaagcucacuacguagacuaggcuauccucaugcacacacuccugccucugugcgugcacauaucuuccacauacucacacuccugccucugugcgugcacauaucuuccacauacucacacuccugccucugugcgugcacauaucuuccacauacucacacuccugccucugugcgugcacauaucuuccacauacucacacuccugccucugugcgugcacauaucuuccacauacucacacuccugccucugugugugcacauaucuuccacauacucacacuccugccucugugcgugcacauaucuuccauauacucacacuccugccucugugcgugcucauaucuuccauauacuucuguugccacuuggcagugcccugcacuuguauuuuucauucugugacccacaaacacacacacuucuaaacugaaaugaagcucacuaaaaaucuuuuuuuguuguuuuuuuuuuuuugagauggcgacuuacuacgcacuccaggcaaacucaccaucaccuuugucuccuggguauuggaauuauaggcaagcaccaccauacccaaccuguguaccuuuuuaaauagauucugaaauaguugggucaguuuaacaaaauaaguuuguuuuaagcugggugacggugguuucuuauuccugcuucucuccccagagaacugagaaagauacauucuguucuguaaccccaccuuccccuccuccacuguucauuucuccuuaggcagcauaucuaguuggugucucugaccccaacagccaagcuggacagcaaggacugguggaacccacacaguuugcccgugcaaaccaggcaauucagauggccugucagagucugggggagccuggcuguacccaggcccagguaauacaagagaacagguaccaugggcgggcugagaaaggaugggcagacugcaagaggaaagagggaggagaaggcaagauucgucccccaccuuucacaagggcuucucgccgugucuccuuguucuucugcauagcacugagggcacguccucucucgagacugagcccauccucccacuugucccacuuagaucuuucucuauuaauguaucuguuguccuuuaucccgccuccauguccuguucaucuuugagcaccuuuuucucccagaccuccuaacagacuucugaggugccauccuuuguccuccaccucugaaauggcucccuuagguuugcauucuuccuuccggcucuuaucacagcuuuucuaucucugucuccucagguguuaucugcagccacuauuguagccaaacacacaucugcauuguguaacagcugucgccuggcuuccgcuaggacugccaaucccacugccaagcgccaguuuguacagucagccaaggagguggccaacaguacagccaaucuugucaagaccaucaagguucgacuguuugaauuuucagguucccugacccaagccaccuucucugccugagucuccuacucauuuucuggggucuuuugcuagauucuccuauccuugucuauccagucuuccaguccucugagcccuugaggguggccuggguuucacuugugugcccgcuugcuaaguccuaaggcucccuguucccuucaggcacuagauggggacuucacagaagagaaccgugcccagugccgagcagccacagccccucugcuggaagcuguggauaaccugagugccuuugccuccaacccugaguucuccagcgucccugcccagaucagcccugaggugaggcacugcaccagagacaccacgagccacuucaccuucgugagcauaagucaugagacucgccuccgucccuccucucuccucagggcagagcagccauggagcccauuguaaucucugcuaagacaauguuggagagugcuggagggcucauccagacagcucgggcguuagcagucaauccccgagaccccccacguuggucugugcuagcuggccacucucggacugucucagauuccaucaagaaacuuauuacaagcaugagguacugaggguuaggaggcauguguggcuggggacaaacaauguggcagaugacugaguuggaaugagguggcacacugucggaggggaggggaggguaaguaacagccuuuaaagagacuuuaagagugaugucucugcagggacaaagccccagggcagcuggagugugagacagccauugcggcucugaacagcugcuugcgggaccuagaucaggcuucgcuugccgcugucagccagcagcuugcuccccgugaaggaaucucucaagaggugaggagaaauguguugaagaguggagaguccaggcucagggagggugugugggggagaaggaaggaguucagaagaaucuuuacuaagacaucgaaggcugggauaugcuggagcuggguaaggaauuagauauggaaggaagccgggagcugggguguaacucggugcuagcguaugaagcacacacgaagccccaggucccauccccacgaccaucacaugcgcaagcaguaggaaggaagaaugggguucugccccagagggcacuguuagaguuacacucagauuugaugucugcuuccucccaggcuuugcacacccagaugcucacugcagugcaagaaauuucucaucucauugagccgcuggccagcgcugcucgggcugaagccucccagcugggacacaagguacguaaggaaucgugugaggagcugaggagauagguuaacaguaccugacacugaacccagcgucuguuucaggugucccaaauggcccaguacuuugaaccacucacccuggcugcagugggugcugcgucuaagacccugagccacccacagcagauggcacuucuggaccagacuaaaacguuggcagagucugccuugcaguugcuauauacugccaaggaggcuggugguaaccccaagguagaaaggaggcccagggggcggggagaauaauuguuagcacaaucuagaaagacaggagcuaaaggcuuucuucccucauguccccauagcaagcagcacacacccaggaagcccuggaggaggcugugcagaugaugacagaggccguagaagaccugacgacgacccucaacgaagcagccagugcugcaggagucguuggcggcaugguggacucuaucacucaggccaucaaccagguuagcgccucggguaccugcggacacaggguaccccagagggacucuggcacagaagcagugacccugacagucuuucuccguuucaucccccucccucagcuagaugaaggaccuaugggugacccagaaggcucauucguagauuaccagacaaccauggugaggacagccaaggccauugcugucacuguucaggagaugguaaguuuggaacaugaggagugagugcccuuagggagcugagcuuggucagaacuucacuucuuuccuuaucaccagguaaccaagucaaacaccagcccugaagagcuaggcccucuugccaaccagcugaccagugacuauggccgacuggccucacaagccaagccugcagcuguggcugcugaaaaugaagagguaaacauggaagccauacugccuucucucaggagauuccaguucauggcccuuguuccccuggcagcucccagggcugucccacgcucccucacucuaguuagucagauaaaagguacaccuucaaggccacuccauagagggugagcaaggcuguguggacguaaaggaucaaagccuucagucacaggucagagggauccauagcucagaauccaccggcuucuggcuucugcuucucuagccucugucaacccuagugagaccuauggcaccgccucugcugggcugagucuccucccucccaaguaccuccguguggcaaauucaugaggcuuauccuugcuuaagcucuuggcuuuuccuuccaagaaagugaguaacuggaucuuaguagggcgugccuaauucccagacccuccauaaacccaaacaggcuggaucauagucuacggcucugauucaaauaaccaagcauaagugcgucucucccugcucugcacggugcuuagcacaguccucaccgugcggugccuucucucacuauuuccacgugaagcaggggacucgugcuugacuaugaaagcaaaaaaagcugugcagggaauauuuucuuggaacuccguuagucugugguacauguuucuuuuuuucuuuuucuuuuuuuucuuuucuuuucuuuuuuuuuuuuugguuuuacgagacaggguuucucuguguagccuggcuguccuggaacucauuuuguagaucaggcuggcuuugaacucagaaaucugccugccucugccucccaagugcugggauuaaaggcgugcgccaccaucacccggcuacauguuucuuuuuaaaguuuguuuguuuauuauuaguguaugugugugugcgguuuguguacaugucauuuagaggucauaugacaacuuggaagagucaguuuucucccucacugugaguuccaggaaucuaacucuggugaccaggcucacacaguguucuacccacugcuccaucccacucauccaaguuuuugagcauccuucaugguuccucuaggugcaguggagccuucugagcacucucaaaaucaccaauguucccucucuguuauucacagauaggcgcucacaucaaacaccgaguacaggagcugggccauggcugcucugcucuggucaccaaggcaggugccuugcaguguagccccagugaugucuacaccaagaaggagcucauagagugugcccgcagagugucagagaaggugacugcugaucuccuggggcugcgugucuuucccaucucugugugccuccccagugccuguuccuuguccucucaagcauggguaacuuugcccuuucccuuugccuacaggucucccauguucuggcugcacuccaggcugggaaucgugguacccaggccugcauuacagcagccagugcugugucugguaucauugcugaccucgacaccaccaucauguucgcuacugcuggcacacuuaaccgugagggugcugaaacuuuugcugaccaccggugagcaggggacugcccggagggagggagguuggcgcgggcccaaggaagacugggcuggagguugggacucuugaggaaagcugaccaggcuggggccuccccagggaggguaucuuaaagacagcaaagguucuuguggaggacaccaagguccuagugcagaaugcagcugggagccaggagaaguuggcacaagccgcccaguccuccguggccaccauuacccgccucgcugauguggucaagcucggugcagccagccuaggagccgaagacccugaaacucagguagcuacccaacaucccuaacucugucccaagccucacuuccuguugcccuuccccccucacaaagcagaguaaugucucccacacagguggugcugaucaaugcaguaaaggacguagccaaggcccugggugaccucaucagcgcuacgaaggcugcagcgggcaaaguuggggaugacccugcaguguggcagcucaagaacucugccaaggugggaagcagugaggagcagcagcaggagggauggggaugguuaacacacuuccuacugcuucuaaagauggucuccucccauuccacugcugcccucaggugauggugaccaaugugacaucauugcucaagacagugaaggcuguggaagaugaggccaccaaaggcacacgggcccuagaggcaaccacagagcacauacgucaggaacuggcgguaagcacaagccaggggcacugggugauaggcugugagugaggccucuccugcauuccucagcgcucugcuugcucauuaccauacuucccacaucgccacgucucucugcugagcugcauccuggccaaaaggcgcugcucaaauuugagucucuccucagacagaaccauggccagcacugcucuguauuggcuuugauauaggaauaucugcagggacuuuacccacaguagcuacucuagaaaagcuuuuugcagcucacagaauccacuaaccaggcucauaagggcucacagagauugaaccagugaucaggggaccugucuggaucugacccagguccuccgcguguauguucugguuguguagcuuagugguuuuuugggguuccuaacagugggaaguggggguguuggcucuuuggccuguuuuggagacccuuuuccuucuacuggguugccucauccagccuuacuaugaggauaugugccuagucuuacuauaacuugauaugcuguauucguauuugguuguuaucccugggaggcccgcuccccagaucugggggaggggggaagugugggggagggacugggaggagagaagggagaggaaauuucuguuaagagaaaacaauaaauaagaaagagaagaaaaacucuuuuugaacacguggauguuugaacuaagucaugacuguugccuucccaucuuggacaccauaaagucuuucuucuuuuuuuuccaacaggucuucuguuccccagagccaccugccaagaccucuaccccugaagacuucauccgaaugaccaaggguauuacuauggcaacagccaaagccguugcugcuggcaauuccugucgacaggaagaugucauugccacagccaaucugagccgacgggcuauugcggacaugcuucgggcuugcaagguagacaugcggguagugagcuaggcuucgggggggggcgggggucugaagcucuaaagcuaaccugcugcucuggggacaggaagcagcuuuccacccagaaguggcgccugauguacggcuccgagcccugcacuauggccgggagugugccaaugguuaccuggaacugcuggaccacgugcugcugguagggagggagggagggagggagggagggagggagggagggagggaggcgccgcuccuccucacaccaaacccacccaucaccugucuccaaaucauccucauuuccaaaccuucuuccugucuuggcuucucccacuuacgucuuccucuucucuuuucuccuuuucccaccuggccuccccucucuaccuucuccucucaucucaucacuccuugcuugucagccggugaguggcaccccacacucuucccuguguggagccugaugcacugugugcaccugagcaggaccugguguuuaagggcugugcugugcggugcacuagggacugugguugggagcauggcugcccuguuucacaggugaaugugaaaccuaggaccugaugcucuuugucgugcgcucuguccccacacagacccuucagaagccaaacccagaccugaagcagcagcuaacuggacacucaaagcggguugcuggcucugugacugagcucauccaggcugcugaagccaugaaagguaagaaguagugagagacaggagggaagauacguucuugucaugguccaaucucugcuuccugguuggcucugagcuagccugugcuucugguccucauagaugagguguugcuaaaugaacuccccagugccuccgagcucccugcccugccucagccuccucuccugccuucgucccacaggaacagaguggguggacccagaggacccuacugucauugcugagaaugaacucuugggagccgcagccgccaucgaggcugcagccaagaagcuggagcagcugaagcccagggccaaacccaaggucagggcuccucccuccccuuccgccugucacagcggccagaggucuccaccucugucccuuuccuuuccaugacccuccccccaccccgacuccccaucccuauguaaccuucucauuccaggaggcggaugaguccuugaacuuugaggaacaaauccuagaagcugccaaguccaucgcugcagccaccagugcacugguaaaggcugcgucagcagcccagagggagcugguggcucaaggaaaggucaguacuuuagcaccagaggaaugaggacaaggcgcucacacccuuagccucacaagucgcucugaaguagggacagccuaggucuaagaggacucccuucuuccuucugcaggugggcgccauuccagccaaugcacuggaugaugggcaguggucgcagggccucauuuccgcugugagugucuaacacccagggugucuuuccgagcuggguaaaccugaggaggcugggguggaauggaccagagcaagaggcauacucuaaucuuaacucuuuguccccauuaggcccguaugguggcugcggccaccaacaaucugugugaagcagcuaacgcagcuguccagggccaugcuagccaggagaaacucauuuccucagccaagcaaguagcugccuccacagcucagcuccugguagcuugcaaggucaaagcagaucaggacucugaggcaaugaaacggcuccagguaagaaacugagugacgcacugucucgcugcuacacugcuuuaaagcgccgugcugagggccucucgucuccuguugcuaaugguaagaauacccuaacaagagcaguuuaagggagagaaaguucauuuggcucaugauucuggguuauagaccaucaaugcuggggacucacgguagcaggaacuugaagcagcucguucagguacauucacaggcaagagcagagagcugugaguucauggcugcaugcuaguguucagcuuucccuccucauagaauccugaguccccugcccaaggaguggugccacccacgggugcuagcucugccccugaaugcagucaaaacaguucugcacaggccagccuaauccagaccguccuuccuugagacuuccucccuuccuaguccuguggaaggcugaugguuagcacuguguagccaugauaacggucucugaacuagaacccugaguucucaggaguugcuguuugcucccucugcaggcugcuggcaaugcagugaagagggccucagauaaccugguaaaggcggcccagaaagcugcagccuucgaagaccaggagaaugagacggugguggugaaggagaaaaugguugggggcauugcccaggugagccucucagaagacacuguuggggacaguguuaccugcacuaucccccugccucugcccccagugcacaucuuucugagucgcuuggcccuucaucccucagauuaucgcagcacaggaagagaugcuucggaaggaacgagagcuggaagaggcucggaaaaagcucgcccagauccggcagcagcaguacaaguucuugccuucagagcuucgagacgagcacuaaaaaagcccuguguauuuaaugcagacccagcccagagacugugccugccacuaccaaagccuucugggcugcucaggacccaagcugcccaaccccagcacucccccaaagugccugccaaacccugggccuggcccugcccagucccacugcaagccguguccucucccugacucccaagugccuuugcacccuagggccccuaagugccugccccccuccagaguauuaacgcuccaagaguauuauuaaugcugccguaccucaguuugaaccugccagggccccagcugcuccagccugccagcagcuuccagccaguccccacggccacgucagcucaacucaucccuuuuugauacuauauccccuacccagcuaccuauggggcuugaggguuguaaacccaaacaggucagacuccaauaaaggugauucuacagcugcag

SEQ ID NO: 1857 - RNA, 12428 nt, Mus musculus
cgacuugcggggugcuuccggccggaaagggauccgguggucccgggucugcgggucaccuucccagcgguggcaccugagcgugggcgcgggggauccuggcugcagggacccgguacccagcccuggagccgcuggagccgcagcccggggcggggccgaaggucgccgggagcuccugggcgggucccagaggcggugcuuugcgggcagguaccgcggcaccgcccccguccguggagcuggucggcccucggccgggcgugcuaaucaccgcggcccaaugacaacaaggcccaacccuucccgccuaggaucuagagacgcgacccagggagaggccguggcgacuuuguugcuguagccgcugcugcagcagcaggagcucucugacuuuacccagauaccaacgucccacggcuuuccccagcaucgggcccucccggacugcaccuaacugcaacuggcaucagcguuuugaaacgucagaaaccugucagagggaaccgaggccaccggggucgugaggacccaggauccagugaacaugguaaccugcgucccggccucagagcaggucggcugugccgaaagagauucccaaguuuauugugaagauacuggcggcacugaggcugugcggguuacagacugcgggagccccgaggauaguggaccccaggaugaaccaagcuacugcaauucagaggacucugggcagcugauggccuccuacgaggguaaagcuaggggcuaccaggugccuccuuuuggcuggcggaucugcuuggcucacgaguuugcagagaagaggagaccuuuucaagcuaacaacaucucucucaguaauuugguaaagcaccucgguaugggcuugaggugaguggauuccguugccuagaacgccgugguuccuaugaucccauucaggcucccugccuagguuggaaaggugggcaagcugcugggcuccuaguucuauuccagccagguauaccauauccccugcauucuuuagcccugcaguuuuugaggguggaacugaagaacauuuuguuuuuccuucaucccucuuuuccuagcaucuugucuucucggagcauuuaguccugaagucagucuuuccuauuuaacugcuggucccccuuccccccacccccacccccaccaugcacuuccucuuucccaggcgucccuuugagauuagcuauaauuuguaacacgguaggagaacgccagucucugcugugcuugauacaguguuuuauuuuuuggaagaggagguucuuuaggcugcauuacccuggcagcugacaccuucuguguaccuuauuuaagcgcaugcuucuucagucccagaauucuuaugucucuauccucaagcucugauuccuggaauaguugaucuuggcuguugucaacccuaaagagagggugagaaguucacucuguucugugacagauggcuuccauaccaaaaauaaaagcgaaguugggauugggcagaguccuagagugccaccuacuugggaggcugagacaggaggauaauuugagccuaagaguucagggcauacuugaacaucacagugaaagcauccuccgguaacaaguggggagagcuagggaugaagcccggaaguagagagcaugccuucuaccacggagaugccuccccagaccucuucagaugacuuuagccagcagugcuuugcuggucuuccagcguuuccucauaucccagagguuacaaacacugcagggcagguucuacagaagcuucuggauuccccacugaguucaaggacuagugaugaaggagcauuccgaugaacaggaacaggcagacagacagacagagagcaucauucugagucacuucacauauaaacacagcacuggggagggaagcauaaaagucaccaaacucagcccccaaagcuucuaaaguaagggucccuucucugccgcggucggugccguggagcugugguggggaggccacuuaccuaagccuagcccuaggcagugaagagggccuggcacugccuggacauuuggcuccugcggguggcccaucucagagagucgucccuccaaguaaguuaggaagcuaguggucaaagcagacaaaaguaacuucaggaagaguuuguuugaagguacgacccgucugucugucauggcagagaagugaugguggcagucacacgguaucgcagccaggagcagagagcaaugaaggcuagaacucgacccucuuucuccuuucuaucaugacuccaggaccccaacccauggaauguagucacccacaguuaaggcgcaucuucccauuuccauuaaccuaaaguauucauuccucacaggcacguccauaggcuucucucuuuggugguucuagaucuggccaaguugucaguaggaauuaacaaucaugggcuggaaagauggcuuagugguuaagagcacugacugcucuuccagagguccugaguucaaaucucagcaaccacaugguggcucacaaccaucuguaaugagaucugauguccucuucuggugugucuggagauagcgacuauguuacauuaaauaaauagaacuuaaaaagagagagagagagaacaaucauauuguuccagccaaauucuaaccccaaauccuuugugucaaaaugggauccaccguacugagauaggcacaugugguuaggauaaggucaagaacagguaugcauucauccuggccucuuagccugcuaaguaggagcugaguuacagaggcuucaagcucuugcucagccccuuagaccuuguccacacagagcuuugggaaugggcuaagguccuacacggaggagagagcagagggggugauucagaacggucguuuuuaagcuggaauugauacuauugaaaaaaacugaauaucucaggaaugaccagcaaccaaacuaaaggagggaacccuucagaguucaacugagggguagccucauaggggugcuggcaggauaguuauuagacuuucaacuuagaguucaauuuugauuguucuuccuuuugccagagucagcucacuuaauaaauguuuacuaccagagcggccuuuguucugcccauuuuuguaucuuguaauucgucucugauccuugcuggcuucccauugcuguccuauuuccuguaaacuggcagagggccuucagccuugcucccaccccauccuuagucucccaugccuuuugccccaccccaggacaugccaguccuauucuuuuuaguguauuucccuucucaacuccggauccacucugucuuccauugcucuuucuaugucuacuguuuguacauccauucauauguaaauucaccaucaaguauuaugggaugcaggcccuguacuuagagcuguggggaacauccaccuagucuuggucauuguuccuuaacccaaggaacuuaaaaauuugucaugcucaugugaggaacacacuggcauaacaaggcaguaucuaauuaggagcuaagacacuguguagcaauagucauaccuggcacagauauuccacuuuauggcuuucuuaucuguuagguuauuugaucuuuccaugauuauaugagguagcuagggcagaaguuaucccuauuccgcacaggaggaaacaaaagcuuggcugacauaacuaauuacuuguuuagacugaauguugagcaugaaaugauugguuaaggagaagaguggaagugggaaagacgggugggcgggacucgcuuagugacccauccugaaugagaguggguaaggaauaagauuaguaggcaggcugaggcagauguccuagccgugagaauacagacaucuacuccuaugugaccgacagcccugaucauuuucccguuggcuacagagcaaggcaagaacagggaaacacugagacuuguuagaaagcuuuacuauugugaguauucugacuuuguuuuguugagaaagguucucacuuugacgccccgguugucucggaacucauuacauagcccaggcuagccucaaccccaaguguugguuugacagauaugagccaucaugaccaaguuaauuuacuggguauuuuggaagaacaaaaucuggaaacugaaaauuaaaugcuaaaguggggaugaagcuuaagaggaaaaggucccgaauaugugcacaucaguuaucuucagcuaagguggcuuccuuucuaccugacauauuuuccaauuuuucaccuuccauaaaugaaaucguuuuuaaaagagggagucuuuuuggcagccucugcuuggauguguggaggaggguguagcuagcccgggaaggcaacugaccuuaacacagacaaaagcuccugagguuugagcuaaagcggugguaguggaguuagaagaaucgcuucucucucagaauagagaaauaagggcagccuacacugguaccugggcagcugggaagauaagggaccuugaacuggagcagucagaggaagauggcuugggagauacuagugaugggucggcccuaggguguugucuuagacagucucaccauauagcccaugcuggccucaaacuuguaaugccucugccucagcuuucagaaugcuaagauuuuaggaauguucauggaauccagcauccuugggacacugaguuggagaucacacagaggugacaaaggaaaggacggugaguguagcuuacaagaaacaagccacucaccuuacacucacacagacacuugcuccucagguacuugaaguggugguaccgaaagacccacguggaaaagaagaccccuuucaucgacaugcucaauucucuaccccugagacagaucuauggugagucucagcucagcugcccuuuucaaagaggguccaacuucugugcuucaggcaaaaaggcuccuaguuuaugcauggcuccauucccuaaguuuuuaaagaugugggcuugcuuucuucuuccaguucuacaccagccauccugacuuucuuucuagguuguccccuggguggcauuggaggaggcacuaucacccggggcuggagaggccaguucugucguuggcagcucaacccuggaauguaccagcaccagacagucauugcagaccaaguaaggaaggggguugggcaggcagaggagugacucuuggcuagcauaggauguggcaguuaggcauccacaugguccaguucaguaaaugcuuucagaaugcgugugccccgcucaguacuaggauggacaguugguuaaagaugaacacagaacccauguuccuugaaagaauaaagaaacagccugauaaaucucauguacuaaucuucugagcacuagcucagucaguacccaccaaagacuagaaauuucuggaucauuuaaacuggcuaaaagaacauuucauccugcauggagugguacauccuuauaauccuaauuuuugggaggcagaugcaaaagaaucaggaguucaaggcuagccugggcuacuuaagacaaaacaaaauggugggcaguaagauggcucaacagguaaagccacacagguuugacaaccugcauuccaucccuggaccugcagggcgagaggaagagaaccaggcccuacaaacugucuuugaagcuucaugcauaacuuuacuguucacgguggcuucugcaugcugugggaucgguguaaagaucagaagacagccuguaggaaggagugggcucucaccuucuaccaugugggcuugggagauuaaacucagguugugaggcuuggugacaagugccuucacuggcuucagccaucuuggcuggcccucaauuuuuuuuuuuuaaagaauauucgaaaagacugaaagagaaaaagugaaaccuaaaaagccauggugggaaaaggcgcacagugcuaagucuccuucccuagauuaguaacgcuuuagccuagguuagcgcccuugccgcagaccucugauggucuucccaggacccccuuuaacucuucucucuagccuuccucgcucauaucugggccuuaauugucaguguaugcccugcccuucaccaaggcucucaaaugaccuccccuucugaguuagcaagucccccuuucccgagcuuccagcuuaccuccaaaggugagauaacuggcagaucucaaacucaccaaugacaguauccuucucaauucaaguuuacuggcugugcucaauauccagucucuacccuaggcccaugucucaucucuuccgcauugcaagccaaguuuagaaacaugggucugaaguaacuauugccuguguacuguguuaauacacuguggaaggcuuuggggauauuuauauuuuuaaaaauccuacaaaguaucauuaucaucauuuuacagaugaggagacaggauccagggggcauuaguaaccugcucaaagcagcaugguagccagugcucucuaugacaauuguuggugguccuaaccauugguacuuuaccagcaacauggaaaauuacuuuauggcuacgcccacaucuguaaucuccaggacugaggcagaaggaucgccaguucaaggccagccugagcuacaaagcaagauccuaucucaaaagaaauagaagggaaaggaaacuuuauaucaauaacaacacggagcguaguuuggaguaacggaggagauuaagcccucagcauuucuccuccccggagccuaagguuauacuggagaaguaagacuuggggacaauggagacugccaccaugaggugggcccacaguagacugaagcagcagaccauacuacagagacuuugcacacaugcccacucuaugagguccacuucaguaaucuagaaaugaccccugcccucagagugagcagugggaaaauuggagacacaggagagcaaaugaaaacacuacaacaauaauuuaccaaauccugaagaggaauaggauguaacagaaaggucccugugggagaggaggaggaagaggaaguaccugaccuaggcccugaaggaugaagggaucuggcuggauggagaugggcagacucgugacgaggaagugaggggugcucacagacuggagagagucuuguauuugugugaccaggcuagaguuuagcauucagccugaaugcuauaggagucacuaaaacacgcuaggcagggguuggcacauacugauuuguuacaucauuuucugcuaccaagcuaagaggcagagauagcauaagccugauuaauuaaggcacugagaucaggcaugaagggaggaggucuaggagcuggcugcacgaggaggaaguaggucaggugcuggcucacugagcuggaaggcaggccuggagacaaccuaaggcuggugguggugacagugacagggcugcaaaggaguacuuugcggccggggaccaaguguguguugccuguggguuacuuauuccagccugucugcucucuugaucaaguuuauaguaugcuugcgucgagaugggcggacuguguaccagcaaguucuguccuuggagcuuccaaauguccugcgcagcuggaacuggggccugugugguuacuuugcuuucuaccacgcccucuauccccgagccuggacggucuaucagcuuccuggccagaaugucacccucaccugucgccaggucacaccuaucuugccucaugacuaccaggugaggauuccuccuguuugcuucauuccaugcccucccccagauccacugcugcuagaaauuguguaaccuaugaaagggagaggcuggagcugugaacaucacacugcuuccgagacuaagucguccuagcugucuagaccuccugggaggccgguuuccugggaacauggagaugcacagaagacagaagggaauguaguggggacaauuugaggagguacucucuggccacuccuaaggauacacugagacugagucccaucucccaucccaggacagcagucucccuguaggagucuuugugugggauguagaaaacgaaggagaugagacucuggacguuuccaucacguucuccaugcggaauggacuaggaggcgaagaugaugcggccgggaguuuguggaaugagcccuuccgccuggaacagggcgggacgacuguucaggggcuccucuugcaucauccaaccccuccgaaccccuacaccauggcuguggcugcacgaugcacggugagggacaagucugcucuguaccucuccucgggagccccugcccucaugaccugacccgaaccuacuuuaccucuaacggucuuccauuucgugaacucccauccucaucacagcccucagccucuagaacuuggaggugacaguguuuaaggagccgaagagcuagucagaauccagugugcuuggacuugccuuuacagagucucuggcuucuuaacaggcagauaccacgguaacccacaccacagccuuugaccccaauggcacuggacagcagguguggcaggaccuacuucaggauggacagcuggacuccccugcuggugaugggggguuugacuguugggaagaaaggcucuguccugucuuaggaccagggguggaagaccugauaaugaaugggccuugucuucaaauuagaagucccuggcuuugggguucaagggggugccugugcugauuccucugugcuccuuaggccaaagcaccccaacacagaaaggagaggguaucgcuggggcuguaugcgucucuagcaagcuguuaccucgaagccggugcugcuuggaguucucacuggcuugggauaugccuaagaucauguuuggagcuaaaagccaaguccacuacagguaaaugcagggauccaaagacccuguggcaggggcgucuagccuagagcaucuguucuuaugccuuucuuuccaucccaggcgguauacacgguucuuugguucagauggugauguggcgccugcccugagccacuaugcacugugccacuaugcagacugggaggacagaaucucagccuggcagaacccaguacuggaugacaggugcccucuugucguuuuuucgcaggcacucacuccaaauaugacuugcucugcuucccuagcagucugucgggcugcgcugggauucacagugucccuacuucacucuagaauccccucuauccugggaggcucauaaagcucuauccccuccucuuggcuucccagaaccuugccugccugguacaaaucugcacuguucaaugaacuguacuuccuggccgauggaggcacaguguggcuggaaguucccgcagacucccuaccagaggggcugggagggaguaugcgucagcuucgcucuacucugcaggacuaugggcgauuuggcuaucuugaagguauggcgugccaguggacuggcaugggucagagcuagguguguccuacauaaugcaggaugacagacguugccuguccugagauacugacaggauaaggggugaauugggaaaacggaaagaugagugggccuacuuccagcuuugaagagcuaccgagcagaagccggcauucuggcaacagugucucucucuuccuccaggccaggaguaccgcauguacaacacauacgauguccacuuuuaugcguccuuugcccucgucaugcuguggcccaaacuugagcucagucuucaguaugauauggguaacgucucugcuuucccuacuccugagcucuuauugucucucagauaacauguccuccccuuccuccugagcaugcccgcaucuggcuccuuaguucucuggggucacacacacagcacuggaucccaccccaagccugcccauucccugcuuucccucacguacuugugucuccgcucccccagcucuggcaacuuugaaggaggaccugacccggcgacgguaccugaugaguggagugguggcaccugugaaaaggaggaacgucaucccucaugacauuggggauccgggugagauuccgucugucagucucuauaccugcuauccuguccacugacacacugaaccagguccccuccccuccaacagaugaugagccauggcuccgggucaacgcauauuugauucaugauacugcugacuggaaggaccugaaccugaaguuuguauugcaaauuuaucgggacuauuaccugacgggugaucaaggcuuccuggaggacauguggccugugugucugguaaggaacgagaacuguguccaguauaccagggauguagcuggagucuugggagaacccagacuuucuuucuuagaaccuaggucuucagugucuugaucccucucuaggcugugauggaguccgaaaugaaguuugacaaggaccaagauggacucauugagaauggaggcuacgcagaccagaccuaugaugcaugggucaccacaggccccagguuuggggguagggauuuccaggucugaggugaagacccgggcaugugaggaugccguguagagcggccggucucacuccagccacuguucccacccagugcuuacugcggagggcuguggcuggcggcaguggcuguaaugguucagauggcuguucuguguggggcccaagauguccaggagagguuugcuuccauucucugccgaggccgagaagcuuaugagagacugcuguggaacggugaguaaaagcaaccuggggcagcuuaaaacccaacuacgggauacaagcaacuugacuuugcucuuucucuauuccaggacgcuauuacaacuacgacagcagcucccauccucagucucggagcaucaugucugaccagugugcugggcagugguuccugagggccugcggccugggagaaggagacacugaagugagaggcuggagaagccagaagucuggguuucccuggaggugggaggcaagucugagacuccaccuuugcucucccuccagguauuuccuacccugcaugugguccgugcucuccaaaccaucuuugaacucaacguccaagccuuugcaggaggagccaugggggccgugaacgggaugcacccucauggugucccugauagauccagugugcagucugaugaagucuggguggguguggucuaugggcuggcagccaccaugauccaagagguaaugaauucucuucccagcccuucaccauuuguacugagguccagaaaacuuccucagccacuaacuuuauuccaagaacacccuacugccugccaucuuauccguccacagagcgcccuucucccuaauaaguguuccaccucuugccuuuaaguucuugccuuuagggcgaacggccuccugucuucucugcucagcuaagguaauugugccaagagucaguuauuaugugugacuucuacgucuccccacagggccugacuugggaagguuuccggacagcugaaggcuguuaccgcacuguaugggaacgccugggccuggcuuuccagaccccagaggcauacugccagcaacaaguguuccgcucccuggccuacaugcggccacugagcaucugggccaugcagcuggcccugcaacagcagcagcauaaaaagagccgcaggccaucagucacacaaggcacgggacuaagcacacagccugaauguggaccaaagagaucgcuggcaaaccucaauucagagugaucccucugaacuguggaggcccagccuccacacuggaccuccuccuuccucccacaaguccugcagcccugagccaauaggacaaucgcgccccucuuccuucccagcugugccaguaaaaaggggcugaggaaccacuuauuuauuucuuacccuacccaguccuuccauggaugaaguauucaaggccaguaaaugucuccaaaucuauucacggggcaacagauacauauggguauaaauaaaauacucagaaaacuaguuaguguggugugucugaguuccugggcauccuaacagagcacgugagcaaaggccagcuuuccccugcuccuuuuuauuugaauacagacaggaguccucaggcugaggacaccccacauccucacaccuaaccugaauaccugcccugaaagaugaccaaagaagggcugugguuagguugccaucccucgcuuucugaaagguuugccugcaggagaagguuggagucggagaagagcaucucugaagaaagaucccagaguggccagugcaggggcugcucugccugaggcgcgugguacaguacacaggaaaaguugcuggagaccaagaacauauguucugagcuguccagugacuggugugugcuguccauggguagcucugacgauagagcagauggcuucggcugaugaucguccucgcuggggagggcacgaagcuugcggugcaacacu

SEQ ID NO: 1858 - RNA, 542 nt, Mus musculus
auuuuuuuuuuuuaaagaauauucgaaaagacugaaagagaaaaagugaaaccuaaaaagccauggugggaaaaggcgcacagugcuaagucuccuucccuagauuaguaacgcuuuagccuagguuagcgcccuugccgcagaccucugauggucuucccaggacccccuuuaacucuucucucuagccuuccucgcucauaucugggccuuaauugucaguguaugcccugcccuucaccaaggcucucaaaugaccuccccuucugaguuagcaagucccccuuucccgagcuuccagcuuaccuccaaaggugagauaacuggcagaucucaaacucaccaaugacaguauccuucucaauucaaguuuacuggcugugcucaauauccagucucuacccuaggcccaugucucaucucuuccgcauugcaagccaaguuuagaaacaugggucugaaguaacuauugccuguguacuguguuaauacacuguggaaggcuuuggggauauuuauauuuuuaaaaauccuacaaagua

SEQ ID NO: 1859 - RNA, 8775 nt, Mus musculus
caggagcucccggcgaccuucggccccgccccgggcugcggcuccagcggcuccagggcuggguaccgggucccugcagccaggaucccccgcgcccacgcucaggugccaccgcugggaaggugacccgcagacccgggaccaccggaucccuuuccggccggaagcaccccgcaagucggaccggaaggggcgccucaacccugaaaugugacaaaggaagucccgccucugccgcgcgacagacuccgcggaugccaccgagcuccgagccggucucgcaggggcggguaggugaggaccuccaugcguaagaaucugaguuuggagacgcgcggcgauguccugggcuaggacguggagccucgagggaagcggggacagaggcaggccugggaggcggcgcaaggggccuaacccugggcgcaaggaggucuggagcuaaagcgacgcccucccgcaggcaguucggagucaguuuccgccaccccaccagcuccuuaaaccccagugcuucccacccucacugaaacuugaaaaaaaaaaaaaaaacaacccacuucuugccccccucggacucaggucuagacuuaagccuaggucuuaaacacuccuuccuucauuuccccguacugacuucuggcacucuguuuccuucuagauuugguuccggagcugccaugaucgaagugguagcugagcugagcagagguccuguguuucuggcgggggaggcucuggaauguguggugacugucacuaauccccuucccccgaccgccacuucugcauccagguggggaugcugguauuggaggugguggcccuuccgggaggaagccugguaucgcucguucuaauuagagcuuugguuguucaguaacuacacuagcaucaaucaccaccuucuugcucauuguaaugaagggcuuuuaaacaaauauguggauggcaggaccccuuacucuccuuugcuccuccucccgguaucacuccuuuuugaguucaauguacuugauguuguuguguaaugguuuuauuucagggguucuggauucccuggucacuaagauagucaucuaaccuuggugaucuuggucagacaguuuucuagagaaaguauuggugaagucaagaacuagguucccauaccuucguuucccuuuuccacagugaggcucuggccugggccagugcccagauccacugccaguuccaugccagcgagagucgaguagcacugccacccccugacucuagucagccggacguccagccugacagccagacugucuuucugccacaccgagguuagagagagagagagagagagagagagagaguguguguuugucauggagggaggggaaguuauugucaccccaggguaaaguuaaguuguucuuguaugacauggucaccaacacaucagugguggaagggaagguagcuugauuugggacuauaagacuuaccuuauuacaacagaaagaauuggcggcuuccccugccuccacuugcugugugacccugguuggcaauggacaauggaguccauugaagucuuuuugacuuuucauaggugagaggggccaguguauccuuucuacuccacccaaaauucuguuuugugaccugaggcuagacccuggagaguccaaaucaugugagugauugucucccaaccccagauugcuuucuaagucuccuggagggaggacucuggcugcuucuagcugcccugucuacuguuucccaaccagauuccuacagugaagugcugcccacggagggcccgccuuccuuucggggucagucagucaaauaugucuacaaauugaccauuggcugccagcgcgugaacucacccaucaccuuacuccggguuccucugagaguucucgugcugacugguaaguuagguuccugaagggaugcgguggggguagaggcuuacuaagcauaugugggaggaccuucggagacuccugguuuuagggaccaugcugaggacgagggauggagaggaagcuaggauguagagcucagauguagcuccccuucagccuucucagguuggagucuaaaaccaguuaguugucuguucacaucucacuccucccagcacugucucugcuuuuucaugccaggucuucaagauguccacuucccccaggaugaggcuguggcgccauccaguccauucuuagaggaggaugacagugggaagaaggacucauggcuggcugagcuagcuggggagcgucucauggcugccacauccugccgcagccuccguaagaauccuuucagaauugcccuguacuccugucugagaggcugaccacaucucuucagggguccacuaauauuuugcccccauuacaaagaaaagccuccuuuuggccucugggacucaguccuucguauuccccaguauaaacuguagacuuuugguaucucauucuccucagaucuguacaauaucagcgauggccgagggaaagucgggacguucgguaucuucaaaucuguguacagacuuggcgaagacguggugggaaccuuaaauuuaggggaaggaaccguagcuugucugcaggugaggaaagagcagcuuucauugugcuccacccgaugggcaagggugacaagggggccuuugucaagaggggugcuuuguagaaauggaaagugaggaucagggcugccucuaaccuacaguccacaucuccaaaugcccgcgaguguacauuucucuuguugcucccaguuuucaguaagcuugcagacugaagaacggguacagcccgaauaccagcgacgccgcgggaccggaguugccccuucagugucccaugugacucaugcccggcaccaggaguccugccuacauacaaccagaaccagcuucucucuccccaucccucuuugcucuaccccuggcuucugcacugccauuggugagaaccggagcacuacuggagaagggaguggggguagggaaugcuggucuuggguaggguggagugggccgugaccccucaagcacccccagacauacccacaucuagcccagcccucugcguuuucucaccucuccacuccacuucuguuucuuagguguacugaccccuaaauacuguuccuaccccugggaugcacugaucucuagcuuccucagcacacucacuucaggcuacaaagucucggcuaucccaaucccagguuacuagguaguuaaauugguauccuuaauagcaucucugguuaacacauuaacaccggguuucuuaaaaacaguauuugaucaaagcucucugaccugugccuucucuucuuuauggacacaaucuguuucuguuuuucuaaaaauuauuuuguugcuuguuuuuaagacaggaucucucacuguguguguagcucugccuggccuggaguuccuaugugaaccaggcuggauucaaacucacagagaucuaccugcucugccuccuuuucccgagugccggucagagaauuuucaaugcauauaauuacuuuauuucaugugagucagggcgccugcaucgccauguguguuuaggucggagaacagcuuucuggaguugguucuuucuaccacaggguuccugacucaggucaccuggcuugguggcaagucccuuuaacccgcugagucaccauggugacucugagguuuguguuuuguaguuugcuaaccacucugucacuggcuuuuacugccuugcagcuguuuguccuuugucugguuuuugauaguagggauauauuugauauguagcccccccagcuggcaucaaacugaccuugaacuugugguccugccuucaccuaguccugggauaggugugugccgccaaaccuggccuuuucuugcuuguagugcagugguucucaaccuuccuaaugcuaugacccuuuauuuaauacaguuccucauauugugcugacccucaaccacaaaauuauuuuuguuuauacuucauaacuguaacuuugcuacugucaugaaucauaauguaaguaucuguguuuuccgaugucauuugacucccgggggucaugacccacagguugagauggacaguuuuagagcaucuaccucuugucucuuucuuuuaguguccuugaaguggcgauuacauuuugaauuuguaacaucccgagaaccaggauugguacuucugccgccauuggagcagccugagccugcgaccuggacagggccugaacaggugccuguagacaccuucagcugggaccuccccaucaaagugcuuccuacaagccccacccuggucucauaugcugccccaggcccuagcaccagcaguauaacuaucugaaacuggcucacaugcccaccauggcaacuaguuuuuccaagaaacugagagcucaaccccuggacuccagugggggcccgcuuuccccaccugggcccccguagcacaggcagugagaaacgggcuuucagcuguagcauuaauuuauuucuuuggaggaaguuggcagcugcuagugguuucccugaaaguggcagcagcagugagcaaucagcagaugggcaagccuuuagcuggaguggggggcagaagccccaggagcagggguguuagccgagccccauucuaagucgggcccucccccuuugcagggcagccgagggucagcuuucugcaccagggaaaauugacagguuccugccuccuguagcacuucacacucagcagggaagucaauaggaugcugagcccuggagaaccaaagguugggagucaggacaguaaaaagccuccuuuagggccugcgcuucccacucagccauccucccacgcccucuuggugucccaucgccccaccuaagcucucuuacucccacacaaggacuuuuuauuguucccagcaggaauacuuccugcagaucuaccucgacuuccccucucuuggugccuucacaucugcagucucgggaggcccuucuguuuacucgugccucacagaaaucuagggacucccuggccaucccuuaggcacaccagaggcauucccucugaccacuccuggcuacucacgugucacagcagcccacaccaacaggaugcagacagguacaauggaaacaguccuugcggagccaagauucacccagagugaaguauuuacccucguaguggcagggagcuaggggaggaugagaaucacuguguuagcagaugagaauuggaagcauuggcagcagccucuccuggucuggggugggagaggauccaugcauacuaccccuccauauagccuucccauucacagguugaaggaauggcuguucuaacacaggguugggcaucucuacaccuucaucccugcccucaucuuucccuuaagcaucaguccaucuuaccuugagcuuggaaguaacacuugcugcuaacucccgggugcuguaggaacagagacaccaccaagcagaugguccuccagccuccgaggauccccuuggcuuggccagcccagagcauccuuagggccauuccugcugcucagcgcucucagacccuuccuggcuucggcucagacuccucuggucuucuuacccccuugcucuucuugccuugcuccuugacuccugaguuucucucuccuugggcucccgucucauaccauggcugggaauguuuauaaagugaggacccuggcccccugcugaggagagcuggacaggcuggaacucuguuuccugaggugagggcaugaaaacaagagguccagcuuuuaacaagcugugagagcggauuccugcccccacacagccaggaggagggagguggccguggaaggggcgcuggacugggcacuuccacagccaggagggggaggguugaaggccccaggugguccccagaucuccuugaccugcagagaggaagcauuccaucaacccucccuccaccaccagcaggggugugugugcugggaucccugccuggaccggagggaggcauuuccuggggauggcuaauccugugccccagccaaaccaaggcgcugcacaagggugcaacugccaaagucuccaggagagcaggccggcaucuggaauggagacuguguuuccuucagaugccagggcagggugucccugagacaucggaaagauggcagcccucagcauugugaggugagggguucauccaaaagcaccccaaagauaaacuucgcaucucaccccaaguggacagcagaugcaagcuuguccuguuccuggccaugcuucugcccuguccccccuuaaggagaagcaucuccaaauacccaacagaagucaccccacuuucacagagaugcccccucuuuccucaugauggggcaaagccuuccaaggucugcauuucugcugacucuggaggagugcugggguucacauggugacugcucacuggcuggcugaccuugcacaggucacuucaccugccacccugcuccuugucugucuauugagaguagaaaugccagcucaugggcgacagcucaugggcuguucuuagcgccaccuuuggcccauggcccucagaaaaucgccacugcuugaggcuaaagcacaaagacagaaaugauguccucucuggacaacagcaaguagccgugcccagcugaaggcuucugcuguggacucuccagaccaacuucugucuuucacauguaugcuccaagguaucccugcugccuccuaagaccugugcuguccugggagcaucuagguugaagggugauguugaucaagcugcuuuucccacuuccauaccuugggaagcgggaucgggaucaugcuuuaucuucccaccccccaccccccacccccaccccccccacccccgcuagcguuaggacucugcuuucucuuacuuggauucugacuuuuccuucauccccucauguggacuucaaggcgccuuugugacccuggucaaacuggacuucuuuuguucuccugcccuugcggaggccccgagguccagugcuucccuuccugcuccuaggacauuuguugugguuugcgcucaggcuugcaguccccuucaucccucgcuuugcuccccgucacauaccacggacagacacagcucacaccuggugugcacgcacacacacaccucccgccugucaccucuuccuucagcagcuacugucaguacaccuccaacuccuuagcugccuucagauaccuuuugccuuggccggggauguaguucagugacaguguugacuuauuauuucagugucccaggucucaccccaaacaccccccuccaaaacugagugggagaaaacaggauuucuuuucagauggauaucuagauaaaagcaaaggagaacuuagcaggggcccccagguaggcucuguaggggcgaggaggggagagcuugaccuucacuccuugcugucuuggcugcggaaggggucagacaggaucaagcuuagaagucugcuuaguagucagcucuuaccacuaccuuugggggaucaaccugaaggcugagcauagagcguuuucugcaguagcuagagacaaugcaagugaggcuagaggucccggagguagaggaggugcuggaaaugagacugggcggacauuacugagccacaccaaacugcgaagugagaaccagucuccugaagcgcaggugaaggccuguggcuguggcgacuucuggaaggaggcaaaggcugagcagaauuccuuucugagguuauagggcaguggggaccuggcugguggccugggcagugaugugugcaggggcaucagugguuagagcccagcccacugagucccagggggguagccuuuggggcaaggggcaggacagguucagggucaggguuggcacaggccaccuaugcagggacaaggaaaacauccgccggagcugggccaggcuguguuccagcagcgcaggcaggugcgcaggggaggaagugagcuuauuccgggacugagucaccccaacccuugcuuuacccaaaugggacagagcguuuggagaugauggcucagggagaugggggacuggagccuggggaggggaagguccugaacaaacccaaaggaguccuggaaggggcugcuuucugcccagcaaagccccuaaauucauagcuuguggcugaacagacacagcgaggcagguuggagcugggaaacucgaggggaagggcagaggaaaggcccuacugagucuuccuagaauggagcaucccagaaagcaaaggcaggaggaggugaggcccaagcugcuaaggcaccauccaugcaagucauaaggugugcuaggccagcuagggcuguccauggccuauggaaaggaaggggcuccagggagcaucaaggguuaaaguauuuggaucguggcaguagcuccuggcucuaaagaggcuuucuguacuggaguaguuguuuggaauucucagguaaacuggaaccacguuggccugugaccauaaagauaguggaugguguaagaagaagguucccugugucuucuauggaacccagccugccauccaguaccccacucucagguccccaaaggaaggcugauagggcuguuuccauauaaccaucccaacacugagaaacaggaggguuccccuaguguggugaccagcuugggcuacagagugagacccuauuuuaaaaacaauuugcucuuacugaaucuuaaaaucuugaauaaagauugaaaaucaau

SEQ ID NO: 1860 - RNA, 8775 nt, Mus musculus
auugauuuucaaucuuuauucaagauuuuaagauucaguaagagcaaauuguuuuuaaaauagggucucacucuguagcccaagcuggucaccacacuaggggaacccuccuguuucucaguguugggaugguuauauggaaacagcccuaucagccuuccuuuggggaccugagagugggguacuggauggcaggcuggguuccauagaagacacagggaaccuucuucuuacaccauccacuaucuuuauggucacaggccaacgugguuccaguuuaccugagaauuccaaacaacuacuccaguacagaaagccucuuuagagccaggagcuacugccacgauccaaauacuuuaacccuugaugcucccuggagccccuuccuuuccauaggccauggacagcccuagcuggccuagcacaccuuaugacuugcauggauggugccuuagcagcuugggccucaccuccuccugccuuugcuuucugggaugcuccauucuaggaagacucaguagggccuuuccucugcccuuccccucgaguuucccagcuccaaccugccucgcugugucuguucagccacaagcuaugaauuuaggggcuuugcugggcagaaagcagccccuuccaggacuccuuuggguuuguucaggaccuuccccuccccaggcuccagucccccaucucccugagccaucaucuccaaacgcucugucccauuuggguaaagcaaggguuggggugacucagucccggaauaagcucacuuccuccccugcgcaccugccugcgcugcuggaacacagccuggcccagcuccggcggauguuuuccuugucccugcauagguggccugugccaacccugacccugaaccuguccugccccuugccccaaaggcuaccccccugggacucagugggcugggcucuaaccacugaugccccugcacacaucacugcccaggccaccagccagguccccacugcccuauaaccucagaaaggaauucugcucagccuuugccuccuuccagaagucgccacagccacaggccuucaccugcgcuucaggagacugguucucacuucgcaguuugguguggcucaguaauguccgcccagucucauuuccagcaccuccucuaccuccgggaccucuagccucacuugcauugucucuagcuacugcagaaaacgcucuaugcucagccuucagguugaucccccaaagguagugguaagagcugacuacuaagcagacuucuaagcuugauccugucugaccccuuccgcagccaagacagcaaggagugaaggucaagcucuccccuccucgccccuacagagccuaccugggggccccugcuaaguucuccuuugcuuuuaucuagauauccaucugaaaagaaauccuguuuucucccacucaguuuuggagggggguguuuggggugagaccugggacacugaaauaauaagucaacacugucacugaacuacauccccggccaaggcaaaagguaucugaaggcagcuaaggaguuggagguguacugacaguagcugcugaaggaagaggugacaggcgggaggugugugugugcgugcacaccaggugugagcugugucuguccgugguaugugacggggagcaaagcgagggaugaaggggacugcaagccugagcgcaaaccacaacaaauguccuaggagcaggaagggaagcacuggaccucggggccuccgcaagggcaggagaacaaaagaaguccaguuugaccagggucacaaaggcgccuugaaguccacaugaggggaugaaggaaaagucagaauccaaguaagagaaagcagaguccuaacgcuagcggggguggggggggugggggugggggguggggggugggaagauaaagcaugaucccgaucccgcuucccaagguauggaagugggaaaagcagcuugaucaacaucacccuucaaccuagaugcucccaggacagcacaggucuuaggaggcagcagggauaccuuggagcauacaugugaaagacagaaguuggucuggagaguccacagcagaagccuucagcugggcacggcuacuugcuguuguccagagaggacaucauuucugucuuugugcuuuagccucaagcaguggcgauuuucugagggccaugggccaaagguggcgcuaagaacagcccaugagcugucgcccaugagcuggcauuucuacucucaauagacagacaaggagcaggguggcaggugaagugaccugugcaaggucagccagccagugagcagucaccaugugaaccccagcacuccuccagagucagcagaaaugcagaccuuggaaggcuuugccccaucaugaggaaagagggggcaucucugugaaaguggggugacuucuguuggguauuuggagaugcuucuccuuaaggggggacagggcagaagcauggccaggaacaggacaagcuugcaucugcuguccacuuggggugagaugcgaaguuuaucuuuggggugcuuuuggaugaaccccucaccucacaaugcugagggcugccaucuuuccgaugucucagggacacccugcccuggcaucugaaggaaacacagucuccauuccagaugccggccugcucuccuggagacuuuggcaguugcacccuugugcagcgccuugguuuggcuggggcacaggauuagccauccccaggaaaugccucccuccgguccaggcagggaucccagcacacacaccccugcuggugguggagggaggguugauggaaugcuuccucucugcaggucaaggagaucuggggaccaccuggggccuucaacccucccccuccuggcuguggaagugcccaguccagcgccccuuccacggccaccucccuccuccuggcugugugggggcaggaauccgcucucacagcuuguuaaaagcuggaccucuuguuuucaugcccucaccucaggaaacagaguuccagccuguccagcucuccucagcagggggccaggguccucacuuuauaaacauucccagccaugguaugagacgggagcccaaggagagagaaacucaggagucaaggagcaaggcaagaagagcaaggggguaagaagaccagaggagucugagccgaagccaggaagggucugagagcgcugagcagcaggaauggcccuaaggaugcucugggcuggccaagccaaggggauccucggaggcuggaggaccaucugcuugguggugucucuguuccuacagcacccgggaguuagcagcaaguguuacuuccaagcucaagguaagauggacugaugcuuaagggaaagaugagggcagggaugaagguguagagaugcccaacccuguguuagaacagccauuccuucaaccugugaaugggaaggcuauauggagggguaguaugcauggauccucucccaccccagaccaggagaggcugcugccaaugcuuccaauucucaucugcuaacacagugauucucauccuccccuagcucccugccacuacgaggguaaauacuucacucugggugaaucuuggcuccgcaaggacuguuuccauuguaccugucugcauccuguuggugugggcugcugugacacgugaguagccaggaguggucagagggaaugccucuggugugccuaagggauggccagggagucccuagauuucugugaggcacgaguaaacagaagggccucccgagacugcagaugugaaggcaccaagagaggggaagucgagguagaucugcaggaaguauuccugcugggaacaauaaaaaguccuugugugggaguaagagagcuuagguggggcgaugggacaccaagagggcgugggaggauggcugagugggaagcgcaggcccuaaaggaggcuuuuuacuguccugacucccaaccuuugguucuccagggcucagcauccuauugacuucccugcugagugugaagugcuacaggaggcaggaaccugucaauuuucccuggugcagaaagcugacccucggcugcccugcaaagggggagggcccgacuuagaauggggcucggcuaacaccccugcuccuggggcuucugccccccacuccagcuaaaggcuugcccaucugcugauugcucacugcugcugccacuuucagggaaaccacuagcagcugccaacuuccuccaaagaaauaaauuaaugcuacagcugaaagcccguuucucacugccugugcuacgggggcccagguggggaaagcgggcccccacuggaguccagggguugagcucucaguuucuuggaaaaacuaguugccauggugggcaugugagccaguuucagauaguuauacugcuggugcuagggccuggggcagcauaugagaccaggguggggcuuguaggaagcacuuugauggggaggucccagcugaaggugucuacaggcaccuguucaggcccuguccaggucgcaggcucaggcugcuccaauggcggcagaaguaccaauccugguucucgggauguuacaaauucaaaauguaaucgccacuucaaggacacuaaaagaaagagacaagagguagaugcucuaaaacuguccaucucaaccugugggucaugacccccgggagucaaaugacaucggaaaacacagauacuuacauuaugauucaugacaguagcaaaguuacaguuaugaaguauaaacaaaaauaauuuugugguugagggucagcacaauaugaggaacuguauuaaauaaagggucauagcauuaggaagguugagaaccacugcacuacaagcaagaaaaggccagguuuggcggcacacaccuaucccaggacuaggugaaggcaggaccacaaguucaaggucaguuugaugccagcugggggggcuacauaucaaauauaucccuacuaucaaaaaccagacaaaggacaaacagcugcaaggcaguaaaagccagugacagagugguuagcaaacuacaaaacacaaaccucagagucaccauggugacucagcggguuaaagggacuugccaccaagccaggugaccugagucaggaacccugugguagaaagaaccaacuccagaaagcuguucuccgaccuaaacacacauggcgaugcaggcgcccugacucacaugaaauaaaguaauuauaugcauugaaaauucucugaccggcacucgggaaaaggaggcagagcagguagaucucugugaguuugaauccagccugguucacauaggaacuccaggccaggcagagcuacacacacagugagagauccugucuuaaaaacaagcaacaaaauaauuuuuagaaaaacagaaacagauuguguccauaaagaagagaaggcacaggucagagagcuuugaucaaauacuguuuuuaagaaacccgguguuaauguguuaaccagagaugcuauuaaggauaccaauuuaacuaccuaguaaccugggauugggauagccgagacuuuguagccugaagugagugugcugaggaagcuagagaucagugcaucccagggguaggaacaguauuuaggggucaguacaccuaagaaacagaaguggaguggagaggugagaaaacgcagagggcugggcuagauguggguaugucugggggugcuugaggggucacggcccacuccacccuacccaagaccagcauucccuacccccacucccuucuccaguagugcuccgguucucaccaauggcagugcagaagccagggguagagcaaagagggauggggagagagaagcugguucugguuguauguaggcaggacuccuggugccgggcaugagucacaugggacacugaaggggcaacuccggucccgcggcgucgcugguauucgggcuguacccguucuucagucugcaagcuuacugaaaacugggagcaacaagagaaauguacacucgcgggcauuuggagauguggacuguagguuagaggcagcccugauccucacuuuccauuucuacaaagcaccccucuugacaaaggcccccuugucacccuugcccaucggguggagcacaaugaaagcugcucuuuccucaccugcagacaagcuacgguuccuuccccuaaauuuaagguucccaccacgucuucgccaagucuguacacagauuugaagauaccgaacgucccgacuuucccucggccaucgcugauauuguacagaucugaggagaaugagauaccaaaagucuacaguuuauacuggggaauacgaaggacugagucccagaggccaaaaggaggcuuuucuuuguaaugggggcaaaauauuaguggaccccugaagagauguggucagccucucagacaggaguacagggcaauucugaaaggauucuuacggaggcugcggcaggauguggcagccaugagacgcuccccagcuagcucagccagccaugaguccuucuucccacugucauccuccucuaagaauggacuggauggcgccacagccucauccugggggaaguggacaucuugaagaccuggcaugaaaaagcagagacagugcugggaggagugagaugugaacagacaacuaacugguuuuagacuccaaccugagaaggcugaaggggagcuacaucugagcucuacauccuagcuuccucuccaucccucguccucagcauggucccuaaaaccaggagucuccgaagguccucccacauaugcuuaguaagccucuacccccaccgcaucccuucaggaaccuaacuuaccagucagcacgagaacucucagaggaacccggaguaaggugaugggugaguucacgcgcuggcagccaauggucaauuuguagacauauuugacugacugaccccgaaaggaaggcgggcccuccgugggcagcacuucacuguaggaaucugguugggaaacaguagacagggcagcuagaagcagccagaguccucccuccaggagacuuagaaagcaaucugggguugggagacaaucacucacaugauuuggacucuccagggucuagccucaggucacaaaacagaauuuuggguggaguagaaaggauacacuggccccucucaccuaugaaaagucaaaaagacuucaauggacuccauuguccauugccaaccagggucacacagcaaguggaggcaggggaagccgccaauucuuucuguuguaauaagguaagucuuauagucccaaaucaagcuaccuucccuuccaccacugauguguuggugaccaugucauacaagaacaacuuaacuuuacccuggggugacaauaacuuccccucccuccaugacaaacacacacucucucucucucucucucucucucucucuaaccucgguguggcagaaagacagucuggcugucaggcuggacguccggcugacuagagucaggggguggcagugcuacucgacucucgcuggcauggaacuggcaguggaucugggcacuggcccaggccagagccucacuguggaaaagggaaacgaagguaugggaaccuaguucuugacuucaccaauacuuucucuagaaaacugucugaccaagaucaccaagguuagaugacuaucuuagugaccagggaauccagaaccccugaaauaaaaccauuacacaacaacaucaaguacauugaacucaaaaaggagugauaccgggaggaggagcaaaggagaguaagggguccugccauccacauauuuguuuaaaagcccuucauuacaaugagcaagaagguggugauugaugcuaguguaguuacugaacaaccaaagcucuaauuagaacgagcgauaccaggcuuccucccggaagggccaccaccuccaauaccagcauccccaccuggaugcagaaguggcggucgggggaaggggauuagugacagucaccacacauuccagagccucccccgccagaaacacaggaccucugcucagcucagcuaccacuucgaucauggcagcuccggaaccaaaucuagaaggaaacagagugccagaagucaguacggggaaaugaaggaaggaguguuuaagaccuaggcuuaagucuagaccugaguccgaggggggcaagaaguggguuguuuuuuuuuuuuuuuucaaguuucagugagggugggaagcacugggguuuaaggagcuggugggguggcggaaacugacuccgaacugccugcgggagggcgucgcuuuagcuccagaccuccuugcgcccaggguuaggccccuugcgccgccucccaggccugccucuguccccgcuucccucgaggcuccacguccuagcccaggacaucgccgcgcgucuccaaacucagauucuuacgcauggagguccucaccuacccgccccugcgagaccggcucggagcucgguggcauccgcggagucugucgcgcggcagaggcgggacuuccuuugucacauuucaggguugaggcgccccuuccgguccgacuugcggggugcuuccggccggaaagggauccgguggucccgggucugcgggucaccuucccagcgguggcaccugagcgugggcgcgggggauccuggcugcagggacccgguacccagcccuggagccgcuggagccgcagcccggggcggggccgaaggucgccgggagcuccug

SEQ ID NO: 1861 - RNA, 1281 nt, Mus musculus
cuguagcauuaauuuauuucuuuggaggaaguuggcagcugcuagugguuucccugaaaguggcagcagcagugagcaaucagcagaugggcaagccuuuagcuggaguggggggcagaagccccaggagcagggguguuagccgagccccauucuaagucgggcccucccccuuugcagggcagccgagggucagcuuucugcaccagggaaaauugacagguuccugccuccuguagcacuucacacucagcagggaagucaauaggaugcugagcccuggagaaccaaagguugggagucaggacaguaaaaagccuccuuuagggccugcgcuucccacucagccauccucccacgcccucuuggugucccaucgccccaccuaagcucucuuacucccacacaaggacuuuuuauuguucccagcaggaauacuuccugcagaucuaccucgacuuccccucucuuggugccuucacaucugcagucucgggaggcccuucuguuuacucgugccucacagaaaucuagggacucccuggccaucccuuaggcacaccagaggcauucccucugaccacuccuggcuacucacgugucacagcagcccacaccaacaggaugcagacagguacaauggaaacaguccuugcggagccaagauucacccagagugaaguauuuacccucguaguggcagggagcuaggggaggaugagaaucacuguguuagcagaugagaauuggaagcauuggcagcagccucuccuggucuggggugggagaggauccaugcauacuaccccuccauauagccuucccauucacagguugaaggaauggcuguucuaacacaggguugggcaucucuacaccuucaucccugcccucaucuuucccuuaagcaucaguccaucuuaccuugagcuuggaaguaacacuugcugcuaacucccgggugcuguaggaacagagacaccaccaagcagaugguccuccagccuccgaggauccccuuggcuuggccagcccagagcauccuuagggccauuccugcugcucagcgcucucagacccuuccuggcuucggcucagacuccucuggucuucuuacccccuugcucuucuugccuugcuccuugacuccugaguuucucucuccuugggcucccgucucauaccauggcugggaauguuuauaaagugaggacccuggcccccugcugaggagagcuggacaggcuggaacucuguuuccugaggugagggcaugaaaac

SEQ ID NO: 1862 - RNA, 1281 nt, Mus musculus
guuuucaugcccucaccucaggaaacagaguuccagccuguccagcucuccucagcagggggccaggguccucacuuuauaaacauucccagccaugguaugagacgggagcccaaggagagagaaacucaggagucaaggagcaaggcaagaagagcaaggggguaagaagaccagaggagucugagccgaagccaggaagggucugagagcgcugagcagcaggaauggcccuaaggaugcucugggcuggccaagccaaggggauccucggaggcuggaggaccaucugcuugguggugucucuguuccuacagcacccgggaguuagcagcaaguguuacuuccaagcucaagguaagauggacugaugcuuaagggaaagaugagggcagggaugaagguguagagaugcccaacccuguguuagaacagccauuccuucaaccugugaaugggaaggcuauauggagggguaguaugcauggauccucucccaccccagaccaggagaggcugcugccaaugcuuccaauucucaucugcuaacacagugauucucauccuccccuagcucccugccacuacgaggguaaauacuucacucugggugaaucuuggcuccgcaaggacuguuuccauuguaccugucugcauccuguuggugugggcugcugugacacgugaguagccaggaguggucagagggaaugccucuggugugccuaagggauggccagggagucccuagauuucugugaggcacgaguaaacagaagggccucccgagacugcagaugugaaggcaccaagagaggggaagucgagguagaucugcaggaaguauuccugcugggaacaauaaaaaguccuugugugggaguaagagagcuuagguggggcgaugggacaccaagagggcgugggaggauggcugagugggaagcgcaggcccuaaaggaggcuuuuuacuguccugacucccaaccuuugguucuccagggcucagcauccuauugacuucccugcugagugugaagugcuacaggaggcaggaaccugucaauuuucccuggugcagaaagcugacccucggcugcccugcaaagggggagggcccgacuuagaauggggcucggcuaacaccccugcuccuggggcuucugccccccacuccagcuaaaggcuugcccaucugcugauugcucacugcugcugccacuuucagggaaaccacuagcagcugccaacuuccuccaaagaaauaaauuaaugcuacag

SEQ ID NO: 1863 - RNA, 20237 nt, Mus musculus
cgccgggccgaggcgaccugaccuggacgagcgagcggcgcgcgcgggggcccaggcggggggcgggaggcagcggcgggcagcgcaggccgccgggcccgggagaagcggagcggagaggagcgggggacacgggcggggccgccgcagcuccggaugggaccagcgcccgggcccguuaguccaggcaggagcuucgggagaagccgucacugggagagucaccccugccuuucccuccccucuggcccaggccucgcuucgcucccugccugcccaugucccaguccuuccgcggcgggcgcccucccaccucagcccggggcucuggcuucucgcagcucuuugcucucccggcccgaucagcugugagguguccccgggccguuucuuugugccagccucccccaagucccuaccccaucccaggcucagauuccucccuucucggcuuggaauugucaggcuacuucaccucucacuguccucaucccggucgcaggcccccuuggucucuucuuccuucugccacccuauccuuagucccuggaccuggcugugggcugguagcccacuccuucccgacccagguuuccccccauccucuucuugcgugguccccagcacuuucuguauccgggccgacuaagcuugcccccacuucucuuccuggcccucuuccccaggcuccaggcuggguggcgcuugugccugcccaguaggccagagcggccccugguucgggggaccgugggucagcugcucuauccccauggcacugccaucccugcugcuggugguggcagcccuggcagguggggugcguccuccgggggcacggaaccugacgcuggcgguggugcugccagaacacaaccugagcuaugccugggccuggccacggguggguccugcuguggcacuggcuguggaggcacugggccgggcacugcccguggaccugcgguuugucagcuccgaacuagacggcgccugcucugaguaccuggcaccacugcgcgcuguggaccucaagcuguaccaugaccccgaccuucuguugggccccgguuguguguaccccgcugccucuguggcucgcuuugccucacacuggcgccuuccccuccugacugcgggggcaguggccucuggcuuugcagcuaagaaugagcauuaucguacccugguucgcacuggccccucugcgcccaagcugggugaguuuguagugacauugcacgggcacuucaauuggacagcucgggcugcuuugcuguaucuggaugcucgcacagaugaccggccccacuacuucaccaucgagggcgucuuugaggcccugcagggcagcaaccucagugugcagcaccagguguaugcccgagagccagguggcccugagcaagccacccacuucaucagagccaacgggcgcaguaaguguggcccgggcuguuuuagaaacaggggaggugggccgcuaugucccuggagcagugcaacacagagaaauaggcagagauaggaaggggagaguucuaugugaugguugggauggaggaacuuuugaggacagagcuccugagagaaccuggcaucagucagaggucagcaaggcugagccuggggcugggguuugaguaguggaugugggugaugucugaucugaaaugugcaccugucugugagcagagaccccuuagauuggaacacaaagccucuugguagcauagagaugacucuauggguucagguuugauugggaaagcagguaaggcucacacaaaaauugugagcacaagugcuugugagccuagggagagguaggcaggaggggacgugggggcugugaagucuagcaaacacagcuuugggggaaggaggggcuugggucaucacgccagucucuggggucuggaguugggcucugacuuggaccagaugguccauguggccccagggcacuugcgacaugagcucuaaggggagggaugggaacaucuguuggguggucgauggguagggcacucucuuguaaugggaugacucagagaggaggggggaccuggaugcugucucagggugcccuucuguccugugcacucccaguuguguauaucugcggcccccuggaaaugcugcaugagauccugcuucaggcccagagggagaaccugaccaauggggacuaugucuucuuuuaccuugaugucuuuggggagagucuccgagcaggccccacccgugcaacaggccggccauggcaggacaaucgaacccaggaacaggcccaggcccucagagaggccuuucagguaccuuuggaacccaaacuaaagaugggaagacucacuugguuggaggaucuguuucucccaagacccuccugaaggcucuggaauagggcagguguggugugcuauggaagggaaauggucagaaauguucugugucuggucucacucuuccuuccugagauuugugacuguuaccuagugugcuugccaagacugaccuuggccgcuaccagagaucuuaggaugcuuuccuaagugccagcagugagcuggaaggcaggaagggaaagaccugagccuuguccugggaagggcugucauccuuauuggagaggcaaggugaaacuauaauauagugugugaggaaaggagacaguuuugugcaugaaacaggucccaagagacagcgguucuggagaggaaugguggauauaggcuuuuguaaaggaaaugaaucuguuguaauuuucauggcacacgccagacccacagaguggugaaacagggauccagaagacuguucaggggacagacaguuugcaugguuggccugguaagaaagcuugguccauguuuugagacagggucucagacuggccuugaacaaguacugggauuauagauaugggcuuuaaaaaggguucacuuaaggcccaucugggagacaaagauggacuuuaaguguuaaggacugggauuugaguuuagagcuaguguccuugacuuuuuuuuuguaugauaauacauguauagcguaacucaggcugcguuagaagaggcggccaacucguaguucagcaaagggugaggugauauggcuugaacuaaagugauagauuaggaagaaugggaggaaauuaaucuaugaaagaacuuggagaagaaagucaguguuacugugcacguccugccuguggcccaagcuuucagugaccuguucccugaagaagaaaaucccaacucuauaucaagacauuuaagacuugguaguuagcucucugccuguagcuucagcaguacuugcugaugcccucaagcugagcaguccagcucacucaccccuuguagcucaggccuccuucccuccugccggugugcaccuuuugguccuucagcgugcaccuuuugggccuuuugugugcauuuucuuuucucuucuucccucauuuuaaaccucccucuugagaucagaccuuugacucuccgccugguuuccacaccagucuccacugaccuguguauguaaguguuuccuauuuguuuauccguggcccucaaaaaguauuugagguggcuuuuggaaugagguaagauccuucccacuccaagauucuuugguucuaaggagagucuacacggccuggaccuggguggccauucuucuccagugaguaagguuuuauguggcugagauuauauauuagguugugaauggugagcgugucugacugugaaugacguaucuguuugcaugccugccuacuagucugugacugucauacuuggacauggggcagugauggggcagguuuuguuuauguuguaaccuuuuccugaaacaaccagcucaccugugucuauauaaugauucuguguucuguaagauccccaagucccaggcugagcugggucccuuacucuggugcuuaacucugcuuaccagagagcacauuauucaguucauauuugagucgcucagaggccaacuguucauauuuacugaaagccuguuauggccucaucaccuuacucgguauggauauggacagagcacacuagaaauagucuccgucuuuuuggaguuuacagauaguaggcgagacagacaagaaacaagcguacucauugcugauaagggucuccagaagaagaaaaacagcuaaguggcaugggaagcaaugggugcugaagcuuggcuaguucaggcaaggcaugucugcaccuucccugggacauagggcuccauagcucucuggguaggaauuguuuuguuuuuuucucuacguucuggaauucaaccuaggauccugugcaugccaggcaggugcccaccacuaugcuacauccccauuccuggguugucaucuuuaugcagaagaaaaaaaaaucucuuccuuguaugagagucaccagcaggcaagagaccucagcacuuagaaucggggagagaaugaucuagucagcuaguagcuauaccagucaguuaauucucgguuccuccccucacucagauaggaaaaaagauguuguuguuacaacuuaagagaaacaggcagugaaggauaagcuggagggaggcuuuugguuggugggagugaggcaucguuaggaaaaacuuuucuccucuguugccagggcugcuagaggggagggcagcauggaguuccgaagucagcacuggcuaagaacaaaagagcagugagcccuuccuccagagaugcugguccccuuaggucucacacgaggccaacccaaggcaaggaggccagagaugccuagaaccuuuguaaaaagaggcuguaacaucaaguuagggugcaggcuggcacuggguaccaacgacugagggggagggaaagagcugccauuguaagugcauugacaggauucuccuuucuuguucaguugucgaggaacaacacagacaguguucaccgucguauuccuugugucucacaugugguagauguuuaacguauaugcauugagucaaauuaaaaggagcguaugggggagggggauagaccuaggaaugguuuuagagagcagaccuuccaggcaccauaacccaagguaagccccuaggacagggaagaaaugucaauacaguggaucgucuuaggaaagcagccaggcugggagguuuugggguuucagugagcaacugagaagucagguuugauauccugagccacuggugcucacacugggaaacacuugccacgggaauggaggaaaggagcugugugugcgcgugugcgugcgugcguguguguguguguguguguguauguguguguguguguguguuugggacacuucucuguaaucucagcauuugggagacuaagguaggacgguugcugagaauuggaggccagccugggcuaccugguaagaucccaucucgaaagaaacaguaacaagccagcaaauagaaaggaagaaagcacuaagcugagggcccuggaaggcaggcugugacucuucaugauuucuuggggcccuggcuggcgucaccuucuguuaugcucagagcaggucucaagguggguggcgcccuccuggccugccccccauugaaccccuuaguuuuggcaguguugcuuguuugguuuuccacuuggggccacuaugagcugggacucguuagcuaccuuugccuuccuuuuagucucugaguaagcacagaacuguuccgaguuguuuuuguuuugggguuggcuuuuuucuuuuuuccuuuuuuuuuuuuuuuuuuaguagcuaguuaguaaccacagcaaaacauucuggaauagccauuucuuaagcauggccgugggaucccggggcuccagaaauucuuuuaggggacugugaagugaaagcuacuuaaaaauaaugucaggauguuacuugccuuugucaaggcucuccuaugauugacaguuggauuuucuagaggcuacagugcagggugaugucaccucucugacagccauggcaaacaugcuugugcauuuuugcguuuucauaauuuaucaggcucagaguuuuuuuuuggggggggggguuucgagacaggguuucucuguguagcccuggcuguccuggaacucauucuguagaccaggcugaccuugaacucagaaauccgccugccucugccucccaagugcugggauuaaaggcaugcgccaccacugcccggcuaucaggcucaguuuuaauuuuaacuucuaauuuggaaacuauugguagauauaaaauuucuuugguguuuucaauaaguuuuaagaggagaaaaggcuuaugcacaguaagcuuguaaucacagcacuuagggucugaagcaggaggauugggaguuugaggcuaacaacaaaacaagaagaaaaggaagaacaaaacaagagcuggagcgauggcucagcgguuaagggcauucacugcucaggcugaggacccaaguucaauucccagcacccacaucagguggcuuacaaccuccugucacuccagcuccaggggcauacaaugccgagggcauguacacacacacacacacacacacacacacacacccuugaaaagggauucagagauuaugacaauuuuuguuuuuaagauagggccuguuguauagcccaguuuggcuuugaacucucuauuccucugccuuagccuccagaaugcuggaacuguaggcaugugucaccauccaugguuuaaaaaaaaaaaugauuacugccagcauaggaguaaaucuucaaccuggagaguuuuagugucuagaaaguguucacgccuacuaucagccuuuguugaaguauaaauugugcuacuccgauguguuuuccagcucucugugugacuaugugaccugccaacaguacaggugcuagggaaugaacccucuuagucugacccugagggccacuuccugucuuccccauccccuccacagccucccuuugccuuuucucccuuuccuucucuuucuccugccugagugugaauauuaaaaguauacaaucaagcaugcaagucucccaguaagaaaacuccagucuaauaacaacugcauguuagaaacugauuucucucucuuuuuuuuaauauuuaacuuuugggguuauuuauuuauuuauuuucgagaccaguuucucugucuagcccuggcuguccuggaacucacuuuguagaccaggcuggccucaaacucagaaauccaccugccucugccucccaagugcugggauuaaaggcgugcgccaccacugccuggcagaaacugauuucuuaucuggaacaaauugacaccuguagaucacgugugauauauugaguaugucuguguaguucacaugugcuuucugugaugaaaauaaacaagacugguagaaauggccagaauuuuguucggauuuuguuguuauuuugugagaugacggcucgcuauguaguccugauuagucuggaacucacuauguagaccaggcuggucuugaucuuauagcauuccuucugcccagccuccugagugcuuggauuacagaugugagccaccauacccagcucgaaguggcuagauuuuaaucuaucacuuuacauauagucacauuucacacaguauauugaacugaccucuuacacuggguuacaagacuaguuuccugugugagcaaucguguuuaguugugugguccaaggcugggcagccccacagcgacagaaggguaugugagacucagaggaccuagguaggcaguuuaaugaggaacagagacauguugauucaugucaguaaaaugcacgcauggccgagaccacguguguuauuuguuugucugugcagugugugugggcaugugacucacaugacacacaucugccucuuagugagcacacuguccauaguagauguuuccugugugcacaguaaauuaaauucaugguuuucgcagauggaauugcugucuuaaaguguuucucacaggguuugaaaucuaaugcacugagagaagucacuaugaacaggugacccacuaugaaaagucaauuuuuaauggauaacacuaucagcauuuaaugcugcugggacaacuauagcccugguugggauggaacucacagaucuggccaccucugccucaauggcacgugucaccauuaccuggccaaacaguggugguuguucuuggugguggcagguacucagaaagugugggacagaggagcgcccauaagagugauggccuagcagaaggccugaugguggaagggaggcagagagguccaugggcugaguuuauagauggaguugauuucguccuacagacaccuuuccagaaccagcccuaucugucuuucauagaggggugccacugccccuaauuuucauacucaucccagaguuuaguacacuccagccuucagacaccccuccccugugcaugcguuguaccacguguguguguguguucgugcaugugugugugugcgugugugugugugugugugcgugugugugugugugcgugcgugugugugugugugugcaugugugugugcaugugcgugugcgugugcgugugugugugugugugugugugugugugugcgcgcaugugugugcgugugugugugcauguguguguguuuacccacuuuuccuauggugguccuuccccuccugcucaccccgaguccuguuuccauggugcagacuguauuggugaucacauaccgagaacccccaaauccugaguaucaggaguuucagaaucgccugcugaucagagcccgggaagacuuugguguggagcuggccccaucccuggugaguagaucucugagggucagaacaggcuacgaggaagggacuucucacagaguccuugaucauggagcaagccccauuucaggcugugacuuccauccaggcuacuacccuuugaccccgggaccgggggugggggaggggauggcaugauagggguggggggagggaggaaguaagccaagaaaguggggaggcguggggacacgcaggggugggagagugaaccaggaaggggaccucaggggacauuuggagaguguugcugcuugcugucuccagaugaaccuuauugcuggcugcuucuaugaugggauccugcucuaugcccaaguccugaaugagacuauacaggaaggggguaccagggaagauggacuucgaauuguggagaagaugcagggacgaagauaccaugguaaugaagggugggggaguggaggccugggggcugacgccaggcucaggagugcagugggcagaagacagcuacuccaggcacugcaagggaagagucacugggggucaggaacagucagaguggacacacgucacugugggcagagacucugagacagugagaugggggggggguacgggggacgacagaaggagaguggccaggguuagaucucaaaagugagggacacucuuuuuuaucuuagguguaacuggacugguugucauggacaagaacaaugaccgcgagacugauuucguccugugggccaugggagacuuggauucuggggacuuucaggugaugggggagaggacagggaggagggauugguccuaagauccagaggggacagaauccuuugcucuggggggcaggagcuuacucccugcugggccuucaucacggugggggcgcagggagaaggcugcgcaugcgcacguggcaggccugugggcccagcguucugcuuccucacagcccgcagcccauuacucuggagcagagaagcagauuugguggacaggccggccaauucccugggugaagggggccccaccuuuggacaauccccccugugccuuugacuuggacgacccauccugugauaaaagugggugugugcagggacugggagcaguccccccuuuacccugccccugcgcucugccccuaccucacugacacccauucccacuccuggcuaugccuucucucugucugcagcucucucucuuuccgucaagaacgcucugcaccuccugcgccugugucucucugcccucagccacuccagucuuucucagggccucucuucucucuuccucuccuucagcuccacuuuccacucuggcaaucguggcccugggcacgggagucaccuucaucauguuugguguuuccaguuuccuaauuuuccggugaguucuggguuuuccuauccucauggcgccucuugcugcauggccucuggcugaggcaggggucccugucguguggcuggcaagucuccuaacccgguguggguuucuuggacuggcagcuuucucucuggccuuugaauuuggucccccuucauccuagguauuuaucuugcuuuuguuuguaaccuggguagacuaguuguugguuugguuauuguugcuguuguuuuuuguuuguuuguuuguuuguuuguuuugugacaaagucuugcuaaguagcccagacuggccuugaacucaagagucuacucccucacacuccugaguauuggguuuacagaugugugucauggagccuuauuugaauacuguuuuuguguuugugauaagguuucguuguagagcucuggccugucuggaacccacuauguagacuaggcugcccuuuaacuucucaggguuuugccuaccucugccuuucaagugcuggaauuaaagaccuccuccaccaugccuuaucucugaauaaggauuuuuuaaaaaagaaguaguuuuuauuuauauaucuccuguaugucuguguaaauguauaccaccacacacauguguaggugccuauagaggcuagaagaggccaucggauccucuggagccugaguuacaggugguugugagcagcgcaggaugggugcuuggaauugaacuugggucuucuggaagagcagcaggugcuccuaaccacuuaggcucaucuccagcccuggaguacugacuuuggguagaguuugggucaaaggugaauuucuauacacugcuugccaccccccccccccuccucaccucauucccacugaagugcaaacaaauucucacaguucuggauaggugggagaucugagaucaagucugcaacagcuucugugucuggugagggugcacguucugauuuguggaaaguaauguuucacugugucuucacagaguggaagacuggcuguccugacuuagcuauaggcuggggauggagcagcacccugguagaguauuugccuagcauguucaaggccauagauuuaaucucuagccuggaagaggggaaugaagagagaggagagaggagggaagaaggggagagagagagagcgagcaagagagagagagagagaacuagaguuguguggugguauauaucuacaaucccaacauuuggaaggcugaagcaggaagaccaucauuaguuuaaggccuaccugugcucugucucaaaaccaaaugaaaccaaaccaaccaaaccaaaccacuuugccugugacacugaguguucaugucccaguccgguggcaguugcagcuuccuggaagcuuaguggguggcaggacagggcuuguccgucggcugagaugugcaguccuuacaggaagcugaugcuggagaaggagcuggcuagcaugcuauggcgcauucgcugggaagaacugcaguuuggcaacucggaucgcuaucacaagggugcaggcagucgccugacgcugucgcuggugagcccuuggcccuccgucuuccucugacuuccuguucucucuuacccuggaccuuucccccccgcacacuggccuguaaugauagacccuugcaccaccaccaccaccaucuaauguuccuuucauccuuccgccuccauguugcccuuggccccagcggggauccaguuacggcucgcucaugacagcccaugggaaauaccagaucuuugccaacaccggucacuucaaggugaagagucaucugcuuguucugguucccgaccauuucauugugucucauccccaucugccaccucugccccugaaccucugcccccucacaguccccgcugucuucccagcgagguucuugggagcucucaguucucuagcaucucagauaccccugaggcucagggucuuugucuguuuccaccccaccuuagggaaauguuguugccaucaaacacgugaauaagaagcgcaucgagcugacccggcaaguucuguuugaacucaaacacguacguacuuggguaugagugggaggugaggguggacagggaagaggaaaugaggggaccaugguucccuggcuaacgggauaaggggcuuauuuaucacugauucccaguugcagguguauguaagagaaaugucauugcucacagugguauuucuguauuuccguauuuauuuauuuagagacauagucucucuguguaacagcucuggcuauccuggaacuuacuauguagaccaggcuggcccugaacucacagagauccuacugcuucugccuccccagugcugggguuaaaggugugcgccaccauguuuggccucuguauuuaagcuuuagggcugcccauucucuuguuuuguuuguuuguuuguuuguuuguuuuguuuuguuuugguagaugagagauguccaguucaaccaucuuacucgcuucaucggagccugcauagacccucccaacaucugcauugucaccgaguauuguccucgugggagcuuacaagugagggacagggguaggagacugugguaggguggggguggagguuccaaagucaccuugugucaaaggguagcccgugagacuggggacagacccugaucucuaacgugucacugucaggauauucuagaaaaugacagcaucaauuuggacuggauguuucgcuacucgcucaucaaugaccuugugaagguaagucuuccccgccauguaaaaugucucagucccucaaucuucgcugcaguuucucuccuggaucucuaacagccaagcucuuucccagcccucuccucccgugacugggugaugcagcgguccuaugucccgagagguucuuguccuccugucccagauaucuuuaauguuucucuagugucucuuuaccucaaaggguuccccuguaguagaauccuauagcugggcaugccaucauaugggagguugaggcagggggcugcucugacuuggagcuugaccaaggcuucagagugaguuucaggcuaguguggacuacauaacaagauccuauccagaaaaagaagacaauuaaaccaaaccgaacagugacgaggcaucccuuagcuggguguggguagugcacauguguaaucccagaacucgcugagacaggaggauuggguguucgagaacagccugagcaucaguaagaaucugucucaaaacaaacaaaugaagacgucgaaugaggucuccgugcacucgucuccuguaauuucaugcuuuaaccaauauuccccaugccuguaacuaacugcggaagaggucucuagucuuuaacauuucuaaauuuaacugcuuguuucuggagacugggucucucuguguugccuuggcugaccuggaaguaucucucuguggaccaggcugaccuugaacucaagagaucuaccugccccggcuccucuguacugggauuaauggcaggggacaacacuuguagcuuugauuucuuuuagagacaggguuucauguugccuagacaggccucaaacuuacuauguagccagaaauugcuuugaacuccugacuuucccaucucuacuuccccaaugcuaacauuguaggugugcaccaccaucguaccuggucagagacugaaacguauuuguauguuaaccuaagagagaggaaggaaacuugcacuaaaucuguuuccauucuaacggccaaccauuuuaaaaugacucagaggccugcagauggcugaagcacacugaugaaucuuguauggcuuagacaguguucagaagcaggucucaucagccuacucaugagaccgccugacugugccugacacuggcucugauuuucugcuaaguuuucagaaaguuuuuuuuaaaauuaauuuaugcauaugaaaguuugccaucaagugagagaggaaacuauuagggaaagccaauguaguuuuggacaggagauguggggauaaacaugaaacccagggguaaauucaccagcuuaggcauuccuuccuaaaggccucgagcugcucaaagcaauaaagaggaggaacucgaaggccuuggaccuguucaaggccagagcuuagcgguuacacccuugugauucugguccacagcagagccuucuagccucugucugaccaccugcaccgacuagggagggcuuccagaguuucucuuuggggaaacacugccuugcccucccaagaccggccuuuucaucuccugggggcaguguucugacaucucugccucuaggaagccaugcuuccacgaugacuugacuguuguugcccaccucugucuauuuuuuucaaacuuugucuucacuacuguguggucuagcauuccucuaauagaccccauucugcucccaccaugaccuggauccuaugcacagccauacacaagaguuacaaguggcuggcuuucuauggagcaccuagagccuagccaugucuuaagucguguccuccuaaacaguagcuaggagugugaagucgguucaggugccgagcugguucuggcugcucccuucacugcucagcaagccgccauucucagggaaacuaccgauggcucgccucaucccucuucauaaguaucuccgccuaucccuugugccuuguaguucgaugcuguuuacaugggaagugauggcuuucccauucugccugcuuccuccagucgaggcucuacaggagacaucaucucaauucagcuuguuuuuucggucuuaagauccuuuaaucucuaaugauuugggguugguggucugaauaucuuuaugaaguuagcuggaucaugccauggacugagguugccuaagccagauacaauccagacacuuacucuguauccugcaggguauggccuuucuccacaacagcauuauuucaucucauggaagccucaaguccuccaacugugugguggauagucgauuugugcucaaaauaacagauuacggucuggcuaguuuccgaucaacugcugaaccggacgacagccaugcccucuaugccagugagacugcucccugcaccccccuccccccaagccauccccucccccacaccuccucccucugccgccuaccuuuuaugucacccuucaagccuuggucguuucuucccggggaggggguaagagggagaccaguaguagcaacauggggcugagcccagguggcauccaagaugcuguuuggggaaccuagccagccuguucacucuuugcagagaagcuguggacugccccagaacugcuuagcgggaaccccuugccaaccacaggcaugcagaaagcagaugucuacagcuuugccaucauucuacaggaaauagcacuucgaagugguccuuucuacuuggaaggccuggaccucagucccaagggugagcgaguccguugcuacacagucgcuucugcuagggaaaccugagucuucauccaaacuuccugucacccuuagagauuguccagaaggugcggaauggucagaggccguauuuccggccaagcauugaccggacacaacugaaugaagaguuaguuuugcugauggagagaugcugggcccaggacccaacagaacguccagacuuugggcaaaucaagggcuucauucgccgguuuaacaagugagaggucacccaggcucagaggcucccgggggacagaaacauuaucauucucaguggaugcggcuggugugccucagggguggguuagauaggaagccuugucauucuugagcaccuuggagcaggugugauagccuggccucccugcagggaaggugguaccagcauauuggacaaccucuugcugcgcauggaacaguaugcuaauaaccuggaaaagcugguggaggaacgcacacaggccuaucuagaggagaaacgcaaagcggaggcccugcuguaccaaauucuaccccaguaagaccuuugucccccuucuccgagaauuuccucacauucuagcucauccaucuucugagaauuuguuugccacccugggaacccugggugacgucuugccacaguaagcccuccuggcuacaggcagaaugcucucacuuggucuccauaugggcugugcugucaucuuucaguuuccagucccuccuucuuggggcacuguucuuucucaccuuugucugaccaaguauaugcagaacgauuucaacuggaaccacuuauccccacgggaguccccucgcagugccggccacuuuugcacccggaugugcacugagcuaggugacaucgucucagcugcuuuccuuuucuuccaccaaagccaacuuccauucuaaggcuuggcugugccacauaccccacccucucccuccuucucucucagagcggggcugaggggacacucuugcuuccuaguucuguagcagagcaguuaaagcggggagagacgguucaggcggaggccuucgacagcgucaccaucuacuucagugacaucgugggcuucacagcgcugucagcugagagcacccccaugcaggugagagccgugaggggagcgggcaugggagugcugggagagccucgauggacuaguuugcucuagagcucuuuugucuuucagcuugagaauuuuuuaggaacuugggcacuaauuucagagccucugcuuucccguccuguuagguggugacacuucuuaaugaccuuuauaccugcuuugaugccauuaucgacaacuuugaugucuacaaggugagagcuggagcugaccuccuucuaagacccauuucaaacccaguuuccugaaccccacagaccuuauccacuccacagucagcgcucccuaaguuucuccagcguccuaguguucuaaugggugugagucuagcaggcguggacacuggcacaacacccguggcucccaggcuuccugaucacgagcuuuagucccuuccucucugggguauuagugauacagacgccuggucucuccuuccagaacaguccgaggaugcgggcacagccugacuauggauggggugggggaaauacauguuacaaagcucuuuguuaaagucauugucggguuauaaagucauuugguuaaggggcuaacuugcccuugggcguaaaugugcugcauuugcauauggauuuuauagcuaauuauguggccuuaggcagggucaggauuucucugagcuuugguuguugcagcaauaguuuaguuaucaugcaaacugaugggccagcaagagggcuugguggguaagggcggcaagccuggugucuuaggcucagugccuggaaucccuaugauggaaggagagaagugauacccacagguguccucugacuuccacauucaugugcgugugggcgugcacgcacaaauaaaugugagaccuauuuuuuuuuagauguuccuaacauguagugugguuguggcagguaacaauauugggcauggugagaccugccugucaucccaguauuuaggagcugggacagacggaucacgaguuuaagauuagucuuggcuauacaacgggacccuaccuaaacauaaaagaggaccuuuuaaagcuuacuuuacccuuucugauguuucucuaacaaaauucccauaaacccuuuacuuaaauccaucaauuauuuuuauuuccuccuacuuauuuuauacgucuccuucccucucuggaacguuugggaaucaagccuccagcuuuucucacgcugcucuguucuaaugcugacuacaucccuggccuuauuauuuuuuuuaaaauucauauaaaaauucauauauucuggaaaauuugagaguaaguuuuagauaaaguaccccuuuaucccuaaauucuaagugugggcucccuccagacuucacugugagccacagguugguacagccaccagcgucgggagcugcuucuucccugacagccaggccaucugguccaugcuacggagcauacgcuacucucuuugugcuucuggguucuuuggacugggacugggauccuguccacuuguucagcaaaugccacugaggacuccccaggggcuggggucgcgaggaagagucaaguauuccccugucuggccuccucuuacucccagauucucagggccauggcauguagucccucgucucucuggucagucauggucucccaagcugucaggaugaccccugcuguccagcuaaccuccuuucucgcucuccccgagacagcuggagaugaccucuuaaaacuaguuuuauuauuuuacuuauguguguguaccuaucugaguaugugccacaugggugcaguugcuguggaggccacaagagggugccauauccccuagaacuggaguuacagggaguuugagcugcuacauggaugcugggaacugaacucagguccucuggaggaacagucaguguucuaaugacugagacuacaggugaccuucuaaucuccccuuuaaaucagguggaaaccauuggggaugccuacauggugguaucuggccuuccaggccgaaacggucagcgccaugcaccagaaauugcucgaauggcccuagcauugcuagaugcugucucuuccuuccgcauccgccaucgaccccaugaccagcugagguuacgcauagguguccauacugguaaggcugauucucaccuggcccuagugucuacuuuuccagaucuuucccaaccaguuuguuuuuacagggccagucugugcuggggugguuggccugaagaugccccgguacugucuuuuuggagacacaguaaacacugcuucucgaauggagucgaauggccaaggugaggacaacagcuuuuaacuccaaacuugaccugucuuacucuuuucuuuucggaguucuuccauaucucucuguuggaugguccugaagugccccauucuuggucuuauguugauucuuauaauuacgcucuggcaggacuggugacaauucuucucuugucuuuucuugaauuuuucuuucucccucugccccuggucuacaucacccuagcucuaaagauccaugucuccucgaccaccaaggacgcccuggaugagcugggaugcuuccagcucgagcuccguggggauguggagaugaaggugauggcaggcugugggggaguggaucaugggaggaugaugguggggggagagagggagacaaagacacuaacacacaagagucugaacugugcucaucccccugccuccagggaaaaggaaaaaugcgaacuuacuggcucuugggagagcaaaagggaccucccggacuccuguaaagcccaggccggccaucuucugcugcugguacuuggaugggcaauggucacuguguuuccacacagcaaaaacagacguagccauaucagauggaaaacaugcauagacacaaacccccugccuuauguggaaaucauagcccccugccgcucagccuuguacauagaccuaucccucccugcccugguccucuuccugccuccuguaaauaucuguaucuagaccagaauauuuuguccaaguauaaaacaacaacaacaaaaaaucauggugucauugucugggguccaggccaucccaagagaagaauacugguuguggacacaguuacucacagaaucaaugaauuagcagcuugaggaugagagugcuuuauguaaaaccccucaucggggacagagaaucaacuccauccaaucuaccucuguaguauaaacagaaacugauuucaaaucccacgucugcuucucuccucgauucuuagauuggaguuguuuucguccuuccacaccccugcccuccucccugacaggcaagggaagauauuacccccacuuggugggggccgcucucaagcucguaaggcaagggcugccccagcgacaagggcacgggcgucgagaagcugcaguucuuccggaaugguguguccaguguccugaugucacug

SEQ ID NO: 1864 - RNA, 2242 nt, Mus musculus
ugcgccugcaggcgacacucucaggaagauggcugcugcugugcugcuggccgugggcuugcgcgcugcgcgcagaacccuggcugccgcgggggcccggggggcgcaggugagaagcagccagagggacgaggggucuugcaggcacuggcgcguuccgggcccggcacgcgcagcacucauccccgcggagccacugccucgaccaagggucaaauuccgggacucugcgggcgggcaggucugacuccagucccggagagaagcgaucugccugcgaccgcuucugggaacagccggggggcgucucgguugagauggagcgugugcugcuguccgggagccagcucucggcuuaccucaaccgugccccuugcaagaagugagugcucccuucugggagcuagccggcugucuuccucggaccucugacccuauaaugugcaccaguuuugcuccuucaucuuucacacaccaccacacgcagcagcgauuucauugaccccacuguuuugcuucagugucacacacuggcuccagcccucucugaaccggugggaaacugggauaucccuaccuauuauccccucagguacagccuaguucacuuagcugaacucuuccguaacuccgcugauucacaugacuggaaccgaaaguccaguguagaagccaagcaugguggcgcauuccuauaaucccagcaaugugggagacuguggcagcagaauuaccaggacugcgccagcuuggccugcauagaaacacuaacaggaaagcugcacaauaagauuugacacccaaaugagaaaucagccagugucaggacaaauacauuaaaucaaguaacaaggcuuaaagaucagaaaacguguaguagaaauacguuaaaaacaguaaagaguuucauucaugcuuugaaguugucaggggcauucaucugauguaugcaaggguagcguuggaacugaggccucaauguugucuugcuuuggggaacagagucuuauguaucccacaccagccaagagucucuaaacguagccaauccuccugccucccugaccuaggugcuggaauuacaaauguacgacuccacacccaggggaaaaccucacucuugaaacugcccuucugggucuucuuaccuggguagugcuagauuucucaggcacuguuacaggaaucaguugcacuccuaagucccgcauaggaaucacugcguguucuguaaccagguccaccaucaccuggccuacucuucaggcucugaaagucaggaauuuuuccuuggagugaaaagcacuaauagguucuuagaagaaugguguuaguaacacucagagcccagcaucuuccaaccucaacuaaguguuuggggaaauuacucucucccuuggggucacccgccccacccucagguccgaggaaacgcagggguguccgacgggagugaaguggccaaggcccagaaagcagcuccuggaggagcaucgccaaccaucuucucccggauuuuggaccggagucucccagcugacauucuauaugaagaucagcagguggggcccaauccucuugugaaugucaugggugcaauggcgccugaugaaguaacaccagucucucaccugucauugcucccagugccuuguguuccgugacguagcuccucaggcuccugugcacuuucuggucauuccuaggaagcccauuccucgaauuagccaggcugaagaggacgaccagcaggugaggagaacaggguccgggggugggggugggggguugggugggggcuugucugggaggagcccuggauuaaacuagagguuuggcuccuauggggagagccaccucugccucugcccucucccuuuagcuucuaggacacuuacuccuuguggccaagaagauagcacaggcccagggucugaaagauggguaucgacuuggugaguggcuuuuguccaugaaucccuauuacuugauguggucuuuucuuguuuugaccucccccgugacccugauccccuaaccucaagcucuguuucagugguuaaugauggcaagaugggcgcacagucuguguaucaccugcacauucacguacuuggaggccgacagcugcaguggccaccuggcuaaaccugccagcuggccaaggaccacaggccuggaugcuuggacggagaaugggaaaaggaaccuugugguguuaauaaacuuauucucccucaau

SEQ ID NO: 1865 - RNA, 941 nt, Mus musculus
cucaccuacaggcccaucugcugccccaagcuuuccuggccgcuuccuucaccuccuuguuccucaggcuguagauaaugggguucagcaugggggucaccacagcguagaggacuguaaagaccuggucugagauccgggcuuccuugcucuuggguuucauguacaugaagaugauagugcuauagaaaagcaggacaacagccaggugugccgagcagguggagaaggcuuugcugcgcccgguggcugagggcacccucaggaugguggccaggaucagcauguaggacaggcagaugagggucagggguauaggcaacaggaggauggcccccaccagcaggaaggcaucgcugacugaggugucaccacaggucagcuucagcacagccaggaucucacaggugaagugucugaucacgugguggccgcagaagggcagccucauggcgaugaccgucucugccacugacuugaagaggcagagcacccaggaggcuccugccagcaucaggcagagccuguggcucaugagcacgggguaccugaguggcuggcaaauggccaaguagcggucauaggccaugacggccaacagcaggcacucgguggagcccguggagaggcucagacacaucuggacggcacagcccguaaaggagauggucuuccgggacgacaggagguggaccagcaucagggguacaaaaguagauguguagcagauguccaaaauggaaagguuacccaggaaaaaguacaugggcgugugcaggcgggcauccaacaugcucaccgccacgauggcuguguuccccagcagagucaccagguacaugacugagcacagaggaaagaguagccgcucgagggccggguagccagaaaaucccuucaagacaaacucagagacugcaguucuguugcugggcuccaua

SEQ ID NO: 1866 - RNA, 492 nt, Mus musculus
gagucagcaccccauagaagagggagaugagcuagucugcaagguccugcuugucugcccccaguggguccuuggacuugggcuucccauacaugaacaggauggucccauagaagacaaguaccacggugaggugggcagagcagguggagaaggccuucuuccuccccucagcagaggggauccucaggauugucacaaggaugaagacauaggagaaagaaauaaagagaaccgggacccccagaaagauuauauuugucacccccaugcugaugacauugauggagaugucagcacaggccaguuucaggacugccaggaucucacauguaaagugauugaugacauuguccccacagaaggucagcuucauugcaagagauguuugaaccacagagacagcaauuccaccugaccaggagcugacagccaugggcacauaggcagccuuguucaugaccacgggguaucuaaggggguugcagaugg

SEQ ID NO: 1867 - RNA, 3901 nt, Mus musculus
gguugcacccugaguacggggggcaggugcuggggagagguccagccugacccuuugggagucacacguucugagcucucacuccaguucugcaggcccacugccucuguuucugauacaagcacucuccacucuuugagaaaucagcuauuuuugguaaacauguucccaagcaagguaagugcaacuuugaucaaagcaauggcagacuuguacaagcagagucaacacuucagaucagccugucuacaacagaggggccugcggcaggguggcgguauucuagaaucacacagacccauggagcugcaguaguccuuaggcucagauccgaggaaagaguuggccagaaucgcagcaagcaguuccugaaaccaugugcauuuucucagugguagagcccacauucugaagauacccaugagcuggauuucugaacuuggugcuggugacaucaaaggaaaugucuccuuuacaaaacacagauuucuggggggggggcaugagggcuggacaaaggagaauggaaaacccagcuggcuacugcccugcccugcccaguccauauaucacacaggcaguguguucugugucccgggcugucuuugggacuauucucacuaucagccuuguauuugacuccugaaugguguuuuaccucuaagggauacuuucuaucuuuaaaaccucagaggaaacagauagauucuugcuuaucuucauguugacacccaacccuucguggauguuuggaggggugcuguauggaagagagacugguuguccugggggugggguuucagaugacagggccagcuagaggcuacaagaagcacaguucaguucacuaggacucugacaggcaagccugggcuccaggcuucucaggaauguaggaaggagaaaccacugucagcaaggagacagguuguuaaguguaucuaaggccuauugugaucacugugguaacacaauauuuuacauugauaguacugacauuguucagguaauuguucauuuucacaacuaguuccuuacugaaaacuucagcccucuagggucaaguacugugccuuuuucauugcaauguccccuaaaccuagaauuauguccagcucauaggcgauguccuguaagagucuguuaacucagauugaguuacuauggcccuaacuuggugacaguuacugagucuacacacaacagaacagugugccagccuggcauaagcacugaggagacccuggaugagcaucugggaaguuccugucauuucagugacuguggccaugagucccuaugcucgagguugcaaacaaauguucauuauugcuuugagggcucuggugguauuguuugguuuuguuuuauccuggcccagaacaaaaccuaggguugagaggaacuuaaaauucugagguguucaucaagcuuccccagagugaccagggcaggccugggcucccaguggagagacgugucaacgagcuggucacuguggcaucaguacgaucgcgcugacucccagagcaaugccaguguccuagagcuguugcccagacugccauugucuccaggaaagcacuguuguauuuuccgagugguuucugcugguuuucauuugaguugucuaccuuuagacuuuauucucucccucucuuucuuuuucucccucugucucugucugucugucugucucucucucuccugcgcaucuguguuauacauguauguucaaauguguaugugaacguguguauguguguauguguguacguguguguguguguguguguguguguguguguguguaggacaacagugaacacugggugucuuccucaaucacucauuuauuuacugagucagguucucccagggaaccugggacaugaugauuugacuagccuugcuggucagugugccacagggaucccaugucuuugccucucaggcccugggaaggugugcaggccauuaugaacaucugguuuucuaucaaggugcugaguaucugaacuugauucucaugguagcacagcaagaaccccauccacugggcuaucccccuaacgcccccucucucacacacacuuuguucuuuuaaaauguguggcagcauuugaaaagcuacucacaggaacaauuucagacuggcgugaugcuaccuuccuucggaggggucugcaucugcuucugcuguggauuugaaagcacuaaaguccuaggaucacugacugaaagcacucacuaaugccuguacccucccgaguuaccucagugcuguggugcugccugggguuccauugcaaaggggagggguuugcuuuggaugggugcccugcacacugguccuugugcaucaaguccuguucuuucucuccacaaggcugccaguggaguaccaaggucucuuggacccuuguuuuucccagaaucuuauccaaauaacuucuucuuucucuccagugcuuuauagagauguuuuauacacuuugccguuuuuucugaauuguccucugcaggagggauaguucagcuuaacuuguuacuacauuagaaaguuaaauaucccccuacuguguauuuccuagaagugaacaauuccauagagacuccaagauugucaaaggugccucuggcugcuuggcaggacaaggcuuuggcuuggcugcccaggagcuuugggaggaagacaauguugaugcugauugcugaguuccugcagguuucaaaccgaauguaccauggacagauccaaugagaccgccccccuguccggcuucauucuccugggccucucugcccacccaaagcuggagaaaaccuucuucgugcucauccugaugauguaccuggugauccugcugggcaacggcguccucauccuggugagcauccucgacucccaccugcacacgcccauguacuucuuccuggggaaccucuccuuccuggacaucugcuacacuaccuccucugucccccucauucuggacagcuuucugacucccaggaagaccaucuccuucucgggcugugccgugcagauguuucucuccuucgccaugggagccacggagugugugcuccugaguaugauggcguuugaucguuauguggccaucugcaacccccuuagauauccuguggucaugaacaaggcugccuaugugcccauggcugccaguuccugggcaggugguaucacuaauucuguagugcagacaucuuuggcaaugcggcugcccuucuguggggacaaugucaucaaucacuucaccugugagauccuggcaguccugaaacuggccugugcugacaucuccaucaaugucaucagcaugguuguggccaacaugaucuucuuggcagucccaguccucuucaucuuugucuccuaugucuucauccuugugacaauccugaggauccccucugcugaggggaggaagaaggccuucuccaccugcucugcccaccucaccgugguacuugucuucuauggaaccauccucuucauguacgggaagcccaaguccaaggacccacugggggcagacaagcaggaccuugcagacaagcucaucucccucuucuauggaguggugacccccaugcuaaaccccaucaucuacagcuugagaaacaaggacgugagggcugcugugaggaaccuggugggccagaaacaccuaacugagugacugucacagugcagaacuuccaaccucuucauuguguuugugagggaagaguggugcaaugaagaggagccacuuccccaagguccaaguaaugaacucagaacuaagacuauaaacaaacuaucaacguuccuuaagcaccaaugcuucuaguuaacaggcuggaaggacaagccuuuacaccuuuggagaga

SEQ ID NO: 1868 - RNA, 2680 nt, Mus musculus
augaaacauaaauagcaucuuuaauuucuuuagaauuaaauauucaacauucuuagucaucugggaaaugcaaaucaaaacuacuuugagauuucaucucacaccaguaagaauagccaagaucaauaaagcaaaugacagcucacagcggugaggauauuggguaagggaaacucucaccuacugauggugagcguuggaauuuuuuuguauacugugugaagguguguuucuguccucuuucacuugccuaaagcagucucugauuggcuuuaauaaagaucugagagccaauagcugggcaggaaguagaaggcaggacuuccugguagagagaaagggacugugggaagacucaugugcgggaggaucuguguguugcagaguuggaaggauuacgugcuggguccgagugagagguaauggccacgugacagauguagauagaauaaacaggcuaauuuaaguuagacaagguaguugggaggcacccaacuauaaugccugugggucgcaacccucuugagguuguugaaugacccuuuuacaggaguugccuaagaucaucagaaaaugcaaauauuuauauuacaauucauaacaggaucaaaauuacaucuacgaaguggcaaugaaaagaacuuuacgguuggguguaccacagcgugaggaacuguauuaaagagucgcagaauuagcaaaguugaggaccacuaacccacagaggcacuugcucagccguguucauugcuguccuacucaugauagccgguaucacuggguaguuggugauuguacauugacauccuguguguuggcaaaacaggaaagcccacaaagauacagugucugugagaggcaguugugucuggaagagaugcaguuugggugugccucuacaggccuagauagauaagaaugcuaaagaauugaaaguucccgcccauuucaaggcacauugcuuggaggaggucuguggucuuugcucuaugaccugaagcaaagucagcuggauggccuugagcuguuccacuguacaggugaaaugguuuggcccccacugacuuggcuuggagucaccaccaccaccauguccgugacucugcucagccuggccaggguguaaggaggagcuagagacuucuuuuauagcaauggaccuuugagagagcucugcucacuuggacuuuugggcucucucucuuuuuggcuuggcuucauagaaggagauccagguaagguagggauuuguucuuugggcuagcaggaaccucagagaaccagugggcaggacauaggagaaacaggauucuaggaaagaacuaaggagcccucuuggguuuggaggagcucaagagaaagguagauuagcucaguacaaugacacagcuagaaagauuucuaaggagcuagcaguuuauuguagaaucaggcuuguaaauagaucuuuuguaguuaagaaaguaaaguuaccuugcugagcuagugggguuuuaccacagcuccugccuccaguguuuuuauggguauaaauauuaaguaaauuuaaaaagauaauuauuacaagccagaaauuggaaacacccuugaugccuguguuagucgggcuuucuauugcugugaagagacaccauggccagggcaauucuuauuaaaaaaaaaauguuuaauuggggcugccuuacaguucagagguuuaguccauuaucaucauagugagaagcauggcggcacacaggcaggcauggugcuggagagcuggcugaguguucuacaucuggaugcaaaggcagcaggaagagacaaugagccacuaagccuggcuugagcuucugagacuucaaagccugcccccucaguuaaucacuuccucugaaaaugccacacuuacuccaacaaggcguuacaccucuuaauaggcccagucccuaggagccuauggggccauuuauuuucucuuccuuccuuccuuccuuccuuuucucccucccucccucucucuuucuuucucucucuuuuucuuucucucucuugagagguuuccaaucuuuuuguuuuuggauuggauauuuucuuuauuuacauuucaaauguuucccccuuuccaggucuccccuucagaccuccccacccccucuucccugccucuaugaagguccuccgcccuggcauuucccuacacuuggacaucgaacacccuugggcccaagggccucuccucccacugauguccaacaaggccaucuucugccacauagguggccagcaccauggguugcuccauguguauucauugguuggugguucaguccccgggagcuccaguggggucuggccuguugacacuguugcucccuccaugaggcugcaaaaccccucagcuucuucaguccuuucuccaacuccuccauccgggaccccgagcucaguccaaugguuggcuuugaguuucugccucugucuuugucaagcacuagcagaaccucucaggagacagccauaucaggcuuccauccgcaagcacuucccagcauccacaauaaaguccggguuugguggcuguauaugagauggguccccagguggggcagucucuggaugcccuuucuuucagucucugcuccacacuuugucuccauauuuccuccugugaguauuuuguucacccuucuaaaaagca

SEQ ID NO: 1869 - RNA, 2680 nt, Mus musculus
ugcuuuuuagaagggugaacaaaauacucacaggaggaaauauggagacaaaguguggagcagagacugaaagaaagggcauccagagacugccccaccuggggacccaucucauauacagccaccaaacccggacuuuauuguggaugcugggaagugcuugcggauggaagccugauauggcugucuccugagagguucugcuagugcuugacaaagacagaggcagaaacucaaagccaaccauuggacugagcucggggucccggauggaggaguuggagaaaggacugaagaagcugagggguuuugcagccucauggagggagcaacagugucaacaggccagaccccacuggagcucccggggacugaaccaccaaccaaugaauacacauggagcaacccauggugcuggccaccuauguggcagaagauggccuuguuggacaucagugggaggagaggcccuugggcccaaggguguucgauguccaaguguagggaaaugccagggcggaggaccuucauagaggcagggaagaggggguggggaggucugaaggggagaccuggaaagggggaaacauuugaaauguaaauaaagaaaauauccaauccaaaaacaaaaagauuggaaaccucucaagagagagaaagaaaaagagagagaaagaaagagagagggagggagggagaaaaggaaggaaggaaggaaggaagagaaaauaaauggccccauaggcuccuagggacugggccuauuaagagguguaacgccuuguuggaguaaguguggcauuuucagaggaagugauuaacugagggggcaggcuuugaagucucagaagcucaagccaggcuuaguggcucauugucucuuccugcugccuuugcauccagauguagaacacucagccagcucuccagcaccaugccugccugugugccgccaugcuucucacuaugaugauaauggacuaaaccucugaacuguaaggcagccccaauuaaacauuuuuuuuuuaauaagaauugcccuggccauggugucucuucacagcaauagaaagcccgacuaacacaggcaucaaggguguuuccaauuucuggcuuguaauaauuaucuuuuuaaauuuacuuaauauuuauacccauaaaaacacuggaggcaggagcugugguaaaaccccacuagcucagcaagguaacuuuacuuucuuaacuacaaaagaucuauuuacaagccugauucuacaauaaacugcuagcuccuuagaaaucuuucuagcugugucauuguacugagcuaaucuaccuuucucuugagcuccuccaaacccaagagggcuccuuaguucuuuccuagaauccuguuucuccuauguccugcccacugguucucugagguuccugcuagcccaaagaacaaaucccuaccuuaccuggaucuccuucuaugaagccaagccaaaaagagagagagcccaaaaguccaagugagcagagcucucucaaagguccauugcuauaaaagaagucucuagcuccuccuuacacccuggccaggcugagcagagucacggacaugguggugguggugacuccaagccaagucagugggggccaaaccauuucaccuguacaguggaacagcucaaggccauccagcugacuuugcuucaggucauagagcaaagaccacagaccuccuccaagcaaugugccuugaaaugggcgggaacuuucaauucuuuagcauucuuaucuaucuaggccuguagaggcacacccaaacugcaucucuuccagacacaacugccucucacagacacuguaucuuugugggcuuuccuguuuugccaacacacaggaugucaauguacaaucaccaacuacccagugauaccggcuaucaugaguaggacagcaaugaacacggcugagcaagugccucuguggguuagugguccucaacuuugcuaauucugcgacucuuuaauacaguuccucacgcugugguacacccaaccguaaaguucuuuucauugccacuucguagauguaauuuugauccuguuaugaauuguaauauaaauauuugcauuuucugaugaucuuaggcaacuccuguaaaagggucauucaacaaccucaagaggguugcgacccacaggcauuauaguugggugccucccaacuaccuugucuaacuuaaauuagccuguuuauucuaucuacaucugucacguggccauuaccucucacucggacccagcacguaauccuuccaacucugcaacacacagauccucccgcacaugagucuucccacagucccuuucucucuaccaggaaguccugccuucuacuuccugcccagcuauuggcucucagaucuuuauuaaagccaaucagagacugcuuuaggcaagugaaagaggacagaaacacaccuucacacaguauacaaaaaaauuccaacgcucaccaucaguaggugagaguuucccuuacccaauauccucaccgcugugagcugucauuugcuuuauugaucuuggcuauucuuacuggugugagaugaaaucucaaaguaguuuugauuugcauuucccagaugacuaagaauguugaauauuuaauucuaaagaaauuaaagaugcuauuuauguuucau

SEQ ID NO: 1870 - RNA, 29046 nt, Mus musculus
ugugggaagacucaugugcgggaggaucuguguguugcagaguuggaaggauuacgugcuggguccgagugagagguaauggccacgugacagauguagauagaauaaacaggcuaauuuaaguuagacaagguaguugggaggcacccaacuauaaugccugugggucgcaacccucuugagguuguugaaugacccuuuuacaggaguugccuaagaucaucagaaaaugcaaauauuuauauuacaauucauaacaggaucaaaauuacaucuacgaaguggcaaugaaaagaacuuuacgguuggguguaccacagcgugaggaacuguauuaaagagucgcagaauuagcaaaguugaggaccacuaacccacagaggcacuugcucagccguguucauugcuguccuacucaugauagccgguaucacuggguaguuggugauuguacauugacauccuguguguuggcaaaacaggaaagcccacaaagauacagugucugugagaggcaguugugucuggaagagaugcaguuugggugugccucuacaggccuagauagauaagaaugcuaaagaauugaaaguucccgcccauuucaaggcacauugcuuggaggaggucuguggucuuugcucuaugaccugaagcaaagucagcuggauggccuugagcuguuccacuguacaggugaaaugguuuggcccccacugacuuggcuuggagucaccaccaccaccauguccgugacucugcucagccuggccaggguguaaggaggagcuagagacuucuuuuauagcaauggaccuuugagagagcucugcucacuuggacuuuugggcucucucucuuuuuggcuuggcuucauagaaggagauccagguaagguagggauuuguucuuugggcuagcaggaaccucagagaaccagugggcaggacauaggagaaacaggauucuaggaaagaacuaaggagcccucuuggguuuggaggagcucaagagaaagguagauuagcucaguacaaugacacagcuagaaagauuucuaaggagcuagcaguuuauuguagaaucaggcuuguaaauagaucuuuuguaguuaagaaaguaaaguuaccuugcugagcuagugggguuuuaccacagcuccugccuccaguguuuuuauggguauaaauauuaaguaaauuuaaaaagauaauuauuacaagccagaaauuggaaacacccuugaugccuguguuagucgggcuuucuauugcugugaagagacaccauggccagggcaauucuuauuaaaaaaaaaauguuuaauuggggcugccuuacaguucagagguuuaguccauuaucaucauagugagaagcauggcggcacacaggcaggcauggugcuggagagcuggcugaguguucuacaucuggaugcaaaggcagcaggaagagacaaugagccacuaagccuggcuugagcuucugagacuucaaagccugcccccucaguuaaucacuuccucugaaaaugccacacuuacuccaacaaggcguuacaccucuuaauaggcccagucccuaggagccuauggggccauuuauuuucucuuccuuccuuccuuccuuccuuuucucccucccucccucucucuuucuuucucucucuuuuucuuucucucucuugagagguuuccaaucuuuuuguuuuuggauuggauauuuucuuuauuuacauuucaaauguuucccccuuuccaggucuccccuucagaccuccccacccccucuucccugccucuaugaagguccuccgcccuggcauuucccuacacuuggacaucgaacacccuugggcccaagggccucuccucccacugauguccaacaaggccaucuucugccacauagguggccagcaccauggguugcuccauguguauucauugguuggugguucaguccccgggagcuccaguggggucuggccuguugacacuguugcucccuccaugaggcugcaaaaccccucagcuucuucaguccuuucuccaacuccuccauccgggaccccgagcucaguccaaugguuggcuuugaguuucugccucugucuuugucaagcacuagcagaaccucucaggagacagccauaucaggcuuccauccgcaagcacuucccagcauccacaauaaaguccggguuugguggcuguauaugagauggguccccagguggggcagucucuggaugcccuuucuuucagucucugcuccacacuuugucuccauauuuccuccugugaguauuuuguucacccuucuaaaaagcacugaagcauccacauuuuggucuuccuucuuaggcuucauguggucugugaauugaaucuuggauauuccaaacuuuugggcuaauauccacuuaucagugagugcauaccguguuuguucuuuuaugacugaguuaccucacucaggaugauauuuucuaguuccaucuauuugccugagaauuucaugaagucauuuauucauuuauuuauuuauuuauuuauuuauuuauuaauuauauguaaguacacuguagcugucuucagacacuccagaagagggagucagaucucuuuauggaugguuuugagccaccaugugguugcugggauuugaacucaggaccuuuggaagagcgagcagucaguguucuuacccgcugagccaucucaccagccccaugaagucauuuuuaauagcugaguaguauuccauuguguaaauguaacacauuuucuguauccauuaaucuguugagggacaucugaguugacuccgccuucuggcuauuauaaauaugguggcaaugaacauaguggagcaugcauccuuauuacauguuggaacaucuucuggguauaugcccaggaguguuauaggugggucuucagguaguacuacgucuguggggccauuuucaaacuaccacgauacccaucaauacaugaauggaucaggaaaaugugguauauuuacacaauggcauauuauucaguuguugaaaucaugagauuuuucaggugaauggauagaaguagaaaaaaaucauccugagugaggaaauggaaaauucaaaaaucaaauauaguauugagaugcuuugagugagcaaaaccccgagggcuccucuguuuguauguuuaguucccagcugaugaaucguuugggaaggaguaggagguguggccuccuuguagaaaguguguaacuggggauggacuuugagguuucagaagcguacaccaggccuagugccucucuccuugucugucugcugccuguguguggaucaggacgugaagcucccagcuacugcuccagugccacgccagucugcuucuugucuaugguaaauaugaacuaacccucugaaacuguaagcaagccucuaacuaaaugauucuuuuuguaaaagucaccuuggucauggugccucuucacagcaauagaacaguaacuaaacaggugugcauuccuuuauauguggauauuacugcuaagccuuuuaauaggcagguuacuauaugaacaacuauggagguuaauaugcagugaggaacuagaggggagggaaguaguccccaaggagggggaaauagaauacauagagaaaaacggcggagaggaggcuggaacagaaggauuaaguggagagaggaggaagauuggguaaggaaggaaguauagggagggagaacuaacaguaggccauuugaaugggucauggaaaccuauuauaguagaugcuucugaaauagcguucauuguacuggaagguacucuauacccuaccagaggaaagguaaucacuaacucagcuacaaacccuuuaccuacauuggugacucuccugcaugguacacugguacaacaguggcauagauguuuuuggaguaaucaaccaccagucaauugcaucuaaggcccacgccaugagaaagaacccauagucuaucauaaucucuaaaaguucaaagucucuucugagauucaugcaaucucuuagcuguaguccccuauaaaauuaaaauaaaaaagcagaucacccacuuccaacauuacaggauauacauuaccaugccaaaacaucauaaugaggaaauacuguacuaaaacaagaccaucugaguaaaccccaaacuuugcaucuccaugucugauauccaacuccuuucagcuuuguugacugcaacacaauucuuucucuugggcucguucuacuccuucuuaacaacuuuccucagcagauaucccauggcuuuggcaucucaaacaacuuggggucuccaaggcaacuucaguuucacagcuucucguucuaaugucuggaauccacacaugcucuucuggagcccugcaaagggcuugggucacuucuccaguucugcccucuguagaagucuaggcucagguugauccacuuuacugcugcugcuauucuugauaaucaucccaugguauuggggucuucauauaugcuggguucuuccacugcaacuaggcugcacuuucacuaauagcuccucauagguucucuucauggugcugaagccucuacuucuuugcaugacuccuucaguccugggccuucaacugccacugagucuacaucuucaccauuggcaccuacugaucccaaauaguggguuaaauguguugaucuggaucaaaauugugugucaucucaucucaauauccggaucaaggcauguugucuuccugcuugaagaucuggauugcaggugcacccuccauuucuagacuggaguucauuccagauauagucaaguugauaauugggaauacccaucacaaucuaucccuugucaacuugacacaccaucauaucuccuuauguccaagugaaaacaauaaucagguuauaaugauaccuaacaugauauaacucccucauucaaugugaaugcauaguaaauuuagauuagguggcaaugucccuuuuucaacauucuuuucacaagauggaagcuuagcaggaugggaucuugccccaaagucaccacucucuuaauuucacuuaguaucuuuaauuuguuuaucuucuugaacacaaagauuuagcuccauuccacuccuuuaauccuugaaucauacauuuuguauuuucccuuucuaaguuugcuacacuugaucaaaaugcucuucauaagagggaaccaauggaccaucuagugauugccauaugcagggauccaucccauaaucagcuuccaaaugcugacaccauugcauacacuagcaagauuuugcugaaaggacccagauauagcucuuucuugugggacuaugccggggccuagcaaacacagaaguggaugaucacagucagcuauuggaugggucacacggccccuuauggaggagcuagagaaaguacccaaggagcuaaagggaacugcaacccuauagguggaacaauaugaacuaaccaguacccgggagcucuugucuuuagcugcauauguaucaaaagauggccuagucggucaucacuguaaagagaggcccauuggacuugcaaacuuuauaugccccaguacaggggaacgccagggcaaaagggggaguggguggguaggggguuggggguggguggguaugggggaccuuugggauagcauugaaaauguaaacaaggaaaauaccuaauuaaaaaaaaaaaagagggaaccacagggcagaguuuauagcaggcuuuuuugagacuuccuuugucaaugcaauuaaucugaaucuuuuuaccuuagugucaggcagacucugcagacaagggcaaaaagcagcuacagucuucaccaaaacaucacaagaacaaucucuaggccccauauuaaaauucuucuccacuggaaccucuucagccagacccccacaguucaagucauccucagcaccccgucuucaugcuucuacuagacucgcccaagaagccccgcuuaaagccgcugcuuuccaaaauccacacuccuccaaacaauagcauagucaggccuaucacagccacacccuaguccccgguaccaacuucuuagucaacguuuccauugcugugaagagacagcaugaccaaggcagcucuuauaaaggaaaacaucucacugggauucgcuuacaguuuccgaagauaagucugggaagcauggcggcauccagaaagugguauuggggaaugaguugagaguucuaugucuuuggagauuuuuuuuuucuuauacugcuuuguuugguuaugcuuuggguuuuguuuguuuucuuauauucuuuuuuuaaccuuacuugucuuuugcuuguauaguaagguuuccaauuuugaguuuuuauggguucucucucucucgcucucuguuuuucuugugcucuuaaauuuuauuaaucuguucauuucauuuuauucuuguuuaucuucauuuuccagguuuuuuuuuuuuuuagacuuacuuacuaugcacacaguguuuugccuacacuccagaagagggaaccaaaucucacauuacagaugguugugagugagccaccuugugguugcuggaauuugaacucaggacaucuggaaggacagccagugcucuuaaccacugagccaucuccccaggcccauccuauuuguuuuuuuuuaagagagugagaaaggaguggaguuugaaggguggggagguggggaagaacugggagaugaggaaagagaaccauaauugaaauaguaugaagauaacuauauuugauuaaaaauguagaaaggggggugcauuacagauuuaccuaacagaagcauuuucugucuccaaaugacucuagcuugugucaagcugauauaaaaugcgucagcacagcagccagagucgucucuuccuggggccuucucauggaggucucuacuaguuucacagggacguuccagagaugacugaggaaaaucuucauacaucauaccuucuuuguuuuguuuuuuggacaucaucugccccaguaucugccuuugcuaaguagaccacacuggccucaaacucaugucuugguuuguuaauuuauuuauuuuuuuuuuuaggguuuguccuaguuaggguuucuauugcugagaugaaacaccaugaccaaaaagcaaguugggguggaaaggguuuaucuggcuuaugcuuccauauugcuguuuaucacugaaggaagucaggacaggaacucaaacgcugcagaauccuggaggcaggagcugaugcagaagccauggggguaggcaugguagggaugcugcuugcugggcucgcuuccccuggcuuguucagccugcuuuauaauagaauccaggaccaccagcugacaggcccucccccaucaaucacuuauuaagaaaaugccuuacagcaggaucuuaugaaggcauuuucucaauugugguuccccccuuucggguaacucuagcucaugucaaguugagagaaaaagacuagcgagcaugcaccugcuucugccuccagacugcuggcuuuacaaaugugcacuaacuuuccccaaacuuuucuauaaauuguuuuuacacucaucuuguguguacuguguugucuaugugugcaacggcauauuugauuaugccaugguagccaacucaggucaucaggccugcaaacaacacuuuuaccugcuaagccauguugccagccuucuaaacuucuucuaaacaguccgugcuuaggaugguuuuuacaaggcccguggaguucacugguagagagcuuugccuucuguccccauucagcaaaauaaaaguaguuuauguaguuacuuaaaaaguaacaaauggggcuggugagauggcucaguggguaagaguacccgacugcucuuccgaagguccgaaguucaagucccagcaaccacaugguggcucacaaccauccguaaugagaucugacucccucuucuggagggucugaagacagcuacaguguacuuacauguaauaaauaaauaaauaaaucuuaaaaaaaaaaaaaaguaacaaacaaaaaaaaaaaacaaaaccaaccaaagauauguguauuaaaucacacaggacuggcaagauggcuggauaaaggugccgucaccaugccugguuacucgaguuccaccuaagggacucacaugguagaacugccucccagcaaguuggccucugaucuacacacacauuuuaacuaacuauaacuaaaagaaaaaauagaacucacauuuuuccuguccuuucuauuugugaaggcaucuuugacccaaagguugguugguugguugguugguugcuuaacggggcuuucuacuugaugcccaagcuggccucaaacuacuagguucaaguaguaaagugaccuuuguuuuuuguuucuuucuuucuuuuuagggugguaacauuaaaugguaacugcacuucucuuggucuaugcacccauaaaauuuuucaaucauccaggagggaggcaaugcaagauucuucuaccagcuuuccaagcgaggacacugagguucagaaacacccagugguuguguguugaguagucgggaagagcucacgucccugaugcccacaaauggcuguuccugaucacuccagcucccgaugcucggcgacucccagcuuccccuaggguggcacuuccgcuggcucuuccuucugcucccagucacgaguuguccccagggcuccuccccuuugccagcugauugggcagcucccgucuucugauuggcuguucuuuuuguggcucaccaacccaaccggauauagaagcaggguuuccgcuuccaccuucucccucuucucgcucguccuccgguagcagccgccagcacagugucggcugcugggcggggugucggcggaucggucgguugguuucggcuucggcgucucugcgguugaguugggcugucauggccgaguuggauccauucggcgcucccgccggugcgcccgguggccccgcucuaggaaacgggguggcgggcgccggcgaagaagacccggccgcggccuucuuggcgcagcaagagagugagauugcgggcaucgagaacgaugaggccuucgccauccuggacggcggcgcccccgggccgcagccacacggcgagccgccgggagguccgggugagagggcagcggcguucgggcgggaggacuugugggcacacucgggucggugcucuuacgcggaacuugggcuucuggcugaagcuuuagaagcgcaaagaggaagugagaccccgucugggucauugcacggaccuccgcugcugcagacugccggcuucugagugcugcugggccggggcggaggggagcgcagaugcaccgacugucaggauccggguccguucuguccaacuuuucaccaagcccuugcugugccugaagccuggucucugaagcugccgcauuggcgcaguuuggccagacuuagagacauggcugaguccacucggaaauaauugcuuauuaggaaaaagugagaguaguauaaacuuugggacacacgugcaaacaaaaaugucaacguaguuuagcaguuaaagauacgcaaaacuuuggauuguggggaggaagauaaggaguucauaaagaugggccggcugcggagaaagaaacugacccagaaggauagguguuacauuacaagcauugcauacauuguugaggcuaggacuccuggcgcuauucuuuggaaacagcuuuggaaggaauuaauugccucaggaaaaggcagggauaguccggaccaaucuaaggagggggaggagggaaagaugaauguggagugcagugugggccuuuccacagcagagcucaagcaacagagacgggauaggaugacaguuuggccuuuggauggcuuccuuguuugaugcucaggauuguggugugggaggaaagauggcguggaaaaggccuauucaguagugaaggaaguaggauauagcuagagagagagagagacaauggcuuuccauuuacaaggaaaaaagcuuggcacuguggaccaucaugcacuuagguauuugggacauuggugccagagguucaccaccagccugaguaacauagggggaacccuucacccaaaaaugcaacuuaaaaauauuaaauggcaaucuccgggcuaguaagaauaucuacccucuaaacucugcgacugugaggcaggugaccaaugaaagcaaacggcauggugacagugaguggugcagccuuaggcucccaugcaccacaguaaugcuuugaguguauuugaggccagagaucacaaauggccauuuuaagcaggcagaauauuuugggacagacuugcuccuacuuugcagccucuggguuuguuuauuuaacaaaaccaaccccccccaaaaaaaacaaaaaaaagcaggacauuaugcuaacuccuagacaaaucaugccccagccagagcuucuaugggagccuguacuguaccccagguuugcaguuugcagcaagcugcuuggacagaccugggccauaaccuagaacugacggcagagccuguuuucuuugagugggcuuuugcauuugcaugagaacgccugaaauuugcuuuuuaguccuauagaguccuuccuucauuuaauagaaaacugaguccuagagagucaugacuuggugaagaaaacagccccgacucuccccucccucagacuguguauaccucguucuguugcagauguuuuagcagggugugcuuggacggaagaaaggcuuugugggugugucgggaaggcaagaauugggagaaguagcauccauagaagagucuaucauucuacgggcaguguuguauguguucagugucacauuuggaucgaucguguaagugucuggucuauaguaggugcucauguguuugacaaauagguaggcagaaagagcccugcuaggcaguugggaggauaaaacggagaggcugcacaguugugcuuuuuuuuuuuuucagcaaagggaaggaaagaggugguugcugacuuaguuccugggaaagacguuuuuaugaacuaagcauuuaacgacuuaaugccagcuccugacaguguguugagggcaguaauaguguaaucucagcacuuccucuugggaguugacaacuuucauacucaacacaguaguggcugggauucaggcuauccugcugcuugagggcgaguuuaggcgauuuauguaacgacugucacggcuuagccugcuuucuucucuguuaagguacauaauauauaccacaagguguuuuagaaucacaucaauuugucugugauugcuuacugguguguaguaagcagucagugaauuuuagcuacuguuuuucuggaaguaggaagaggcguuaaaagguuugaaggcagacuggagaaauggcucagcgguuaagagcaccaacugcucuucuaaagguccugaguucaaaucccagcaaccacaugguggcucacaaccaucuguaaugagaucuggugcucucuucuggugugucggaagacagcuacaguguacuuacauauaauaaauaagucuuuaaaaaaaaaaaaggcuugaaggcuuugggguauaccgaguaaauugaaagaguaggugggagcucugcuucauguacuuuccagagggacagauuaaaaaaaaaaaaaaagacguaaacuugcucccucugcagggaaaaugcccaugggagaugcccacagguuaaacagaaggcugggccaagacauauguuuagggauagguaaccaacccggugaaguggcugggguagucaugaagaacagaugguuaggaaggagguggggcaagucagauauugaaaaauaucccucaguggugggggcuggaggagaggauauagaaaguauuuauugguggacgacagagcguguggucacaggcacgguguuucugacaagccaagagagaugaauuaaagguuguuuuucuggagggagauuaauuuuauugguagaaauggaagaaagaaauuaaagaguguuacacaugauauuuaaauaugcugugcauuuacugcauccaaacacuccgcaugccucuggauccaugcagcauccgccagcgaggcugcggugucgcagguuucggaugagaccugguuacugugcaagcuaagcugugcucuaagguacaagcuaauccucggcucagcuaggaugcagcccuaggucugccugacuucacuugcugacauaaacauaagguuaaaguugccuugcuccauggaaacuuuacucugcccuugguuauuuucuucuugcggggaugggguggugguuugagucagggucuguuccuguaguucuggaacuugcuauaaauaaggcuggcagaacucgaaucaccugcuucuguccccgagguucuggggcuaaagcgugggcugcucugcuugaguggccucuguggcuuucuggacuucccuuuauugguuuuuuugagagaguuucucuguguagcccuggcuguacuggaacucacucugaagaucaggcuggucuauaacucacagagaucugcccaccucugccucccaagggcugggauuaaaggugugccccacucugccugccuucuuucuggacuucuuaagaugccugagaaaguuuucugcaucauugguguuaguggaguugucuuaaaucaaaguccauagauauaauuccuuuguuucuguagacuguucuuugacuugggucaucugauugauguaagaaugagaagacuaucgagauggcucagggguuacgagcugcaguuccuagcaucacaugguagcuggaacugcaguuucuggggaucugauuaccucuucuugucuuugccggcauuguauacacaguggccugcauauacauacaggcaaagcacccauacgcauacauaagucuuuagaaugucagaagaauaaaguaauaucuaguaaagagcucaaagcaugugccgggccaggaugauuccucagacccaaagggcaggcugccaguaguuuaggaguaugagugugcaaugcucugguuuuauuagaguaguggccaaagucgucuuuuggcgcugucccuaggcugaaccguauuaacagugcucgcuguaaucuauuaaccauacuguaggacuggucgggcuagccaucggaggcucaggggucgaagaguaucucacucuucuaccuuacacaaaaacagauuccaggugagacagacauucuuuaaaguaccggcagaaacaccagugagauggcucagugggcgaaaggcccccgcugucaaaccugauggcuuaaauaaagugugauuaguuauauaaaagaaaaaaaaauguuauuaugggauagcccuugcagaagccacagaguaauaguugguaacauuugcugacaaauugaauugaaacucucaggauuaaaugucauaaaccaaguugaaaaacaauaugggguguugggauguagcucaguugguagagugcuugcuuaauaugcaugaagcccuggguucaauucccaguaccguauaaccugacuuauacagugguguaggccuguauucccagcacuugggaagggaggcagaguauucgaaguuuaaggucauucucaccaacaugauguuuuuccaugauguuugaagacagucugggcuacaguaaaagccugugucaauuaaacacgcgcgcacgugcaaaugaugaacauaggagauggcucaaauccugcacaagcgagacucugaguuagaucccaaguacucaugugaaaucugacugcugugguagaugccugcaagcccagaguugggaggagacaggaucccuggugcuugcuggccaaccagcagaccaugucuuuaaaaauaagguugaagucacuugggggaagauauccaaugagaaccccugaguuccacaugcaugcacaggugcacagagaggcgccuggggagggaggugaacaaaaugggggaaauacuugcaguauuauagauuuauuaauaaagagaauuucgagaucagaagacaguaaaaacaggcagaucucagacaguugaauaaagaagaaagucagaugucagauaccucguuaccucagaauaggaaccuucacaguaauacauacccuguggccuggcaauucuucaacaagaaauucaucaaaggacuacaccagccaaauacuucuauucacuguuaggaaccuuuguuagaauuauuaggcuauaugccaccuaccuuuaguuucuuucuguaugguugacgcucaccuggaauuugcccaggcuggucucacaacccuugaucuccugccucagcuucugagugcuggcacuacaggcguguaugaacacggauaguucauauccacacccuggccccugugugcgugcaggucagaggcaagcuugcaggaguccuguucuucuacuguuugggucacagggaguggacucagggugucaggcaauuuuuuuuuuaaauuggguauaugagcguuuugccugugugcauguuucuacaccauuagggugccugguacccaugaagacacaaggagaccauuggaucuccuggaacuggaguuacagaugguuuuaagcugcccugugggugcugggaaucaaaccugcauucucagagggccuccagugcucuuacacugugccaucuuuccggcucccuucccccaccgaaguauuuugccuuuugauccuagggccucucugaggcaugcaggcuaggcaggcucucuugccauugagcuaugcucuagccccgcugucacuucuuacaggcuauucaguagcuucuaguugcugcagcacacaauauuguauucucguauauaauccuuaauccuuaaguggcccugacugacuugcugaaaucuuaugucuuacagaugcuguugacggagugaugaauggugaauacuaccagguacagagugcucuuaacuauauuaaauaacacuaaacuagagccuuaacugugauuugaacugacugaccuaaaagagaccccagugcuggugcccugucugccagaguagacaguggcaguggcaguaagagcuuuuuggaaaaaaaaaaaauagaauuugaaacgaugaucaucauccucaauuuaagcacuaugugcccuaugccauauccaguacuauagaagucacugggaacaaugugggccuggcuguccugggauucacuaaggagaccaggcuaggcugccucacaguuuaacuugccucugccuccugagagcugggauccaccacuaagccuggcauucacuagaacuuuaacgcucuuucucguuguuagagucuaauacggucaagcugguaaugaaccccagguggccacaucauauaauucucaaaucaguuugcagcucugagguuuugucaauguguuauuaggucucaagucuuuacccacuacagaaaagcaccccugccuucugacucauagucgucugcaguuuuugauccuucccugauuugacuauaguugcuaugcauuuucuuuugaauucuuucuuaaaauuuaccguuugguuagauggcauucagugacugucuccugcaugguacagugucauuugaagcccuaauuaggcucuaagcuuggcuuuguugcuuugaagguuagcgcauaucucucugucgagugaggagagagacugaucacaguccuaaugugucccuuaugcauccagccucagcuuuccugucaccuacucgugccccacuuuuuaacagauaacaacuaguuugccucccuucugagagugcaaggacccagcucgguaaugcuguaaugcagggagugcugguggcuuguagggcucuccuguugcguuaagucauccuuuaacauuuuacacagccucgcuaugugaccuguucuacucuuaggaaggaugggguacugauagagugugugauuguuuuguguuaaggagagcaaugguccaacagacaguuacgcagccauuucagaaguggaucgauugcagucagagccugaaaguauccguaaguggagagaagagcagacagagcgccuggaagcccucgguaaggaagcccuuuuugccuucgggugucuguuuucaguagaguagcugaccuggacugcauucuugucccucggaagcuugcaucagcccuaguguuucugaucggucuugaggaaguuuuauuuuucagacuaaaggucgcaaggccacugacaaggcuauaccucaucacaggcuauugcaugagaacacaggagcauagggaggcguccucccagggagagcccuggauuugaggugaaaggcucaguucaagauuugcugacuaggggggcgccuggaggaagucaguuacugaccuagagcuguucauaaggguauaugggaacuugaaguacuguucauuugagcuacacggaugguucauuugucauuugaaagaugaaccuaauguuaggaaauguguucguaacuuuccauugcugugacaucagaguggagagacucagcuuagggaaaaggguuugauuuggcucaucguuucagaaaagggcuccuggcucuaugauuuuuuaggucugacaagauagaaacauccuggcagaacagacagaggacauuguuaccucaaggcagaugggaaacagaggagccaggggcuaaggacguuauuuaccuucagaaggacucucagcagccaccacuucauccaggcuccccuuuguuaccacaucucccagugguccauucuguugugaaucagccauggauccacccaucaauuagguuggaucucuuguaguccagucacuucccaacaaauagcaccgugagccuuuuuuuuuuuaagguuuauaguugaauuuguguguaugaauguuuuagcagcauguaugucugucaugugucugguaccugcagaggucagaagaggguguaggauccccugcacauggagguauggaugguugugagccauuauguggaugcuggucuucuaaaguccugaaucgucucucaagcucccuacaugagucucuuaggggguccuagccuaucguuuccaaaucauaacagggagccuggacuucuuuucuuagccuaauuguuccuauaagguaaggggucuuuuugcauuaaaaaaaauauuuauuuuuacuuuaugugcauuggugguuuugacugcauguaugucugugugagggugucagauccccugggacaggaguuacagacaguugugagcugccauguggguauugggaauugaacccagguccucuggaagagcagccagagcuccuagcugcugagccaucucuccagcucccuuuugcauuuuuaugaguaaagguauugaggauuauaaguggauuguuugaagcacacagcuaagaagugguaaaaacaaaugugaguuugucugcugugcuucgggauccacauccaucccaccagccacacugcuuccuaagugcgucugugugcauggccaucucgccgggcaggccaggcccugccuuggcaucagcuucugguagaauuguauaccuuaaugucaccuauuccuucaagaugagggaagccugcugugacagugugaggaggugaccaauagcaucucuuuguagcccugccuguccuggggcucgcuguguagacgggguugggcugcugagugccgagaguaaaggcguacgcuacaaugccagcucuuaauggcuuucauuuaguuaagagugugccucucuaugugugggcuucauuuauuuuuagauuuguuuauuauauuuugugugccuuaguguuuuguuuacauacacacaccaguggugccuggugccuucagaggccagaagaggguuugggaugccuuggaaccaagauagaugguugagagccaccgugugggugcuaagaaccuaaccuggaugcucuguaagagcaacaaaugcuccuaacugcuggggccucuccaucaccccugugugguuuauagagagaugugcacauacuccuucugauuggccggucagcucuaucauacgggcgacuccuagaaguggcgaagucuucauguacuuaugccaguauucucccagacucuaccuaaugaaacauggcucccuagguuucagaugggguaacugacuccuagaaguagggagagaccuuguccaaauagccuaaccagucagugccagaccuuuuaucccuaguuucaaagcuuucaaaacagagugacccugaauagcaguaacuaaauggcuuuuccuagguagagauacuugguaucuaugccucuggccaguuuguuugugauaauacacaguaucguagcccugaccauauguggguauucaaguccuuguaacugauucagaaacucaguuuuaaacuuuacuuauguuuaguaagcuuacacuccaguggccauguguggcuggaagcuccuguguuggagagcguuguuaagggacuugcaaacaggaugacagggcuuagcagcugugguuguuugcuugcucguugucugucuuuagugacggcuuggaggcagaguuugucucacaggaaguacauuuuggugguaggaaaugucuucuuucuuuuuucuaaccaccaaguuuggguuuugagcaacucuuugaagaauuuucuuagcuggggcuccuucauccagcuccaccacagagucucauaguguagcccuauuuggccugagauuuguugugcauaccaaacuggcuuuaaacuuaggagcuuccugggcacggggauuacaggugcgcauccccagucccaacucaagauggccacuucagggaaagucgaacauuuggucuuguauugcagucaauguuuguuggcaggggguuucugugguuucacccuuuuuuucuguaagaacugagaaagcacgguguugaagcggagccgguggccguggucucaaauggcuccuauaaggaguggugaggcuggcuggggaggaagguucccgucagcgugccucgcucucaggaggcuccuuccuucccgcgccagcucgugcuguuagagcugugucccaucaggcugaacaguaaggacucucaguuacuugugcuagcacacagugaaucuguaagccagcagacagacaggcagccuggguuuuauacugcacacacuguuacuuacagaugacugcccaucuuacuucaguuagacugauccuaacauuuaaugaaaaauacguacgcuggcuauggugauacccccucuaauccuaguaauugagaaacauacaaguuugaggccaguuugagcuauacagcaaauccauuuugggccaugcaaugaaacuugagaaaagaaagacuuuuuaaaaaaacaaaaacaaaaaaaaccacggucucucuauuguguaucucuuguuucucuggcuguccuggaacuugauacuuagaucagacugccucaaauuuacagagaaccaucugccucugccuacuaguacugggacuaaaggugugugcugucaugccuagcccuaacaaaaaauaacuuuaaugauuguuagaaugcauagaauauaguccaaucaaaaggcaauuaaaguuuuaaacauuucaagguuccacuguggaacccaggauugggcuugggucaugaggcuugcauggcaagugcuucuaccccagggccaucuugccagccacagaagggcaguaauugggggguaguccacuuggauuuggguuuggugguagguuuuauuucauugaagcucauguggccuccucaacuuugagaauccauugguuuauccucugccccgugugugucauggacaggaccaucagaaauccugccagugugucagaggcuuuagcgggaccccaaguagacgggucucaugugcgcgccaggccguuucuggugaguuaaacaacagaggagagucuguaacaucaggacacuuggaggugacucccacggaugcccaggaacgcucuugcuucuucagaccagucuuuacuugaugccaccccgcuuucacucuccuucugcaagaugauaauuacagggugggcugccucugcauuccugguggccuugaugguuauauaauccugugguuauuuucaggcuggccuacugaaggaagucaaguguaagcuugcgagcagaccagucuuuguucucccuuauccauggcaagcucacucgacuuuuugagguuuuuuuggguuuuuuuucccucccucacugcugaaaaugaaccuaaaaugugucuucuugggaguauuguaaagauugagauacauguaagucacaggccacagaggaugucccugcgagcaugucugacuguucgagugagucacggugccccuagcaugaucaugcaucccucccuuugugacgggugaucuucaaccagacauugugcaaaacuacauuuaaucugaaaacuucacaugggaguuggaaagauggcuuggagguuaagagcacuggcugcuccugcagaggacccaggcugaguucccagcacccacagggcagcucacaacugucuguaacuccaucucacggguccucuggccucugggcaccugcauaugugccugauuguguaugaguguaugcacacacuccgaauaaauaguuuccaaaggagaaauguuugagaauccaggcuagcaaaccuacauauaugacuuuucugaaccugcagucuugagccuuucggugauuguuaaacagugauccuguguccuuggccccugcagcucccuccaucccuguuuucuuuccauuagcucugauuugugagucacuucuaccucugcuaauuuuacugugcguuuccugccucgcacaagaguuuccaccauauuuauaguuaggggaguaacuuuguguuguuuaagaauaugagugguuacauuagggguguggacuguguucauuucuggagaguuagacgcaucuguugauuaauugggagaguacuugcccagcaugcacacaguccugaagucagucuccagcaauacaaaccggggcauagucauuuauuucuguagaccagcauucagagggggaagcaagaggcagggguucaagguuuucaccagugucauagguuuagggucauccugggcuacaugaaacacuggcucaaaaaaaggaaaaaguuguaugcaugccugugcaccauauguuugaaguaccuauagaggccagaagaggguauuggauccccuggaacuggaguuaaugaugguuguaagcucccaugggaugugggugcuggggauggaacccuggcccucugaaagaguagccacugcucuuaacucaugagccaccucccaucacuuuuuucccuggcauauauguauaugcucagacauuccgauagcucuguacauucaguaggaccaaaacguuacacguugaaaugaacuuacuucugcuuucccucaguuguauuccucucucucucucucucucuuacaagaugccaauucucggaagcaagaagcggaguggaaagaaaaggcgauaaaggagcuggaagagugguaugcgaggcaggacgagcagcuacagaagacaaaggcaaacaacagguugguccuuucucugagacugagucagauccauucgagaacccaguccagguuccuggcugugccugccuucuuagaaaggccuuggggaucuggaagaaacugcuagaaacagaggcuacaagucuccugggucuugugagcaaaauucaacuuggauugaguuuggcucuuaaacugggccugguuucaucaacuguaauggcaagaucugggaaagguaggcccuggagcccugagaugaaaggucagcugcagagucucguuacuuuggagagaauuacagacuaaguauacagauccccuaaauguagccuugcccuccuaaagaggcuuucugaaguccguccuuagcacggacgugcucuguaauuaggucguucaggaugucccagcauggacugcaggauugaggcuucaccgacgacugccugugcuuaggaagcucugggcucaugaacaugcuuuuaaaagaggggcuggagagauggcucagcgguuaagagcacugacugcucuuccugaggucuuggguucaauucccagcaaccacaugauggcucauaaccuucugugaugcaauccaaugcccucuucuggugugucugaagguagcugcagugugcucuuacacacacacacacacacacacacacacacacacauuacacuuacugaaaguuaauacuguggggagagaaaacacuccguccccuaucauuaccaaacaguagcugugguaugcacucauuucguaggggcccuuacuucuuggagguagccuagggagaugcucagaguauagcucccugccacaggcagauuaacuuucugcuggauucagagccacccaccuuuuaccaaguaggaggcaugccacucauuucauuguuuuuuuaaaaaaaaaaaaaaaaaaaaggacaaaaacagaucccaaggcagacugggccuuagguuauucgcugugggcugggucuggcauuucgggggcagcucuuagaaggaaaucuuucagaaaauauagccagcugaugccauugugaagcaacuaugacagaauaagugggcucuuauuaagacaguccuuuaaaacuccccguguuucuugaucaucuuugacauuguccuuugaugccaagccuaggccucucaaccuggacaugucucugagggguguacucuaagacagugccuuucagguuccauuugaguaaggugggaaggacuuuggucagggucaguugccauccggccgcccagagccucugugcugaugugaagugugaaaugucaggcuccucugcucuugccaccucaagacgauuccccuccaggaucagguguggcucugcaguaaagaacgauguugcaguggggaguacaccccagcaaaagugccucagcaccgcuccacucuggaggcccuggggcaaguccacuaacaucgagucccauggcuucagcaacuugacaaauagaccuucaagcuuaauaaugaagacauugggaacaggcuuucuauugcacaaguuugugcuuauucccuuuauuuaaaggaauaccccacgucuauuagaggaacuuaaccuuagagggugagguucugagcauguagucagauugcaguacuuuaguuuacucggaauuguagaauguugaguugccugauccucccuaguuucugauuuuuuuugggggggggguugagacaggguuacucuguauaguccuggaacucacucuguagaccaggcuggccugccucugccucccaggugcugggguuaaaggugugcgccacaacugcccgaccucccuaguuucacagagaagagauuucuuauggaguguuaacacgucgaugucggaaaccagcugagucugccuuauaaaagcugcucacagcucaggucugagugcauaagguuaggguaugcuaaccaccauccccacauccuaggacagaagauacguuuucuacucuuuaauccuguagauuuuguuuuuuguuuuuguuguuuuauuuugauacagucuuuucuguguaauccugguggcuggcaucaaacucagagagauccuccugccucugccucccaagugcuggaauuaaaggccuguacuaccacugccugucuucgagugauuucuuuagaggauggugguuaggagaauuuauaaaucauuugaggugcuaggaaugaaguucugugaugcaggacuuuguguuaaauccucaaaaugacauagggaaggagggguaucagccaagccauuggugguaccacacuacuauaauuggauacucugaaggcugagacagaaaggaggcuaaccuggaacauagagaccuauucugaaauaaaacaaaacccuucaccacuugggagcacauccaggccaggucuuccugagugaggugaggaggagucagcagaagggugggggcaacgcgguggugguguuugguuccuauguagccgguacuguguugucuaugccaaaccuuaucuuuuaccccaaguuagggccuaccuguuguugcaccagagagugaaucauucaguuguggccuaugagaaagaauucccuuuucagagacucagaacaguggaagucuccugcaguucaugcuugggggacaacucugcagcaucucccuucccaagcaagaagagaaacauuccccuuguuagaggucucuuguguuaggacuuucagcucuaaccaaaaccacuugaggaauuaaauccacuauucuuagcagugguagacuucuuuuuccaugcccacuguagagcuauuuauagaauggaguucugaauuguuauuuuaggccuuuggucaggcauuccucuccccguuucaggcuucccuaagcccugacaggugcugauuccaggucggccuuacccugggaggagagcagacagguggggcgccugugcgcuagugucucuaauuuugucugucagaggcccugcuugucuuagagacaagcucuuuauucuuggggcuaguagugaagaggcagggccucaccaaggccuuuguugugagugaugcccugaggggaggcugcagaccuuucuucucccccagugagagcaaagcagcauaaauggauuaggcuaagccuucuguaaacuaaagggauuaggguguagagcugccugcccuucugugccucccacucgccugacugacucacccgcagcuuguuucccugaguuacaaccaggcugcuccuuuugcuuucuuuccguuuccacagauauccucuguguagagaauuaggaaagaaugaaggguauguguguauuuuaaaaguaaacuaaaaccgccggaggucuaggucaguuagucgugauugcauggccugugugaggcccugggcuugguccgcagcacugccugaaggggauccucgccauccccgcauuccuaagauugggaacgagaguaggagaccuagaacaucaagggcauccucgguuaccugucaaguuuaaggcuagccugggcuacaugaggccccguaucaaaaugaaauaaauagaaacuggaauauauguuacuagaauuugcuuucagauaaauguguguguaaacugaugagugaccugauuguccuuuaaauggccuuccagccaaugucugccgccucaauuuugggaggccaggacuacaaagugagauccuaucucacaaaacaaaauuuuccuguuuguuuguuuguuuguuuaaauccuaaaacaauauagcaaagaacaagcugagguuuggcagggucauucccagugugccugugcccugguuaguuggguccugcacauucccaccccaccugccucccgcccucgaguauauaaggacuuggugaggucaggauuuuaagcuacacuuugucaaaagcccagacuggcauguguuuagaaacugcccuggcuuccugagcagacacggaacccuggggcccaaacuagcuuccauuuccccagagcacuuaccccagccucuucuacgucuaaggcgcacugugcaacagccacagguuuuuuguuccaccaagcaagugugggaaagcaaugguuggguccaagauuugggauuaaaucuuuggggcugugcccaucuguuggcuggcaguggucauacccagugauaauuccugaggcugacagaaagucagcauggcacccugagcuggcaaacguuaguguguagugaggaaaacacgugcacugcgauccacacugccaccggcugaccaagucuucaucgcugagccucagucaccuugccugggaggaaggcgaggacaccgucagcaacggugcugacuaacgguugccguguguggaauggcauguagcccauaacagagugcuuacuaaaggcugucgccggugaagcccaaagcugacgcugcagugcucuccuguggcgggcaccaggaaggccaguuuccaagaugccccucucugugcacuggagugcccaccgcuggaaggcccugggucagacggagcccggggagcaguucccuggggacugucaggugcaauacugugggguuuagauguuuucugcuucucaauguucucucuuuuuuccugccugcuugccugccuuuggacuucuugcugucuaggguggcagacgaagcuuucuacaaacaacccuucgcugaccugauugguuauguguauguugcaaaacuaauuccuuuucuuguuuugauucuuucuguuuagaguuaaugcuccuuuuugucacaaguugcuuugcuuuuuaaaucuuucacauuggcucuguggggcugcuugagaguugauaagcuagauaugacuguugcuaaucuugcacaacugucacucccugcucucccuguggccauuugcauacuggagguccuggagggaagcaagcuucaauggucucucugggaaggguuuuuuugggcuuaguugggucugaccacuugcuggugcugccagcuuccaggcccugcugccugccugucugccccugcggagccugcggugaccuaagauguuggggccauggucugcagcacaauauuaccagagucagagccggggagcaggagguggaggcucugccuugccaauuccugauccuuaaagaacaugaagugucauucagucaggcaguguggguaucugacacuguuucccuggucuuagauagcagaaauugcuauuuuaguggcuagcuucuggugcccugcccucuuccccagcacagagccucccuaguugugaagucaagauacucaaaacuguccaguaaacugccgcaguuuucucccccagaaaacuaccuuuucuagcaaagcuuuuuuguuuuuaauaaagauccuuguuagugaccuuaguauugcugaggacuuggaaauaguccugcuuccuuuuuaugacagaacuaggaaggaaaaagaacaacuacuuggggaaggugguagacagagucucuuggggcccaugacccugggauggccaccucauuagacggcagaacuggguuuccugggccccgggugaguuugcagugaaacuugugaaaugcuggacuuacaggugguguuggcuuugacuuuuacacauucucuggaguagagaaauggagacuggaaaaguugagucuggguuugcuggacagcaggguggcccgccaaaggcagcugcacgcucccaggccaagaaagaccggcaagggcaugucuagcuuacugaccaucugcauugagccauucucauuuucuauaucugaccuaaaguuucuccuuguuucuuuucuucucuucaccuuuaagcacaaacauaaaccauccuugcuacagccuagaacaguuaaguaaaccuuucucacugccccuaacugugugugccaugaagucgcaguguuguaguggcucugggcuucagcaguguuugccacggccaucccugugauagugccacccucuguccccacagaccggucaucuccauugcuuuugcuuugcccgugaugcuuguuggaguagcugaaguccaucgugucuuucccacuucucccacgugccuuugggcuguugcuccagccaguuaguucccacagggcaggcugauccccaugugaaagaguguuggaguggcauccugccaaaaagcagcucacauuagcucuccugccaggaucuucccugaguggcaccagauaccugacuggagagaaaauggcagacuguuggcugagcuggugaauguccuaacaaccccuuccagaauggcuucaguguggugccugcuagcaugggugcuuggucuugaauaccuucugcucugcccuguuucucuccagccuuaggagugaguuugaggcuaugaugcagugacccgagggcuuuuuagaagucuuaauucccuugaaccucaguauggcccagcacaagcuacucugcaagcccuugaucagccugcugcuuaguucuuguucagaaaagcaguuuguaguuggccaaggaguugauuuuucaugcucugaugagcaaagccagccauagagacagaccaagcccugaaccaaaccuguacuccgccauuucacagagcagccuggguaccuguaucuaggagagcugggcacaucugcccuugcuuguggccugagcuaggggccaauacucucuggaaaaccagaaugccacuaagucaaaagucacuuacuuuguagcaaguuauagcaagacagccaccagauugcucaaaggguuuuuuuguuuguuuuuuuuuuuuuuuacauuaaaccaacauauuguguuauugcuuccagggcagcagaagaagccuuuguaaacgacauugacgagucauccccaggcacugagugggagcggguggcccgccugugugacuuuaaccccaaguccagcaaacaggccaaagaugucucucgcaugcgcucaguccucaucucccugaagcaggccccccuggugcacugaagagccacccuguggaaacacuacgucuacaauaucuuaauccuacucagugaagcuguucacguaauuggauuaauuauguugaguucuuuuggaccaaaccuuuugucuuuagaguugaucauuguuugugauugcauguuuccuucaacuguguucucccuggcauucagagacgagagaggaagaggaagggagaggagcucccgacaguagccucaaccugugcuuuugugcauuauucugagaauaaauuucuguuucaaacaauguauacaugaag

SEQ ID NO: 1871 - RNA, 29046 nt, Mus musculus
cuucauguauacauuguuugaaacagaaauuuauucucagaauaaugcacaaaagcacagguugaggcuacugucgggagcuccucucccuuccucuuccucucucgucucugaaugccagggagaacacaguugaaggaaacaugcaaucacaaacaaugaucaacucuaaagacaaaagguuugguccaaaagaacucaacauaauuaauccaauuacgugaacagcuucacugaguaggauuaagauauuguagacguaguguuuccacaggguggcucuucagugcaccaggggggccugcuucagggagaugaggacugagcgcaugcgagagacaucuuuggccuguuugcuggacuugggguuaaagucacacaggcgggccacccgcucccacucagugccuggggaugacucgucaaugucguuuacaaaggcuucuucugcugcccuggaagcaauaacacaauauguugguuuaauguaaaaaaaaaaaaaaacaaacaaaaaaacccuuugagcaaucugguggcugucuugcuauaacuugcuacaaaguaagugacuuuugacuuaguggcauucugguuuuccagagaguauuggccccuagcucaggccacaagcaagggcagaugugcccagcucuccuagauacagguacccaggcugcucugugaaauggcggaguacagguuugguucagggcuuggucugucucuauggcuggcuuugcucaucagagcaugaaaaaucaacuccuuggccaacuacaaacugcuuuucugaacaagaacuaagcagcaggcugaucaagggcuugcagaguagcuugugcugggccauacugagguucaagggaauuaagacuucuaaaaagcccucgggucacugcaucauagccucaaacucacuccuaaggcuggagagaaacagggcagagcagaagguauucaagaccaagcacccaugcuagcaggcaccacacugaagccauucuggaagggguuguuaggacauucaccagcucagccaacagucugccauuuucucuccagucagguaucuggugccacucagggaagauccuggcaggagagcuaaugugagcugcuuuuuggcaggaugccacuccaacacucuuucacauggggaucagccugcccugugggaacuaacuggcuggagcaacagcccaaaggcacgugggagaagugggaaagacacgauggacuucagcuacuccaacaagcaucacgggcaaagcaaaagcaauggagaugaccggucuguggggacagaggguggcacuaucacagggauggccguggcaaacacugcugaagcccagagccacuacaacacugcgacuucauggcacacacaguuaggggcagugagaaagguuuacuuaacuguucuaggcuguagcaaggaugguuuauguuugugcuuaaaggugaagagaagaaaagaaacaaggagaaacuuuaggucagauauagaaaaugagaauggcucaaugcagauggucaguaagcuagacaugcccuugccggucuuucuuggccugggagcgugcagcugccuuuggcgggccacccugcuguccagcaaacccagacucaacuuuuccagucuccauuucucuacuccagagaauguguaaaagucaaagccaacaccaccuguaaguccagcauuucacaaguuucacugcaaacucacccggggcccaggaaacccaguucugccgucuaaugagguggccaucccagggucaugggccccaagagacucugucuaccaccuuccccaaguaguuguucuuuuuccuuccuaguucugucauaaaaaggaagcaggacuauuuccaaguccucagcaauacuaaggucacuaacaaggaucuuuauuaaaaacaaaaaagcuuugcuagaaaagguaguuuucugggggagaaaacugcggcaguuuacuggacaguuuugaguaucuugacuucacaacuagggaggcucugugcuggggaagagggcagggcaccagaagcuagccacuaaaauagcaauuucugcuaucuaagaccagggaaacagugucagauacccacacugccugacugaaugacacuucauguucuuuaaggaucaggaauuggcaaggcagagccuccaccuccugcuccccggcucugacucugguaauauugugcugcagaccauggccccaacaucuuaggucaccgcaggcuccgcaggggcagacaggcaggcagcagggccuggaagcuggcagcaccagcaaguggucagacccaacuaagcccaaaaaaacccuucccagagagaccauugaagcuugcuucccuccaggaccuccaguaugcaaauggccacagggagagcagggagugacaguugugcaagauuagcaacagucauaucuagcuuaucaacucucaagcagccccacagagccaaugugaaagauuuaaaaagcaaagcaacuugugacaaaaaggagcauuaacucuaaacagaaagaaucaaaacaagaaaaggaauuaguuuugcaacauacacauaaccaaucaggucagcgaaggguuguuuguagaaagcuucgucugccacccuagacagcaagaaguccaaaggcaggcaagcaggcaggaaaaaagagagaacauugagaagcagaaaacaucuaaaccccacaguauugcaccugacaguccccagggaacugcuccccgggcuccgucugacccagggccuuccagcggugggcacuccagugcacagagaggggcaucuuggaaacuggccuuccuggugcccgccacaggagagcacugcagcgucagcuuugggcuucaccggcgacagccuuuaguaagcacucuguuaugggcuacaugccauuccacacacggcaaccguuagucagcaccguugcugacgguguccucgccuuccucccaggcaaggugacugaggcucagcgaugaagacuuggucagccgguggcaguguggaucgcagugcacguguuuuccucacuacacacuaacguuugccagcucagggugccaugcugacuuucugucagccucaggaauuaucacuggguaugaccacugccagccaacagaugggcacagccccaaagauuuaaucccaaaucuuggacccaaccauugcuuucccacacuugcuugguggaacaaaaaaccuguggcuguugcacagugcgccuuagacguagaagaggcugggguaagugcucuggggaaauggaagcuaguuugggccccaggguuccgugucugcucaggaagccagggcaguuucuaaacacaugccagucugggcuuuugacaaaguguagcuuaaaauccugaccucaccaaguccuuauauacucgagggcgggaggcagguggggugggaaugugcaggacccaacuaaccagggcacaggcacacugggaaugacccugccaaaccucagcuuguucuuugcuauauuguuuuaggauuuaaacaaacaaacaaacaaacaggaaaauuuuguuuugugagauaggaucucacuuuguaguccuggccucccaaaauugaggcggcagacauuggcuggaaggccauuuaaaggacaaucaggucacucaucaguuuacacacacauuuaucugaaagcaaauucuaguaacauauauuccaguuucuauuuauuucauuuugauacggggccucauguagcccaggcuagccuuaaacuugacagguaaccgaggaugcccuugauguucuaggucuccuacucucguucccaaucuuaggaaugcggggauggcgaggauccccuucaggcagugcugcggaccaagcccagggccucacacaggccaugcaaucacgacuaacugaccuagaccuccggcgguuuuaguuuacuuuuaaaauacacacauacccuucauucuuuccuaauucucuacacagaggauaucuguggaaacggaaagaaagcaaaaggagcagccugguuguaacucagggaaacaagcugcgggugagucagucaggcgagugggaggcacagaagggcaggcagcucuacacccuaaucccuuuaguuuacagaaggcuuagccuaauccauuuaugcugcuuugcucucacugggggagaagaaaggucugcagccuccccucagggcaucacucacaacaaaggccuuggugaggcccugccucuucacuacuagccccaagaauaaagagcuugucucuaagacaagcagggccucugacagacaaaauuagagacacuagcgcacaggcgccccaccugucugcucuccucccaggguaaggccgaccuggaaucagcaccugucagggcuuagggaagccugaaacggggagaggaaugccugaccaaaggccuaaaauaacaauucagaacuccauucuauaaauagcucuacagugggcauggaaaaagaagucuaccacugcuaagaauaguggauuuaauuccucaagugguuuugguuagagcugaaaguccuaacacaagagaccucuaacaaggggaauguuucucuucuugcuugggaagggagaugcugcagaguugucccccaagcaugaacugcaggagacuuccacuguucugagucucugaaaagggaauucuuucucauaggccacaacugaaugauucacucucuggugcaacaacagguaggcccuaacuugggguaaaagauaagguuuggcauagacaacacaguaccggcuacauaggaaccaaacaccaccaccgcguugcccccacccuucugcugacuccuccucaccucacucaggaagaccuggccuggaugugcucccaaguggugaaggguuuuguuuuauuucagaauaggucucuauguuccagguuagccuccuuucugucucagccuucagaguauccaauuauaguagugugguaccaccaauggcuuggcugauaccccuccuucccuaugucauuuugaggauuuaacacaaaguccugcaucacagaacuucauuccuagcaccucaaaugauuuauaaauucuccuaaccaccauccucuaaagaaaucacucgaagacaggcagugguaguacaggccuuuaauuccagcacuugggaggcagaggcaggaggaucucucugaguuugaugccagccaccaggauuacacagaaaagacuguaucaaaauaaaacaacaaaaacaaaaaacaaaaucuacaggauuaaagaguagaaaacguaucuucuguccuaggauguggggauggugguuagcauacccuaaccuuaugcacucagaccugagcugugagcagcuuuuauaaggcagacucagcugguuuccgacaucgacguguuaacacuccauaagaaaucucuucucugugaaacuagggaggucgggcaguuguggcgcacaccuuuaaccccagcaccugggaggcagaggcaggccagccuggucuacagagugaguuccaggacuauacagaguaacccugucucaaccccccccccaaaaaaaaucagaaacuagggaggaucaggcaacucaacauucuacaauuccgaguaaacuaaaguacugcaaucugacuacaugcucagaaccucacccucuaagguuaaguuccucuaauagacgugggguauuccuuuaaauaaagggaauaagcacaaacuugugcaauagaaagccuguucccaaugucuucauuauuaagcuugaaggucuauuugucaaguugcugaagccaugggacucgauguuaguggacuugccccagggccuccagaguggagcggugcugaggcacuuuugcugggguguacuccccacugcaacaucguucuuuacugcagagccacaccugauccuggaggggaaucgucuugagguggcaagagcagaggagccugacauuucacacuucacaucagcacagaggcucugggcggccggauggcaacugacccugaccaaaguccuucccaccuuacucaaauggaaccugaaaggcacugucuuagaguacaccccucagagacauguccagguugagaggccuaggcuuggcaucaaaggacaaugucaaagaugaucaagaaacacggggaguuuuaaaggacugucuuaauaagagcccacuuauucugucauaguugcuucacaauggcaucagcuggcuauauuuucugaaagauuuccuucuaagagcugcccccgaaaugccagacccagcccacagcgaauaaccuaaggcccagucugccuugggaucuguuuuuguccuuuuuuuuuuuuuuuuuuuuaaaaaaacaaugaaaugaguggcaugccuccuacuugguaaaagguggguggcucugaauccagcagaaaguuaaucugccuguggcagggagcuauacucugagcaucucccuaggcuaccuccaagaaguaagggccccuacgaaaugagugcauaccacagcuacuguuugguaaugauaggggacggaguguuuucucuccccacaguauuaacuuucaguaaguguaauguguguguguguguguguguguguguguguguguaagagcacacugcagcuaccuucagacacaccagaagagggcauuggauugcaucacagaagguuaugagccaucaugugguugcugggaauugaacccaagaccucaggaagagcagucagugcucuuaaccgcugagccaucucuccagccccucuuuuaaaagcauguucaugagcccagagcuuccuaagcacaggcagucgucggugaagccucaauccugcaguccaugcugggacauccugaacgaccuaauuacagagcacguccgugcuaaggacggacuucagaaagccucuuuaggagggcaaggcuacauuuaggggaucuguauacuuagucuguaauucucuccaaaguaacgagacucugcagcugaccuuucaucucagggcuccagggccuaccuuucccagaucuugccauuacaguugaugaaaccaggcccaguuuaagagccaaacucaauccaaguugaauuuugcucacaagacccaggagacuuguagccucuguuucuagcaguuucuuccagauccccaaggccuuucuaagaaggcaggcacagccaggaaccuggacuggguucucgaauggaucugacucagucucagagaaaggaccaaccuguuguuugccuuugucuucuguagcugcucguccugccucgcauaccacucuuccagcuccuuuaucgccuuuucuuuccacuccgcuucuugcuuccgagaauuggcaucuuguaagagagagagagagagagaggaauacaacugagggaaagcagaaguaaguucauuucaacguguaacguuuugguccuacugaauguacagagcuaucggaaugucugagcauauacauauaugccagggaaaaaagugaugggagguggcucaugaguuaagagcaguggcuacucuuucagagggccaggguuccauccccagcacccacaucccaugggagcuuacaaccaucauuaacuccaguuccaggggauccaauacccucuucuggccucuauagguacuucaaacauauggugcacaggcaugcauacaacuuuuuccuuuuuuugagccaguguuucauguagcccaggaugacccuaaaccuaugacacuggugaaaaccuugaaccccugccucuugcuucccccucugaaugcuggucuacagaaauaaaugacuaugccccgguuuguauugcuggagacugacuucaggacugugugcaugcugggcaaguacucucccaauuaaucaacagaugcgucuaacucuccagaaaugaacacaguccacaccccuaauguaaccacucauauucuuaaacaacacaaaguuacuccccuaacuauaaauaugguggaaacucuugugcgaggcaggaaacgcacaguaaaauuagcagagguagaagugacucacaaaucagagcuaauggaaagaaaacagggauggagggagcugcaggggccaaggacacaggaucacuguuuaacaaucaccgaaaggcucaagacugcagguucagaaaagucauauauguagguuugcuagccuggauucucaaacauuucuccuuuggaaacuauuuauucggagugugugcauacacucauacacaaucaggcacauaugcaggugcccagaggccagaggacccgugagauggaguuacagacaguugugagcugcccugugggugcugggaacucagccuggguccucugcaggagcagccagugcucuuaaccuccaagccaucuuuccaacucccaugugaaguuuucagauuaaauguaguuuugcacaaugucugguugaagaucacccgucacaaagggagggaugcaugaucaugcuaggggcaccgugacucacucgaacagucagacaugcucgcagggacauccucuguggccugugacuuacauguaucucaaucuuuacaauacucccaagaagacacauuuuagguucauuuucagcagugagggagggaaaaaaaacccaaaaaaaccucaaaaagucgagugagcuugccauggauaagggagaacaaagacuggucugcucgcaagcuuacacuugacuuccuucaguaggccagccugaaaauaaccacaggauuauauaaccaucaaggccaccaggaaugcagaggcagcccacccuguaauuaucaucuugcagaaggagagugaaagcgggguggcaucaaguaaagacuggucugaagaagcaagagcguuccugggcauccgugggagucaccuccaaguguccugauguuacagacucuccucuguuguuuaacucaccagaaacggccuggcgcgcacaugagacccgucuacuuggggucccgcuaaagccucugacacacuggcaggauuucugaugguccuguccaugacacacacggggcagaggauaaaccaauggauucucaaaguugaggaggccacaugagcuucaaugaaauaaaaccuaccaccaaacccaaauccaaguggacuaccccccaauuacugcccuucuguggcuggcaagauggcccugggguagaagcacuugccaugcaagccucaugacccaagcccaauccuggguuccacaguggaaccuugaaauguuuaaaacuuuaauugccuuuugauuggacuauauucuaugcauucuaacaaucauuaaaguuauuuuuuguuagggcuaggcaugacagcacacaccuuuagucccaguacuaguaggcagaggcagaugguucucuguaaauuugaggcagucugaucuaaguaucaaguuccaggacagccagagaaacaagagauacacaauagagagaccgugguuuuuuuuguuuuuguuuuuuuaaaaagucuuucuuuucucaaguuucauugcauggcccaaaauggauuugcuguauagcucaaacuggccucaaacuuguauguuucucaauuacuaggauuagaggggguaucaccauagccagcguacguauuuuucauuaaauguuaggaucagucuaacugaaguaagaugggcagucaucuguaaguaacagugugugcaguauaaaacccaggcugccugucugucugcuggcuuacagauucacugugugcuagcacaaguaacugagaguccuuacuguucagccugaugggacacagcucuaacagcacgagcuggcgcgggaaggaaggagccuccugagagcgaggcacgcugacgggaaccuuccuccccagccagccucaccacuccuuauaggagccauuugagaccacggccaccggcuccgcuucaacaccgugcuuucucaguucuuacagaaaaaaagggugaaaccacagaaacccccugccaacaaacauugacugcaauacaagaccaaauguucgacuuucccugaaguggccaucuugaguugggacuggggaugcgcaccuguaauccccgugcccaggaagcuccuaaguuuaaagccaguuugguaugcacaacaaaucucaggccaaauagggcuacacuaugagacucugugguggagcuggaugaaggagccccagcuaagaaaauucuucaaagaguugcucaaaacccaaacuuggugguuagaaaaaagaaagaagacauuuccuaccaccaaaauguacuuccugugagacaaacucugccuccaagccgucacuaaagacagacaacgagcaagcaaacaaccacagcugcuaagcccugucauccuguuugcaagucccuuaacaacgcucuccaacacaggagcuuccagccacacauggccacuggaguguaagcuuacuaaacauaaguaaaguuuaaaacugaguuucugaaucaguuacaaggacuugaauacccacauauggucagggcuacgauacuguguauuaucacaaacaaacuggccagaggcauagauaccaaguaucucuaccuaggaaaagccauuuaguuacugcuauucagggucacucuguuuugaaagcuuugaaacuagggauaaaaggucuggcacugacugguuaggcuauuuggacaaggucucucccuacuucuaggagucaguuaccccaucugaaaccuagggagccauguuucauuagguagagucugggagaauacuggcauaaguacaugaagacuucgccacuucuaggagucgcccguaugauagagcugaccggccaaucagaaggaguaugugcacaucucucuauaaaccacacaggggugauggagaggccccagcaguuaggagcauuuguugcucuuacagagcauccagguuagguucuuagcacccacacgguggcucucaaccaucuaucuugguuccaaggcaucccaaacccucuucuggccucugaaggcaccaggcaccacugguguguguauguaaacaaaacacuaaggcacacaaaauauaauaaacaaaucuaaaaauaaaugaagcccacacauagagaggcacacucuuaacuaaaugaaagccauuaagagcuggcauuguagcguacgccuuuacucucggcacucagcagcccaaccccgucuacacagcgagccccaggacaggcagggcuacaaagagaugcuauuggucaccuccucacacugucacagcaggcuucccucaucuugaaggaauaggugacauuaagguauacaauucuaccagaagcugaugccaaggcagggccuggccugcccggcgagauggccaugcacacagacgcacuuaggaagcaguguggcuggugggauggauguggaucccgaagcacagcagacaaacucacauuuguuuuuaccacuucuuagcugugugcuucaaacaauccacuuauaauccucaauaccuuuacucauaaaaaugcaaaagggagcuggagagauggcucagcagcuaggagcucuggcugcucuuccagaggaccuggguucaauucccaauacccacauggcagcucacaacugucuguaacuccugucccaggggaucugacacccucacacagacauacaugcagucaaaaccaccaaugcacauaaaguaaaaauaaauauuuuuuuuaaugcaaaaagaccccuuaccuuauaggaacaauuaggcuaagaaaagaaguccaggcucccuguuaugauuuggaaacgauaggcuaggacccccuaagagacucauguagggagcuugagagacgauucaggacuuuagaagaccagcauccacauaauggcucacaaccauccauaccuccaugugcaggggauccuacacccucuucugaccucugcagguaccagacacaugacagacauacaugcugcuaaaacauucauacacacaaauucaacuauaaaccuuaaaaaaaaaaaggcucacggugcuauuuguugggaagugacuggacuacaagagauccaaccuaauugauggguggauccauggcugauucacaacagaauggaccacugggagaugugguaacaaaggggagccuggaugaagugguggcugcugagaguccuucugaagguaaauaacguccuuagccccuggcuccucuguuucccaucugccuugagguaacaauguccucugucuguucugccaggauguuucuaucuugucagaccuaaaaaaucauagagccaggagcccuuuucugaaacgaugagccaaaucaaacccuuuucccuaagcugagucucuccacucugaugucacagcaauggaaaguuacgaacacauuuccuaacauuagguucaucuuucaaaugacaaaugaaccauccguguagcucaaaugaacaguacuucaaguucccauauacccuuaugaacagcucuaggucaguaacugacuuccuccaggcgccccccuagucagcaaaucuugaacugagccuuucaccucaaauccagggcucucccugggaggacgccucccuaugcuccuguguucucaugcaauagccugugaugagguauagccuugucaguggccuugcgaccuuuagucugaaaaauaaaacuuccucaagaccgaucagaaacacuagggcugaugcaagcuuccgagggacaagaaugcaguccaggucagcuacucuacugaaaacagacacccgaaggcaaaaagggcuuccuuaccgagggcuuccaggcgcucugucugcucuucucuccacuuacggauacuuucaggcucugacugcaaucgauccacuucugaaauggcugcguaacugucuguuggaccauugcucuccuuaacacaaaacaaucacacacucuaucaguaccccauccuuccuaagaguagaacaggucacauagcgaggcuguguaaaauguuaaaggaugacuuaacgcaacaggagagcccuacaagccaccagcacucccugcauuacagcauuaccgagcuggguccuugcacucucagaagggaggcaaacuaguuguuaucuguuaaaaaguggggcacgaguaggugacaggaaagcugaggcuggaugcauaagggacacauuaggacugugaucagucucucuccucacucgacagagagauaugcgcuaaccuucaaagcaacaaagccaagcuuagagccuaauuagggcuucaaaugacacuguaccaugcaggagacagucacugaaugccaucuaaccaaacgguaaauuuuaagaaagaauucaaaagaaaaugcauagcaacuauagucaaaucagggaaggaucaaaaacugcagacgacuaugagucagaaggcaggggugcuuuucuguaguggguaaagacuugagaccuaauaacacauugacaaaaccucagagcugcaaacugauuugagaauuauaugauguggccaccugggguucauuaccagcuugaccguauuagacucuaacaacgagaaagagcguuaaaguucuagugaaugccaggcuuagugguggaucccagcucucaggaggcagaggcaaguuaaacugugaggcagccuagccuggucuccuuagugaaucccaggacagccaggcccacauuguucccagugacuucuauaguacuggauauggcauagggcacauagugcuuaaauugaggaugaugaucaucguuucaaauucuauuuuuuuuuuuuccaaaaagcucuuacugccacugccacugucuacucuggcagacagggcaccagcacuggggucucuuuuaggucagucaguucaaaucacaguuaaggcucuaguuuaguguuauuuaauauaguuaagagcacucuguaccugguaguauucaccauucaucacuccgucaacagcaucuguaagacauaagauuucagcaagucagucagggccacuuaaggauuaaggauuauauacgagaauacaauauugugugcugcagcaacuagaagcuacugaauagccuguaagaagugacagcggggcuagagcauagcucaauggcaagagagccugccuagccugcaugccucagagaggcccuaggaucaaaaggcaaaauacuucggugggggaagggagccggaaagauggcacaguguaagagcacuggaggcccucugagaaugcagguuugauucccagcacccacagggcagcuuaaaaccaucuguaacuccaguuccaggagauccaauggucuccuugugucuucauggguaccaggcacccuaaugguguagaaacaugcacacaggcaaaacgcucauauacccaauuuaaaaaaaaaauugccugacacccugaguccacucccugugacccaaacaguagaagaacaggacuccugcaagcuugccucugaccugcacgcacacaggggccaggguguggauaugaacuauccguguucauacacgccuguagugccagcacucagaagcugaggcaggagaucaaggguugugagaccagccugggcaaauuccaggugagcgucaaccauacagaaagaaacuaaagguagguggcauauagccuaauaauucuaacaaagguuccuaacagugaauagaaguauuuggcugguguaguccuuugaugaauuucuuguugaagaauugccaggccacaggguauguauuacugugaagguuccuauucugagguaacgagguaucugacaucugacuuucuucuuuauucaacugucugagaucugccuguuuuuacugucuucugaucucgaaauucucuuuauuaauaaaucuauaauacugcaaguauuucccccauuuuguucaccucccuccccaggcgccucucugugcaccugugcaugcauguggaacucagggguucucauuggauaucuucccccaagugacuucaaccuuauuuuuaaagacauggucugcugguuggccagcaagcaccagggauccugucuccucccaacucugggcuugcaggcaucuaccacagcagucagauuucacaugaguacuugggaucuaacucagagucucgcuugugcaggauuugagccaucuccuauguucaucauuugcacgugcgcgcguguuuaauugacacaggcuuuuacuguagcccagacugucuucaaacaucauggaaaaacaucauguuggugagaaugaccuuaaacuucgaauacucugccucccuucccaagugcugggaauacaggccuacaccacuguauaagucagguuauacgguacugggaauugaacccagggcuucaugcauauuaagcaagcacucuaccaacugagcuacaucccaacaccccauauuguuuuucaacuugguuuaugacauuuaauccugagaguuucaauucaauuugucagcaaauguuaccaacuauuacucuguggcuucugcaagggcuaucccauaauaacauuuuuuuuucuuuuauauaacuaaucacacuuuauuuaagccaucagguuugacagcgggggccuuucgcccacugagccaucucacugguguuucugccgguacuuuaaagaaugucugucucaccuggaaucuguuuuuguguaagguagaagagugagauacucuucgaccccugagccuccgauggcuagcccgaccaguccuacaguaugguuaauagauuacagcgagcacuguuaauacgguucagccuagggacagcgccaaaagacgacuuuggccacuacucuaauaaaaccagagcauugcacacucauacuccuaaacuacuggcagccugcccuuugggucugaggaaucauccuggcccggcacaugcuuugagcucuuuacuagauauuacuuuauucuucugacauucuaaagacuuauguaugcguaugggugcuuugccuguauguauaugcaggccacuguguauacaaugccggcaaagacaagaagagguaaucagauccccagaaacugcaguuccagcuaccaugugaugcuaggaacugcagcucguaaccccugagccaucucgauagucuucucauucuuacaucaaucagaugacccaagucaaagaacagucuacagaaacaaaggaauuauaucuauggacuuugauuuaagacaacuccacuaacaccaaugaugcagaaaacuuucucaggcaucuuaagaaguccagaaagaaggcaggcagaguggggcacaccuuuaaucccagcccuugggaggcagaggugggcagaucucugugaguuauagaccagccugaucuucagagugaguuccaguacagccagggcuacacagagaaacucucucaaaaaaaccaauaaagggaaguccagaaagccacagaggccacucaagcagagcagcccacgcuuuagccccagaaccucggggacagaagcaggugauucgaguucugccagccuuauuuauagcaaguuccagaacuacaggaacagacccugacucaaaccaccaccccauccccgcaagaagaaaauaaccaagggcagaguaaaguuuccauggagcaaggcaacuuuaaccuuauguuuaugucagcaagugaagucaggcagaccuagggcugcauccuagcugagccgaggauuagcuuguaccuuagagcacagcuuagcuugcacaguaaccaggucucauccgaaaccugcgacaccgcagccucgcuggcggaugcugcauggauccagaggcaugcggaguguuuggaugcaguaaaugcacagcauauuuaaauaucauguguaacacucuuuaauuucuuucuuccauuucuaccaauaaaauuaaucucccuccagaaaaacaaccuuuaauucaucucucuuggcuugucagaaacaccgugccugugaccacacgcucugucguccaccaauaaauacuuucuauauccucuccuccagcccccaccacugagggauauuuuucaauaucugacuugccccaccuccuuccuaaccaucuguucuucaugacuaccccagccacuucaccggguugguuaccuaucccuaaacauaugucuuggcccagccuucuguuuaaccugugggcaucucccaugggcauuuucccugcagagggagcaaguuuacgucuuuuuuuuuuuuuuuaaucugucccucuggaaaguacaugaagcagagcucccaccuacucuuucaauuuacucgguauaccccaaagccuucaagccuuuuuuuuuuuuaaagacuuauuuauuauauguaaguacacuguagcugucuuccgacacaccagaagagagcaccagaucucauuacagaugguugugagccaccaugugguugcugggauuugaacucaggaccuuuagaagagcaguuggugcucuuaaccgcugagccauuucuccagucugccuucaaaccuuuuaacgccucuuccuacuuccagaaaaacaguagcuaaaauucacugacugcuuacuacacaccaguaagcaaucacagacaaauugaugugauucuaaaacaccuugugguauauauuauguaccuuaacagagaagaaagcaggcuaagccgugacagucguuacauaaaucgccuaaacucgcccucaagcagcaggauagccugaaucccagccacuacuguguugaguaugaaaguugucaacucccaagaggaagugcugagauuacacuauuacugcccucaacacacugucaggagcuggcauuaagucguuaaaugcuuaguucauaaaaacgucuuucccaggaacuaagucagcaaccaccucuuuccuucccuuugcugaaaaaaaaaaaaagcacaacugugcagccucuccguuuuauccucccaacugccuagcagggcucuuucugccuaccuauuugucaaacacaugagcaccuacuauagaccagacacuuacacgaucgauccaaaugugacacugaacacauacaacacugcccguagaaugauagacucuucuauggaugcuacuucucccaauucuugccuucccgacacacccacaaagccuuucuuccguccaagcacacccugcuaaaacaucugcaacagaacgagguauacacagucugagggaggggagagucggggcuguuuucuucaccaagucaugacucucuaggacucaguuuucuauuaaaugaaggaaggacucuauaggacuaaaaagcaaauuucaggcguucucaugcaaaugcaaaagcccacucaaagaaaacaggcucugccgucaguucuagguuauggcccaggucuguccaagcagcuugcugcaaacugcaaaccugggguacaguacaggcucccauagaagcucuggcuggggcaugauuugucuaggaguuagcauaauguccugcuuuuuuuuguuuuuuuugggggggguugguuuuguuaaauaaacaaacccagaggcugcaaaguaggagcaagucugucccaaaauauucugccugcuuaaaauggccauuugugaucucuggccucaaauacacucaaagcauuacuguggugcaugggagccuaaggcugcaccacucacugucaccaugccguuugcuuucauuggucaccugccucacagucgcagaguuuagaggguagauauucuuacuagcccggagauugccauuuaauauuuuuaaguugcauuuuugggugaaggguucccccuauguuacucaggcugguggugaaccucuggcaccaaugucccaaauaccuaagugcaugaugguccacagugccaagcuuuuuuccuuguaaauggaaagccauugucucucucucucucuagcuauauccuacuuccuucacuacugaauaggccuuuuccacgccaucuuuccucccacaccacaauccugagcaucaaacaaggaagccauccaaaggccaaacugucauccuaucccgucucuguugcuugagcucugcuguggaaaggcccacacugcacuccacauucaucuuucccuccucccccuccuuagauugguccggacuaucccugccuuuuccugaggcaauuaauuccuuccaaagcuguuuccaaagaauagcgccaggaguccuagccucaacaauguaugcaaugcuuguaauguaacaccuauccuucugggucaguuucuuucuccgcagccggcccaucuuuaugaacuccuuaucuuccuccccacaauccaaaguuuugcguaucuuuaacugcuaaacuacguugacauuuuuguuugcacgugugucccaaaguuuauacuacucucacuuuuuccuaauaagcaauuauuuccgaguggacucagccaugucucuaagucuggccaaacugcgccaaugcggcagcuucagagaccaggcuucaggcacagcaagggcuuggugaaaaguuggacagaacggacccggauccugacagucggugcaucugcgcuccccuccgccccggcccagcagcacucagaagccggcagucugcagcagcggagguccgugcaaugacccagacggggucucacuuccucuuugcgcuucuaaagcuucagccagaagcccaaguuccgcguaagagcaccgacccgagugugcccacaaguccucccgcccgaacgccgcugcccucucacccggaccucccggcggcucgccguguggcugcggcccgggggcgccgccguccaggauggcgaaggccucaucguucucgaugcccgcaaucucacucucuugcugcgccaagaaggccgcggccgggucuucuucgccggcgcccgccaccccguuuccuagagcggggccaccgggcgcaccggcgggagcgccgaauggauccaacucggccaugacagcccaacucaaccgcagagacgccgaagccgaaaccaaccgaccgauccgccgacaccccgcccagcagccgacacugugcuggcggcugcuaccggaggacgagcgagaagagggagaagguggaagcggaaacccugcuucuauauccgguuggguuggugagccacaaaaagaacagccaaucagaagacgggagcugcccaaucagcuggcaaaggggaggagcccuggggacaacucgugacugggagcagaaggaagagccagcggaagugccacccuaggggaagcugggagucgccgagcaucgggagcuggagugaucaggaacagccauuugugggcaucagggacgugagcucuucccgacuacucaacacacaaccacuggguguuucugaaccucaguguccucgcuuggaaagcugguagaagaaucuugcauugccucccuccuggaugauugaaaaauuuuaugggugcauagaccaagagaagugcaguuaccauuuaauguuaccacccuaaaaagaaagaaagaaacaaaaaacaaaggucacuuuacuacuugaaccuaguaguuugaggccagcuugggcaucaaguagaaagccccguuaagcaaccaaccaaccaaccaaccaaccuuugggucaaagaugccuucacaaauagaaaggacaggaaaaaugugaguucuauuuuuucuuuuaguuauaguuaguuaaaauguguguguagaucagaggccaacuugcugggaggcaguucuaccaugugagucccuuagguggaacucgaguaaccaggcauggugacggcaccuuuauccagccaucuugccaguccugugugauuuaauacacauaucuuugguugguuuuguuuuuuuuuuuuguuuguuacuuuuuuuuuuuuuuaagauuuauuuauuuauuuauuacauguaaguacacuguagcugucuucagacccuccagaagagggagucagaucucauuacggaugguugugagccaccaugugguugcugggacuugaacuucggaccuucggaagagcagucggguacucuuacccacugagccaucucaccagccccauuuguuacuuuuuaaguaacuacauaaacuacuuuuauuuugcugaauggggacagaaggcaaagcucucuaccagugaacuccacgggccuuguaaaaaccauccuaagcacggacuguuuagaagaaguuuagaaggcuggcaacauggcuuagcagguaaaaguguuguuugcaggccugaugaccugaguuggcuaccauggcauaaucaaauaugccguugcacacauagacaacacaguacacacaagaugaguguaaaaacaauuuauagaaaaguuuggggaaaguuagugcacauuuguaaagccagcagucuggaggcagaagcaggugcaugcucgcuagucuuuuucucucaacuugacaugagcuagaguuacccgaaaggggggaaccacaauugagaaaaugccuucauaagauccugcuguaaggcauuuucuuaauaagugauugaugggggagggccugucagcuggugguccuggauucuauuauaaagcaggcugaacaagccaggggaagcgagcccagcaagcagcaucccuaccaugccuacccccauggcuucugcaucagcuccugccuccaggauucugcagcguuugaguuccuguccugacuuccuucagugauaaacagcaauauggaagcauaagccagauaaacccuuuccaccccaacuugcuuuuuggucaugguguuucaucucagcaauagaaacccuaacuaggacaaacccuaaaaaaaaaaauaaauaaauuaacaaaccaagacaugaguuugaggccaguguggucuacuuagcaaaggcagauacuggggcagaugauguccaaaaaacaaaacaaagaagguaugauguaugaagauuuuccucagucaucucuggaacgucccugugaaacuaguagagaccuccaugagaaggccccaggaagagacgacucuggcugcugugcugacgcauuuuauaucagcuugacacaagcuagagucauuuggagacagaaaaugcuucuguuagguaaaucuguaaugcaccccccuuucuacauuuuuaaucaaauauaguuaucuucauacuauuucaauuaugguucucuuuccucaucucccaguucuuccccaccuccccacccuucaaacuccacuccuuucucacucucuuaaaaaaaaacaaauaggaugggccuggggagauggcucagugguuaagagcacuggcuguccuuccagauguccugaguucaaauuccagcaaccacaagguggcucacucacaaccaucuguaaugugagauuugguucccucuucuggaguguaggcaaaacacugugugcauaguaaguaagucuaaaaaaaaaaaaaaccuggaaaaugaagauaaacaagaauaaaaugaaaugaacagauuaauaaaauuuaagagcacaagaaaaacagagagcgagagagagagaacccauaaaaacucaaaauuggaaaccuuacuauacaagcaaaagacaaguaagguuaaaaaaagaauauaagaaaacaaacaaaacccaaagcauaaccaaacaaagcaguauaagaaaaaaaaaaucuccaaagacauagaacucucaacucauuccccaauaccacuuucuggaugccgccaugcuucccagacuuaucuucggaaacuguaagcgaaucccagugagauguuuuccuuuauaagagcugccuuggucaugcugucucuucacagcaauggaaacguugacuaagaaguugguaccggggacuaggguguggcugugauaggccugacuaugcuauuguuuggaggaguguggauuuuggaaagcagcggcuuuaagcggggcuucuugggcgagucuaguagaagcaugaagacggggugcugaggaugacuugaacugugggggucuggcugaagagguuccaguggagaagaauuuuaauauggggccuagagauuguucuugugauguuuuggugaagacuguagcugcuuuuugcccuugucugcagagucugccugacacuaagguaaaaagauucagauuaauugcauugacaaaggaagucucaaaaaagccugcuauaaacucugcccugugguucccucuuuuuuuuuuuuaauuagguauuuuccuuguuuacauuuucaaugcuaucccaaaggucccccauacccacccacccccaacccccuacccacccacucccccuuuugcccuggcguuccccuguacuggggcauauaaaguuugcaaguccaaugggccucucuuuacagugaugaccgacuaggccaucuuuugauacauaugcagcuaaagacaagagcucccggguacugguuaguucauauuguuccaccuauaggguugcaguucccuuuagcuccuuggguacuuucucuagcuccuccauaaggggccgugugacccauccaauagcugacugugaucauccacuucuguguuugcuaggccccggcauagucccacaagaaagagcuauaucuggguccuuucagcaaaaucuugcuaguguaugcaauggugucagcauuuggaagcugauuaugggauggaucccugcauauggcaaucacuagaugguccauugguucccucuuaugaagagcauuuugaucaaguguagcaaacuuagaaagggaaaauacaaaauguaugauucaaggauuaaaggaguggaauggagcuaaaucuuuguguucaagaagauaaacaaauuaaagauacuaagugaaauuaagagaguggugacuuuggggcaagaucccauccugcuaagcuuccaucuugugaaaagaauguugaaaaagggacauugccaccuaaucuaaauuuacuaugcauucacauugaaugagggaguuauaucauguuagguaucauuauaaccugauuauuguuuucacuuggacauaaggagauaugauggugugucaaguugacaagggauagauugugauggguauucccaauuaucaacuugacuauaucuggaaugaacuccagucuagaaauggagggugcaccugcaauccagaucuucaagcaggaagacaacaugccuugauccggauauugagaugagaugacacacaauuuugauccagaucaacacauuuaacccacuauuugggaucaguaggugccaauggugaagauguagacucaguggcaguugaaggcccaggacugaaggagucaugcaaagaaguagaggcuucagcaccaugaagagaaccuaugaggagcuauuagugaaagugcagccuaguugcaguggaagaacccagcauauaugaagaccccaauaccaugggaugauuaucaagaauagcagcagcaguaaaguggaucaaccugagccuagacuucuacagagggcagaacuggagaagugacccaagcccuuugcagggcuccagaagagcauguguggauuccagacauuagaacgagaagcugugaaacugaaguugccuuggagaccccaaguuguuugagaugccaaagccaugggauaucugcugaggaaaguuguuaagaaggaguagaacgagcccaagagaaagaauuguguugcagucaacaaagcugaaaggaguuggauaucagacauggagaugcaaaguuugggguuuacucagauggucuuguuuuaguacaguauuuccucauuaugauguuuuggcaugguaauguauauccuguaauguuggaagugggugaucugcuuuuuuauuuuaauuuuauaggggacuacagcuaagagauugcaugaaucucagaagagacuuugaacuuuuagagauuaugauagacuauggguucuuucucauggcgugggccuuagaugcaauugacuggugguugauuacuccaaaaacaucuaugccacuguuguaccaguguaccaugcaggagagucaccaauguagguaaaggguuuguagcugaguuagugauuaccuuuccucugguaggguauagaguaccuuccaguacaaugaacgcuauuucagaagcaucuacuauaauagguuuccaugacccauucaaauggccuacuguuaguucucccucccuauacuuccuuccuuacccaaucuuccuccucucuccacuuaauccuucuguuccagccuccucuccgccguuuuucucuauguauucuauuucccccuccuuggggacuacuucccuccccucuaguuccucacugcauauuaaccuccauaguuguucauauaguaaccugccuauuaaaaggcuuagcaguaauauccacauauaaaggaaugcacaccuguuuaguuacuguucuauugcugugaagaggcaccaugaccaaggugacuuuuacaaaaagaaucauuuaguuagaggcuugcuuacaguuucagaggguuaguucauauuuaccauagacaagaagcagacuggcguggcacuggagcaguagcugggagcuucacguccugauccacacacaggcagcagacagacaaggagagaggcacuaggccugguguacgcuucugaaaccucaaaguccauccccaguuacacacuuucuacaaggaggccacaccuccuacuccuucccaaacgauucaucagcugggaacuaaacauacaaacagaggagcccucgggguuuugcucacucaaagcaucucaauacuauauuugauuuuugaauuuuccauuuccucacucaggaugauuuuuuucuacuucuauccauucaccugaaaaaucucaugauuucaacaacugaauaauaugccauuguguaaauauaccacauuuuccugauccauucauguauugauggguaucgugguaguuugaaaauggccccacagacguaguacuaccugaagacccaccuauaacacuccugggcauauacccagaagauguuccaacauguaauaaggaugcaugcuccacuauguucauugccaccauauuuauaauagccagaaggcggagucaacucagaugucccucaacagauuaauggauacagaaaauguguuacauuuacacaauggaauacuacucagcuauuaaaaaugacuucauggggcuggugagauggcucagcggguaagaacacugacugcucgcucuuccaaagguccugaguucaaaucccagcaaccacaugguggcucaaaaccauccauaaagagaucugacucccucuucuggagugucugaagacagcuacaguguacuuacauauaauuaauaaauaaauaaauaaauaaauaaauaaaugaauaaaugacuucaugaaauucucaggcaaauagauggaacuagaaaauaucauccugagugagguaacucagucauaaaagaacaaacacgguaugcacucacugauaaguggauauuagcccaaaaguuuggaauauccaagauucaauucacagaccacaugaagccuaagaaggaagaccaaaauguggaugcuucagugcuuuuuagaagggugaacaaaauacucacaggaggaaauauggagacaaaguguggagcagagacugaaagaaagggcauccagagacugccccaccuggggacccaucucauauacagccaccaaacccggacuuuauuguggaugcugggaagugcuugcggauggaagccugauauggcugucuccugagagguucugcuagugcuugacaaagacagaggcagaaacucaaagccaaccauuggacugagcucggggucccggauggaggaguuggagaaaggacugaagaagcugagggguuuugcagccucauggagggagcaacagugucaacaggccagaccccacuggagcucccggggacugaaccaccaaccaaugaauacacauggagcaacccauggugcuggccaccuauguggcagaagauggccuuguuggacaucagugggaggagaggcccuugggcccaaggguguucgauguccaaguguagggaaaugccagggcggaggaccuucauagaggcagggaagaggggguggggaggucugaaggggagaccuggaaagggggaaacauuugaaauguaaauaaagaaaauauccaauccaaaaacaaaaagauuggaaaccucucaagagagagaaagaaaaagagagagaaagaaagagagagggagggagggagaaaaggaaggaaggaaggaaggaagagaaaauaaauggccccauaggcuccuagggacugggccuauuaagagguguaacgccuuguuggaguaaguguggcauuuucagaggaagugauuaacugagggggcaggcuuugaagucucagaagcucaagccaggcuuaguggcucauugucucuuccugcugccuuugcauccagauguagaacacucagccagcucuccagcaccaugccugccugugugccgccaugcuucucacuaugaugauaauggacuaaaccucugaacuguaaggcagccccaauuaaacauuuuuuuuuuaauaagaauugcccuggccauggugucucuucacagcaauagaaagcccgacuaacacaggcaucaaggguguuuccaauuucuggcuuguaauaauuaucuuuuuaaauuuacuuaauauuuauacccauaaaaacacuggaggcaggagcugugguaaaaccccacuagcucagcaagguaacuuuacuuucuuaacuacaaaagaucuauuuacaagccugauucuacaauaaacugcuagcuccuuagaaaucuuucuagcugugucauuguacugagcuaaucuaccuuucucuugagcuccuccaaacccaagagggcuccuuaguucuuuccuagaauccuguuucuccuauguccugcccacugguucucugagguuccugcuagcccaaagaacaaaucccuaccuuaccuggaucuccuucuaugaagccaagccaaaaagagagagagcccaaaaguccaagugagcagagcucucucaaagguccauugcuauaaaagaagucucuagcuccuccuuacacccuggccaggcugagcagagucacggacaugguggugguggugacuccaagccaagucagugggggccaaaccauuucaccuguacaguggaacagcucaaggccauccagcugacuuugcuucaggucauagagcaaagaccacagaccuccuccaagcaaugugccuugaaaugggcgggaacuuucaauucuuuagcauucuuaucuaucuaggccuguagaggcacacccaaacugcaucucuuccagacacaacugccucucacagacacuguaucuuugugggcuuuccuguuuugccaacacacaggaugucaauguacaaucaccaacuacccagugauaccggcuaucaugaguaggacagcaaugaacacggcugagcaagugccucuguggguuagugguccucaacuuugcuaauucugcgacucuuuaauacaguuccucacgcugugguacacccaaccguaaaguucuuuucauugccacuucguagauguaauuuugauccuguuaugaauuguaauauaaauauuugcauuuucugaugaucuuaggcaacuccuguaaaagggucauucaacaaccucaagaggguugcgacccacaggcauuauaguugggugccucccaacuaccuugucuaacuuaaauuagccuguuuauucuaucuacaucugucacguggccauuaccucucacucggacccagcacguaauccuuccaacucugcaacacacagauccucccgcacaugagucuucccaca

SEQ ID NO: 1872 - RNA, 2402 nt, Mus musculus
uaggggaagcugggagucgccgagcaucgggagcuggagugaucaggaacagccauuugugggcaucagggacgugagcucuucccgacuacucaacacacaaccacuggguguuucugaaccucaguguccucgcuuggaaagcugguagaagaaucuugcauugccucccuccuggaugauugaaaaauuuuaugggugcauagaccaagagaagugcaguuaccauuuaauguuaccacccuaaaaagaaagaaagaaacaaaaaacaaaggucacuuuacuacuugaaccuaguaguuugaggccagcuugggcaucaaguagaaagccccguuaagcaaccaaccaaccaaccaaccaaccuuugggucaaagaugccuucacaaauagaaaggacaggaaaaaugugaguucuauuuuuucuuuuaguuauaguuaguuaaaauguguguguagaucagaggccaacuugcugggaggcaguucuaccaugugagucccuuagguggaacucgaguaaccaggcauggugacggcaccuuuauccagccaucuugccaguccugugugauuuaauacacauaucuuugguugguuuuguuuuuuuuuuuuguuuguuacuuuuuuuuuuuuuuaagauuuauuuauuuauuuauuacauguaaguacacuguagcugucuucagacccuccagaagagggagucagaucucauuacggaugguugugagccaccaugugguugcugggacuugaacuucggaccuucggaagagcagucggguacucuuacccacugagccaucucaccagccccauuuguuacuuuuuaaguaacuacauaaacuacuuuuauuuugcugaauggggacagaaggcaaagcucucuaccagugaacuccacgggccuuguaaaaaccauccuaagcacggacuguuuagaagaaguuuagaaggcuggcaacauggcuuagcagguaaaaguguuguuugcaggccugaugaccugaguuggcuaccauggcauaaucaaauaugccguugcacacauagacaacacaguacacacaagaugaguguaaaaacaauuuauagaaaaguuuggggaaaguuagugcacauuuguaaagccagcagucuggaggcagaagcaggugcaugcucgcuagucuuuuucucucaacuugacaugagcuagaguuacccgaaaggggggaaccacaauugagaaaaugccuucauaagauccugcuguaaggcauuuucuuaauaagugauugaugggggagggccugucagcuggugguccuggauucuauuauaaagcaggcugaacaagccaggggaagcgagcccagcaagcagcaucccuaccaugccuacccccauggcuucugcaucagcuccugccuccaggauucugcagcguuugaguuccuguccugacuuccuucagugauaaacagcaauauggaagcauaagccagauaaacccuuuccaccccaacuugcuuuuuggucaugguguuucaucucagcaauagaaacccuaacuaggacaaacccuaaaaaaaaaaauaaauaaauuaacaaaccaagacaugaguuugaggccaguguggucuacuuagcaaaggcagauacuggggcagaugauguccaaaaaacaaaacaaagaagguaugauguaugaagauuuuccucagucaucucuggaacgucccugugaaacuaguagagaccuccaugagaaggccccaggaagagacgacucuggcugcugugcugacgcauuuuauaucagcuugacacaagcuagagucauuuggagacagaaaaugcuucuguuagguaaaucuguaaugcaccccccuuucuacauuuuuaaucaaauauaguuaucuucauacuauuucaauuaugguucucuuuccucaucucccaguucuuccccaccuccccacccuucaaacuccacuccuuucucacucucuuaaaaaaaaacaaauaggaugggccuggggagauggcucagugguuaagagcacuggcuguccuuccagauguccugaguucaaauuccagcaaccacaagguggcucacucacaaccaucuguaaugugagauuugguucccucuucuggaguguaggcaaaacacugugugcauaguaaguaagucuaaaaaaaaaaaaaaccuggaaaaugaagauaaacaagaauaaaaugaaaugaacagauuaauaaaauuuaagagcacaagaaaaacagagagcgagagagagagaacccauaaaaacucaaaauuggaaaccuuacuauacaagcaaaagacaaguaagguuaaaaaaagaauauaagaaaacaaacaaaacccaaagcauaaccaaacaaagca

SEQ ID NO: 1873 - RNA, 63829 nt, Mus musculus
cugggacugggcucccuugggccccgccucuuccggcccgcgagguuugauuccuuuggcgggcggaagcugcuggaacuugaauccugcagaaauucccaccgacuuguuccggcuuugcuagacucugcagccggcugcuucaccuucuguccuguucgguccuguucgguccuugcugggcccgcugcccuucaggucaguucuuccguccucgggccgcacucugggccucguggggcguggccgggagacggaguuucccugggguuccacccaucagcacuguucucugugagaacgucuagguuuuucgacccuggcuuucacagaugguggaugguaguuuuuuuuuuuuuuuuuuuuuuuuuuugucucggguucugagauguaucuugcgucuugaacucacuggucucgaacucacuuuguagccaaagugguccuugaauucuggauccuccugccuuaccuuccugagcgcaggagauacaggcgugagcgcuccccacuccccauuccccgcucagcggguaauugauaaaguuugacagagcauuugacgccccggaggcucccauaaugggaauuuccaguucuguuucagugcuuuugacugucugcaaaagcgauucagagaugggcuuugaggcacuuacacuuuucaacucaguuuucugggguauuccaguuaaaagagaaauguguguaaccccuuuguagagcccaaauccuuccucaccuugcaccucuaaagcaaguggcccgagacucguauuguaaggacgcccagaggcuauagcaguaaauggaggagccagguggcuccugccaagaaggguguggaggggagcaguucccugcuucucaucccaaggcaggagcucacacuaaggugagguagugaguguucuagucucaccuuagguagauuucugugguuaauggaggaggaggaagagaggguuucagaggggucugaaacguuggcuagagaauuuagucccaacuuuuguucauguuuuggcuucuguuucuucuuaaacaccuucguggaaacaguggcucugucccuuuuaucuauuaugaaccaacuagauggacagguuagucccuaaaugcuuuugggaaugaaugccucuauugcugcucucagaaaucuccgcaaaggagcagaagggugccgccacucaacuguauucuaaggccagguuguaagccauucugcacucucaucugaaaugaccagaucagugucaaugagcacgagaggcaaguuaauguguuuuguaguaagugauagcauggcucaaauaacaccauacugguagcaaaauacccucaguuugccuuuuaugaggacucacuguauaguccaagcuggccucuaacucacagagaugcaccuaccugccucuguuccugagugcugguauaaaggcauguaccacaguuaucuaauagaaucacaaauuucccaauaucuagcuaauuucuuauuuuuuucagaaaagugucucuauugcauauaccccauuucuucaccaacuagaggaguucugagauaucauauuuuugcuuucuguauuccaauuucuagaagguaaacgggauguguacaguuauuuagacccagcuuuauaccuacaacaugaucuaaucacuagucucuuuuggggggaggugggguggggugggcugaggcuuugagacaggguugcucuguguagcccuggcuguccuggaacucacuuuguagaccaggcuggccuugaagucaaagauccaccugccucugccucccaagugcugggacuaaagauguuaccucugcccagcuaguuuuuguaauaguagcaaaaaugaucuucccuggauuugaagaugauauaaucuagccuuacaguggugauacucaaagacauggugugauuucagggaagaggguagucagaaaaaaaaaaggauuuaguguuugugcaagucuuuuccuaggaacuggacauuuuaaaaguccguagggaggaaucugugaagaaguuaauuaugagccaagccugguaaugcaguuguaacugugugugugugugugugugugugugcuacaguguguguggguggagguuaguugccagcuaugggaguuggucuuucugucaugggggucccauggggguccugggaucaaacucaauuucaggcuugguagcaagugccuuuacccacugaacaaguggguuuguuguuugaggcauagucuccuguagcccaggcuggaagaacuugcuguguaggaagaccuugagcuccugcuucuaccuuucaaauacuggcauuaccggcaaguccucucaccuugguaaaguucaacucuuuauuggaauuugauuuguauagaugauaugagacaggaagccagguuuugauuuuuguuuuguuuuguuuuugauuuuugagacaggguuucucuguguagcccuggcuguccuggcacucagagauccuccugccucugccuccugagugcugggacuccuccacccagcucuguuugcuugauuuuuuuugcuauggcuaguuagugcuuccaugaucauuuacaugccuaagcuuuguguuuaccccuguuugcaaagggagcuggugagcucugacaguccuuuuauuagaugugugcuauuucuucuguguuacagguucugguugucauuuugaauaaccuuccagguggacuaugaaagauuaugacgaacuccucaaauacuaugaacuauaugaaacgauugggacagguaauugucaucuuuuucuuggaggcagaguacgaauaaaguaauucaaaguauggucuauuuggguggucaugagguuuuuaguauaauugauguggcuuaaauuuuuucuuuaucuauaacuaaaaaguuugaauuugcucuugcuuuugcucuugcacucuugcucucuugcacucuagcucucuugcgcucuugcgcucuggcuccuaaagauguaagcaauagagcucuugcucucuugcucucuugcucucuggcuccugaagauguaagcaauaaagcuuuugccgcagaagaaaaaaaaaaaaguuugaauuuauuuuagugugugugugugugugugugugugugugcgcgcgcgugucugucugucugucuggugugcaucucuguguaugauguauauggggaacaugucacaguauacacaugguggucaaaugacagcuuguggaguagauuccuuuccaccuuuauuugguuucuggggcugggaugcagguugccaggccugugugccaguugccuuugccugcugagccaucucuucugaugcucugccuucuuuaauaagcagaguagagcaaggguagcuagccuaucagagagaggcucacaggucacuacaaaaguguuguauuuuaguguaacuaaagccauuggagaguuuucagcuaaggagugauauggccuuuuuuuugaaagggucguccuggcugccugagagugaagacccugggugggggagggcauagcugucagaagcaauggcaggcaggagaguccaugccaggcgaggauggcagcaugguuagaaugcuagggugaagcuagugagacugaguuauaacauacaauaaacugugcauaggucugaguuuacgugaauauauacauagucaugcacuaccugcucagagaaggcuugggcaauuuagucagaaccuggguccuuucccccaggaagucacuggucuguuuccccauguaaguaggugggauuugccuaugaguugugcauggaaugccagagaaacgaagucucauggucuugugcccagccaccugggagaacaguggggaagacuauggaagaaacuaucagaaacuucuuuuuggguguauuaauuugaacaucuuucagauagcuagaaauauuuaaucagccuuugacccaguucuaauacauuuguaguuuuuaagcucauugaaguuuuguauaauuugucuucaguuuuaguaacuuuauauuguguucuagcauguucauaauaaagcaaauuuuuuuuaaaagauuuauuuauuuauuuauuuauuauauguaaguacacuguagcugucuucagaugcaccagaagagggcaucagaucucauuacgggugguugugagccaccaugugguugcugggauuugaacuucggaccuucggaagagcagucgggugcucuuacccacugagccaucucaccagccccaauaaaguaaauuuaauugaaguauuaaacauggaauaugguuaaagauuuacuucuauguauguguggucugugcauggguaauccuuaugucugugggugucugaggagaacaggagagggugucugugugucuggagcuggaaugauagacagcugugagcugccugauguggugcugggaacugaacucugaugguccguaagagugacaaacauacuuuauuagcagccaucuccagcucccauagagcauacuuuaaaagagugaauuuuuuuuuucuguuuuuuucaagacaggguuucucuguguagcccuggcuguccuggaacucacucuguagaccaggcuggccucgaacucagaaauccuccugccucugccucccgagugcugggaucaaaggcauacgccaccaugcccggcugagugaauaguuuuuuccuacuucuuuauuguaaaauuagguauuugcuguucaugguaggaaaacaaacucuaucuauaacagugguucucaaucuuccuaaugcugcaccucucucauacagguugaggugugccucaaccaaagaauuaucguugcuacuucauaacuuuaauggcuacuguuaggaauugucauauaaauaucuguuuucugauggucuugguuucccuugugaaaggauuguuugaccccacccccaccccaagggguugucauucacagguugcaaguacuggucuagaaacauggacugaaaagaauuugcaaucccggcuagcauguuggaagugacaaaagaaaggaaaauuuccagaaaaacguggcuugauaaagucuuuuaaaacaucuguguuugggcccucauuuuucuccguuugcauuuuucuguacucagguggcuuugcaaaggucaaacuggccugccauguccucacuggagagaugguagcuauaaaaaucauggauaagaaugcgcuagggguaaguuugagaugacuuuuuaccuuaauuauacaaaguuccauugauacuuuuauguaugaauuauaguacguuggucauauuugucucucaugacauuaaaaacuuaauuuugaucaaggugucccuauauauagcuguccuaggcucaccuuguguggaaguuggccuucagcuugcgaucucugccucacccucaugauaguuagggcugcugguguaugucuucacacccuccuaagaaguauaugucuucucauaugugugugugcauggcaugugugugggaacacauguaggugugugugcacguauauauuugaauggucccuuuacauuagugugagauucuuucaggaauucuaggcauuguacuguugaccuacuaugucaguagcuuuuugucacugugacaaauacuugagggaaacaauuugaaagggggaaagguugcguuuugucuugugguuugcuuugggccugagguaagguuggauguuaggaugguuugagcuugugcuucaguggcagcgaggagacagugcguuccuuggcuaggagguacucuccuuuaucucagccacgcccaggcuuacugaguggagucacccacguucaguguggguccucucugaguccucagcuacuccuggugugugcuugcucgucuccacccacgcaaacuggcagauugaguuugccuuuauaacauuccucaggauacuaauuuugcaaggcuuuucaguuuuuugagcaguuuguuuuagagcuagugauagcugccuaguaugaaaguugcugaugcugaugcugaugcucgggacacuugccagagagcuuguugcuuaucugaaccaauguuugucaaacagagugauuugccccgagucaaaacugagaucgaugcgcugaagagucugagacaucagcacauaugucagcucuaccaugugcuggagacaaagaacaaaauauucaugguucuggagguuagugcuggguuccagacaacugaaaguuuuugcuugcucuuuuaguaggugagagagaauucugucuucuuagcugaaaagucagaaucaguguuuguucuaguuuccuuuccgucgcugggauagcguacuccuuauagaacauaauugaggaaggguuagcgcaguuccagggucacaggaagacugagaggagagagaaagaaauaaaugcuugcuugucugcuugugcucagcuggauuucuccagucucauacgcaguacaagaccccugucuagggaacagugccacccauagugggcugggacuucccacaucaaugaacuuaguaauggcagucucccacagacauacccacaggccagucccauagagucaacccaugauucucugcccaggugauucuagguuguguuagguaauaaagcuaacuguuauuguuauuuguucuuuucuuucaccuuuauguggguuccugggaugaaagccaucuugcuggcccuuuuugugccuuuuauuaguauauauuaauuauauauaauguguuacauuaugauauuuaguacauaacauuuuuguauaugaaauauauuuauuuuauguuuaugaguauuuuuuaccugcacaucugugugcaccauuuguguaccuggugccuagugaaaccauagaggguguuggauccccuggggcuggaguaauagacagcugugagcugccaugugggugcugagaagugaacguguauccucugcaagagcagccagugcucuuaaccccucagucaucuguccagcuuccuaucuaauguuuugaccauauuugaccaucucuguuacauuauugccucuggucccuucuucucagcuagcccugcuucugcuuccaugucuuugcuuucuuuuguuuuguuuucuuuuuuuuuuuuuuuggguugcuuacaagagcauggcuaccuuacuaaugacuguaucccugaagaaaauguuucuccucccuuaucaaccauuagcuauauaaauccugaagagggggcuucguaagcucuuuuucuuacuugccuuuucgccuauagauaagugcaugguuuugugucagacaucugugugcuugugggcaugcacacuugcacacgugcguguggaaacgcagagugucuuucuagcuuguucuuucccuuccuuguuaagaucucucacugaaccuggguuaggcuggcuggccaagggccccagcuccuugucacagaggcuugucccugccugugcugggaugacagcucuguguugccaacugcaggcuuuuaugugggugcuugggggucugaacucaggaccucaugcuuguucagcaugaaccccuagggggcucuuuuuagggagauugaaaaucaguggucuuuggacaaugaccagcaauaauuacuggagaaacaauaauugcuccugcuuuucauuuuuaacuuuagaugacuguacgaaaugugaauuuguuaacuugagaaugaguuuuaguacuuugcuauaaaaauauaaagcccagagugaguuuuuugaaaucacagugguaguugguuuaacuucuauuuauugguacuaaaacugcucaagggaagacuuacuguucuccuuucuggaauaauuacugcgguguuggauccugagagugcaguucucucacucaguuaccuugccuuuaaaguuaaacuaauauugaguuugcaguaguuuuacuuuccauuccugggaagugauuucuguaacguguguaagugugagucucuuguuguugaaguacuguccaggaggagagcuguuugacuacauaaucucccaggaucgccugucggaagaggagacccgggucgucuuccgucagauacugucugcaguugcguauguccacagccagggcuaugcccacagggaccucaaaccaguaaguggccuuaucagccuuagauguuuaccugggaguucagcacgguaugccucaucucuccaggugcccacgugcucugcuuagaaaccguccaguucugcuccuuagauucuuguuauagucaggaucuggccauucacauuucuuucuuagcauccucauguacaugacauuauagcugcccuuugucaagauuuuaucccugggaaaaaugagccauccaguauuuuccauucaguguucuguuuuuguuugagacauugucuaccuacauagcccaggcuggccuagagcucauaguauagccuuggcugcccccagcuuaagauacugcugucuuaaccauccaaaaugcuaagauuauauuccguuaauuucaaaccauuccccccaagaagggggcagcucagcagaauugacagcuuguaccuuaaaggacugaugaaagaugugagcauuccuuuagcuuuuaggauccagugugugugugauagugaguguauauuuaaacguaacuuuguaagacagagucaggaauguagaaucagucugcagcaguguuaucucuuuuaaguuuuuauaccgaacucuucggucugaguuccauuuagucucucucuuguuuuuuuguuuuuguuuuguuuuugagacaggguuucucuguguagcccuggcuguccuggaauucuuucuguagaccaggcuggccucgaacucaccgagacccaccugccucugcuuccaaguacugggacuaacggugugccaucacugccucucuccccuuuucuuucucuuugugguucuggggaguaaaccuagggucacaggguugcuggcacagugcucuucccucugagugacauuuccauucuccagccuuuuucucuuguuuuccuuguuuuguuuuguuuucuaagucagaguuugggggauggguuggggaagacaggguauugcuauguagcccuagcugaccuggaacucacuauguagaccacgcuggucucaaacagguccccuugcuucugccuccugaguaccgucauuaaagguguguacuuaucccuagcucuauuuuuuucuuguuuuuuaauuagcuuuuauuuauguuuuaacuuauauuggaucucagcuucaaauagaaacaacucuaaauuauuuuuagaaaugguuggaagugggguaugacauaggacaucagaauacaguuaucaaaauaucuuuguuuucucaggaaaauuuauuauuugaugaaaaucauaagcuaaagcugauugacuuuggucuuugugcaaaacccaagguaaguauggaaauaaaaaugcauuuaugucuauaacuauaacuauaaauaucuauguguuauuuuucacuuaaucuuuauuguuugguuauguccauuuagaggaauauuaaauuuuauccuuagcauuaauaguuuuauaaguaugcuacauaauucugagauggaaccaagauugugaguccccccagggaagcuaugagaaucucgagugacagguaacaugaagccauuaugauacgauacugaaucaugugcuuguaguuugaguauuuugccacuagaugaugccuuuguucauuuguguacaaguugagaauugaguguguaucuaguuuuuguuacccaagugguuauauaacuagggguaaguuauacgccgaggugauccucuuuccuugugaaagaagaggggaguggauggccaugggcuucuacagucacucugcucaggaguccccucauuugcacuacguaguaagugcugguguucuucagcguaacuucucuuugaggugacuuugaacuucucagcucugccgcugccgcugucuccugugaggcugcugguuggaggcuuccuucuggguucucuaaugauggcgcugcgcugcugagaugagcugucuguacucauuaagaauguugaaauugcagacucgucucagcccuuuguagucccaugauuauuuccugccccucagaacuagcaaggugcagagggaagcagauuuugccucuucaguucugaaugucugcuucuuucugauucuucucccacugaugucuauucugagaucaccagugggggcuugugucgggaagcagaugauucagaaggcagguuuaaaagguuuuuuacagacauaaaagcuuauaaagaucauccuuuggcauguaaguuauauucuccacaggagguaguggggauguuuguagaagacucccauuagcuuuuuugguuuuugguaauggcugccacagauucaacucauauagacagcaucuaaaaaauggggagguuugggaaagauuggccucaguucuguggggcucucacugcgucaccacggccuggcucauuuguaaacagagucuuaagguuucuugauccuuugccucugguagagcucagcccaggagugcagcggcagcuucguuuuuagaaggccugucuauguuucugugggagagaagaggcuaacggaucaccggggaaggcggcgauuggucuuagcacagaggcuagacaguagauuagcaaugcauucauucuccuaugcagcaguugcuucuuccugggaacaagaaggaagaccuucuguauuggcaaagaugugauguuaaagcuagggacuugaguucuguggguauuccuugaguucuugggugugggaaaucaugggugcucguauaaaugugggguugauuacugugcagaugcguaucuggggaaguauacaauugaucugaccuaucugaggggagaggaucuucauggagcuccagugguauuggaaguguagagaaucccaacugauacaaagaacuguggcagaauuccucacuuugggggauaauuuuucaucuauccucucuuugaguucaaaggggagaauuuauuaaaguuuaaugcuuuuaauguuuauguuuguuuucugagacuggucucauguggcugagucugaccuugaacuccugaucuugcugcuucuggccaagugcagggauuacaaaugugcaggagcugagacucacuguuccuggggccauaacuacaaguguuugguuuuuguguuacgcagggcaacaaggacuaccaucugcagacgugcugugggagccuugcuuaugcagcuccugaacuaauacaagggaagucguaccuuggaucagagguaauuguuacugauuagucggaugugucucuucauccucauugugcuggcuuuuguuuaaaguggcuauaguuugaauugguuaggucagcuaggaaggguccaaggcgaugguguugcgcccaguuuucaaagauguuuauuaauuagcacagagaaaaacuuauccuucuagcauagcugacuuguuucuuuuuuuguuuguuuguuuuuguuuuuguuuuuuuuuuuuugagacacgguuucuuuguguagcccuggcuguccuggacuugcuuuguagaccaggcuggccucagacucacagagagccaccuaucucugccuccugagugcugggauuaaaggugugugucaccacggccagcuugcacuugugucuuaguucagucagcuaucucauucucugcagcucagguggugcugauguuagugucauaaagaaacaagacacgagaggucagaagcucaggacuguggggcugaaugccuccugucuuuccugcagucugguacagggugcucucuggaaaggacuagcacagguggcagcugggcucagcuugcuuuaccuacagcacccacauuucucauggaacaucucugggcauaagugcuaugugggagaaacuuuagaaauacuagccuacuuaaucugaaacaggaauagaugggaauuuguauauuuuuagugacuucauuuugaucuaaauuuaaaguauuguacaaaaauagauuuaagacauuugguauguuuuuauuuaaauuuguaauuauuuauauucuucccuauuugcuuuauucuuucuccauacaauuuuaugcucauccuucuuaaaaaucauaugaaugugaccuggacaucauauuccuuuuuaauuaagaauuugcguguauuguauuuuuuuauauauugucucuuuaaaaacuguuauaucuuuauuuuguauguacauuggggcagcacaugcccaguguacauauggaugucggaggauaacuucugggguuaguucucuccuccaccauucgggguccaggcacugcacucaucucgccaggcuugguaaccaagcaagugccuuugaggagccuuuaccugcugagucauuuugccagccugcauuuuuuuuguguauuuauguuaaaugagccaaaauuuuaauuuguuuauuucuugcuuuugaaaugcucuuccaugaccucuuggccugagauucuuugccacagucuguacccgcuacauaguugcaaccaacuacuuuauggggugagggugggaucgggaggggaggggaggguaucccaccuugauagcugcacacacagaggccuagcucuuuagcuuguugugucaacuuuagguugauuuggugcucagcacaaagggacuccaucauccugguauacauacaaacaaccugauaaacacacauauacauacacaauugggaacagacacacaaagaugugcuuggagcuugccuaaggcuuucaguucugugaaucaugugcuaggcuuucaugguugaacauauucuuugguuuuuguuuguuuguuuguuuguuuguuuguuuuuuggggguuuuuucaagacaggguuucucuguauagcccuggcuguccuggaacucacucuguagaccaggcuggccucaaacucagaaauccgccugccucugccucccgagugcugggauuaaaggcgcacgccaccacgcccggcuugguugaucauauucuuaagcuccuccuguaaagcugguagugcacuuccugcagcagugccuuccuuggccauggagguggcgaagggcgggcgaaacugaauccugaauacacuuugaggcccucacugggagacuuggcaauggcagggaaaaugcuuauuuguuuauuuauuuuggaagaauaguuuauugaguaugcugcaggagggcaacaggcuggguaguaacuggcaugcugacuguagcuuuaucuauguguauuuuacuggauauuaaacuuagggccuugaauauguuaacacuauaucacugacuaaaucacuaucccuuuaguucuguuguugauauuuuuuucuuuguuauuuugagauaggauuuugcugaguuuucaguuggaaaccugagguccuccugccucagccuccugaaaaggacguuuuuucguguguguguguguguguguguuugcuguguguaugucgguguucauauauuuauguguguaggucugaaguugacaucagguugauaguuugcgcauuauugaggcaggguguuacugaacccuggaguucuccaggucuggcuagguuggguagucaggguggcaagggaagcuugucuuugacuucugggcuaggcauagaagucacaccgccuagcuuuuaugugguucugggguucuaaacucccauccacagaucugccuggaaagauguuuauucacagagcgaaacccauuuuggauccugugcuggacuggaauucaguauguagcucgggcugaccuugaguuuuuggguguucuugccucauccucccagugcugggguugcagauuuaagccauuaugcuucagacccucuaaaacgugcuuguaccgaucaucuuuauaguuguauuauauugguuauuguauuuuguuagcucuaucuacauguauguauguauguauguauguaugcaugugugcaugcagaugaaggccagaggacagcuuauggggauuggcuuucuucuuucacuaugaggguccugagaacuuaggauguaacccuaggcaacaagcuucuuuuccagcugauccuuuuugcugacccucuugaguucuuuuuaaucuggaaaacuuagguuuucuuuguuucccuuaauuuuuuuucucugagacagacuaucaugcuguagcucuagucggcccaaagcgcauucuguaagucaggcuggauucccggagagcccuggccucugagggcugggauuaaagguaugcaccacaaugccuggcuugucugguuuuugaaacagucuuauagaucucaggcugugaacuuacuauauagccaaggauggcuuugaacuucugaccuugucucuacuuuccaaguuguggaaugacagacacgugccauucaguuuauggggugcuggggauccagucaugggccucaugcgugcuggaccccacccccucagcuuguugguuuuuguuuuuguuuuuguuuuuuuuaauuuuaacuuuggaaaaauacagauaacauaaaaucgaccauuguaauugcuuugcaguucaguuuguuaagugcugucacauuguuguacauugaagcucugcagugcucuuuacuuguacagcuaaaacccagcgcucauugaacaauacucccccauuucugcuuaaucucucuggcuuuuguuccauucucugugucucugaauuugguuauucugcauuagguauaauuuuaauaauuuuuugugacuaucuuauauucuucaacaugccuuccagguuuaucuguguuauagaaugugugggacuacauucaggcuugucuuucaaaaacugugugucgugcgugcauggcagggcauucccugaaccgggggcucacauuuucuugacuaggcuggaagccaacaguccacagcaguuuucugucugcuguccuuggagcuggacuguauaauuuuaugcagggugccaguggguuccggggcucuuacucuuguccaugggaaccugacugucuuaagaacuguaccaaggaguccucaggcauccuugaaagaugcagaaccugaggccuuggagguuguuuaaguugugaaguaagcaguugagauaauucugguguuggccugcaaagggcacauuccauggugggcucucugagguucucacagauccuaacgggaaguguuucagcaugcuuucuucccccaguucuuuuuaucuuacugccaaucgauagguuuauuuacauuuacuuggacuuaugauuuuaguuaguguguucucucaucuugugugaaucagcagcgaaaugaggugcuugaugaggcgaccugaaagucugguuucuuuccaggaggaggguagauuguguggaaacauuacuauacucuuuucaucuuucaguuuaaucucacacauaaucuguuuugacuucucgugguauuugguguucacuuccuguuuugccauaacuuaaugaauuacauguuugcaucucucaggcauaaaugcuuaacuuuugaucuacaacuugguacacaaauuaccuguugacuugaaaggcaagcuuuucacguccguccgacauccuggaguccuggcugggcucuggugugauucaauugacagcucuacauccgcuguguacuccuagauaggcgaggcugucgcauuguuuaacuaguuucucuuuuauuugucuuugucaaaaaugcaguccuuuacaaacuucacaagaauaagugaggguggagacugacugacaguuaggcacucgaucuuugggcuauucgcagcacggaagcuguguuaguguucucuaaaucaccagaacuuacugaauggaaggaaaauacagauuuauuaaacugauuuauagauuauaguccagauaaucuguuaauggcugucucacaaggaaaagccaagaauccaguacuuguucagucuaugaggcugaaugccuuugcaguccugaucuggugcuggucugagaggauuccuagagagccuagaagguuuucagucuucauuagaauccugacaguaguggauaugauaccagccgugagagcaggauaaacggacuugccagugagaguaagcaauagcuucauucuuccaugcccuuuuaugcgggcugcuacuggaagguguggcccagauuuaggguaggucuuccuaccugaaauauauauucaagcaaaccaauacugugguuuaguugauucuagauguauuaaagucgacaaccaaguucggcuacuacgggagccaugauuaauaaugaggcauguuuauugcgcaaagcgggucuuacuugaauagucauugcucaggacucaaggaaaucucagaaaguuacagcuuuuuucugaaguuuaggauuuguagugcuguuaugcuaauuucuagccuacauauuugaaaagucagccacugaauuuuauuaagauuucuuccuaugcaaaggguuuugcaucauagcuuaauugcacuuucagauuaacaggaaguuguuagacuuguuuuugacaucucuaaagguuugcacagucguccuauauaaccuuagccucuggcagccuuaaacucgucuuugagaaucagagaaucagaaucaagguuuuguuucuuuaugacuuaguuucuagaccuuuggggauucuuuucuuuuuaucauuuuugguuuuucaagacaagguuucucuguguaguccugauuguccuguuuaggucugcuggccuugaccucacagaucaucagccucugccucccuagugcugggauuaagcaaacgcaccauccuggccaccugggaaugauuucuagucaguauuagcguguagcuagaggaguauacggaauugaacgucagcaggccuuccauugagucagugacuuuggacgaaucuucuuuucuaggccuuguguucagucagaagagcgauucugugauucucuuuuaggugcccugccuuucugaaacguguuuuguguuauuuuuuucucccucuuaggcagauguuuggagcaugggcauccuccuguaugugcucauguguggauuucuaccauuugaugaugauaaugucauggcuuuguacaagaagauaauggugaguauaugaguacagaauuucagaauuaaagcugucugugcugcuuauuaugugcuugcauguauaaaaguaccaaaauguuccaggcuguuagaagauaagacuauagcuaguguuuggccaugguuaaggggaaaauaguuggagccugcauuuucuugaccuggauguuggucauacuuuuuguauucaguuuuugaaagcuuaccaagguaugcauuuaugauuuaugucuaucucucuuuaugauagauaucauauauaugauauauauguacguauauauauaucauauauauaugcacacauacauauauacauauauguguguguauaaaacuuucagcuuauauuuuguuaaacucuuugaguaaguacuaaauauauauaauauaugauauaugauauaugucauaauaugugucauauaauauauaucauacuuacuuaaggccagccugggcugcaugagaccuugauuucagaaaagggaacuuuuuguuggcauuguuuuuggaagugccauccauuucuuauucugagaccgggcugucccuagacuccugugagugugaaagaggaucacaccuggcagaaccaagcagagcuggaaacggaguauggaggauguucaaggucugcaucuucaucaaagcacuugcuuuccgaugguuuuccagaugcuccuggcugguggcuugaggaagcuagaaucuuacuguguugagauuacucauuuuuucuccaggaaccccaaagccauugugaaaaggacagcucagugggucaucagaaucaccagccuuggugccaggcugcacggugaggggugaggcagauagcucacgugcauacuucauuugcauuuaauaaaagaacaagguagcaggaaagauacacugagcagugcaggaucaccugaguguuugcaucuucagcuuuaggcugcuaucuaagccacucagcuaagauuugaggagugcugugcuuuuccugucuagaccuuaaauuacuccguuguuuccuuuccugcaaauucacacucaugacagaugugucauuaauauguuaauuauuaauauuguuuaacuaguauauuuauuugagugcacuaguggaucuugaauaaaucuuuugggggcugaaacuuaccuuaaaauaauaugaaagugcucugccuuaauaguaaaaaccaagguuuuauuuuugggcaaauugagugccuuugcaauugcaugaaugguagaacaugucuaauucucguuugggagagauuuggccuucuuaauuaauauuauuuacuaauacuguauauucuuuguuuuuccuacuuugaauuuuauuuuuuaguuuuucauguauuugcaaguugaaaauugauucaaauuaggauuuuuaugcauuauuguggaauuuaauuucacacauuauagauuuugaaauuuauuguaaucuugacucagaacuauuguuccgagucgcaguguaauacagucugcugguugaaucuaauuaaggugucguaucacuugcauacaguauguaucugccuagaauguucuaaaaauucucacuuaggacuaguacaacccucucaucuuggcuugauugaaaaacucagcaauauuugacacauugugaaacugauuuaagaggcagccuuuguguaucuugcauuuguuggcuaucuuaacaaaacccugaaauguaauuuucagcaugaucacuuagagauuguguuuuaaucuuauuaaagucaccuauucauuugcuaucacuguauuugaagacaagcaugaccauacuucaguucugguauacaaguauuagaguggucuacauaauuuagaagucaaaguuggauagucagaagguaaaauuucuuaccaauuguuacuuucaaauuuaagggaaaugaguaacuuguuucuuuaugcgauuacauuuuuauaauuuuauagaguugacuauggugcugucauugugugcuggagagauugccugccuuucuuagcaccauguacacagugaacaacugaaggcugcuagaauucccaggauuauccuuagcccagagauccccuucuccucccacuuggcuucugcccacuguugcucuugcucucauuugcaaggaaaucacccuuuaaauaaagaagcaggacuaaggggcacagcccuggcuggcacagggccuucuguggugcugccccuccucgcugcacuguucccugaggucuucucuguuuagucuuuggauguauuguauaucuuacugcuuaaaucaccccucuguguacuugugggcuuccuugaguuauauaagcacagcagaaagugcugcaucucccucucguccuuuucuagccuucaacauacgcuguucuguaacauguuucuuaaccuuggcucucuucuugauauuugggaugagcucacucuuugcuguaggugaugcagcgcagagcacuggggugugcagagcacagucuguacuuacuagauauugggagcagccccagccugcacacucaagccaagcacagacaggcuucugcucgaaguuucucgcgcugggguagugguacacagacuguggaguacucccacccuuagcuagcaguuuggguccuuuuuucuuucuuccuuuuauuuuuauuuuuuauucuuuuggguguuaguuuaagggcauaacauuucuuuuacuuugguaguuaggagccuauauuugaguaucagaagagcugggaaccuggagccagacucuuccuugggaagagaggcuggugggagaguggcaccugaaggaagcugugggaguugcuuagugcuucuaaagucaaggacuugagggugguggcuuaacacgauucagauaugcccucucacaguugcaggugggcacaguucgguguaaagggggucaggguuaagcagacaccuauagcagucagcaugggggugcccagagcacagccuguccagugaaaggcauggcagaagagcagggucugcucaggcacucagguaggcgguggccauuugauaagcagguaggcaggcccaucucuucucgcuguggcaagagcaagcugaagugugugagaagcaggcggauaggcagauggcugccuguguccuugaagaagugcugggguaacaggugcaguaccacauaaagguuuucucaguguggguuugggauugaauugugggugcccagcagguguggcuggugccuuuauccacugagccauggguuuugaguggucucauauaguccaggcugaccuaggaccugcuguggaucguaggguagccuugaccugcuuuccugucucuaggauuauaggugagugccgcuccuccugguccucuacagugcuggggacugacccugccuugcgcaugguaggcagugaucaccaacggagccacaucuccauaucuaaguuuuuguuccauuaguugaauauaauuucaugcuuauuggccacuuaaaugccuugccaguauucuuugccugcuuucuuuuagaauauaugcuuuuugucuaauuucuuccuuuagucaaaaaauaugaauugaguaccuuaugcacacuaggaccagccacuguucaggucaacagaauggcacaauccucguauuaaggagcuugugucugaauguagugaggcauaaaguguaaauugagagugguacuagggcuguaaagcaaauaggaaugacugguguggggcgcugugguaaauaugggcaggccagggugggccgaucuucacuggcauuagguggagaucugaggaagacugccacauacacucugcuggcacccagcacagcaugacagacaggcagagggaacugagugccgaggccugagguaggcugcuuucacuagugacugucuauaguuaggagauggagaguuugagagguagcaagaagcggaaacagaccaccgugagccagauggggaaccacuugggggaaggcuuggaguggugaggugccaugacugucccacuauuugaaaagaauguaagcaguaaugagugaagacuagacucuaggccacagugaugcagucuggaugaucaguuagcagccucacgcaggugccacaggaggcgugcaugauagaugaggaugcuggggauauugugagcacagccaggaugcugaugcguugaguguggguugagaggaagaguuaggaguugacaguuggcagugcuccccccacuccccggggcagggaggcagugagaguggcugcgguggugauacccgagugacucagagaccuuucugugugaugaaguguggguaguauccuuucacuucggcagaagaggcuuuucccugauggcugcuaaucuugcuaguguuuugcuguucagaaauguaauguguuuauuuuguggugauagucuuacaguuuuugguuuuaccgucaugucugaaaaaauucuaaaagcaauuucucuugcauuuuuuuuuuuuuucuuuuugguuuuucgagacaggguuucccuguguagcccuggcuguccuggaacucacucuguagaccaggcuggccucgaacucagaaauucgccugccucugccucccgagugcugggaugaaaggcgugugccaccaccgcccggcucccuugcuuuuuaaaaguauucuuaggauuuuguauuugcauuuaauuugggugaaguuaguuuucaugcaugcuaugaaauaacauauuaaacuuuagguuuucucaaauaauuaucuuguuauucuagcaucauuaaagaauuugaucucugcucuaagaaauuauuauaucauuuccccagaguugggaaagaguguuuguggcaggucuaucaagagguaucuugaccugaguuaagguuuaacaaccuccuggcuuugccuuugguugaugauagagugaccacaaugucucagucaaccagguuguaagcaucucucuccucagugaccuccauucccucaaaaauaauuugccuuacaaaaugcuuuuagauggcucagugggcgaaagcucgugugccccacaaacugaugaccucaguucaacaaccaagaggcgcugcacaggggaggggccgacuccucagagcugauuuuggaccuccacacauggaccugcaucuacaugugcaugcucacacaguaauaaugucuuaaaaaagaaauuccaggacagccagggcuacacugagaaacccugucucgaaaaacaacaacaacaaaaaaaaacacacacaaaaaaauuggcuuuuuuucaguuugcuuuagugauuuucaagcaucauuuuuguuuuguuccagggauggggaccgaauccaagguuguaaacauuugcuaggcaagcucaccaccaccgagcucauucgcuauccacugcgacuucuguuuauuuguuuguucaagacagguuucucuguguagcccuggcuagccuggaacucacucuguagaccaggcuggucuugaacucauagagauguaccuuccucugccuucugagugcugggauugaagaugugugccaccaccaccaccuggccacugugaucuacuuuaaccacauguccugcuaucagauacauuuugcuguugcuucacugugucaccugauaauugcucugagaugauuaacuccacuuugcuuuagcaauauaaaacgagugucguauucuccuugcuguucauguaauaaugguauggauuccaaagcuucaguguguguguguguguguguguguguguguguguguguguguguguauguguguguaugugugugugugugacuguuacagucucagugcuguaguccuuuucugauacguggauaauuuagaggugacgaaaggauuuaauuuacuggauuuuguucuuuucagcaagaacugggaguuguucuuggugucgacugaaucuuguaguugguuagagaaaguuagagaugcaaaccuuagcagcccauuaccuuagaauaccagcaagguggguuggaccuaagucgucauguuuccuuugcuuuuuuucuagagagggaaauacgaaguuccuaaguggcucucucccaguagcauucugcuucuccagcagauguugcagguaaaguuugcuauuuauuuuuaaguuauagaagcucauaguaaugguuugauuuaacuuuuaauaucuguggaacugcugcauuuauuguuuccugugagcuuaagaaggauuccauucaucauguaucuuguucucucugggaaccucuacuaguuauccuguaagcacaguugcucuagacuuugccugucuuagacgaugugcccuuuucacauuuauuuauuuaugcaugcauucauucauuccuucauccacucagcagucauucuguuuucucuagcucuugcauguuaggcauguggaagccaccgagcaaaugcuuggaugaacugauguguaaucuauggccugugaucuaguagagugcuuuucaaacgucaccaugugucagaguggccagguggacuuguuagugggccccauucuauuugucugaucugacagaucuggaacaggaccaagcauuugcauuuccaaaaggcuccugaauggcgcugaugcugaucugauguuuuggggccacuuugaaaaugacucugaugggaugaaggugaaagccuagguauucauccuauuaaucagucaguaguagacuuaucuccuaaacuauugggaucuauaaaaagaaaggggcaugucugagccgaccgcacugcucuguggaauauuuuagauacagugauuggaaaugcuuggaaaaugaguaucuuauuagugaaucauuuuacucacuguguuaccugaaugucuuccaguuuuccaaugauuaagccaucuuuaccuuuaauuuaaaauguaccucaggcucacccaccuugauuaaguagaaccagaccaccaaaucuccauagugagauugaaaaaugccuuggccuuucuucuggaccccagacuuaaucuuuguugauuaauuuuucucuccucacaucugaacaucacaaauggaagcgaaaggugugcuuuucagcuuguucuaugugauugugagugaaucggaaguagagauugcauauucagugugaaugcccugcguugcgcuuacuugaauacuaaacuggugaaucuuucccaugaauagguuuuccagcaaaaagacuauuacaucauacaauagauugacugaacuucaugaauaauguccauaccaaugaaguucguguuuguuaaacauuuaucuuguaggccuguguugguugcuauaguuuucuugccucaauugccuuuuuaaaagaauucauuccaaggccauuuuaaggucuuugacagcguuauuugugaugauaacauuuacaucuauucuggugccuuuugaguuuucaggagaaagguguuauagucucuguuugaaauguacuuuaauggccacuagguggacccaaagaaacggauuucuaugagaaaucuccugaaccaucccugggucaugcaagauuacagcugucccguggaguggcaaagcaagacuccuguaaguaugcugaaacuacccaguaguuuguuuucagaaguuugugugacuucagaaccugcaugcucuaaaguaugaaagaaaacguauuuugcauacuuaaccuggacugaugguggagacuuagcccaauccuauccugccugucagucagucucugggccagugaguggucgcucagccuguacugcacacaaaucaccugggaccuucagaagcagacccugcugggaauagcgacgccugucucuaaguccagcacuuacugccgucucccauucuacaguacucagugagcacauucagaagcucccggguacagucaggguuguggacagugcucuggaguugcugcugcugcugcuguuguuuugagaccggguuucucuguguaucagugucuguccuggaacucauucugagauccaggcuggccuugaacuaagaacucuaccugcaucugccucugcuucccaggguuaggauuaaaggccugugccagcaaggccugagugcuguggagucuugaggaaguuauuuaacucugcuuggccuguuuauucauuuguagaaauagguugaacuuguucugcuuuccagaguuaugaaguuacauuaguuuucagacaucuaagccugaggaauguuuugcacccuuaauauauauuuauuagcucauuaaaaaguaacaguaaaaguugaguguagugacacaugccuguaaucccagcacuugagucaggaggaucgcagguuugaggacagcaggaucuauacacugagacuaucucuaaagaaaaaacaaucaagaaaucuguuacacauuaugaauacauauuuucaugaagaaaaaucauuuaaaaauaauuugucaaaggaguggcguguugaugacuuuccgagcuucggcgagccugguauaacaggggaugucugugucgucuuugguuucugcacuuagaaaaugcagccuuacccagacagagggaaaagggcaaguaucuuaguaaccugucagguaguuugugaugauuccuuaaugcuugguuguuucuuuuuucuuuucuuuuuaaaaaaaucuuuguuuuaguuuauguguguggaugccuguacccugugaccaaagaggacagaaggggacguggggucuccuggaacuggaguuggagacgguugugaaccaccauguggguguugggaaccgaaccuugguccugaguuaugagaacagcaugucuagcccucaguuugguggguuuugaagguggaguuuggagucacauuguugaacacuguggauucucccauaaagcccaagagucaggucuuuucuucauguuccacucuguacuggucauguggaaaauauuugugcacugaguugugcagguuuuccaaugcugacacauuuuuuugacacaaauaccaucaguuaauuuacuuuguugagcuuugacaaauuauuucucaaauacccaaauuuggauaaccaguaaggaaugauauuccaugacuauagauucuuugcucagacagcaauggcuuugcauccgacacuuccgucuuauauuaaacacacacaugcacaauguugacauguaauagaauaauucuuuucuuugcuucaccaaggguuuaauugaaaccgacauaucaggggaaucgugaguccaugcuuucuacagaagccccguuucacucauugcuguugugcuauagcucaaaugucagcacuggggaacugugagaaacacacguguuauaaaaauggugugagcgccucaggacacugcagaccacacucuaaagaguggucuacuauacaugacauucuccucauugcucucacaggcacaugugguacacacacacaugugcacacaccauauacacccuguacacacacuugcacacaugcagcuuaacauauguaguuagaaacggcaagagugucuuuauaggcuuuucagguaauuaagacuguucuccacuucugcaauggcaugugucuugccacauggauuggaauagcuuggaggugugucucagacauguuacauguagacaaaugguaaguuugucucuggaauaaucacaccagugaagagaaauacucaguagccagcuagucuuagaaaaguugacuuuugcuucaggccgcuacucuuguccccauguuagggccauacaggcuggacuaaccuccucucccccauuucccugugaugguuaacucucaguguaucucuuauccauauucuccuugguucuccaugauuuaauggauaucuauugaguaaaugcaaccuaaucuagugauuacuaaugccagagccuaagaaccaugugaauaucugagcaggucagcagaaagaacagggaaacugaugugccccuugugagguggagauugggggugcaaaugccuguguucaaccauugggggucaucauuucuccacguguagaaggcuucuaucuuuugagccaugauucuaauagaauagaauacacuacuauucauguuagaauagacaccaaaaugaaguaugugucucauuguuuguucuugagacacagucucauguagcccaggcuggccucagacuuguguagcuaaagcuggcauagaaccucagguccuccuaacucugcuccuaaggacauucucccauuuaaacaaacaucagaggguuuguguguuugcuuucuguucuuuguuuuuaaauuugggacauaguauaaaguaagauguaauuuucaguguuccuuuauucacaucuuaauauaacugcuggucagcugugguggcacagaucugugaucugagcuccuugggaggcugggcaggaggaggacuaauuugaagcugaucuugugucuugggaaaaagacaggaaaacagugaacugauaaucuggaucuggggcaucguugucauccuagcucuugggaaaccaaagcaagaggacugccaugaauugaggcagccugggcuaccgaguaguuccaggcuagcuauggcuacagugugagacacugucuuaacuaaacuauugcucaaugguuaagagcacauauuuacuauucuuggagagaacccagguuugcaucccagcacccauagcaagugguggcuuacaaccuucuguaacuacagcuccagccagggaucuaauaccaccggccuccucaggccccaagacacacagacacacacacacacacacagacacacauagacacacacacacacacacauagacacacacagacacacacacagacacacacacagacacacacacacacccaccaccggccuccucaggccccaagacacacagacacacagacacacacacacacacacaccaccggccuccucaggccccaagacacacagacacacuagacacacacacacagacacacauagacacacacacagacacacauagacacacacacagacacacacacacacacacacacacacacacacacacacaccaccggccuccucaggccccaagacacacacacacacaugugcagagcaauacaaauagaccuucaaaauuugcuaguauuuguugcauucuacauuagcgugcuacuauggaaugauauggguagaagucuuuggguaguacuuuucgguaaaguguuguucuguagccucuguuaacucaucccacccuuguacuagcucucugaacgggggcuauuauugcccucuuuugcagauggagcuaaaggauguacauuuucaugaaguaacacaguugaguggccaguaugcauagaguagagaaccagaauuugaauccagacaggggcugcggccuggaaaggaccugagaggucaguugauuuaagugcgggccuguaucaugcccgacugccacauuccuggucuggugucuccugaacgaaccguagacagguagcaucauggcgugguagaaaagucugagccaggaaucaaaaugccagucuuggcugggguuggggcugggguuggggcugggguuggggcugggguggggcugggguggggcugggguggggcagauguacuucauuucaucaucccuaaucagcacuuugguuaguguccugucuguagagucgggguaccuuucuccaucagauuacucaucgcucuccugccucacagagcuguugugggugaaaugaguuguaaacagaggaggucuaaggauuguugucgccuuuugaaggauuugcuuuuuucuuucaguguguguuaucaaguaugaacuauaaaaauaaugcugauuuacuuggauauuuaaggcauagaugcuguaauaauucuacgcaugaucuccucgugcuauuuucaugcacaggucuaguacccuaguauuguaucaaauagaaguuauauucaguuucauuuucugcccuagugaacaggaaauguagcaggcacggauaauccaaaauaauuggcuaccuuuggacaugcauuuguguccuuaaccuaaccugagugcgcaagcugagaauucagagcaccaucaaacugccgagccccucugcgggacucgguuugaaaugagagacuuucucagacccuugucacccuguccuuuuuagucuagcucaggaguccaacagaacgcacagugccuccuucgugccuguccugcuuuuccugugauagcauguguagaugcacagggcacggcggcuggaggacaggcucuugucuguuuccuuuaaaaacguggggcuuuuguuguguuuugcauuuauuuauuuuugugugugugugugugugugugagagagagagagagagagagagagagagagagagagagagagagagaaacaguauguaugagagagaaagagacagacagagagaauguguagggcagagaagucagcucuuuccuucuauccugugguguucacaaucccaggccauggaguuugguggaaggagucuuuacuuccuaugccauauugccagaccugguuuuuuuuuuuuuuuguuuuuguuuuuguuuuuguuuuuuccccuuucuuuuucucauuuaaaaauagggucucccaaagcgggagagauggcuuagcauuugagggcacuuacugcuguugcagaggacuggguucaguguccagcacacacauggugacucacggccaucuguaacuccaguuccaggguggucugacacucuucugaacucuuuggacuccaggacuuugguguugcacauacacacacucaggcacacucaggcacagacaguuaaaguccuguguagccuguguagccuugaguuugcugcauagcccagucuggccucgaacucuugauccccuuuucuuaacuccuugaguauuagaauuauggcuggcaucauaccuggccgagaaguauuuccugcuuagggcguagcuuggguauggaaggaacucaguauuuuucuucuuccuugagcagugacaucaauaggaagaggcccaacuggguguugaaauguuuggggcuuuugagguugaggucauccuaaugagguaucuguacucugagagucacaaaagcuaaagcaacacauugaauauaugucuuagcacucuggaacucuccagugccacuaauauaaaccugugugggcuguccuuuuuuuuuuuuuuuuaaaugacccuugaguuugugcuugucccagccaauagcguaaguuugucuugcucugcugaguuuguucuggaauggagugccaugcacuggguggcugggaggcucaggcacagccugccaggugucuggucccugucaucucaccuuccaucucccaacacucagguugcucauuaggggucagcguccagucuuaaaggaacacagacacuggaccacagaaagguagucgucuuccuguuucucuccguucaugaaggugggauaaguuucuugggagcucacugucacuuguguguggcacaugagggugguggucgcgauaaugcucugccuugugcaaggcaaacgucuccuucaugcugugucugauuccagguugcucauuuggaggggaagaguggcuguaacaagaauauuuaaauuucugaaagauaucaaguuaaagaggaacuagaauuguguguauuaguaaaaauaguuaaccauuuguugagggccuugucuguuuuagcuauacuugagcuuuccugaguuacauguguggcaaggcauguaccaugucuuuuacagaugguaaaacaggcucagggagguguacuggaauauucaaggucaaauggguauaaagugaugucacaaugaaaaccaagaucucucuaaucucaaagccuguuaucugucaggcugugcugacucaguagugagagaucccauggagacacucuuaggugacagagaggccgagcaccccagcugucccacuucccuucagaggagagcugggagcagaaaguagaccguucuguucaggagcuguuguggggagaauggaauauggcuuacuuuggaagccauauuccucaugauugucuucacacaucaucuucugaggguuuuccagcccagacaaagccacuccugucauuuuguucuuaaggacuugguaauugcccuuaggcaaauugaaauuuaaguugaguuucaguguguugacauuacggucugcuguaucuucaaugugacuggcucugcuguguuugucacacacuaucacauggccuacugggauugugcagaccuaaaccugcccaaagugcaacacgacaagucaggucacccuuugaccacuuaggaaaaugcugacuucuauacguggcuacugucuugucccuuugcugcacagaagcacugacugucagucaggggacggcaucugagagccagacacgaacucccuuccuugaaaugguggucggccucugauggcugggaguagcgaggaggcugcugcgcugauaacguagcucacguggguucggggccagcacugcaaaaagaaaagagucauaggaauguuaauguguagccaaaaguuugacaagcucgugauuaugcugauuuuaacuuuuagaagagcacauaugcaaacaguguaugaaauuguguuuuguaguugacucaccucgaugaggauugcgugacagagcuuucuguacaucaccgcagcagcaggcagacaauggaggauuuaauuucgucgguaagaaaugcagcaugaacugaaacauggugacuuuuguuucaucguccuucuguuuuguuugugauugacagugauguagcauuuuuaggaccaugggccaucaugaauguaacuguggcaguguauauucguguaugagacaguucuuuccuugcaucuucuggaugauguucucuuaaaaccuucgauggcuuguuuauuugcuuguucuguguguaugugugugggugggugagcacgugcugcgggaaguguguagagcucagaggacagcguguggaaguugguucucucuuuuuacucaggaggucagccugaugacgaaugccuguacccccugagcucucucagcauuccucgauguccucuuuaaauaagaacacucugcgcuuuggacauugguuagagagaugugauguuuacacaguugagaaucagagcaaguuaauccacagggaagugguagugcuuguugucaugguuuugaaguucucagacgcagaaaucugguucugcaguaaauaugaagaaggcaacauacuuacacaugcuuucacauacguccaaggguaggcauguagccagugguagaguacuugcaugguaugcuugaagcucuggguucuagcucuagcaccagaacaaaacaggaacaaaaagguuucuuuucaaacaaacaaggggcuuguauuguaguccggguaguaggcuccaaauaacaugcccuauacucucucuguuucugacuucuuugucuguuuuucugucugcauaucucucucucucucucucucucacacacacacacacacacacacacaccccacacacacaccccauacacacaccccacacacacacacauacgaacguaugcacgcacgaaaccuugauguaugcaucucucucucucucucucucucucucucucucacacacacacacacacacacacacacacacacacacacacacgaacacacacacacgaacacacgcacgcacgcacgaaaccuugauguaugccucagcuggccuuacccuggaguucacugucuaccuugaacugucuuccugcaucugccuuccuggcacugggaacacaggcaucugccacugcccagcucacaccauaguuuucuuuccuaaaacagcccuguggucugcuguucaucguccagcuuaugaagcucaugguuaggacaauauuggcacgauuucugauguuggauugcuuuugcuuuuucagguccuuuauauccacaugaaaccuguagucucccuagagaucacaacucugagucccaucucggguagcaagugaggcucauaccuccaugugcuccuguucaacacuuugucuuugucacccgugcuuuguauuuuuguuuguuuguuuguuuguuuugcauaguccaguuuagaaaucuuaacaguuuguuuugaaacagcuuuacugcuuugccaugagagcuuugcaaugugaagaaacucugagugccgccaugcagugguucugggccauggugacagaaugucaagaauuggaagcuaaugcagacugucuuaauguccccuuagucucaaacaguacaaauuugaaauuucuauuucagcaaccuaaaaauuuuugcaugcuuuuuugggagggggugggggauaaucuuuaauuaaaaauuacauuuaaugccaccuguaaucccagcccucagaaggcugaggcaggagagagaccgccucacacuggccagccccacagccgugggagcucacuccuauaauuucaacuugggaaguugaaaugaggaauuugaugcuaaucugggcaaaccugggcuacauucugagacucugucucaaagaaugaacaaaaaccagcuccuggucaccauguaggauuaaugcugcccuuggcucuagagaaguuucuuacugcagagggagggaggcagucaaugcagaaaccucuaacuggucagagugauggcgccgugugugaccccaaaugagccaucaccuucuccaaagcucagaacauguagaaacauggacagaaagaguguaugaguguaugagcccgaggauggggcugugcugugaaagaugucuuucuggccuuuguacucaugcccucacugcacaggaucggccggucaacguuucauugugggugggacgauuggcauuaaugguuucaggggaaggugccauuuucucggugccguagucacugauaaauuggccacacuccagcaauagccuucacccagugggccacacacagccagcagggugggaggagaaggcuuguugggaagagggguucaugggagugggcgugguaugagaggggcuuggggcugacaaaaacuaaaauucauuggguacauaugugaaauucucaaagaauaaagguaggguuacauagguuuuauauaauuauuuuucuuuagaaagguugagguucagaaaguucacauuuguucuaaauacuuuccaguuugagauagaagccagcucuguauagccgaggcuggccuugaacuuucaauccugcuucagccuucuuaguacuggaaucacagugucaccaugcccagucuuuacuuuccaauuaauuaauuaacuaauuaauuaaauuugguuuuuuuugagacaagguuuuucucuguagcccuggcugucuuggcugucuuggaacuuacucuauagaccagacugcccuuaaacucagagaucugccugccucugcuuccugagugcugcgacuaauggcauacagggcuuuuaccuuccaguuuaaagaucuuuggugauccaccaagguuguuauaauugcuaaggaaguuuggagcucugccuuuguuuuggggcuaccuugaccaaucaguucucgugccuuaugcuacugugguaccauugaucuuugugacaagacagaagaaacacugacacacagacggaggcucugcaaacacuccuaaacuuuucccuugucugucugcuugcuuauuuugagacaagauuuugcucuauaacccaggcuggucuggaauugccuguaaaguccaggcuggcuucguauuuccaccagcuuuccugccucagccuccugagcgcugggauuaaacauuugagucaccauacaugacuucuaaauuauuuuauugauaaauguuucuauggaguagucagauucccccuggcuuacagguuggcccaugucauuguuccuguccuggagucccagcaguggugccccgcuucuggcuuaucacugcccuccucuuccugcucugagugguucucccgagggccugugaagcuaacauuuaacuucgagaggauuguagcgcccugugugguggugcgcccuuuauuccuggcacucaggauuccaaugcaggcagaucucgugaguucacagccagcuugggcuacauagcaagugccaggacagccagagcugugcagagacccucucucaacaaaccggggaaguggucaguugucaagacagcucaguggguaaaggugcuuguugccaaggcugacaacccgacuucgagucuggaaccuacagaguagaaggaggcuguggacccuuuggcuuccguguguccauucccccacauaaacuuuuaaaaaguuaaaaguguuuauaguucucuagagagagaacuuuuuccuaacaggcaacccuaucagcaucagacauuugcuuucagaggagggagugacccaacaggugaggaugcaggggggaagccacugcauugcucucucuccccuagcuucccgggcccucaucgaaucggagggguacaaagggaccacagcccagaggguuuauaaguggauggcuuuugccaagggaaagaggaagcacaggcacguguagagaacacgcauaaacuguugugagguaauucuaccagggacauauggacguucuuaaagcugaauagaaagucuguucuaaaauaucuagagcacuauccucaaaucauucacagugcuuggauuagguuaguauagugacagccuccucuuuuauuuuggugguacugggggguugaacccaggaccucagguguccggaugagugcuguacagccugcuagcuaaugucuuucuuauccucugucucugucugucugucugucucucucucucucuuucucuuucuuucuuucuuucuuucuuucuuucuuucuuucuuucucucucucucucucucccucccucccugucugucugucugucuuucuuucuuuaaaagauuuauuuauuauuauauuuaaguacacuguagcugucuucagaugcaccagaucucauuacggauggucgugagccaucaugugguugcugggauuugaacucaggaccuuuggaagagcagucggugcucuuaaccacugagcuaugucuccagcccauucugugucuuucaaacaggguuuguuuguuuuuauaaauuuguuuucaaaagguggcagcacacgugacacgauggauguggaggaucuuuaguauaauuggggaaaaggaaggauuuaguucugcaguucuuucucugaagucuuuucugcccccugcuaugauguguacaauagucagaauuccacuguaauuaucacaacauacaguauuuuauucucuuucuagauugaaaggaccagcaugaaaauuucaacucauuuauuauaugugagccuauguaaaauauuaacugacaaaauaacaaaagcuaugcccuuugugccacgcccuucuugagagcacaucauggcauuaaauauuacuccauuauuaaaaguuagcgccuuuuuuuuuuuuuuuuuuuuuuuugguaaguacagaagcucguagucugaauuuacuuugagucuguaaguauuuucugaaaucucauuaaaacaauagaaaaggacuuuaaaaaaauuaaaagcuuucuaggacacauauauaaacaggagacaaauggacaucaagaaauuuuuuaaauuuaugaaauaggucgcagaggauaagaggaguugggagaaagccgacggccaccuguuugugagggaagagguaaugggggcaccgacucgcgcucuagaauuccgggaaagggucaguuagcaaggaagaaggacgagaacgggaaggcauggcaaucaaauacauaaugcaggaauggggaacuggguaaaaagaauaauauuuucagaacuaggggaagcuaguuaguucuuaaagaagauuaagguguguucauaaagaacuuuuuaagugcuagcccccagaacucgaaacucuccacagaaauaaaaaaaacucaguagaaauguuugaaaaugaaguuaaggugaaguuuucaaaaguaggaguaagaaacaaaagauacaaacugagagaagggguaagaaagcuguaucgugacauuuuaauuguaguaagagaaggcuaaacagugacauggucaggggaaccaucaaaggaaauggaccaggauuuagcauuguggaugaaaucagauacacaaaucaaugucuccucuagagggauuucagaaagcuggggaggaccacaaguuucagagacaaaaacuaaggccauauacaaaggcaugggagcuagacuguguguuuguauguuaguauguauauauguaugcaugcaugcauauauguguggguuauuuuuuuuuuuuugguuuuucgagacaggguuucucuguguagcccugguuguccuggaacucauucuguagaccaggcuggccucgaacucagaaauccacuugucucugccucccgagugcugggauuaaaggcgugugccaccaugcccggcacguguguauuuuuuaagacaagguuuguuuauguagccccggcuguccuagaacuugcucuguagaucaggguagcuucaaacucagagcucuccugccucugcuuccuaagugcugggcuuaaaagcguaugcuaccauccaaccugcguuagacuuuuaaaaauagcuaugcuagaaucaaaaggaauaguaucuuccaaacuauaaaaauuguuauugguuuguaauucuuuacuugaccaaaccagaaucagucauaaggacagaaugcugucauauaucagacaugcacaauuucaaaacauuuaucucaugucaacccucagaaaguuacuggaggaugguuucuacaagagugucaaucaagaaagaagacugcuuggguacauuguagcauggaggagaaaaaaggugcuaggcuggcagguggcacagggaaugccaaugggaaaugucucuagaagggaggagguggguuagccaauguauugagaauguugagaggcaagucuacuacaauuugugguagaauuagaaaaaugaggcacuuaaaaauuuaauuucagagccgggcgugguggcgcacgccuuucaucccagcacucgggaggcagaggcagguguauuucagaguucaaggccagccuggucuacaaagugaguuccaggacagccagggcuacacagagaaacccugucuugaaaaaccaaaaaaaaaaaaaaaaaaaaaaauuuuuuuuuuuaauuucaggaguggcaucguucuaaaacaucaaaaagaaaaauacaggaaucgagacucuuuauuaucuucuguuuuagugucuuuuuguuuuuaguucuugugugguuugguugcugggcuuguagccaaccaguguggcugauauuaagguauuaauccuggagguggugaugcugcucugaguaccucccuguccccgucuuagauacucuguguacuuccccgauaucuuauuguuacuuuuguggugcuggggauggaacucagagucuugcaagugcuaggcaaguacucuuaucauugagccacuuccucagcccugcgucucauaaauuguuaaacaguuaacuagugauguuauaaacauucauucauucauacauacauacauacauacauacauacacacacacacacacacacacacacacacacacacacacacacacacacacacagucuagcucccaugccucuguauauggccauaguuuuugccucugaaacauuugugguccuccucagcucucugaaauuccucuagaaggcccgaaugccuuauuggccaccucuuggucucuauucugacuuguuguauugggguaacaauacaguauuuaaaaccuaccucuuucuaguugugaaugcuacuuauaaacucauaaugauguaaauuugauuuagcugcaaaugauaaaauuaccagaggaggaggagaugagaagauguauguaggaaagauguuguaauagaucaaauuuuuuacuucccauacuaagaguucuaugggggaauaucugaggauaagacaacuugaacuacaaaggaaauuagcuuagaaauauucaauggaaacaaaauagcuuuuagguguuuagaaguucuuucugugcagggcaguuuuaggugugcaggugugauguggagaaauguuaagugucacgucugaagcuguugacugaauucugaaugccuguggcacugaagaaaauaauuuaaaguagaguacuguuccuucacacacaugaguguguugacugccugguuuccuuuucccucaguggcaguacgaucaccucacagccaccuaccuucugcuucuagccaagaaggcccgggggaagccggcucgucuacagcuccuguccuucucuuguggaaccgccagcaccacuccaaaggcaaguuguagaagcccuguguggccaccugcucaccuggccugcagccuuagucacgagcagacccaccaccgccaguaugaguaagccagaugcagaugcaagaaagggugugucuucugcagugcugggauugaaacccgggcugugcacaugcaagccaaguacuugaccacugugcucuuuccaggggguuuaaacaucguggugagaaaagugggaguucugaacuugauauggcauuuaaacaacccuuccucugcccccuuucuccuuuuccuuuuuuguccuuuuauagcacaucgugcuuauugggaaauagauuaacuaaaagaaaguaauagaauuuacuuagaaaccugcuagcuacagaugauagaauuccucuuuuuaaaagauuugucuacuuacuuauuuuaauguauaugaguguuuuguuugcauacguguguguguguguaccacugugcguugcuuggugcuggaagaggccacaagaggaucucagauccacuggaaauggaguuaaagauaguugucagccacuuucugggugcugggaauugaauccagguccuuugcaagagaagccaguguuuuuauccacugaaccaucucuuugacccuggauaaaguuaccucuucaaugugucuuuccugucucugcucugaguacuugacagggcuuuagaagggagucaggccugugaauacaugauguucugcauuuuauaugacagggacuacuugaauaugaacacuuucaugcuuaccucacuguugagauuuagguuucugcaguugucaaagcucgagcaacguaaacucuacuagaguagguuuuaagcaaauugugauucuuuuacguguuuccucugucgcgacuguugauagugauggaguuucuguauuguaaacaacaugucguuccucuuaggcuccuaagagauuuguuuucucuuuaauucucucuuccauacuugaaaucuauuuuauaucacuuguuuauuuguuugucugacuuauuuauuuuauguguaugaguacacugcagguguuuucagacacaccagaagaggguuuguuugucugugugcgugugucucaugcuugugugugugcacucgugccacagcaugcaggugcucagaggagagcuuuuaacaacugauugucacaggggguugaguuuauguucuuaggcuggcaccuuuccccacuaagcuauuucucuggagccccucccugcaugcccacucuugcuuaaaaucuaacggacaguuguuggaaggcugaagcaggagaauuacuguguucugaagccagcaugggcuacauauaugaauucaggccagccuguggguacggaaugagacccuaucuguaaaacaaacugcuugaggacuuuguuaggugggugugggaugcuggaauauagucuucgcucaguuuaauucagacugcaguuuaaugacuccaguguuaggaaacauacaguaggguugcagcaguugcucagcgguaguggguucaguuagcaugcaugccugaggcccuagguuugaucccuaguaucacagagaacaaaaggaaaaaaucagaaaggaaaauuuauuuuugcuauccucagaaagccacaauugaccuucuuuauauuuauuugauauaauccaaauggcccuaaauuaagcccccuuuuuaagaucucaaaacuuuuuaaauauguuaaagccauugccuucauggucucuaguuuguuuuaauuccuccuuuagaacuauuucauggccugucaguuaugagcugugggucagguggauguuaggguccugacagaccuuguccaccuccugucuuuccucccuucuugauauuuugaccaaacucuggaguaagagugucaggcaguugaccacuguguaagucuguggagugagguacucucaccuccaggcuguaggcugugaaggcuuggagaguucuguuaggcugcugagugccccgugcucuuccuguauguggagugaaucagcccaucaccuuucuggaugcuuuaaagggucaaauccuuuuaacucuagauucauuuggguccaggaggacauaagaauaugagcuuuguuucuggguaccugcaggaaggaaugauuuaccucuccaucgaauagugacuucagccagauacauucaguucaggucccuggugcgcuggccugagccuuggguuuucuugcuuuugccuuuacauggucucagugaguggcuucuuugauacauaaagaauccaugugggaagaucugagaagauacaccugacuuccauucacuacuuaguaaacauuuaccuaaccauuguauuauuugggcagucauguuacugaaccaauuuuuauagcaaauagacauuuuagugaccagaaaauaagcagaaaucaaauuuugaguuccuuuuugcuguuugugcuaauuagugaacuugagcaggcaguauaguuucuuugcauucugauaggauggccucuuuuccugugguuuuguuuuuaagagaauuaguaauucugacuuaccaaucaauugauggugcuuucauagagauaauuauuaaagucugagucaggaaucacugaagaccacacaguugugagcaguaguguugccaggcaccguggccuuggagagcagguuuaucugaguugguacuugcucuuggaauagucgcgcugagggaaaacacagacacacaaggacucuguaccucaguggucgaggugaggacuuugggaaauaggagugaccaccauugggagauucaaacuggaucagcaguugagucugaguuuagaaaaauggaaaagagggaguugucaaauuagaaagagaauuccuguauagaauuguuuagucaagucaggugugucggcacacaccuuuaaucccagcacuugagagacagaggaguuugaagccagucuuaucuacagagugagcuccaggacauccagggcuacacagagaaacccugucucaaaauacaaaaacaaacaaccaacaagaagacucauucagucagggacgcuguguggcaguuuugccugcuguagagucaucaccgccauccuuugcacaacacugaacuucugccgaccugcccuagacuuagcaucaguguucuucucagccuggcagucuacguaugcagugaguucucacugauaguacucggcagccccggagaacucucaggguacgugagaggguaggaagguucccuguuugaggaauauagaucugaggagauuuggccuugaacucaauuagcuguaagucuggguaaagggguggauguagguguuaggaauugagugguacuccacagccucagccuuuaggcugucuaacauacuuuuaguuuguacaggggaaggaugaaggaaaguaagguguucuguugggaguguuagcagaaggcccacggggccuguuuaugggcaaaguauuaccauagagcccaaguguccuauuuauggguaaucuuucauaaagcuaacuuacuccuggccaaaaugaugagcuuuuaaaauuuacuuguacugugugcuuuuaauguuuucuuuuuuaauuaacacccucuuagccucuauaggcaccauuuaugcauggggcacauagaccuguaugcagacaaaauacucuuaaacauaaaauaaaaauuaaacaaauaaaguuuugauugagauugcauaauguaugaguggggguauauauccaugccauggcaggguuuggaggucagaggacagcuugguggagugaguucuuuccuuccaccuccaugaguucuggagaucaaacucaggucaccaggacugcagggcaagcgcuuuuaccuacugagcuacaugcuggcuccugguaggugcuccucagugucagagguuauguccuuuccagcuucugcuuuggugagauuauacuugugaauuugcaaacgaggugucuaauauugcuguguaauagugacaagcuaagucagucgcauuccauauaaccucuagcuugucucugugucugcuuccagacuuucucccugugcuugggauaugcugcuguaaaauuggaauccccauguuguuauugcuaacuucuuuugccuuuuugaauuaauagucaaagaaucugagccuggaagauaugagcacaagugaugauaacuguguggcuggauugauagacuaugaauugugugaagauaaauuauuagcucccaagacgccacagguggguaguuuuauuacuacuuaaagcagaaugcaugucuuaauuauaaacacaucuagcccaacaggaaaucaggucugugcuuguaaauuuauuuacucucuaagccacugaagacauuaaugagagauuauuggaauauuaaugagggggaagucagugauuuccaaguuaagaaaaccaagauuccauucuggagcacuucacugccucugcccucuuugaugaacuggaauuugccuguaguuaaauaguugaaauucgcccuuagaguguuuagcucuguguuuaacaguauagagccaccagaaauugugacacaguaauucuguugcccucucaagggucucuuguguccuucugugaacgccuuuccucuuaacucagggcagcggcagcgaugucuccuccucuagcguucuugucugaagccgacuucacguuuguuguuggacuucucagguguguggcucagaguuuccaccaguuuuuuuuuuuugaaugugagguuuuuucucauuauaaguuuugucuuuauucuguuuucuuucuguuccucggaguaauuuugacccaccuguuuccagugugcugauucccuuucuagugguuccugacaaugcugugaauuauucuaauaagucagucacccccuccccccuagugugugugugugugugugugugugugugugugcgcgcgcgcgugugugugugugugugugugugugugcgcgugugugcgcugugcacaugcagcacacccccaugugugucugcccuccccacggcagggccucgccaucacuguaguguagugccgguuccccuggaacauacaguauaguucucagacagcucccucaugccucuucuauaccacugugcacaaguacuuuuuaaaauaucacuauacuuuucaauuuagaauuucuggguaguucauguaauuuuaucucuguugauucuacgguguugcccuuauacuucaguucucuagaaccuagcaucuuauuuguuaaucccaacuuguuuaucuugaguugaacugaacucuugaguugagaaaaauuuggcaggauauucuguugucuuguucuuauagucugaucucaaacacuaacauauauacucuucauuugauaauuuugauagcugauauuuuucuggucugauuuugagucuuuauuuuuauuuaguaggaacacacacaggcaugcgugugugugugugugacagagagagacacggagacagacagacagacagacacacacacacacacaggucuacauuggguguacuucucuauuauucuccaucucauuuccugagacaaggaucucucguugaacccagagcucagcaguuagcuagaguggcuggcuacggugcuuuagggaucugccuguguuagugccuuccccaggguuauagacgaccaucacacccacaccagcuuuuacauggguguuaggggccagaguacaggcccucaugcauguacaaaagcuauuuuucuaacugagccauccccccagcuccuguuagaauuuuuguuuguuuguuuguuuuuuaagacaggguuucucuguguagcccuggcuguccuggaacucacucuguagaccaggcuggccuagaacucagcaauccaccuaccucugucuccugagugcuggguuaaaggugugugccaccaccaucugcaaagaguauucuaauaccuuuauuuuuuuuuuuuuuggucccaaucacugagaaaauguuuauuuuugguacauauuagaguuaaaccaugacaauguagguauuaagaaacaugacauaggcuguguguggucauucccagcauugucugggauccugaguguguuuaaacacccauucugaaauggggaaaucccugcucguagaaaagacagaugaucuaccugugccgaggagaacugaagacacugucaggcauccuggugugccagcaauguccucuugguggccuugaauuuuaauaagaacaguacaaguaauuugcugauuauuaagguauauuguaaagaaauaggcuuuucuccuuuaucuuggaccuuuuuuccucuagguuaccaaacacuuggcagaaucaaaucacgcagcaucuaaaucaccagcgccagggguacgcagagcaguggcaaauaaauuaauggacaaagaaaaugugugcacucccaagucuucugugaagaaugaagagcaguuuguauuuucugagccgaagauuccaguuaguaagaaccaguauaagagagaaauacccgccucaccaacccguuucccaacaccugcaaaagguauuugcuaggaaauaagcagagauuuaaagguucaaguguaauucuuacuguuauaaauaauacgcuggcuuuuggaaauauguagccuuguuggcuucaggggugggucagcugccuuuaucucagauucuugaauuaguggaaauggagauaauacuaaacuuguaauucacaguggugcucuuucuuucuuuuccacaucuaaagauuuauuuuaggugugugugugugugugugugugugugugugugucccaaaggagucuugcagagagaggaaggcgccccuggagacggaguuacagguaggugucagccaccaaugugggugcugggaaccagacucuggcccucucuggaagcacagccagcacucuuagcugcugcgccaucucuccagccccucugucacauuugugugacugagucguugcaguaggauagcaacuuagagugugccauguuuccauguaggaauggagacuuagaggaguggggggcuuugccgaggucuugcguccaggcucagccuacuucacccgcacugggacucacucaggcugggguuucugcugagcucuucuuacucucugguucuccauccuggucaucuaucgggucugcccugccccucaguauccuggaguccagaaggcaggggagucugugacuccuucccagccuucaggugacaugucuuucucuucguguccucuuugguguaaugucuaccaguuuuuaaaccguuucuccaggacacuuaguguuaugguugcugucucaucuggacacauucugcugugucagugugaggccaguuugcugggaccgggucucuccacgacaaguaauccauguuugcagcggagugcugggacugaaggcgcgugacaccacugcccagcuuuuugcuuuuucagacucucucauguagcuuaggccagccguagacuugcugguauugugugagaaugacucugaacucucgauuuucuuacuuccaccucccaagugcuaggguuguagauguguaccuuuuugccugguggagagagguggggauagagauggggagaggagaggggaugagaacgacuauguaggccaggagucauccuugacuguauucuucaggagccaccuacuuuacugagacagaaaguuuuagugggcucugaaguuuauuuggcuaagcuggucaaacaucacacaucaggagcccaccuaucuccgccucugccucucuagugauggaauuacaaguucauucgaaaccacaccaggcuuuuuuucuuuucacuggggugcugaggaccuaagcucaaguuuucaguuuuucauagccggcaacugucuuaguuaggguuuccuugcugugaagagucaccgugaccgagguaacucuaauaaaggcaaacauuuaauugggcugccguacaggcuccaagggucaguccauugucaccauggagggaagcauggcagugugcagguaggauggcacaggagaagcugagaguucuagaucuuguuccaaaggaaaacaggagaagacuggcuuccacgcaguuaggaugagggucucagagcccacucccacagugacucacuuucucaagcaaggcaacacccacuccaacaaggucacaccuccuaauaguaccacucccuggaccaaacauauucaaaccaccacaccaauccagccauuucccaaaccucauucaggaauuaaaaagaacagacaaaacaacaacagaaaaccucuuggccagauaggguuuuuuauauacuuuuuuaaaaaauuauuauuauugauacuuuuaaagugauuguaaagguuuuggaauguggacaguuugaaguguaguuuacacagcuuauccuugcaacauuguguuagugaaaagcuugauauuaguagcuauuuuucuuuaaacacaagagcuuccacagagagcaaguggcugaagaugcaauuuguaguucccaugagugcaucuuacuuuuuuuugaugugaauauuaauuccugcaugugacuccuguguccaggcuguaguaguugucauaggacaacuauguaugguaacauguucuguuagaauacaaagauaaagacguuuuuaacaggcacuuuuaguuagcuuuuuuuuuuguuccugugaaacuagggagaauagaauuaauuaguuaaaaacaaaacaaaacccccacuuaaaaaauguuaucaauauuacuauuaaagggaauaaaacguguguuuugcuggggauugaacacaggacgcugggcaugcuaagcaagugcucuuccacucaguacagcugauggagcuguagagcacucagccacccugccagcaguauaaaacucagaccagaaaagacguuagucaguaguaaccggaccuguugaugcacgucuguugcggaccaugcuggagccuugucagcuacaugugguuuguguuuauuuuucuaauagcuagagcccagugccugagagaagccccgguuagaacaccagggaauuccgcaggagcagacacacuaacgacaggugucauuagccccgagaggagguaagugcugcucuuccgacuccauucuuuaguguaggccaugggauuacucuucucaucugggagaaaaaucagcagagggagccaagacagaugcugcuggaagcgggcaucucugugugaggacggccuggggcugagcauggcuacuggaacagcauggagucagaaacuaaugacuuccagcacagcgagccaggaaggcagggacccugccucuggcuaucacuuccuucuccaaggccacuuagguccauuucucugccaguggaguagaggugcaauagugaaauaguagaggugaaaauagacuauaaacugguuauuggaugcugcugcagguauuaucaguuuuuauguuguugauacugugguuggauaagaagauauucuuacuuguuggauguguacacagaaagaaguguuucagaauagaagaauuaugauaccuucuggcagcuaagcaaguauguaaauguacuuaaucuguguauugucuauauacacagagaaagccacugaccaaauauuagcaguuguuggcccuaggaggauaugugguauucugaugucucuauguuugauuuaaacaaaaaagugaaagggcugagccuuguggcauagcauaggccuggaucucaccuacuugggaggcugagguaggaccacaaguucaaggucagcccguguaacuuaaugaagauccuaccacaaaaauaaaaaguaaaaagaagcauugguagaaugcuuucccaguauaaaugaagaccuagguucaaucccugacaucucccaaaaauagaaacaaaaugaaaggaaagggagacugaugcagcaggcggaggcccugucuguuggagauggcuuuaguguccccuccccagggggauugaggugaccuggcuggcucaccugucuauggcccuugguguauggaggagcaggcacgggaacugugagggcagcagggcagugccauuagugcucuguugguuuuuaaggugccguucaauggacguggaucucaaccaggcacacauggaggauaccccgaaaaagaaaggaaccaauguguuugggagccuugagagaggacuggauaagguucucacugcgcucacaaggaacaagaagaagggcucugccagagauggaccaagaaagcgaaagguaggugggccagagucuguuacagauuucagaagcugacucuuaauaaguguaucuagcaccgcccuucucuguuugguuggcuaacccaggcagucuucuucccucagccugccaaaugcuggggucacaggcaugugcugccaugugucgugcuugucugucugggguguuuccaucccaccucccauguuccugugugugcacacaugcauguguguacauguguguacauguuacuguugauccaggggcuaacacagggugucagguuugcggaucugaggcccucagccccuugagaucguccuugguggggguaagaaggugcagagucaaugacagacuccagaagucaggucagaggcaggagcagacucguuuauugcaggauggagagugccuuuauaccuuucaccuguguccuauugguccaugacaucucguucccuguagcuggcaccaucugauuaguuguuccagucaugggcucuguuuccaggagucaggcagauuucacgguugccagauguagagguagcuguugugcgugcgugggccacuaugggccacuaugggccacuaugggauaggcugacugguuccuccuacacaugucaaaugcuuugaccuacuuagcugucuugccaguagauguuuuugcuuuuuaaaaacaacuauaucaaguaacguuacuguucuuuuuuuuuuuuuuuuuaucuuuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuuggcucuguaacuccuuccaugggugucuuguucccaaaucuaaggaggggcauaguguccacacuucagucuucauucuucuugaguuucauguguuuaacaaauuauaucuuauaucuuggguauccuagguuuggggcuaauauccacuuaucagugaauacauauugugugaguuucuuugugaauguguuaccucacucaggaugaugcccuccagguccauccauuuggcuaggaacuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaaguaaccauagguguguggguucauuucugggucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauuacuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuuccuuaauuucuuucuucagagauuugaaguuuuuaucauacagaucuuucacuuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcauuccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucauccagguuuuccaguuuuguugaguauagccuuuuguagaaggaucugaugguguuuuggauuucuucaggaucuguuguuaugucucccuuuucauuucugauuuuguuaauuaggauuuugucccuguguccuuuagugagucuagcuaaggguuuaucuaucuuguugauuuucucaaagaaccaacuccucguuugguuaauucuuugaauaguucuucuuguuucuacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaguuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcuuccuuuuauuuuuguuguuagaguuggcauucuguucuuguggcugucuucuuuuugguuuguugaaugauuacuuucuuaguuguucuagggcgugauuuccguccuuguauugcuucuuuucuguuauuauccuuugaagggcuggauucguggaaagauauugugugaauuugguuuugucguggaaacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggauguguuuuucuguuuuucuuuaaugauuucuaccuguuuggcuguguuuuccugcuuuucuuuaagggccuguaacucuuuagcagugcucuccuguaauucuuuaagugacuuaugaaaguccuucuugauguccuccaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaugucuuaggaucacguguggaaucuugugugggcccuugcgggugucaggcgacucagcuggcaagguagcccagggcucgaguggaguggaagggguuugugccccagaucaagcccggguagccugcuucccuauguacugcagucucaaguuccgcgcgauuggauuggggcaggcgcuguguuccacucaccggaggucuuagggucccguggggagucccgugugggcccuugcggguguugggcaagacucugcuggcaaggaagcccggggcucgagucgagcggaagggacuugugccccagaucaggcccggguagccugcuucccuauguaccgcagucucaaguuccgcgcgauuggauuggggcaggcgcuguguuccacucaccggaggucuuagggucccguggggagucccgugugggcccuugcggguguugggcaagacucugcuggcaaggaagcccagggcucgagucgagcggaagggacuugugccccagaucaggcccggguagccugcuucccuauguaccgcagucucaaguuccgcgcgauuggauuggggcaggcgcuguguuccacucaccggaggucuuagggucccguggggagucccgugugggcccuugcggguguugggcaagacucugcuggcaaggaagcccggggcuugaguccguuacuguucuuuuaaaagauuacuuauuaguucauuuaugcccuuuuugauaguuaauacuugcauauucuuauaugguagauuuuaagaaugcagagguggccuggagagauggcucagugguuaagaacauuuguugucuugcagaggaccugaguucaguucccagcaccuacaugggggcucauaaccacccacaauucuaguuucagaagaucuggugcccucuguagccucugcagacgcgaggcacacauauccugcacagaugugcaaacaaaacagucauacacauagcauaaaguaaaaaccuaaaaaauauuuucuuaaagagugcagagguaauuuagguauaguugcccucuucaaagaacauauaacuagaauucaaauaccuuaaucacacaaauugaucacaggacaacauagagguggggaacaugggauauauauggggaaggaagagcugccuucaggcuggagaccugagcguggcuggcacauuaccgauaccguuauagguucucaugaaauauuuacauucaagaaaaguaaauuugaauuuuuaaaaaacaguuguuuaaaaauaguucugcuuauggaggucagaggacagcuugcaggaaucuggcuucuccuucuacugugugguuucugaauagcaaacucuggucguccugcuugggaguaaacucuuacucauggagccaucuuugcuguccuaauuugaacuuugcauuguaguauguuuggggaagacagugaggcaggcuggaaggcccaaagccuggcuaagaggcucgcuucuuauuuaguaacucuguuacacuuuaaaauaguuaagcuguugauguagacaagauacuugguggggaaggagaaaacaaccuauuagaaguaccgggcgugguggcgcacgccuuuaaucccagcacucaggaggcagaggcagaggcaggcagauuucuggucuacaaagugaguuccaggacagccagggcuauacagagaaacccugucucgaauaaccaaaaaaaaaaaaaaaaaaaaagaagugucucaucacuguuuuaugucgugaugagauacuaugacgaaggcaacucuuauaaaagaaagcauuuaguugagucuugcuaacagagguuuagcccauuaucaucauggugggaagcauggcggcaggcaugguaggcgugguguuggagagguaguugugaucugcagucagcaggaagagagccucuggaacgugcaugugcuucugaaaccccaaagcccacccccagugacacacuuuccccagcaaagccacaccuccuaauccuccuaaucuuuugaaauagucccacuuucuggugacuaaucauucaaauacaugagcucauggggcuauucuuauucagaccagcagugacauucuguugguccucaucaggcuuguagcuauaucauaaugaaaacacaaauucaguccaacuuugaaaaucccaaagucuuucauagucuuaacauuacuuaaaguccaaaguuuaaagucucuucugauauuuacacuaaucucuucaacugugaaccucccagaacgcgggucacacacuuugaacauacaauaauacaaauguacauuaccauuccaauagcgugggaagggaacguagcaaguaaagucugggucagagcuaagaaaccagcaggcaauugccaaauucugcaucucuguaccuggugucaaaguucuucaggucucugacucccuuuagcucuggugacugcagcacucuucucucuugggcugguuccacacccuguuugcagcucuccuuggugucccacaacucugguggcaucuucaguaucuuggggucugcaaggcuucauuuacccuuauagcuucacacgguggccucuccuguccuccaugcaggaacaccucugacaugucugaccucagcagccuuccuuagcccuggaaggagauuucacacccuccuuuuuuauccuuguuucuaaagacacguauacacacacacacacaaugaaaauguaaguuggaaaauguaaaagauugguaagacaggaagaugaacauguacaguugacaugaggcuggugagaggcucaguggguaaagacgcuacuguggaagcucagcgagcugaguucaguguucaguccccggagcucacgggacggcaaagggggaacaacgucauauacagugcgauucacucaugcucacacauaugucaugucuacacacacgcacuuuuuauuugaaugggguuguuucugaugaagccagucucccuggcuuccccccugcugugcuaaugcggcuggcuggcuggcccuccuguguuuucuucaaguguucuuauuugaaaaggugcugucuuggguuuuugugucgcuguggaguucaaguccucaaccuuucucucucuaagcugcacuacaaugugacuacaacucgccuggugaaccccgaccagcuccugagcgaaaucauggcuauucuuccaaagaagaacguggacuucguacagaaaggguaagaagcucgccgacugccgccgaugcugucacucuuccccuuccuguuagcgcacugugguugucucucccuccugccccgcugagaaugcccugcaaccaccgcucuccagagggggcugugccagugccauugcucaugcugauuaucuuaugagcugagaacacucauggucaccacuuucaagguuagacuuccaucucagaauugggaaaccgggacuugcauuuguuguaagacaauucuccuguacauccuauaauuuucugcuuuauuuuuacuacuuaucaguugaauuauuaaccaguaagacacuuuggacaagugaaaauuuguagcucauaucuuugugacuaccucauggaguuuugguaaauuaaggaaguuauuuugacugagugucccugcugagaggcuccgugugugccucguggucugaggagcuaggucuccucggaacaugcaaauuguuucuaagaauuucaauaauuuaugucuuuaaaaugacuuaauuauuuuaauuuuaguuuuuauuuuacgugcauggcuguuuugccugcauguacauaugucuaucacauaugugugccuggugccuacagaggccaggagaggggcaucagaucccuaagagcuagagucacagaucacugugagcugcccuguuguugcugagaauugaaccuggguuacgagcaaucuuuucuccuagccauugagccgucuuuucagcccuacucauuuaucugaaacacagucuuacugcguagcccaggccagcauggaacucccgaucuggaccgccuccaccucgcaagcacugggauuacaaguaugcuaucauagcagcuucuaaaugccuuuauuacagcagcuguguacauacugacagcaugcagauaggaucauuuagauggaguucaauuucuuuguuuguuuagccuuuugagacaggaccuuguacuguaguccaggcuggccucaacuuuugauccuucugccucaguacccugaguucuagguuaucuuggguugaccuggaacucaguuaacuaauccaggauggccuuaaccuuucgauucuuaccucuaccucccggcucugggucgcuguggccguuagaguaagacuuuaggcaguccuuugugaagggaucauuacucaggcgcugcagguguguuaccuaugugaacucuugcuuuucucuuuucagcuucauuagaacauguuucucugacucacucuuagugcuuuuuacguguggugcuguuuccuuggucccagaagcucuggcugacucuccgaggcggggggaugauugcuccuuuggcuugugauucggcagcagaucacuagcugacauccacccaguguuuugaccuccugauguccugagccaccaaagggucuugacucuguucuguuccuuucuguuuguguuuaccuuguggcaaagcuuuccugugugaugugguagcucauucucuuugguaaggauggaucacuucccacagaacuacacugcuuucauuugccugugaagacccuucgccauaggguguuccuuaugacauuucucaggcugguuguuuauuucuaaggcuuuaugucccuucucccacccagucacuauaacuaaggaagacaaagaguaauguuuugugaaacuugauaauaagugauaaaaucaguugcaguugugcuuaguagcacauaaguuauugugaguuuaaggcuggacuaaacuauauaguaacuuccaggcuagucugggcuagauaagauacuauuucuuguuguuuggugguuuucuguuuguuuguuuuugagacaaucucagguagcuccgcugaccucaaggguccuaaguagcaguguggagcaggggaagaccuugaacugucucugucuuacaaguucuaggaguccauggcuacaagacccuaugccaaaaaacaaaccagaaauguccauacuucugagaaaugaugccuaaucauacgcguaaauaguuaagagaacuuaaaucuaaaauaaacucuaguguuucuuguggcuguuauguauugaagaucaguaagacauaacucauuuaaaauauaaaguaaauaauaauuuuauuuauaugaauucaauucaugccacuuucauagucaagguccuguuuugugucgcuagggaagggaaccuggcagcuuugauaugcaugcccuaugcuuccagcaggaccaucuccuggucuuuuuuugcuuuccuuucuacuguaaaguguuauaguaagcauaacuucuacacauguauuagaaaaaucugaaggcaagucuuccuagagaguuaauugcuucagcuguacguaagugaaaguuacacgucuuagagagaagaauauucuaaaguucccuuguuuucuuuuguugggaauguuguggaaauggccucguguuccuggacuacacauaaaauaccaggcugcccgggcaugcgugucgugugcagcugggagaggaggaaggcuuuccuguggucugagagccgagcacugugaucaccgcacucuuagggucaccacucagcacuguagcacagccaggccagugggaaacuauggggaguggauugcuagagcaaaagaaugccucacuuccccaccagcuccugggggucaggaacccccuugcaucauccagaacacuuauggcucccuaacugcuggugucuugugucuuacaguuacacucuaaagugucaaacgcagucugauuuuggcaaagugacaaugcaguuugaacuggaagugugccagcugcagagaccugacgugguaggcauccggagacagcggcugaagggugaugccuggguuuacaagagauuaguggaagauaucuugucuggcugcaagaugugaccgaugacaguguccgucugcccggaugaaugugggugugauguugcacacaggaagacugugagauugguuccauuugggggccauuggaucuauggaacuacaagcucauuuaaauagccaucuucaagaccaauguauuuuugcuuuuuaaacaaaaauuuuuacuuuguggcugaauccaaggcaacuguucugucauuaucaauuacucucuguuuuaaucaugggcuugguauguuaguaacuguuuuuauauucacuuccaucaggggaugccagcucuucacugugacucauuuugauguacaguuucuuucugaacuaaaaccauuugugaauauaucaagcucuuuuuuguaucugauuuugauccaaauaaaaccucgaauggcuuccugacuguuaaguagagacuauuuggaguguguuuuaucuguuaucaaauaugccuugggcagaaaaacagauaagaauucauuugcauaauuuuuuccugucucugauuuaaguaggauuuauugagaucguuaacuaagucacagcugugguuaccagaguuaaacaacacauuuaauauguggaauaaaagcguauugacuucaguaaguauguccagucaacaaugauaaguauccgaacugcaggccccaugaaauguuacuuuaugguaaucucuaagucucaacgauggccccagauuuguauuuuuauuucauuuuauuggucucuaaaggccagaacucaaguuacauuuguauggauuuuaccaauuaaacuaguuggagaaaaaaauagcacuguuucuggucagua

SEQ ID NO: 1874 - RNA, 175660 nt, Mus musculus
uguuuuccccggaaguaccuucuccucccuggaguccgcgcggacgcggcuuccuuaccucauuuguccucgccccuccccguuccucuacgcguuucgguuccugguuggugcuuccuggucgcggccgcggcagugaguaugugugugacggaccccgagcugucccgcggccgggggaccccuuccccucuccgccucgcccgcggagcuguggaacuaaugcgugccccucucuggccuuccccucccgguccuucggggcucagcgcagugcagcgcagcaaauggccucucagcuccgugccgccccacgcggcucagugaccgggcugggguuuggcggcccgagaccagggcuugggcaaggcugggcggcgauggccuugacgggcacgucuucucugucggcguuacuccaccgccucccacgguucacccguccuggggaggugggccagucccgaaauguggaggucucccuucgcugaggggaaccuggcccucaaggaugcguccagucgggggccaccuuaagcuggugcugucaaguagccgcuucacgaguagacacaaagaaucugggaacuaugccccauuccuuauauaaaaccaggguauccuaagaugauccucugcccccgcgcccgcacacccuaacagcagacaguuguagucaauuuuacuguggggaaaucgagguugggaguuggcagcccccaguuccagccaucacugauuagcugccgacgcucagaauaccuuuaggucgaguuuacugugauuucaagucucaggguugaaugaaggaaacuuuuuuuuuuuuuuuuuuuuuuuuuuuuugagacaggguuucucuguauagucuuggcuguccuggaacucacuuuguagaccaggcuggccucgaacucagaaauucgccuaccucugccuccagagugcugggauuaaaggggugagccaccacgcccggcagaaggaaacuuuuaagggccuuuuuuagcccauuggauaauuuuuuuccugagccuguuuuucccaaguauaaaaucacccuuaauuuaaugacuaggcucccuucaaaagcucucgacuugguguugaacauuuagaccuuaaauugcagcguguguauuuaagacgguguugugcuuuagggacaguuaauuauugucauuuagucagaggauggggaaugaucugagggaagaauuggaagugaaaauuguaugaaaacuacacgauuaacagugcaugggacaaauaggagaagcacuguuuccagcagaguccaaagaguaguuagaaguuaacaucaguaaauuuagcaugcauuucugacauggagacaagcccauuguuucucucuuugauggucccauuuggauuccuuaccuccuuugauuggaagugacaguaacauuugaaaaaggggcagacauuuuaacuuuuguaauugguuuuguuucugccuucacugaaucucaguagcacacugagauucuuguaaguuauaaaccuaaguggagaauaaacuauuagucauuuuauccauugacaacuguggauuuaaaaauucagcccucaaggugggguccagccccagguagaacacuggcuuagcauguccaggccccuggauauaguccccagcaccaucaaaugaauaagaccaaauuugggauuuaaaucuaccucagaugaccuauagcacccagaaagaagcucuaagcuggaaauacuuugaaagaaaauuaagagcaaagcgucuagaaugacuaguagguaaucuuuuaagggggaauauuggcuuuuaagucuugguaaauucuggaaaccuaauuaaccuuuguuaguuuaaagaaauucaaugacugucccccccccccaaaaaaaaaaaaccacagugagugguuuuauauucuuucuuuagauaagcuucuuuuccacuucugauauuuuagauuuuaaaaugugaucagucuucugaguugcugugcuuugauaacaucuuuuguuuauuuacucuuuggggauggguucuagggguuaagacaggaacuucugaccaaaugcuaggauuauugugugucccugugcccuaccacacagaacuuugauaaaguuuaaguaccaguuagguucuuaaauaguaaauuuguaaguuuaaaugucuacuacuccuuuuaauuaaaaugucuguuucagguuuguauucccuguggaaaguuaauguauaugucagauaaauguagguguuuagccaguacacauauagcaguauuuguagugaugauuagcuuagaucaggaacauguaaaucaugcuagccgaguucuuaaccaaguguccagccuuagggaggccuccuugugucuuuggaccuguuucuucaaauguuucuaaagggaguuuugugaaaacaauccagcagguacuuuuuagauguaaauguuugucagaaacauguguuagcugguuaaguaugcucaguaaaaagcugagaaagccuucugcgucaaaaagcgugugugugcacaugcagauacacaugcagauucauacucauccuugaguauacuuuuuaaaaauuaagugaauuugauugaaauuaacguuguaacaaaccaaaacagcuugaggcaaaccuuaacuuuggcauauaugagcuauauaaauauaaaagcguauguuaugccagaacacaguuuucaaguacagaaggaacaaaauccucuuaacugccauagggguuaaauuguuaaauucauuuuucuaccuuucaugggaagagauaaauccuuagacccaaagaaguccguuuuuauuauggcucuguaguuuauuuuuggcauauauucacaggugugccuauggcucuauucuuaaucccuuuccuuugggauggcuccaagagugguacaaauuuguaacucuguaauuuagcucuuucauuuuuuuuuuuuuuuuccugucugcccuggaauuagguuuuaucuuaaguccacacuggauccucuggauggguccacugaggauuuugaaggaagcauaauuccuugacuucuuuuagaauuaauuuaccuauuaaauaaaaaaaggaaagaauucaucuuucauuugaaguccucugaggcuaacauuucaauauaaaccgauaaaugucaugagcauuauuauucagacagccacauuccucuggaaugacaauaacagcauagaacuugaaaauaacuugaaagaucacauggagggagcaaguacauuauagccuuuaaaggaaaaagaaauuaauuguguuuuguucuguuuugguuuauuuugaaauaguaucuucuagcucagacugaccuuggaauuuacuguguagcuaaggauagucuggaacucuguaucuucuugcuuccaucuggaauuacaccagaagucauuuauuucuggaaaacaacacccaaacucuagcuugaguguauacuuuuuuggcucuuagauuccuggagucugcugguucucuuaacaaaacagacaaaacaccuugaaguucuggcagaaacgcaaaccuaggaaaacaaagauuguuucuuaauuguauuuguaaagcugaaaguggaaggaagaguaaguuggcacuguuacuuuugucuagggugcuccugguguuuagacaagcgugauuuccuuuccucagaacuguuauuuugaucagcauuccauugguagauaauugaaaccucuacuguguagauuuuugguuaguguuuuggaauaaagacaacugagaaauuauucuaucacaaugucuauguucuaagcauuuguuaggcuuuuucgggggaggggggccgcuaaaaaacaaaggcuuaaugauagaagucauguuuucaaacauuuauaaacaucuccaaauagcuguuuggcuuggcuauugugaucuauuuaacaaagugaacaaggucccugccuuccuggaauugugaucuauacuucugggacguuuacauugaauaaguaauuagaaauguggugaguguuuuauaaaguaccauggaagccucugaaauagagcacuuaauucuuucugaugggaaauacuauuaagccugaguugaaagaugcaggggauuuuauagaugcuuagcagaaauuuuuuuuuuagacauauauucccaaagcugugauuuuugucucaauuuuaguuauuuagaaaaauuguguuuucaaaugcaguuuuauaacuagcauuggaauaaacauuaccacaggguagguuauuauuauaguaaaggcaguaauaguucuugcagcauugggaaugaacccuggggucaucucacauggaggcucacacauuauuccugggcccuugucuguuuuaaauugagaguaaacacacacacucacaguaggugugaagagaguuuucucuuguaugagaagguguaccugagaagaagugauagagaaugaaaggagagauggagggaggaagguggauggaggcaggugguucuuagguuacugcugugcccuuuuuuuuuuuuuuuugcaguacaauacacuucucucuuuuuuucuuuaaaaaauguugauagagcuagacaacuuggcauacuuuaauuccagcaugcagacgguugaggcaggaggaucacuuuuaguucaagguuagccuggugucuguuauaacaacacuguuuuaaaaaaagagaagaggaauaaaagaugaauggaauggggagagauacuuuuaggcgucuuaacauuuuagagaacaaguguucacugccuagcacuggaucucaaccuguguccuuucaaggaugccuuuaggauauuugaauugauacaguucagucuguugguagcaauucuuguuugaaaggucuaaggaucggacuagugcaucaaucaguucucaaccugugugucacaaucccuuugggggucgaacaacucgcauaucagguagccugcauauuagauauuuacauuaaaauucauaacuagcaaaauuacaguuaugaaguagcagcaauaguuuuaugguuggggucauuucagcaugaggaacccuacuaaagggucucagcauuaggaagguugagaaccacuguucuagugggcaauaacagggcuuauaaaugcguggaaaaguguauucuuaaggaaaaaacauuuuagcauguugggagaaguggugaucuucaaagucagcucugggcuaauagguacuuacugaacaagauuucaacuuuuaaaacuauucucauaugacuuucucguuuacagcauuaaggcaacugacuuuccauaauguuugguggcuaugagacuauagaagcauuugaagaugaucuuuaucgugaugauucaucuagugaacugaguguugauagugagguggaauuucagcucuacagccaaguccauuaugcccagaguauacauaaugccaacaaggaggaaggauaugaggaaaagaacugugagaauucggaaacagugaguagucaaccaaaucagaagaacuuaaucguccuuucagauagugaggucauccagcuaucugauacaucagaggucaucacauuaucugaugaagauaguauuuauagauguaaaagaaaaaauauugaaguccaagcggaagaaaagacccagagcccugcuacuucucauucuaauaaaguggcucagaaaugcaagaggaauaauaagaagccuaaaccugaagagaggccaggugugauccgagaggucaugaucauagaggucaguucaaaugaggaggaagaaaguaccacuucagagaacgaaaauguggaaagcuggaugcuccuggggucugaggaagaugguaaagacaaugacauccuucucaacuugguggggugugagaccgcuggugcugaagguuagugucguauugacuguuuugaaaaguacuaacaucuuuauuaaaggaggacuacuuuuccuagauaaaagaccaguagggucucaucuauuuaauuucauuuuuugguuuuauuuacaugagacucacuagcuuagugguucuuuuucugaacaugauaaagaauauauuaaagugucgaagaaacugcuucuauaagcaaauuuuuagcguuucuucuuauuuggcucaagucauucuagauggaaaucuucguucuuuucugucugcgaacacaggugaguacucuaccuacauggcuuugugaucuuauuuggccaacucuuuggaaugccucuauaaugccugaauaaguguuugcuuauucaggaguuagccagauaaccagcauguggaauaucuaggucacagaaggcagaagauacaggauugauaucucaggaacugcagaucuaguagcaggagauaggacaggcuuaaauuuugcaguggacuguaggagaaaauauaaacuuuaagcaccacauucuugaaggugcaacuuuugguguuaaguuuuguccccucuguuacguauagccaucuaauaucagugaauaguuuuaaaaguucccuucauucucuuccuuuacgccagggcuuucacaagcuuccucauuggucuucuuuuaccugcccugcacacuaguagucuucagauguuuugugacuccugguacuuuacugguguuucaaaaccuuauugccucucuucuguuuucugaagaaaugauggcauuaaauauaaaucauucuuggaucuccaaaggaaugguaaauuuuuuuuuuuuuuuaaggaaucaggugggcaauauuuuagaacuccaggcuauaaaguuuuuuuuuuuaacuauucaaccuauuuguuggaaaguugccuuccauacuacuuaaagaaaugggcaccgaggauguagcucauuugaauccaugucuagcaugugugaaggccuggguuuggucucugacaccauaucgaucaguuguggugauguacaccuguguccccguauuugggaggugguggaagcaggaggaccaggaguuaaaggucagccaugguuauauagcaaguuagaggccagccucaaauacaugagauccagucuuagaaagaauaggaagauuuggggguggcuguuccaacaggaucuuacuuagaaaacggggcuagcacaagcuauaguuugaugagccuugggauuugacagccauaauaauaauaauaauaaugauaaugauaauaauaauaauaauauagcaguuauacagccaaaucaaauuaauuucugccuaaauaagggagaaaugauaguuuuuaggcagaagggaagaaacuuuuagagacuaagcugguuugcuaggucagggaaguuuuguaagaugagauuggcuacauauguuauuagucuuaaaaguuaacugccaaaucuaauauuuguagagauagagaagaaaguuauacauucugauggauugaaauggaugagggaacaauauaagcuuguacgauuuucuuggggggagggaaaugagagguggcuguggaaaggaugcgugcuguagauacucuuugguaguagaucuugguauuugcaagauaaaauccuuuuagaacaguugacaggucucacuaugacuauaguucuauuuuuuguaucugguaauggagaaaauguguguuuauaaagaguuguuaauacucuccuaaagacuuuguauuuuacuaucacaauacuguaccuugguuaaugcacauguaugggagguggucuuuauauaauguaugacguggcaccuaagcuguugcuaauugucuaucuccccaggaguucugagcuuggaauucauuaagcuaacacaucaacauaaaagaauaaagauugcuuagaaguaguguucagucacaauuaggauaauaugaauguaguaaacucauuuuaaagcauucuguuguuuugguaauauuugggucuaaagauccccucaacuaguuucuauucauguuccugugugugugugugugugcacacacacauauacauauauauauauuuuuuuuuucuuaguaucuccauuuggugccuuuauuguaaaucugaaaccuuguuuuagauuuagcauacugaagcuaaaguuuguuuuuauuuuguaacaggucucugcugguuuaaggaucugcagagaugguaaaagcuaacugcaguauuuagauaauuucugaaaacauaaacuaggcauugacuuuaugaaagaacuugaaaugggaaaggguggcccugagaaagagacguugcugaugcuauggaccuaaagaggaaguggcuggauggacuugauguggcacuggccuuggagcauggugugggggcaaagcugccuuucuccuguuggauggugaggaaaucugguuggagagaagguuucuauaagagaggaucaaaggcaaguuuguggcuagaaaagauacacacaaggagaaggcuuauuuauuugguaauuuuuuuauuauauauuauauaaaaguguuuuuauaaaaacacuuuuaguuuuuauuuguauauauaugugcacaugcaagcaugggugugcguaaguuuggacaugugaguacuguggcacacuuguggagaccagagaacaacuuaaaagaauuaauucucuccuucuaccauguggguccucagagucuguguuguuuccuacuaagcugccucaccaguucacuaaaauguguaaguguuggggcaugacaaggaaagguggagcuaauggagcuaagucugagaacccugagaaaaagagaugcuucaaauacagauuggcauaagaacauagaaauguacauauuuuaaacuagacaccaauuguuucauugaagagacuaauacaguaagaaacugaguuaauuuuauagaagucucagccauuggaguuaagucuuagaaaauucugauaaugucacugaaauuuugugguuuauaaaugaguacaauuauugaaauugaacuaucacauaaguauggaagacuauauaaaugcauacguauucugcauuuucucucuagauauauuuucacagauagaggauucauaguugcuauggauuuuuagcaaucucaauauacacauuuucuaucauuaagaaccucuacauuuucgaaggaaggacuuuauaacauuuucucuuuggucuauuccagaugccaguaucacuguuguugaacuuugaggcugcuguucaauaaaaugagggguacuuaauacuaccuuugugauaugaugauuugccugagaacugagagggcuguugagggacuaggaggcaguacuguaugcaacacauaugcuagauaagggaugauucucgaaagccaguaugggaggauaguguaagauguugccaagcuacucagaaugggguacagcuugaaauuuacugcacugguuauuccuggaacuuuccauuuaauauuuuuucagauuguaguugaccauguguaacacacucuggagaccaaaccauggauagauagagagggcuucuguguuagaaaagcaugucuguuguugggagagaagaaaccgaaagaaacaagcauguuuucauugcuguagugaguggcaaccuuuguuugcauaagacagcgaaauaauaaagacaauaagugcuuuaggaauuguuuuccuuggauuaaaaagaggacauuuuaacuguaggaagaaugguuaauuuuuggucuaggucuuuauuaaggauggaauguuguaaugaacuccagaguccuguaacccagcuucaacagugacucacagcugacaccggccuuagagcuuggaacugaugcuuucuuucuuucuaucugcaguuacaugcuucuaucacuauucugaagcagaacguagauagaauguuauuucacucauauauacagugucuguuucacucuguaaaucuuucugaaaagaaauucauuuaaaaaaauguaauuauuaucacucccaaaaaauuugcgaauaacuuuuaucaucaaaugcccagugagaaucacaggcuaacucucaguuuuuucccuuagaguuaauuugagucauuucugaucuguguguugcaaguuguugcugauuuuaguguccuuucauuuauaagcuacccuuuaucuccucuccuuucuuuuuaauuuuuuuguaaugugguuucacuaauuggauugcuuuccaucuagaauuuccuauauccauuuuguuuaauauuucuuauuguauuuccuacuuccuauggcuuguuuuccuuuuauuuaccuuugauacauaggcucaucuguuucauuuugcuuuugauauguuuauuuucaauuaccuuuuaaaaauguauaauuuuuuuuagauuauaguauaauuacauucuuucucuucucccuuuccucccuucaguccuucccauguuuaccaaucaaucacuugcucucuuucaaauauaugcccuuucccuuaauuguuguuauguaugcguguugcuguuauguauauauguuguaucccuaaauauaauaaaugcaacuuacuugcccauauaauguuacuuuuauguauguguuaagggugaacauuggagggucaauugcuuugcugugccuugaagaaaacuauuaucucccacucucaguugccuguaguucucuuuaggguugaggcuucaugcucacucuuacacuccuaccccuccacuuaagcaugucuuuuguuuuccuuguucagcuccuguuuaggcagucauguuggugagacuuuaugaguauagcuucuaggcauuccuaggagacagucucacaguaaauccccuaauccucuggcggucacaaucuuucuaccuccucuuccagugauccuggagccuuaggugcaggaguagauguacuguagauguauucauugggacugggcuccacagcucugcauuuuaauugcugauguagguuucuguaauggucucugucuguugcaaaaagaugcuuccuuuuauuguggguaugaggauaaauauuuagaguguaguuagggauuauauggguaaagauuaucuuuuuaaaauuuaauuuuaccuuaaaguuauauaaauaauuuaguuuuuuuuuaauuagguauuuauuucauuuacauuuccaaugcuaucccaaaagucccccacccgcucccccacccacucccacuucuuggcccuggcguucccuuguacugaggcagauaaaguuuacacgaccaaugggccucucuuuccacugauggccgacuaggccaucuucugauacauaugcagcuagagacacgagcuccgggggguacuggguaguucauauuguuguuccaccuauaggauugcagaucccuuuagcuccuugguuacuuucucuagcuccuccauugaggcccugugauccauccaacagaugacugugagcauccacuucuguguuugcuaggccccggcauagucucacaagagacagccauaucuggguccuuucagcaaaaucuugcuaguguaugcaauggugucagcgaaauaauuuaguuuuauauaauuauaaaaucaauaaaauaagguaaagcccauucagauaagccuauuuuuuuaagucuccaccuugauccugcucuuucccucauggauacagguuaaggaaaaaaacaaaauaagacagugcuuuguccuuauguuaaaauaaaaacaagcaagacccagguauauaucuuuaugaucucucuuucccuuuguuaauuaggauauauuaucauacuauucuaccuuuuuuuuuuuuuuuuuuuuuugguuuuucaagacaggguuucucuguguagcccuggcuguccuggaacucacucuguagaccaggcuggccuugaacucagaaauccaccugccucugccucccgagugcugggauuaaaggagugcgccaccacccccuggcuguuguaccuuuuuaauauaugcgauggagcuggauuucuauacugugcauguguaaaggugugcaugacggugaggugaauauuuuaguaucucuuaugcugagccgugcugauaauuagacaguguuuucugaauguaagugaggaauacuuaaaauagucaaugaaugauaaauuguuacaccauuaaaaugaagagcagauaaauaauaguucaguuacaacuggagaagcaugcuuuacuucuguucucacuguuaaugccucuuucucguuucuuaauuuugaaagcuacagauuuagcaaaaauuaaauagucacaggauuuagaaagaaaauauucuuuauauccuuucaagaaugaaaacuggcauuuuuaaguugaagccauauuucucauuugugacugguguucuagaaguuuuguguuaagugcauuucugucuuugccacugguauucuuucuuuucauaguuauuugaaguuaaagugaacucauggcccgguuaaugugaaaucauagacuuuugaaauugagauauacuuauggcuuugaaaacuuaagacaauaagaauuuugauaauuuuuuuuuuuugugugccaaguuucauuuuuccccaaaccauguacauaaguuuagguguaaauucagaagguggagaacucacgcagggcccuugcugaguuccugggacuuuuuagguucucaaccaaagcuugaaacugaaaauaauugaguagaaugggucccuauuuaaaauucaguuuuuugcaucuugccuuuuuauuuauuucuugucauuucucacaugggugccauguauauugaucauugagaccaccagccucaccuuucuaccucauauuuuccuagcgucucucucucucucucucucucucucucucucucucucucucacacacacacaccuucaugucuuuuuaguugucaaacauuucaauuauuugauuugauuugggucuuuacauacacagucuaucuucuuggaucagucucugccuugccugccugacaucuguucaucguucaauuaacaguuuaaaguuuacugaaugaaguaaugguuauaguuucucaguuauuagauaucaaauuccacaguugaccugcugucacauaaacaaaaaacccaaguuguuuuuugaaugucucaaguauaacacuuccuuaaauacauuuuauuuuauuugauggcauuuucugaucuacuagcuuaugagauagucuuuuguuauguguuuuguuuuuuguuuuuuuuuuuuguuuuucgagacaggguuucucugaauagauagccuuggcuauacaggcuggccucgaacucagaaauccaccugccucugccuuugccucccgagugcugggauuaaaggcaugcgccaccacacccggcuuuaugagauagucuuaauucuuaaaccuuaaacaaccccccccccccaaaaaaaagcacaaccaaaaaacacuuugcaagccacuuacuuaaguaagguauugggauucaagagcugucauaugguuccugccuuuagaagccuuaaaaugcuugauaauauggaaaacucacugauguuaaaaaacauuucuacaaguacaaaagauguuccagaaccaaacacaaucauccuagaugaauauaaugcacuuuauguuuuuaaaaguuccaggugcuguagagaugucuugguaguuaagagcacuguugcucuugccuagguucuuuuaccagaaucuacgugucuguaucuguaguucacauuccagggaauucaaagccuucaccugacuuccaugggcaccaggcaugcaugugcaacacauacaaacaugaaggcaaaauacucacauguauaagauaaaucuaaaauaauuuaaaaauaaaaagcucagucuguaaagcucuugcccgaaagccugaagacguaauuuugauccccagcaccugaauaaaaagucugguacgauuguagguacuuacaauuccagcacugaggaggcagaggcaggcagaucauggggcuugcuggccaguuagcuagcauaauugacaagcaucagaucccuacaagagcccuugucucaaaaaacaggacaacacccaaggcugaucucuagccucccugcaggugcacacauauaugcauaucacacauauguucaugcacaggagcagacaccuacauggggggagagagagugcauggaguugagaaagcucacuagcugggugugguggccuaugccuguaccaguucaggauggcuaaggcaugauuucaaguuuaagaucaaacuaggcuauacugaaaccuugucucauaaaacagugcacagcugguuucaugucuuuaaucauagcacucaagagguuugcaggaggauugcugugaauucaaggccaguuugguuuacauaauaaguucuaaggccaaccauggcuaccuagagagacugucucaaaagaaacaaaacaaaacaaaaaauguacaaaacauaaaacaaaaaaacucccaaaacuccuacuuuguaggcaaaacacaagagucaguuggaaaguuuaaguaauguacaagaaagaaacaugaguauaugguaucacuaauuuuuauauaugguuagauaggaugggacauuuuaauagcaugucuuuuaacauggcugucuuagcugagauaagagcagacacguagguucuuuauaugcucagaaugcuguggaagauuucuuaggucaugauuuucuuuguuucugccucuuucuugucucuauuucuuccaucucuucuugaaaauauaguuggaaccagacagugguggcgcacaccuuuauucccagcacuugggaggcagaggcagguggaucucuugaguucaaggccagccuggccuacagagugagauccaggacagccagggcuacacagagaaacccugucuugaaacccacugucuacacauaaaaaagaaaagaaaauauaguuggauauuuuguuuauuaaaaaaaaaaccagccugugcauugcuuuaugagacaaggugucaguuuguaguccaguuggaguguguacuguauugcaguuggaucaggugcuguaaauaguuaaggaaugugaccagcuauuaaggaguaucuuauacagcucuuuaaauuuuuaaaaauuauauuuacuuuguguuucgcuugcauguaugccugggcaccaggugugugccugguaaaagaucagaucccuuggagcuaucauaugggugcugagaaucaaacuugagucuucuggaagagcagccaauucucugggccaucucuccagccucuuuaugcagagcuuuugaaaauagaacauuuaaaaaaauuauauaauuugggcuuuuuauagguuguugucuuucuuaauuguuugaccauaguaaaggaaccaaauuguuuaguuugaaaccacuaauaaagcuuuauuuuucaauaauccuucagauuuuuaagguaauauuuuccuccuuuuaucaacuuaauuuugguaauuacaguucuuaggacaucccaggccuaauugguuacaaaaaugaguugccauuuaacacacuucucguggauguauaguuuaguaucugucuuauaauuaaaaaguagccccaugcuagagcuccagugaccaagagcaacaaggcucccucccuagugugaucagcuuuuguaagcauggacuacacaauuccuaaagcugcuuugagcugugucucucguuguacaugucaccuuccacuuuacuguuguaagggcaucuuuuuuuauuuaauuucuaauuagcauaaugacuugagcuguguuauucacuguuucauggugaaguugucauaggaagagaagaaauaaaaauguucagauucaacuuuacuugugaauggggugaaguuuaaaagccucuuauggcuauuguucagcagacuacaaaucuuauuggaaacccaugaaguccaaggcagcuuuggguugaauuuuaauaacauuuugaaauguugauauugugugucacuuaauuuuacugugauuuuucuauagaucaccaacuuugguacacauucuuucaaagucauuuuaugacuuucagucuaaauucacuuaucauuguuuaaaaaaaaauuccuuguuuaguacugaggaagaaaauugaauuuugcuuuugaaaaagcauuaauaacuagcuuugauuuuuuuucauaguuacauuaaauuuaauagaaacuuuuccaccuugauauauauuuauugaacuaaugacaguguaguuacuauuuaaaaguuaguuuauagauuugcuuaccgcuuuggaauggagaagcauaaaauuaagugggcaacauuuucauucuuguuauaggaacuugaguccugauguguuuaggugcaguguuaaauguaauuuucacauagccucaugcuauaaacauaaucuacuguauauaaagaucauuuguauaaagcuauuaacuauaacuagugggauauuuuuaugguuagauuauaaauuuuauaugaauggcauguuuagauuaugaaaccuuuuucaaaagaaauacagaacuuuuuuuuuccaugaacauaaaggcuauucagaucauuucuuuauagauuuuauuuuguuaagacuuugcuaaauuuauguucaguuucaaguaauuuguuacuuccuuaaauacuccaauugugguuaaaaaugaaguguugauggaaguugcucagucuaaaaguuucuuuuguuuccuugcuuaccuuuguuugauuguauauuaaaguuacugugguuaauguuuuggcguuuucaguuacaugccugaucguugucacuuaugcuaagaauacgagauaaacauuuuagugagcauccaccauguaaggacacauuuucuuuuaaaguuguacacauuauuugauuuucauuugagucuugauccagucauauugucucugguauaauucuagagaugaaaucuacuuuguagugccuguuuggauucaagaaauggaugaaacaaacuauuuuaaggaauucuuacuauguuaaauguguaacuucgauuucugucauaaauucuuaaccuuagaauuucagcuuuugucauuuuugaaaguuauucacuguucuuaucccugucuuuuacaaacacauuuuaaaagaagacagcaagccugugugauggugagaugcuagccaucugcccccaggugagagaguagcauuuagaagcucagggcuaguuuuuaagggaaaguguuuuuauuggcaagucccuugaagggaguaggucgcauuugguuuuacuuuguagcuaaauagcacuuguaacagaauuauccacaccaggcagaaaguccuaccucuagagaacuuuucaacagucuccauacuaauacuaaugaggaauucuaaagacuaggaaagcuugguuaugcugauaaacguuugcuaaagucauucaaauagugcuuuuaaaaauggggaauuuaggauuauggaagauaaauuuaacugaagaaaggugguuuuugaagaguuguagaacuacauuaacccuggaaguuugucuguacacuacacuagcuguucuuauguguuaaauugucugcuuuaagcauagggauuuuuuugccagugacuuuuagaggcaauauuauuuuauacauuuaaggagaaucuucauugucauuaaaaugucuuuguuacaauaagaacuugaaagauugugucaguucuauauaggcaaguauuuugauccuucuuuuuauuucugcucauuugguuugcuuuagacaugacacagauuuuguggugaauacuuacaauuuaaauauuguucgguuucaguauugccuaauaaucauuuaacuugaugccaaauaguugaagaacuucaugauacccaguuuaaauguuucugaagaaauucuugguaaaaauccaccagguaguagcuugugagguauuucugaguguuuuuguuguuauuguucuauuuguacuuaaaauuuucuguuuaaaauguuuucauuugaaaaaccauuauuauuauuaucauuauuauuggguuuaacaaaauaaauguaguagucaaaccucaaaucaucucauuuucaacaguauugguuaguuaaaaaacugacuacaauauaguucugugugagugaaggagcugugcuugcuguuggaucgcgcagcuaccuaacgcuagguuagcaggaccagcaaagagacuuuauuucauuagauguuuuuauuccuuugauuauuuaaaccuugaagauuauagguuugugugcaacuuuuuaaagcaauaguaagcaacgagaaucccuuuucuuccuuuaaguauauuacacucaugugcguauuuuagcaaaaaaggaaaaacuuaaaucuucuuuugagucuugguaguuauucuuaaaaauggauuaaaccaauaaaguuuguuuaggaaucucaaaaagaucuucaguaggguaccugcggcucagcagucuaucugugcagauucccugccuauuguggcugcuugcucauuuacauuucccauggcuuuggguugcagacuugguuuucugcaagagugcccaugcucauuugcucauauauucugagugacuuuuuuacuuuuucuuucuucuuauuuuguugauugcuaagaggacagaguuuuguuuuuuguuuuuguuuuuuaaacaccgccacacuuguuccuuuguuauuucuuuuccucagugcauauauuucuauguuguuuuguuuggcauauugugaagaauuauuguuugguaguuagauccauggggacuagcagagaaaaagucauuuugaucuugguuuuguuuccuuaauaacaguagcaauuuaauucccaaacuauugagaagcuuaaaauauauguuagcuuuaugaaauugauggaaaguuauuaguccuguaaauuucuguucuugaucauuuuacuacuguuagaaugaagauauuuuuugucgugagucaaguuuuaauaguaaaaauacuaauugucaguaaggaguauuguaaaauuuuauuuuaaauauuauguaauaaaagcacacucuugagauuaguuauaauuguauauaugauuucaucuauauugaaaauuuguuguccauaacauauauaaguagacauuugaauguucauauacuugauuaggaauauugcauuuuuaucuugagaucuuuuuauaaauuugucuuuaaaaaaauagaugaugcuauuucuucucagaugugaguaauuuuguuucaugaaaugacagcuugaugcugccaaaugcuaaguccuugaaaaaaugugcuguggcagcuuaacaaucaggcaauuuuguuguaaauaaaaaacagggaaucugcaucuaacagcucuacaaaauaguuuucccauauacaaagguuuuaaaaguauauguuucuguuuuaugaacaugacauaauacaguauuguguauuacucuaacauaaaauaaauaaauaaaaaauccuuggccauuuaaagguuguaaugcugugacgccucucuguuaacaggcugaaaaaccuuguuguugguaaauagaaggaaggagggagucaggguuaacuuaucauuuuggaauuuuuaauguaauacauaauaguaauuggauauuuaguaauuuucuauauauggguacucuaauaguuggagaauggccauccuguaucuaauaacgguguucuuuuuaaauuuuugauaauuuuagugucuuagauuacagaauucauaauuaccaagaaacaucauuuuuauguuauuuugcuuuuuugguuuauucucaauauuuugauuuuacacuaauauuuugauuuguaugaaaugaguucucaagaaacuauuucuuuuaaaaacaguuucaaaacaagaaaauauaugcugauaucuaacuagucguugacuguucuaaauaaaauacauuugaacuuuuugaucauauauuuauaaucuuuauuaguuuauaaaauuauucagacuucugaaugguauuuuuaaaaaaaauuuuacuugaccuuugauguuucaaucuaauaauugcaaaauacaacaauuugagauagugcaccaaaucagggcauguucuauaaugugaaaguaacauaacuauaaaaguguacagcuuugaaaauauauuuucauggcaaguguaggucugacugucuaugagcauacuagcacaguauugcagagcuaggcuggaaauggaccaaggacagaagcugggggagugcucagugcugcugaaaccucccaggcaguugucacacaaccuuuguuuuuaaaggucaugauugccuggugccuuugccagucuuuauuugcaauucuuguuuuguggcguuucuuuuuuguucucucucucucuuuuugcuuuggcacuggguggaauguucuuuuaaaacugaguagcuaaacuuguacaguaauauuaagguguaacggaaauacuuucauguaugcuuuguuuuaggccagaaaaugcugugacgguaagcuaaugagaagagaauuaauuaauuaaugaguguuuugaaaacugauuagcuuugaaauuuucuguucaguuucuguucugaguuagaauuuaaauuggagcuguuuacgaaauaagucacauuaauguguuucuguguuccaguuggguguugguauuuuuugaaaaaugauauuuggugauaugagagaaaguaggagaugagcacagaauaaaaguugggggagggggcaaggaauugucugcuucaagugacuccagcugacagaccaauagagaguuuuaagagacgaaagugcugaaacuccauuuuaaaauacuaaaaggguugaacaugcuugacaaggcuugauagugaaaagugcuauaauguuucucuggccucuauucuaaagcaauauauguuuuaaaacauuaacaagaaguaccgugaaacuuaguauuacugcccaauaagugauuguauuuauuaaagcuuauuaauaugaaaaucuaaaauuauaagaggucuauauaagaguagagaaggggaaucacaaaaauuaauuuuuauauuuugcuuuagaaacugcuucuaauucagguaugccauaauacaacuuucuuucuucagguuguaaggauaucacuuuuuaguauucagaaauuuuugaacuuuuaauuuuaaauauugauauaaauuggagccuuuuuuaaaaaacaggugcagauaugagaaaaagauacaggauacaugcuagcaguuggcuuuuaaaguuuuuagugauuacacuuugaaauagaaauacaguccuggcauuuuucaggauacacaugcauaauuagcaauauuaauacugggaggaagcauugugaagaguagcagauuguauccuugauuaucccauugcugguguugcauuggcuucuuuguuggggugggagguaaauuguauuucagaaaaggaugaaauagaaagcugcuuucagguaaauuuguaucuuugcucuaaaaugucuuugaagauucauguugagaaagcuugugaaaauucacaaagcauauuuucauuuaguuggcugcuaaaaacuugauuaaucuagaaaaaaaaagugaaauuaauuuuuuuauaguuuaauguuuguucuugaauauuguuuaguguuuuuuuuuguuaauuugaguuuauucugaauuugguuuuuaaaguucuauuuuuaauaauguuauuuggacaaauucucauaacuguaaucauauuucagucaucaagauacuuuaugagccauauauaacuacgcuagcauucuuuucugggcagccguaaaguaagugcugcuuuauauuacaguguaugugaccauuucuaauuugaccuguuacuguaaagaaggcuaacaagugugugugacuagcccaccccuucuggagcaguugaaaacaggccucagaaggcucaaaggaauucuuuuaacuccuagcagggccacggggucaaugucagauuuagucaugcuguuauuuuagcccagugguccagagagaugacugaaaagugagucuuuuauuucuuuuuuugugugguuauuaacaggauuaaauguaagccauuguguacuuaguaccaauuaguuucucaucugagagguucauuaugauuuuuugucagccuuguucuuguaauauuuguuuuauuguuugauuauuuaaagggauggauggacuagagaagucuuccagcagugcuuugcuguucaucgagaauuuuaauaaacacuuaacuuuccagagauuuuucucuugauuaagaaaugacuauuacuaaaaacugacaagaaagugaggaaguuaaauaaguguuuaaaguuuucuuuuuugauuuuuguaguuuucaaaaagggcuaacuuuaucaauauuucaugguuuuggaagucuacuucauauuuguaugcauauuucuuaagauuauguucauuuuugugaauauguaauuuaucaggagaaauauaugcaaagaagccccaaaguguaaguuucuacauuugagcuuuuaaagcagaacauaagaauucuagaaucaagauaauugccagguauauaagcaaaccuuaauuuagaaggaaagaauccggaguugauucuuuaugccauuauaaaugaguaaaaaggagaaaagaaacauacccaacgguuuaguugcuuauuacauuaaugauugcuuuuaaaacugugagguaaaaauucuuaguagugcuucuucacauaauuccucacuuagcauguugaaauauuuuaguaaaauuuuagucaaaauuguucuuacaaguuggauuaguuaguuauggucauuucaucuaaaagcaagaaauauaaccaaauuaaaagauaaguugucugcuaauucguguguguguguauguguguguguguguguguguguguguguguguguguauauauauauacacacacacacacacacacacauauauaucuaucuuacauauauuaaauaaauguauuuagauagaauaugagcuuuguacuugaaguguagaauacacauuuuccuaugcauucacuguuaauggaugaauguguuacacaguucaaauauuauguuauaauugcaguuuagguaaaugugauuucuacuuuaacugaauuguugaguuucuaaaucucagauuauuugaucuaucguauuagauuguacgauucuguugaagaccuuugcuauagggccuaacauuuuuguuacugagauuacuguagcguugaauauguaagauuuuaugauucagauagcuaugaaauauacugcuucugagguauagcugccccacuuuggcuagcccuuacaauuuaagauuuguguauuuaacuuuuugggaaaggcauuucuacaaaaaucuacauauacuauuuuucuuaccuuucucuuuaauuguaauugaaauaugcuuagauucuccagauggaagcuuugaaaaaaauaagaaaagaguguaugguagcuguauaaaguaaccugaagauuuucucgcuacaggaauugaaucaguucccuccccuugugguuggucauccaucccaugggaaagcacgcagcuucuuucagauuaagcguguagucucacuaacauuuucugaaggucuguagagagccagagguggaucauuagugaaauggcauggcaauaggaaaagacaagccucuccucuuaccguuucuguauuuaacuuuaaaggaaguggaaagaaaucaaauagauacuaaguugcaaaucaaauucaccucugaguuaauaaaaauucacuugaaauuaauauucuuauuguucuauggaauacuuuuuagauggaucaacccuuuguuauuuccuuuuuaauuugauguuuaacuuuuaaguacuugguagagagcagauccagguauuagcauucaacaggaaauguaaaagguagauggaacuggaaaauaauauauugaaugaggcaauccaggcucagaauguuaagucccacauguucucucuuggagguacuagcuuguaauguuucugugugggagugagcauggguagaugccaggaagguggaaaggugcucaagaaaggagaaguagaccuugagagaggagugugggggaggguagcagaaugcauauggucuggacauggaaagggaaauacuugaggcugaagggaacacaggggugggucagaaguuggguaucgaccacaacuaaauauauaugacacugcauuagaaaacucauuaauucuggauguuaauuaagaaaaugaaagaauagauuaugaaagguugagcuguaguaaagauacuuccuuagggcuucugcuccuuuagggcgggcagcucaugcaguagugacuguugugagcagaugaugcagcacguggggaguacuugcccugucacucuuucuguuauguauugcgcuagucacacaaccucaagccaggccacuuuuaaaaaguucaguggaaguuuaagaacuugaaguaaguuguuuuacuuuaagaccauuaaagauuauuguuugauuuauaaugaaguucuuggaauaauaggcauuuuauuguaauuggcaagugcucugcuaaauaaaaaugacuuuuagauaacgccuuuucuauuuacucagaugaaggcuaccaaauguugcuaaacuacuuuuaagauguuuaauauugguauagagauguaauuuuuuuauuauauaaauuaaguaagacaaaaggaacaauacaaaucuaagaagauaaaugagaguuguguagaugaauagaacaaaaacacgguuaguauuuaaauccaaaggcuaacuuuuauauacagucucuaaugcuuggggcuuuuguuuccugcaauaaaaaugacuuuucuuuauaaaagucaugauguucuauuaggauuaaacguuauaguucauacugugcuuuuauuaagcuuauaagauaccaucaauguuuuaguauauugaacuuacaacugauuuuuuuuuauagcuuuuuaaugaagaccaaauauuuguggcuuuugucuguaacuaaguauauauuugauagguuuuauuuaaaaguuuuaguauauuguuugaaagauaccaggcacaagauagcuacuuacacacugugauauuguuaaugguucagcuaguccaauuggccucuugaacaacaguuagaguugaaaaucaccaguauugguuagcuaauuuuuacuagagcuuacuuauuucuagagucuaacauuggaguuuaacuaaaagggauguuuugcuccauuuaaauuuauaaagcuccacuuacuuguuuuuugucugguaucucuaaguaauuguuucuucauauucuagcaaaauauauuuaauuuguuguuuuuauuauuuaaggauuuaauuaugaaaccuguaaacuuuuugguuaucuuuuauugauugagaacaaagacaaauaaucuaagacaacaaauaauaaccaaaacuaagauucauagccauucauuuaaucaaggacuaaucagggccuacuguguuacacuguggauguccuggugaauacagagaugaaucaaguacagagccugacuuugcaggucuuauaguguaguagaagucaggaucugcaggagaaaaaccuagagguacagcaaagggaagauacuuuccuucaggguuagagguaugugggcgagauacaaugccauacaaauggccaggggacagggcacaguagacugucauuucuuacaggacacuucuucuuuagacaaggcuccucagaauuuggagaagaagguugcagaauuugucaaaaauuuuaagauuuguauucuuauuuugacauugaaagguuuuguauuaaagcuacuguuucucauugccaauuagggauuugccagagauuugauugauguuuaagagaauuucacuuuucuuaagaugauccacauaaucuugauaaacuugauaaacaaaagcuuaggcuaauguuuuaaauuaaucugugcucuuugaacaacauucagauugaggcacaaaaguagguaggccaguggauauggguggcaagagagucaccuggggauuaauuauucauuuuauaacuaucucuuuucuagggcucuagggaauagucaaggccuugaggaauugguugcuuuuggauuuccaguuuuaccuucuguuagcaguuuugcagugaauuaacuguuuaaauaaguuaauugaaccucuuuuaucuuguagaauguguguaggauguuucauaaauucagggacucugaaaaagaacaaauaccuuaccuuauaauuuaauguuuauaaggacauuuuaguuccauauuagugcuuuaaguauaauaaauuaaagaguauuuauacugaauaucucaaacauaauuuuuuuggaggaaaaggggcauugaaaauaguuuuucuuccuucccucuuaaaaaaauauuuuuaaagaaaaauauucucucuccuaccaaacaaaacugaccaaaguaaaaauuugguggcuuugauuuuauacauguucugaagucuguccaagcuuucagaaugggagaauuccucagaaauuacuguuucucaugggagauacuuugaucuuaggguacaaguuaggaugacauuauuugcuucugucauacauagauagaauaauuuuagugcaucucuaaagguccuuaugguauuuugcauauaauagguuuuuuacuauuugaugcucauaauaguucuugugucagcuugccauuauauaaaacauuuucauuuugauugauggauacuuuaaauggcuaacaggaacaaaaaugcaguauuguuguuuucuuguucuuguuuuguuuuacuuuuuuaacucugagcauuugcaaguaucuuguaauuuccuauguguggaaacccugaaacaggagaagccccuuaaagacugaggcccuugaaagaaguccuaaagacaccacugccugacugcaggcauuuuuuagaagucacuggcuguaaugaagccagccuuuaauggcaguuuuuccucuucuuuucagagaaugugacagagugucauuaagguuuuagaaaugaaugcucgggaggggaggaggaucccugggaccacugcgaugcccaguguguggccuggggcuucucaguugggcuccuuuuagguuuuuaaucaggugcggaagggggauggagaggacaggaacgggaguagaccagagcggugagcaccuguacuuuugucacccgauguaaaaguugaauuuguaggguucaauguaaaaagguaaaccaaacucuagauauguugagagccaauaaacaaucagccuuaacuauuugcauuuggaaaugugauuucuuuuugaauuuaacuuaaacuguuugaauauauuaaaucugaaauuucauuuaaauuguaauuccacuucugcucuggggauccuguuuuaaccuauuguucuuuccuguggugacaguaauugcccuugauguguucugcagguaaaucagauugcaucacaaaagagggcaaauaauaaaugugugccagaaagagcuguuucuuagaauaggaacagaaaaacuugccuuucccccuucaaacauuguaauagcaucuaaaagauauugcaucacuuuuuuuuuuuuuuuagugggguggaggacagaaagagaaauuauucuaaaauaggcauucaaaauuucuuccuuucaauuucuucuuaaacacuuguauuuaaugaauaacauuugccaucugcguaguauuuuguguugcuuuugagauuccagugucuauacaaugcuugucccuguuuuguaagccauaacagccuuuuuuuuuaaacagguagguuugugguuuuuuuuccccccaugaaucccuauagugcugaaauuaauaggaaugcaauuuguuuuccugaacuuuuuccaguuaaaauuggaaauuucuagaagggcuaaggauucauagcuuaguaguaaagaacuugccugucauaccuaugaaguccuggguuuaguucccaguacuccccugccgccaagaaacaaauguauaccuuauuucuguuugccaugagaaucucuuauguuaaaaugauuuuucuauacuuaauuuucuugggauuaaaaaaaaguugacuuugaaaaggauggcuuuugcuuuuuucuuagcuuuuuauagguuuaugaaaaauuauaaaaguaauuuuuauauguuaaaauacuuucaaagguucguuuuccuugacucugagaugauauuagagcucuguauugcucaggguuaacuugccuugcaugggcugccuauuguugguagcucaguguuucacugaaucuuggucauugcuaucugauacaaaguaaaauucaccaguguuucucccuuucuuaaggaaggguugagaccaguaguucucuaauguccugagacuuugggcuuaaaucaguacaggcugauagugauggucaauauauuagaagaaauuagagaauguucaucccaaggagcuuugaagagagaugucuaaguaucuacaaaagauuaaauaacuuuucaggaauuauguagggauuauuauguacuucauuauucucaucuuuuuaucuagaaagugucaucuguucucuguucaucuuuucaagaguauauacuagaaaugugugauuuauugauguuaauagucuugguuaucuggcuaagguaguauuuggguuuuuaaaaauauuguacuuauuaaauugcaugcauguguauaagauuguguguaugugucugugaugggagauugcuuguguauguggaagucagaggacaacucaaugaguagguuguuucuuucaacuuucauguggguuucagagaugaacucaugcuuacaagcagugaugaacucaccucuguguuuuugaggguagaguacauguaaaaauuaaaauauuguuaccucaucuauuuguucuucacaugguaguuuauacccucaccauuuugcaauuauuuuucccuuucuggcuuucugagaugacaguuacuacacuuugaauuucuaguuacacuggauauuggaagaaauauaaauauaaacacuaagaugauaauuauauaauuuacuuagugauaacuaggucuuccaaguugacuuuuauuaauuuauaauagcagaacuuuuauuuggauuuuguuuuuguuuuggaaguuuuggggacauuguugaggcaaguacucuauuacuuagcuguaccccaguaguuuugauaguaauguuugauuguugaauauauuuuuaaauaguccuguuaucugauucuaacauuaaaauagcucuuuaaccuaaauucuaggagagugaagauuuaucaugugaagaauucucuuuguaaauugcuguuggcauucugagaaguugaaccagauagaauucuuuguucucagaugauaacaucuaccaaauuucagagucuuucccauuuuuuacuaccuaaaauaugcuacauuuauuuucuucucauuagcuagucuuagcucauagagugaguucaaagaggauuguguuugguaguguugcucugagggucagugcccauuaguuuacagauuucauuaggugcuuucuguaggcacauagaugugccugugggacugauuaagacuggaggucgucuuaaagaguuacagagacaaaguuuggagcugagccgaaaggauggaccaucuagagacugccauauccggggauccaucccauaaucagcuuccaaacgcugacaccauugcauacacuagcaagauuuugcugaaaggacccagauauggcugucucuugugaggcuaugccggggccuggcaaacacagaaguggaugcucacagucagcuauuggauggaucacagggcccccaauggaggagcuggagaaaguacccaaggagcugaaggggucugcaacccuauagguggaacaacauuaugaacuaaccaguaccccggagcucgugucucuagcugcauaugaaucagaagauggccuagucggccaucaguggaaagagaggcccauuggucgugcaaacuuuauaugccccaguacaggggaaugccagggccaagaagugggagugaguggguaggggagugggugggggagcaugugggggacuuuugggauagcauuggaaauguaaaagaaauaaauacccaauaaaaaaauauuuauuuucuuacugcuaaaaaaaaaaagaauaccucaguguagccugcuucccgucuuagacuuguaggacagcgguccucugccuuagacucccuucagcucaguuugguuuuguuagaaguucauguuuauuagcuucuaaguuuaucguuguucuuauuuuguggagauucacuuaaagucuugguagucuacauuggcugagguagaccucaccuccgaccuuggccuggguccuuugguuuaggugcugauucaccuuuguucuuuccuucuuuugggcauccuuuuuuccuccccaacucucagcauuuuuuccaaauguuuauuugaauuaaccuuuuuuaaauuuuaagcuauuuuugcaaauuuuccucaaguauauacauuaacauuagaauauauuuggacugcaagaaagcuauuuuacuuuucuuuuuuguuuuuuguuugguuuuggacaggaucuucuuacguagcuuugacaggucuccuaugcuuggauuacaggcuuauguuaccaugcuaguccauguguaugcauguuuauguguguuugcauacucucugccuccucagucauuaaaaggauaucaugacaaacugccccucccuccuagcauaucuucuucuuuacaaggcaaguacuuuaccaauugaccuuucuacccagcuauuuaauuuccugucuuuaaaaguagauuuucuuuguauuuuucuuucagaacaauauguuacaaugcaaagaauguuaaaacagauggaaacccacauuugggcuggggaguugguucagugguuagaguauguacuacucuuuuggaggacccaugucagguggcucacaacugucugucuguaacucuagcuucagagcauccagcuuccucucuuggcuuucugaggauaccugcaucaaagugcacauccaccuacacagacacacagacacauauuuaaaauaaggcacaacuugagaagaaaauuaacuccauuguuaggccagccacuagacuauugugaaauuacuguucaaauaacauuuugaaaguauucaucaaauuauuuuuauuaauaaugaauuuauuguuaaugaguuagcauauauuaaauuacuuagcuuuaguuuauuauauggaaaaaucuuuaggcaaagaagcuuaagaugcaguuuccuagcaaaggcacacaugacucagauguaacaauaauuacugcacaauaauugaguguauaaaagcuuugugcuuagagaagagugaguuuuuauuucuugaguggaagccaaaagguuucauuaaggaggcaaauauuaaacuuagguguagacuuuguagaaguggggcugggaaggagagggaaggggguaguaaggauaaggggauuggaugggcaguuacgggggaagagauacacuuuucacaguuccuguaaauuaacugaagaggaggcaggacuuccaagcuuacuucaugagccaguugucaagcugacacuaaagacaguaaaagaaaaaaaauuacauaguuaaaucugugaugaagauaauugcaaaaucuucaacaaagcacagauaaaccaaauucaguggcacauuguaauuaucacaaagagaagguacagggauaguucaacauauauaaauaaauuaaugagauguacuguauuaauauacaaaaggauaaaaaucauacccuuuuacuguguuguuuuuugggacaaggucaucuuuguaauacagauucaguuggaacucaggauucuccuaaaugcugagguuacaccuaaaaaucuuauuuugaugcagaaaaagcauuugagauaacaccacauucuuuugaaguaaaaacuaaacaaauuugguguggaagaaagaaauguaucacaaucgaacaaaggucaugacaguccuacaucauagucaguggugaaaguggaaggcuuucuucugguaguucaagacaagacaagaucccuuuugucacuuuugucagcaauuagguaaugggaaaaaggaaguaguaccaacauuggaacaaauaaauucaucuucagguaauauuuacauauggaaauccuguaagacugcacugacacuguuaggauaagugagaccaguaaagaaacaggugcagagaaauggacaaacucaguuuuaauuccaaacaauaacagugagcuuugugaaaaagaaacuaagcaaagauccaugaauaauagcaucaaaaagacuaaaauacucaaugauaaucucgucaagaagguaugcuuacauuuauuugugaauauguaugcaugugcaagugugugucauaacacacauaugaaauucaaagggcaguuuguaggaguuggguuuuucccaccaugugaguucugagaaucaaacucaggucuucagguucgguagcagcaccuuuaucugcugagcugucuugcugggccuaccaguagaaacuggaaacugaaauaucaaugaaagaaauugaaggggagugugugugugugugucuaucugucuaucugucugucuguguauguuuaagauauccugcauucauaaauuggaagaauuaauaucaaaauauucguacuauauaaucuaaucauaaucacugaaauaccugucaaaauuucaaugcccuucuuuuuuaaaguaaugaauauauuuuuagaauuaguagagaaccaccaaaggcccccagauagucaaagcaaucuagagaaggaacaaaaguggaaucaugccaucugauuuugaaguauauuuuaaagccagaaugaucagaacagaauggaaauggcacagaaucauacacaaagguauuagaacagagagcccagcaauaaaucuaaccauaaaaguuuaguuuuugacaaaggggucaagaucauguaauugguaaaaguuaguuucuuuaauaagugcuguugggaaagcuggauauuuaccuauaaaagaaagaaauugaauuauacauaaaaaccaaccugaaacguauuaaagaccuaaauguaagacauaaagcuuaaagucuuaguagaaauaggauaaaagcuguuaucaguggccuuaugagugaauucuuuacauaucacacucacagcacagagaacuaaaacagaaaaaaggagaacuacacaagaaguacagcaauuaaaaaauuaccuauguaguaaggaaagaaauguuuuugucagccauguaugugauagaguucccaauuguauggauauguaaggcacauguaacccucaaaauaauaacauaaauaacccaauugaaaauggacgagaaacuugaauugaucauuuuucucaagaaauauaguuggauaaaaaaauauggugcucaauaucacuagucauagggaaaugcaagucagagccaccaugagaugucaccucauaccuauucaaauggcuuuuauuaaaaugauaaaucauaccaauaauugacaccgaugugagggaaaggaaaccuguguacauuccagugcagccauuauaggaaacagugucaaaaucccucaaagaucugaaaaguagcaaauggucuacuacucaucccaccccugaauguuuacauccaaagaaaacagauacuuuucucaaagagaaacuaugcaaguauauacuugguaagcuugcuuuucagcagguucaguuagaauagagugggugaacugagagugguguguugcuaaugauuaaguguucuguaucuucgguauauuguauaaaauuaguugaaagcauugaucguuaagauaucuaagaaaagacuugugaauauugugacauuuugagacuauauaguguuucuagauagaaaccaaucagaaugcucugaggaauggauacaguccauauauauauuuuuuuuuucuuucuguguuccagaguguuuguuggugucagaagaaagcuguauagugguaaauacuuagcaccaaguuaaauaagaacuugcaggcugaacagggccagugaguaaagcagaagugggagaaucagaaccuaaagcuuugauugugugcucguagucaaggaacagagaauggaaacguguaaagauaauuguaauuguacccuuugacucacaguaaugaacauaacaagugcauauacuuaccugauguggaaacaaauacuuucuguuucuggguuaauuaacuaaaauuaaaauguuuauuuaaaagguauacaaauuauaaaaucauuaugguaauauuuucaucuuaaaauuucccaaagauucauuccuuguauaauagaggaauaaaaaucuguauucaauauauaaaaugagggaauauagggcacccaguaguuguguacacuuggcuuacagguauuaauauaguauauuacauuuaguaaauuaauccuauauuucuuucuguaguguauuaauuguauuauugucugccauggccauuucaguacaaucuuucuagucauggaacagcagccaauucuaggaauuaaaagaauuagguuacuuugccugauggcacaaaaccacacaagguauuaaaucauuggcuguuuggggaacagccagaaauaaaguucaagauaaaaggcaauuugcaugcuguucauauuuauucauacuuuaacagguauauuuuucuccuucuccuugauugguguaaucuuuuugaaacagauuuucaauugcuauuuauguccagaggaacagaauuuuaauaaaauuuuaggauaaagucuaaauucaggauucaccugcaguaagucagugcuacuagcuaugaaaaauauuuuaaucugucucuagaauauuuaagcauauuuuauaugaucaccugccauaaaacauuuaaagcauuuauuuaucaaguaauaaaaaaccaguuuguuaauagaaagaacugauaguuuuaaauauuuuaaaaugcuguuuuauacuagcagcuaaccugaaggacauucugaaaacaucacagucuauguuaaugccuuggauauuaaauguccccuaaaggcucuuguguuaaaggcuugguugccagcugauaggcauuugugaagugguuggauaaugaggccucagaauccacugauggaguaauaccuugauagcauuauugggaagcagugggaaauuuuugauggggaauaggucacuaagggcacaguuuugaaggguuuaucuuguuucugucuccucccuccaucugauuugcuuuaccauuugcccucugcuaugcuucucucuuacuguagaucagaucucacagaucuaagugaccauaggcuaaaagaaaccucugcagcuaugguggugcccacauuuaaaaucagucuucccucaguuaauucucgcugggaagagcuucgcagaagcaccuuugggugugucuaauaaccuauuuguuuuuacucuaucaguugacaagaaagauaagcacuauaccacuuauauaccaccucuacagaugaagcuuaggcuuguguguugaaccucacaacgguguauacugguacagauugauugcaagucauagcuucaagggcagcacucugcuuuccuaaauagaacauuucaguacagugacaugccaguguauauucaguuugguucucuauucaugagagcuacaguuuauagcauauuuggagcucaggucauggcuguaaucagaucucuaagaaccaaaaguuuugacugugacucuucaagacauuauuuggcaguucuucaguuauagcauguagauauuuuaguguuagaacccuuucugggcauugcugagguucugggcucuauugaucucuaguacuguaaaaaccccuuccagaagucuccuuaugccucuuugguagugcuaucucuugcugcuccacaaccuucuuccuuuggaacaauugguuuccuccaggguagagcgacuuugcauuaagaauuaugcuuuuuuuuuuuuuaacuauaaaagacaggagauuacucagcuaaauacaagcauguaugcuugaggaccagaguugggaaucucagcaccuaugggacaagaaagccagggucucuuuucuauuuuguaguuaugguucugggaguacuugugcaugguagacaagcauuguuuuuaugagguagaguuuugauauagcucaagcugccuuugaacuuauuauguagcccacucuggccuagaacuugcaaucuucucugccucaccucuuguaugcuagaacuauaggugaguaccauguuauauuccauguuuaaggcccuagguucaauccuaacaacaacagaaaucacuacuuacaugagaaucuauuuuuggaauuuguuuuccauuuaccggucuuaauuuuagcuucauaaguaucaauugagaauauauuagucaguuugcaaauuuucugugguuguuuuaggcccuuugcauuuuuaaaguaaucaguuucuucuaaaaacuguguuagggauuuuaaaauaugcugaauauuugccaguuaagauuugaaauguugggaguauggggagauugcucaaugauuaaaagcgcuguugcuuguacagaggaccugaguucaguuuucuucacacagccacuuguaacucuagaucugugggcuccaauauccucuuaggccacauauauacaauuaaaauaacaucuuaaaagaacugacaugguaaaaaugcuuaguauuucagcucaugaauauugguauaucuccaauacuuuaauuucucagcaguguuuuuuuaauuuuagaguccaaauucuaccaucaaacucaugucuaaagguuuuguuuugugauuuuugauacuguugugauuauuuauuuauuuauuuguauauuagucuuuguuccgguaucuuugcuaaaaucacucauuuguuggggaaaaucuuuugcugauucuuuugaauuugacucacuugucaaguacaaauaaagacugacuguuugguauacaggugacuuuuguuuugcuuuccuugccuuauugcucugcauagagacaucagaaauguuggauagguggcagcaaguauuguugucuccuuucugauuucaguaauugcauagcaucuucuuucaucacuguauauacaguuucagcuauaauuuuuuuggauugugggaguuuccuucuauuuaguuuuaaaagcauuuuuaaaaauuaggauuauuagacaguacauuuaaaaguucugauuauuugguuuucacugacuuuuauauauguuggcuuuuuaauguauauuacuuguauaccuuaacaggcuucaacauuuuuacaauucauauaauaauacuuugaucauauucauauccuuuguauguagcucuuauuagaagugaagaaagguuuucauagcugagacucaugcaacuuaaaaaaaaguuacacucuauaauucagacuggcgucagauuuguggaguuuucuugccucagcauuccaaaugcuggauuacagguucaagccaccuuuuucuuuggaacugagauaucugauuguauauaaccuaauuucuuauaaaacuuaacuuucagaagcaaacauaguguagaaagcuaaguacugucauauuauguuagaacauguuucucuuggaugaaaggacauuuaacuuuuaacuagguuaaucugauuacacauuuaguuuuugauagcuuguaguggcauaauggauagacucagauaaacuucugauuaacagcagucagccuaaauccauuauguauguaucauggaacuaaacuucuacuuggccuuuauuauuacuuauaagcaguauauuucucucaguuuucuaauggccaugauguuuauuuuccuagauagaaccucuaggaaaccucuaggugguuuugugguagguuuaaucuugauuuuuggaguuagaucugguuuguauacugaacucauuuccuuuauaaguaaguuacaacauuuccaaguuuuaguuucuuuaguuguacaauacagagagcuguuuucuuuccuuuuuuuuuuucuuuuuggauuuauuuauugauguauuuuauguguauugguacuuugucuauguguacaucuguauaccagauggugauaucagacaggugugaacugccauguggguacugggaauuuaacucaggaccaucagaagcaaugauugcucuuaacaacugagccaucucuccagcaccccacccccacccccaaaagcuguuuucuacaugaauuguaucauggcaguuauuguauauuagaauuuggaguugcuuuuuuucucuacaguuacauaguauuuuguuauauggacauauuuuuauuuacuuaauaugaauuuuaauauaguucuuuauuuaaaugacugcauagguauguuuaaccuuuuguuuggaccuuauuuuucgcacauguuguguguauaguacaaaauuuuaagaguauacuugcaggugacuuuagguucacacucccacccauaaacaagagugcuuguuucacaaagucuuuguccaugcucuuucugguaacuguuuuaagaacaaaacuucuuagccagugugguggcacaggccuuuaaucucagcgcuggggaagcagacacaaguagaucucugugaguucaaggccaggcuggucuacagcaaguuguaggacagccagggcuacacaaagaaccccuuucaucaucauuucuauuucuauguauuucuguuauuguagaagagguugaaaaucuuuuuauauauuuacgauuauuuuugccuauuugacuauuagaccagugguauuuacuuacugauuuuuuuucucauugaucacccucccccaauacaugcauuauaacaaaguacguaguaauuuuccuauguguguguucaguucuaugagacuuaucuuuuuaauaauugucuauaugguaaaauaauuuaaacacugauaaaacacagaacacaggagccuucucuaccacagacccuucucuucucccucugucuuuuucuuguucucacuguuuaaaauagaagcuggggguugggauaggggguuuguggagaggaaaccaugaagggggauaacauuugaaauguaaauaaauaaaacaaccaauuaaaaaaagagaaaaaaauauagcauuucugaauagauauuuuaaagucuagaccagcccuuugggguuaccccauuuugauugucuuauggacacuacaaacuuagcuaaacucaguguuuuuccuuauaagcacgucuuacauuaaaauugucugagauauaucaguaguaucauuuuucuguucggaagacuaacuaguaagacucacuagugagaaaguucuuacaguauguuaauucauuuauuuauccaguaaaaaguacuauauauuggaaacuaguggucccuggauaaaagagguauccuucugccagggcaucucucaucacuuuggaaagacaaguagucaguugugcagcugaguaagaagcacugugauuggauaagcaugguacuugaagguuucuaugaagcagugcauagaggagaagaagggaagcuugaauuacauuuguaauuacagaauaugaaucuugauaaggccaaaaacacuucugucacuaucaggggccauaauguugacccaacuuccuuugucuucugugacccuuuguaacgaaccauuaaucugcauuucuauaacuuuaaaucuuauauaaauaaaauuguacuguaugagugagaccuuuuaggauugaccuuuuguguucucuggaaauucauugaaguuguguuuguauauuauuaguuuauucuuuuugauugccaaguuauauucucuaauaugcauacauacaguuuaaucagagugcugaaagacagcuguauuguuuucaguuuuugucuuuugcaaggaaagcugcugugaacauuuucguauaggauuugugaccuucagucuucacugauguauguaaguguccaggaguacaguggauguguuauaugauagcuugauugauuuuuuuuuguauacagaaauuguugaauagguaacacuuuauauuucuaucaaugcuguaugaauucagugagcaugcauauuguuuuuaaaaggaaauaaccacuaagcagaaauagaauaauuguuaauuauagguuucauuauuaugggaaaauauucauguuaguuagaaaacuagagucuaagacaugauuaucuuagguaguaaaugugcagaaaauagagaggugguucauuauugauacuuguauaagugguguuuaugacaaguugauguugaaggacauaauacuuagcauugauucuucucucaugucugguaaacuaaugaucuccuuuuaaaagcaaagagagggagguaacuauucuaugucucuagcugcaaaagacucacuccucuuugugcacuaugugaaacaaugcaguauuguuccuugguucuuuuuguccuuuucagucacacuuaaagagaauaguuaaauuuguugccauaaacaaugagggguaguaauauauuauuaaaaaugccuugaaguuuagaagaauaaaaaauauggcaggcauggagguguacacuuguaaucuugucaaucuggaagcugaagcaggaaggucccaaauuuggaacuagcuuugaacuauauaguagacauauaguaagaacuugucucaauaaaaaacaaaaggagacgacaagggggguggcuuaauagauaaagaugcaagcaugagggcauggcuggaauccccaguacccauuuaaaaacuugagaggcaugguggcucuuuauaaucuccccauucagccaguagagacagagucccuauagcaagcugguugucaauucagugaguuugggugucugugagagaccuugccucacuugguacauggagaguaauuggcaaagacaccugaugucagcuuaugaccucuacaugcauauacacuccaacuaugcaugcacagaugcaagggaaaaaagcaaacuaaaauagccauuuaaaagcaaaguguaaguguaguuuuugugaaggcuaaaguuaaguuagaacauaauaaagagugcuguguagacuaguaaugacaagacgcuauguugauagugccugcacuuaagauguggagagugauacuacuaaagucuuccucccccaacccauacuguuccuacaaugaggaaaacaucaaauagaccccaacuauggaacauuguaugagauaccuauguagcauuccucaaguugauagaucaucacaaaguucuagauacauccacagccuagaggaacauuaaagaaauaugacaucugaauauaauguuuuuuacauaugauccuagaauaggaaaaaaaaaaccuuuaguaacagcuaaagacaucugaauaaagauggauuuugguuaauaaaaagguuuugguaucaguuugcuacucuugcaaacuugccauacuaacuaggaugaaagcaacaggggaacuaggauggggcaccuggaaaguguacuuuuaaagugucuaaagcuuguuauggugugcauaugcucucuaaaaauuuuuuuaaaaaucacauauuaggauuuggaaguggaaaccucugguagacaauuaagaucacacaaggcaauaagcauggggccucaauugauacaucauugacucucacucuuguuugaacaucaucuuguuaugauucacugagaagacccucacuagaauggauguggcuucucacuugggccuucccagccuccagaacuuucagaaauacuuuauuauuacuauuuuaaagaaauuacccaguuugagguauuuugauaugaugacucaaagugaaccaggacagaacccugaacaauaguuugcugaaaugaugguuugguaguuaagacacugugcugacgguugcauaaggauucuacuuagcuucacuaauuaacccuuugauaggguuugauaugucaucauuaaugcaaaagucaagguauguucaacccauaugaaaaaccacauaauaauagaauuuuuguuuauaauuuagagaaaauuccagauuuucuuuaauucuagccaucuccacuccaucccacccccaaaaaaguaaagaaagagaauaaagaaaaaagaucauguaaacuaggaaagagggaguagaagggagaaacagaaaagguacacugccugguaguauaauuaaaauauaaaagauacaacagugauggcacauaguguuggaacuauuuauuagucuuaccaggcuauaacguucaaguguggccucaaaugcauuugaccuagagacuaagcaaugaaauaaaaaauaacccuuuuuuagauuugugaauagagcuuuugaaggccuuuuuagaaauguuaccacgcacucacccacguaggaaacuacaggggacugaaaagaaaaagauauuuuauaaguacgaugaacuagcauguuuuagauguguucuguguauacaguuaaugauccaugguaaugaguaguagucauuucaucuucugaucuguguuugugauauuuauuuuguucccuuuggaagauuugagucaccuuuguuuuauaucugcuauacccuugccugccucccucccucccucccucccucccucccuuccuuccuuccuuucuuccuucuuuccuuccuuccuuccuuccuuccuuccuuccuuccuuccuuccuuccuuccuuuuuuguuuucauggcauuauguacuuguuguuuuuuuucuucuuuguccauaugaugcuaugacauuugcugcuuuucuuggucuuaguuguaucaugaucuucaaaauagccaggcauguuauuuacacgaggcagauaagcacaacccuuguauguccucauuaugucucugagaggugguguggguuuuucccuucuucuuuuuuaaaaaaaauuauuuguuuauuuuuugcuggcaguguuaauaauguuuucauaaaauaugauugauuuauaagucuguuuaacaugccuuucccuuuuugucuuagugcuuugcuucuaaguugcagaugcagugacugaacaauaaacuguguggugugacagguaaauuucccaauuuaccugccgcaauagugugcuguguaaugccauucagucaucucugaauuuuacuugccugauuaguugagugaagcagauuuucaauuuaaauguaacuucaucugcuugauuaaaaauguaacagaacauuaucugcugcaaauaaauuucagaggaagagaugauuuugccuguuuaaaaauaacaucuguuuauauuggcuggaagcaggcgauuaauaccucucuaauuucgagguuuaccaguccagcucaccugucucuuugcauggauaguugaaauugauggcugucgaguauaaacauuuaccuguugauguuuaguugauggauuucuuuuuaaggauaauacagaaucccaucauuuauuugcugcucaucaagaugauugacaguuuugccaacaacauggaaaaaggaucugccuucaugaugcauaugagaaaaauuuuaccccucagugaugagugcccuacagaaaaacagauucucgugaauuccuuuucacaguugcuauuuauuugaauucugaguuuagaggccaugaguauaaauuuaaggcaaguguguaguaaaugaggguacuauccccugcuggcaucuuucaucaagugauuauuuguguuggccacacugacaaagaaaauggaagauagggaaaaacagaauggugguuuuuuuuuuuuuucucuuuucuuuucuucuuuucuuaacccauaguguuuaguauaguguuaggcauguacuagaccacuuaauaaauauuuauugaauuugaauuaaaaauuaggccucaaguauauuugauauccuacaaguguaacucuagauuuuguauuuuaaauguuuaucuguaaaacuauaacaaaaauauuugcaggauugauuucuuucuuuuaaagcuagcuuuuaggaauuuacugaaagguuuuaaaauauacaauucucuaauaaauauuuucuagguaggcauuguucacuguuuauuuuucuuccuugaauagaaagguguaguuaaaaagcauaaugcaaagcauucugacucuaguuaagaggggcugcagcuagugagcuuggcuacguugguaaugcugcagaacaauauguaucaucccagaauuggcauaaacuaugccagucuugagcauagucucaaaaaggucuuuaaaauuuuauccuuacuuuuuaaaauuuauuuuuaaguaguauguaaaaacauaaaauugagcauauuagugagaguuguuucaaugcuggauuuuuuuguagcauauuuugacuucauuuaauugaauaauaauaauaauaauaauaaugauaaugauaauaauaauaauaauauuuuguugacauuauuuuucaacauuuguuuguaacauuuagggguuuugaccacauauauaaaaaaaucaaaacuauauuuuucagguagacauuugauauuugguuuuuaucagauuaaauuuaaucacuaaucaaaaauuaauuuuuagcuuaaauuuugcuuccaaauauauagggcuauuuaaucucaucaguguugauuuagacaucuugggugguuuuguucuucaaauacaaaauaugaauauuggggauuggauucuuagauauggaauccuagauucauccuagugcuuuaggagagcauagacuuauguucuuaucuucuuagaggcuugugaagaugacaauucagauuuaagcuaccuuuaaaauauaaaggacuuuacuauuauuauuauuauuuacuauuauuauuauuuuuagauaaguaucagaaauuuagaauacuucuuggcaggcugagacaggagaauuacaaguuugaggccagccuggacaacacagugagauccucugucaaaauagaaaauggaaauuguaucauauauuucagcauuuuuugucuuuucuucuuguuugugcaaguuuugcguuuuccucuguccagauaaucuuaaaguagaaugaguaaaucagagaacugaguuuauagcaaaauaagaugcuguagguuuugaagauaucuaaccugagaaccccaaaauacccaaauuugaaaucuaauacaacauguuaccacuguggaaaauucuagaucucacaguccaaauggauauacaucacagauuucauaagacuguuuucaagguaugugaauaaaauacaugaguguauuaaauauaagugauuaauaauauaauguguguauguauauacauauaugauauauauuauauuacauauauuuauuauauauggauauauccuaaaaucugaaaaauugaaaucagagacuuuuucucaaguguuaagaagccuucaauguguauuacaugaaauuuguauuauugcuuaguuugcuucauagacuucuuuugcuaguuguuuugugauuugcuguaacuuugaaacauugucacauaauuucaaacaaggugaagaacuugcagagugguguuaaucuuaauaggcaggacuuagaaacaacccaggagccauuaacuaauugaaggauaaacaaaauuguagauuguuacaguaaaacauucagccauauaaaaaugaaauacugaugaauacuauaagugaaccuuguuaacauuccaagugaaagaaaucagauucacaggacuauauucuaugauuucauuuaugugaaaugucucaaauagggaaguucaugaagacagaguagauuugugguugccagggguuagcaggaaagagaauggagaaugacuugguuggguggaggguauauaaguauauagaugauguuuuaugaugaguggcggugaccaaaugacuuaugacuuuacaaagccuguugaauugugccucucauaucauggaugcuaacugauauuaauugaaaaggaguagauggagaaauuuaaagcugcugaguuauugagaaaucauuacgagaagagugucauuauucauucuucuuuuguuuaauuaaggcauugucugcugggaggacugacaagaaugacagggaaguagacuugcaagguagugaugagauugcagucuuaaagcagcauuuuaaauuuuauuauauugacauuuaucaauuauuaacaauuuugcugauuuuuacacaucuuaucuuuuaaagaacacaguuuucuuucaguaauuuaaaaagauauacauaagauagucuugaggaaauucaggcuauccugaaauugugcuguccuuguuuugagauuucagcauucauuucugguagagagguuacagauucuaauuuagauuguaaauaaguuguuaaauuagagaaacaaacacuuggugaauauuuagaaaaauuagugaauuaauaaaaucaagguaaauuuuugaaaaauggaaauauaucuuuuguauuuagucaguaauuuauauccacuaaaaauuuggcagauauuguguuaacaagccagcauuaguuuuauaaaauguucacaugaguaaaaauguccauuuuuaguuuguagcuaauaaagaauauaguaugugccuuuugagaugugauaacauucauuuuguaagucagaggaaaaugccaucuauuugaauauaaaauaucccuuuagcuuucagaaucaaugcagugucgaguauugacugucuuagaggucaguccuaauggauuguacauuauauuauuugaagugugugauuuguucuaagccugcuacagaaaucaguuacuuccaguuauauuuuagaaccacugugugaauguauucuaagguuagcucuaguuacuuaauuuuaaaguugcauuuauuugucaauuuugcauguguguuucuaaauguggguauuuaaguaccaagguacaugugugcagauuagaggccaacuuguaucggucacuuucuuuuccauacggcuccucccaugacgugggucaucugauaugguggcaaacuacuggagccacugagccuuccucccagccaccuguagcuguagaucuugaaggccauguacauccuuaauuuuugcuacuauuucauuaauuugagccauagaaacauguccaaauuuuaaaguauuuuaaaagugccuauaaaaguaguaauuuuaugagguccaaaauaauaauaauuugugucagcuuaccagguaagagugaguacugauagcagacauuuuucuuugucccggaaaucaguucuguuaucuguuaucaugaagaaauaauaugcucagcaagugggauacucaggauuuaaacccaaaaggucuugcuucagaccccagacauuuaaaagauuuuguguaugcugccuuccuacuugcucuaguuccccaagucuauugcaguuuugcaaucugaaaccccauuuugucucugcuguuucucuccuuuucuuuaccuauagaaugguaguacaaauugacuuuuuauugaauugugcuuguauuguaguugugauuuuuuuuucccagaaugcuauggaaugauguaagcauaaaggaaccaaucagcagaauauacuaauaagggauaaaauccaauuccuucaacaaacacacuucaaaauagagagaugagaguucacaaggaaaggaaacuuguaaauaggaaaauacaauaccuaauuuuaaauuauguacuuggauucuuauuuauaacuuauuauaauauaauauggauguuuccuaaagcuuugcaauauaucacgauauuuuuaacaaaauauauugagaacuucacuuuccagcuacuacuacuuuaaugguucuccauugugaaacuccucauaaucuaaccccagauaagacuacuaguucugugugcuaaaacaucauucaauacaguauaauguuuguuuguuuguuuguuuguggaagauuaccguauaccccagguugaugucaggcagcuauguaagcaaugcuagcuucaugccuuuauugccugaggauggcggcuuguacuaccaugcccagcuuacaauauagcuuucaaagcugccaagagcauuuggcuucuucaccuuucucauauuuuaaagguguuauacucuuucuuuaagaguuucagguuacuugcauucaaggguuuucuuuuuuuuaauuuuugucuuccaccucuuguguauggcauuuaaagucuugaaauuugagacaagagagauggaaaaaguuaauccacuucuaagacagaucauuuucagaguaaauuccaaggucgaacaggauauauuuuacuuaauaucuauuagagguagauuuucauaaacuuuuauccaaaguaacuagauagauucauacuuucaguguaaaggguguuaugaaaauguaaaguucauuaauaugcuguauauuuuuaucccuuugaauguaauuuagagauuauauucuauaauaggauuuaugacauuauacuguuuaaucuuuaggguauuacaaacacaucaaggacaguuggcaguaacucagguuugccugcauuuuaacaauguauuaauacuacuaaggaucauguauuuuaguuaaaaggaaacaaaaguuauauugcuagaauguuuacaaauuugaagauaaauuuuucugugggauacaaaauaaauguuuaagaacuagcaagaugaauuaaggaugaaaugauuuauuucuugcauuggguuuuaauauaucagggaugaaacauacacaugcaugcacauacacacuuuacgcgcgcgugugugugcauguaugugugugugcguauguguguguguguauauauauauauacauacauacauauauauaugcacauucaucuaaauaugcaucuucucaauaacuuaaacuuauaaaguggaacaaucuucccacuuugcacuuuaaagcaguucugacuuauuaaagguagguguguugaggugucuuuuuuguuagaaauagcuugacauucuaaaauaggaggugccaaaccaguagcacacgguaaagcuuccuuggugguuuuucuuugugcaaacaaguguauuguuauguaauacaauaagauauauuugggucuuuacaucauugcccagauuuuuuucagccugugauuaauucauuacuuucauuucuuuuuuauugauuuuaauaguuuaaacugcaaaauuuaaaggacaagaacauauguuuucaguuauggucaccucgcacuauuagcaaagacagcuuggcuuuucaagauuuauggguaccugguucuuuaauuuccuuuuuuaaaaguuggaacuaggaacagauaguugcaaguaggguuaguaagaggcuuagugucaaagggcgcaugcuuccuagucccgugacuuaaguucaauccccgggacccgcacaguaggagagaauauugcccucugacuuccagguguguacuguggcacacccuccccaguuaauaaauacauaagugaaagaaugaaugaaugcauguaugcaugcaaguuguggauagcaguuuuaggaagugugucuucuggugugucugaagacagcgacaguauacucauauacauaagauaaauaauuuuuuaaaaagugccagaaagacagagaaugagauuuaauaguuuaaaguaucccaauagaggacauuuuucucacugcagucuuaacugccacugugguuauuguauccaccaucaucaaaaacuauuguuuuauaaagaaaaacaagcuagaacuagacgccuacuacuggaguucucuguuuucacucagugugcacuuccagacuuuggcuauauuaaaguaggccaggggucagcagagaagaaacuguuaaacuugcuaccauuugaugguaguucagauccgccuuaaucagcugcuccauauauccuaagaaagacaggaaugcuuauugcagcuuaccucaaauugaaacugaaaucuuuuccugagugaaaaggaacuuuugucuuauagcuaagucuuucugauuugucuuaaguaagauucuagucuaaauauccuucuguuuucucuagucuaagugucuugauaauuguuucuagcaaagcuuuuguuuguugcaaauauuagaagcaugguagguuucuugcaugcuuguccugucuucucccuugaucuugcucucucugucucuguuuuuaaaucuguuuuaaacuauauaguuuagcaaguauauugaagcugauccugguaccucaaaucugugauggcaguauuugggaggcugaggcaggaggagcaccaugaguucaaggucugucugggcaguagaaugagacucugucucaaaauaaagagggaaaaaauauggaaaucagucaaaauaauucuuucuuccucucuucucuuccuuaucacaacuuuuguauuuacucaguaccuuuacucuccccccccuuccgcccucugaacuacuuccaaaugggugggcaggguuauguagcgagaacacucuuccuccucccccucccccuccuccuucuccucccccccccuccuucuccucucccccacuaccccaaaggcugccuguaucagcuguccuccuggcuaauuauaauuccaaagggcauuaauaaccauuuaaauuaauccuauaauaccugcauuugcuaaaggugaggcucaggcuauuuaacccccuacuaacggacucaaacaugaaucaaaacuaguuagaauuuugcauuuuauuuuugcuauaaggggaaauaacacacacacacacacacacacacacacacacacucuugucuucuugcagccauccaguuucuaauaaugcaaaaaagcuuugccauuuaauacagcuuucauuaagcgaccaaaacuaaauagcuugauuuuuuuuuuuuuuaaagaaacauuuggauugauugugagucuuuugagacagaacuguagaagaccaccuaacagcagauaauccuuuaguuaaaucacaauuuuauaaagagcuaaaaauucccauucuaauaaccaguguuaugauaauuugacaauagcagucucccagggggcauuaugcagaugacaagacaauuacaauuucacaauuccagauaaagaagauuggaaauuaaaugaccagucuuaaaaggaagacucacuccagguuauccagaccaccucguaagugcucugucucagcacaguggaacucgucccuugguuucuagguagauguuuuaguaccaacaagcaguaagaagacagccugcaauauagucagauaccuugucauuuuuagcagagucugucugggaucaguaaacaauacauuguuuucuuucauuuuaccccuugagucacagaguuauucaggaacagcacauuuccucuuuucccugacuccacuguagcuccuuuugagagcagguguauacuacggcaggguuuuggauuaauaugggagaguaaaguuucacaaacuggaccagagagcagcauucuuuggacauguugaggucagaauucugcaacaagggaaaaaacacauuccgaugaaacauuucuuucuauguaauagggugcuucuugaaaaauuguuuuuagugcuaguauaugugccagcuuuggaaaagucuagauucaaucaaggucuaagucaagaaaauuguuuugagaaaaagacaucuucugguaucuccagagcacuccuucaacaaagauaucuuugagucaauagaugucaucccacaccuggcugggacgacucacuccuuuccugauuaccacuuagagauuuuuuucccuuuaagaaaaaaacuuuacacaaaauguaaacuucauacauuugggauuauucuuuggucuggaucuuuucuuugaauaaaacgagcuuugggaugcuuauucagauguucaauggaacaguguggagaacaguaauuguguuugggcuaaagaauuaauccaguuagucaugggaagcaugacuuagcuuuuccuuaguagcugaauuggggugcaaccuaggggcuauuuuaggauuuagacucaaauagaaacuuuuagaauggaaaguuuauuuuuguugaugaacauaugcuuuuguauaaugauccauugacuugauuucaacgaaugugaaauuguuuguuucaguucacuguuauauuaucucuguauuaucccagauuuuaaaaagaucauugucagagagaaugcauuaauauguguuauaauuggaaugucucacagaaggguuauaacuuuaauguuuuugauaguuacagugaaauuacuuuuaucaacaguaauuaugcuccucaaauagaaaaucuuacauguaacaggcuggaaaaggguauuuuagaaagcccuauuuuuacuuuaggagaauaauuauucuguguuugauggaaaacagcaguuuaaauuguuaaaaugguagacaaaagagaauuucucuggugacauuaguugcacaagugcaccugcacuguauucuguauucuacugccuggagaaaauaacuuuuuaaaaaacuuuuuacuugcuuaucaaaacuuguuuaagcuuuugcauuuuccauuguuuuauauacaaguaaauaugaaaaaucaaugagcuaauuggcauugaauagucacucuaugccuaguacuuggugaauucaaucaugaguggaugcauacaacagaaagagcagaguccggucccucauccucauucucucuugguuccuugaagacaguucauagacauaaacucagguaaugugguccuuuggauucgcugcuucuuucacuugcagugcuuuucagagcaguccaguaacugucagaacuuacugcucuuuuaagggcugaauuauaggcauaugucacauuuuugucacucaguuuguagacauuugagguagucucacuuuuuggcuauugggaauaauguuuguugugaauuuuuuuuuuucauacauguuuuuaguucuguugggcauguacuugggauaagaacugcugacucucauuuucucucuuagauuuuagaauuuauuguuuguuaaauguuucuuuccuaccuuccaaucucaccagagaucuccauaucuggucuuaauuacuuucuugaucaccccuauuguuugcaccugaagaaauuguacuuaccuuucuaggcauauuucaaaagaauuuccuauguaagaacuuugcuagcugcucuacaaaagaaucaguuuuguauuguuuuuaacaugacacacagaugauuccuuuauaucaauuuuugugauaucauguaauuauggauauuaguuuuaccagauuaugaauuccugaauauaggaauuauuagcagauuucuccgauguauaaggaaauuccugacacauagcucuuaguguuuuagucaucuuguucaguuuuuucaaaauauaaauaugucauucaugagcacugcuaacuucccaguuucucagacuggcauucaagacauuaaguuucuucccaggcacucccaaauuguucuugcuuuccagcguucuguuucuuguuuuguucuuugugcagaauguuucuuuccauccugucucaaccuuuucacaaccugccuauacuucaagcuauaucuugauuauaacacuagacauauuucuaagacuagacauuauugaauauguucauuuugcuuucugaagauuuaguuaagcaauccaaaguauaaacagucuauuuuuuuccauguguguguguuuguguguuuguguguguguuuguguuugcgugcgccagagauggauguugggugucuccucuaucauccaucuuguuuuaugguuuugcuuguguguguguguuuguuuuugaaauagggucuccuauuagucaucuagauuagcugaccagcaagcucuaugugucugccaccucaccaccauaccaagcuuuuguaucauuguggguuucugaccucaaguucuugugauuuuauacacacacacacuuucuacugagcuaucuccucaggcgcucagacuuauuuuuaaagucuauaaauagaaauuauagcuacaaauuacccuguaacacaugaaucuccaucucguuauacugauuuuuauuuguuuguuuauuucucuauugaccuguauuuuuuuuuuuuaaauaaaaauuccuguuuguuuucauugauggguguaugcucugguuuucuaguaaaaguagugcagaacaacucuuauucuuuggauaaauugguuccugaaagugauaauagauuuaucuaauaacuuaccaccuuucaauggcagauguuuccuggcacugccauauuggauuucuucuuuucuggaggccauacauuuauuuauggcaguucaaguauaaauuuuagaccaggcaugguaggucauacuucuaauuagucccagcacugaggaaacucggguaggggauugacauuugagacagagagaccuggguuuuucauacaagucugcauauauuaaggucgggcucugaaaagugggguagcagccacucuguucauguucaucucuuacaccauaguguguuugaguauauugaggguuauucugguugaggugaugcucuuacuagaagacuggaugguagaaucuagauuacagaaccuuauugcacugugaguuaggaaauaguuuagagagcuuauucaguaaauggguaggaaauuuggaguuaaguagagacuugagcaagaagcauagauccuauagguuaagaagcuaacagaaugaaucaggauucaguguaggguuaauuugaacagcccugagaaaguacaucugaaagguaauucauagugcaggguuagaauaagacagagugaaacuugggcuuugugcagacaacauacucuucauuauuuaaguaaugucuaaguaauaccuucauuguuaucauggaauguuucuugucaaagaaaagauuuauuuuggguguuguucugguuaacuuauuaaaagcuuugugugaaauuaugcuggauuugguuuuaagaauguaagucucauaaauucacagccuggguaacaaauugaaucucuaaauaaaugcucacaaggaauuuaagagaaaaaaaaaucccauuuuuaagagacuagcuaauauuuauuacaaggaauuaauauuuagagaaauucucuauccagaugacaccugugugcuguaucacugcuagcucagaucuuuaguaagacugaagcaguucuugcauccuguuaccucugggaagcacaccaaguacauacaugaugccucacaggcuuggcuggaaaguucucacagcucuuuguuauauugugagucauccguugugagcauuugggagaagaaaaaacaaaguagauuuuguuuguuacuuauucuuuccuaucucugucagaaaaaugaaaauaccaccagaaaauaauauuugugacaugaucacauaagcccgugucuuaugucuuuuaaauuagcauuuagugaagggaaaaacgauuauuuugguguaaauaugguuuguugcaugaugaggaaacaaguuugaauccugaaaaaucaucacaucagaaguauuuuacuauguggagagagugaauggcauuuuaagcaagaaaaacugaacaguauaaaguaagugggauugaggaaguaauuaaugcaauuguguaaaaugucuacuaugaauuaucuacuagaaacacugcacauauuuuacuauaguccaaaauuugagagguaguuuauaguagacugguauuauaggauugaaaguaaauauuacccaaauaacuuugaaguaaaagucucuuaggacuugauaauauaauuaaaaacacugaccaagaaagaaguaaaagaaguugcauuuuuuaaaaugacuuuuaaauguuauccacuacugacaguuaaagggagguuggaagaagauucaguguaguagaugaguugaguucaaauuaccuguuugauuucagugaaggaacugugaagguaccuccagaggaagaguaggaugcuguauuagaaacuaugauacaaauauaucuaguauuuuugguucuggaauuaaucucaaaaaccauaucaucuucuaacauugucuuugccaaacccuaaacucucugccuuuuguuuaucuggcucacacuauccagugcagaaauagguuguagugauuaaugaaagaaggaaguauuagucaucauauuauaaugcaaguuuaucucuagguacagcuacuuuuuaagcucucugauaacaauauugucuauuuaguuuucacaauaagucuuuugcaaagcguuguucacaugaacaaauauuacuuaagguucuauaccagauaaauggacauuugaaauuaaaaaggaccuaauuuaaagaaucaggcaaaauucauugagauagugguuuugcgacuguaaaaccacuguauuaaauauauguucauuuaauuuuuauuauuguuuuuauaucuagcuuuuuguuuuguuuuggcacuagaaaagguaaauaugacauuuggcuuuaguaggaugcgauuuaaaacugagaauuuaaagauaacuuucuucuccagcagguuuuauacuuaaguucucuuguuguuuuauaugaauguugauuagaagcuuucuuguuucauauuaugguuguuauaacauuucuugagagcauugaaagaagaauuuuuaccagauaccuaggauaguccuaaaacggaaucuuuaauuaucuaaaacaauuuuaggucauuauuggauaauuauuaaaaggauuaauuauuauuuuauuguuacacauugguggcauauuaaguauuuauauuugauauuagcaaacauuugagagccaauuuuaauauaucacacuacuuuaaauuuguuguguuuaaggagggaguggucaccacguuaguauuuuacucuauuuauaaggaggaaaaagcaauccagaacaaucaaagccaggcugaagcaacuuguuaaacacucuugcauuagacugucucccccacuucugaugugauacuuugaaggcagcugcuacagauaaacucuggagccccagauggugguugccuaauccucaugagaauucauguccuggagcagcucuuaucucuccagaccugacauugucugcgagcuuucacuaaggagaggauaauauaaacaugcuaugcaugagcuucacuucuugaauaugucagagacacaggaaguuacagcaaaguauaacaagaacagagcucacauuauugaaaguauuauuuaaagcacucgauggcgcuuguguuaagugguauauaguuggcaggaaaugcacaaugaaaucuuuuuuaaaaugccacagccuccaaagccugaauucagaaauguaaauuugucgauaaaggugcuauucucagaauucacuguuaauauaauuugcuuuaaacuaauaauuucaggcaagccauccuuuuaaugaauauuguggcuuuuacuucuuacuugguaacccuuuuuguuugagaaaucaacauaccuauucaguauuuaauaaguucauauuuaauguuuuguuugaaaaauccuaaggauaugauuuguaggaucagagccagagagagcaugauugucuuucugacauaguagccacauguucuaaaaugggaauacagaggcugucugcuucaggcaguaucacauuuaaacugugagcaagggacauugacacuaacucuauguagauaaggaaggggguucuucacagaauuuuccaccaaauggaaagcuauagauguuuuccauaauaaagcucaagguuauaucuugagccuuuugucucuuuccucaaaauaccauaccgucuucuacagccauauuggacuucccacuaacuguagaaucaguagggcccauucauguugucauacauugucucaguguguuuccuuggcuuaucgugcaugcucuuccugaaaaaggcagcuuucaaccccagagacacagcuuacguaucaauucugcgaauccuuuguuggugucauuuuguuuuguuuguuucuagauuuacuuuuacuuaucacuuaucuugcuugugugugcacaugcauauauguggggcuacuucaccauagcacucauguggcagucagaggacaccuauaggaguagguucugucauucuaccauguagguuccugagaucaaaaucagucuuuaaccucccgagcugcccuugagacucuuuuguuuuucccugcuucuagaacuuuauagcuagaauaauuuuugcaaauuauagguuugccagacauuaugguacauguguucucuuagcauuugggaggugagagaguguaaguucaaggccagccuuugcuacuuaguucaagaacagguuaagccguauaaccagacucuuucucuacaauaaacaaaagagcuauaagcugugugagugguuggguauagcaguagucucuacauucuggaggcagaagcagaagauugcaggucugugcccagacccuauuuccaaagcaaaggaacccaagcuugggguagaugggcugaauggugggggaaagaagcgguucuagagacccguguuccacauaauagguuuuuacaguaagcuaauugaugaugcuuauugugguuuuucuuugucuugcuguauccaguucuguuguguucuguguagucaugcagccugacauggagugcuuaccaucuguguccacugcugcuacccacugaccuccucugcugcuuccuuuuucuuucuuguuuguuucacccugucauccacaugguuuggagggaugguaacaagggcucuuaguguauucaaaggccaauggaaacaugcuguacaaucucucaucacauuguuuuccauuuuuaaaaaccaaaacaaaaagaccaugcuggcuguggcugugaucccuuucuucuuugguggucuucacuccaccucuuuguaacucacucugcucacugucuuuguaaaagcucauguuucuuauuuuugcuucccucucuuaauuuucuuuuucucaauuuuccccuuuccucuaauugccccaccccacaugcauguaccaucuugugcuaggauggagcauggagcuuuagacaugcuaccauugcuccccuuucucugaguuucauucuacacccccacgucugccuucauuaccguuaucuugucucccuuucccauccuagguuguaugucauguuucaaacacauguaccagucccacuuugcuuccauaguaucugucacaugcacugaucccacgcugcccugacauguauuacucuucucauaugccuugacuguaauaaaucuuuaaaaaauuauuaucagcucacuuuuuguuaguuucauacaugacucugugcuuccuucugucaucuucccuugucuuaauauguguguuuuauucaguccguaaagaugaggaagguguacagcugagugcugagguauuuacugucucuuagaaacuuuagugcuaaguuagaaacaggagucagugcaaaaagaaaaacaagacucaaauaaaaagcucgaggagauccugcacauuuuucuccagauguagcuagcuaaguguagucuucaucucucaucaagaaagucucucuuugcagcagaugagaccacuauagaaaacuacaaccaaucaaaaugcaguguuguggaauccaggccuaacugaugauaucugcaacacagcuccggagccuaaggcucagggagcauugcagaagagggggaagcaagauuguuacgagcugaucaagaaaacgguugugaggcugucuccagaaggucagaagcuaaacucguagucucaccaacacaacuccucagacaugaacugaacaaauacggcagacauggaaaggggaaguucaggaccucaacccuagaugaagaacugcaggcaguuaaggagcugagagcaggagaagcacugucccucagcgacgagcacaccaagugguuaccugacaccaaaugguuaugugagcaucaucuaauggacauccagugcugguuuuaagagcuuguguagucuauguaggaaauaaugaauauacaaauuaggauuuauuuuacauggucucccagaguccuaguucaaaauacugcuaacuuacaguaucauuugaucccacaguggauucccacauccagaaugucuuugguaugcuguguauagauaaaauuagcugaguaugcuauagaaaaaaauuauauuuuauagauucaguuuguuaauacaaacuagacuuucuuucuuguuuauuuuauauuaccucaacaggacuugagauagauugaaauaaaggcaguuaugcauaagcuagaagacaauaagucaaauggugugcagcuguuucccuuaggaauauuuaaugaaaugacgccuggccguaaacauuacauuagaucuuagccuugacaacuaagacagugaaaaauauaauggacuauaugcuuauuaaagagauguacauuuuaaucuuaaguuucuucauguuuaugcugcauuauguccuuaaacucucuggaauaagcacugucuagaucuauguuuuagcacaauaaaauuuuuaguucaaauuaccaaguggcuuuuucaagaaaaugagcuguuucaagaaaaugacuucuuuuggcaaaaacagcaaugcaaaaguagcuuuuuguauagagcugccacuuacaaugagcucccgagaaaucaccgggaagaccguggacaaaucagaagcucuggguucaaaugagcuccagauagacauuuggccuuccuuuggacuccgugacccugggugcugaacagccucauugaccuuuaguuuccucacuuuaaguuacggcuaauaacauuuacgaauguguccucagcucaguauggguuuuccagaaaaaacagaccuuagguuuuguuauuuaacccugacaaauuauuuaacauauucaaucuugguuuucucacuuguaaacaaacauuaacaauaguauuaauacuggacuaauuguuaaaaaaaaagauaagagcacuuaauuacucaguauagccauuauuaaugauaauguaauguaaauauuuucauugaaaaugguauuuguuugaccuaaauacauugaauuaaauguugguauauuuguguaccaguaguggguuacaaaguaaaagaaagcucuuaaauaucugccuggauuguugauauuucuggcaguauuuaagcucuuauaaaaucacagucaugagcauuacaaguucagcccucaguguuaccuugugaugguuaauguugucaacuuuagagauuagacuaccuagacucaguuaagagaagguccuguggguuugccugggagcgauuaucuugaucauguuuaccaggggaacaggaauugccacugugggucaguucccugcuugggauucuggacuaaaaagagagaaagggacuaagcaguagcaugcagucauugcucucugcuuccugauuauggaugugaugugacaguugcuuucugcgagacuguauccuuaaacugugagccaaaacaaacucuugcuuuuguuagagauuuuaucacagcaacagguaaagaaauuaagacaccacacacuccucucaaauuuaaaucauaguaauuugaguacaagcaaaagauucccuuauauucccacagcuaugauugcauagaucauucuagacaacugaccauuauguuuagguacagccuucugucacgguaggaaagauagcuuguuugucaugcuuacuaguaauuagaaugcuguaauagucuauacugcuuuuuugaugacaauauacccucuaaguucacgaacccaguuucuuuuguuugcguauccucgagaaucugguauaucgugcacuugcuuugcugcucagcacuggcacuguuucccucacacugcaucauucugcaucacuccagcacggugccaggcugcuaacugcuccaugcucugguguuaucugugcacuuguacuuacucagaauugaguauuucuuuguaguuuuguguguuuucgauacaucuccuucuccuugaaauuguaccaguccuuuuguuguuagguacauacauguuaaauaaauguuaugucuucuuugaagacugauuucucugcuauaauaugaugccccuguuuaucccugagccucuaagcauagugugaugugucuggucuaacauaagggacauucucacagucgcuuuacaugucuauucuguuuucucuguuuccuuggaggaucccaucauucauuuaugaaauguuuuguaacugcccauauuucucagacauuucguuuagguuuuucacucucucuuuucuuuucaguuuuggaaguuucuguuuuaauaguuacacauucucugaugugugcuuaacuagggaaugaucaaagacauuuguuuuuaaaguguuauuuguagcuuuucugauuccuucuuuauagaguuuuuaucucugccuaucuggcuugcauaaaaugugugcuguuuccauuagaauauuaaccagaauuuaaaaauucccagugugauauuuguaacaucugugcugugcuacaguggauuugaugcuuguuuggguucuuugacuguggggguuuuuuguuuguuuugguuuuugguuuuuacugacaccugccacuuuuuuguuguuguugaaugguauaaauuguaugacagaaaaaaaguacuauauaauaaguaagcuuuuauuaauauaaugcuauaguguggggguaggagaagcacucuuugguuuauaauuuuuagccuuuaggcgacccugugccuggcugugauuuuccuuguugcuucugggucuuguccuugccuacuguuaaaugagacgaaaugauuagcagggguugaaauuggcauugcucuuccccaagguagggaaaacgcugauaacacucuuaagucaagugcugcuaaauguuuauuugaggaaaauuuugacuuaaaaauucuuucaaaugcuuucucugcccccuccuugauggcuguaugaggcaauuuuucucggguagucaugugaggacaugguagaucucucugaaauaaaacucaaaaagcuguggagguccuuauaugauuuggucccucuagaauuuuuaaccuuuaaaggugucuuguuucuagccauuuauagauuacagcuuagguuuucucaccagggcauugguucuuuggagauuucaguucucauccuuuuccuucaggagguuugauucugucugccugucccuuuaauuuuagguauaauacuuugucacaggacuugcuucucuuuuggugacuucuguuugucuguuugauacugaaucucacuuuguagaccagacugaccuugaauuuauaaaacccaccuuccucugccuucugaguggcaggcuuacagggguuuaccaccacgccccgagagugagugcgcugacuucuguuucuuauuugcugaacuagaaaccaaaaauauagaagcuugcuuuuguuccccuugaacauuguuacagcuuuguccuugcuauuaaucaugcaaaaucuugucuacuugggagucacuuuucauagauuguuguauauucuuuugagcauagguaauauuuuacuuaugucauaugucucguagaggaaucuuaauccagcugcuuuggcaagggaucucauccaaagaccuucuaggucugaacgauccagcaggaaugcagacauacccuucgcacacacuuuuaguuccuaacaaugaagguaagguuaguuuauaaaaggaaacagccauauuugaauuaggcaucuaguugagaggcaaagugacaaaucagaguaagauuugacagaauaagucagagauaggauaugaagguuuagauaggaaaagcaacucacaugagaacagcacaagaaagagcagagagggcaaggcagggaggagaguguaaugugguguuuguguauggcaguuuuacagauaccaguugcaggugaagacauaaugagccagagaaagagaaggagccagaaaauuagaacagauuuagccaaagucaguaugaggccaaguagaagcagugagaagccagacuaaaucagucagcuuggaagguuagauuguauggaggcuagaagcuuccaggccuaggccuagggauagaaaugcucuaaguucauccuaagccuucuauucacacaguuuggguacaacucucaucccauaccauaaugagagaaaauaaaagcgacauuuacagugucuaauuuagggcuguuugauugauuacuaaaaauaauaccuuguggggucuuuggauucuguuaugcuucuccaaagagacuuguuuguuuuucaaagcugacaguugacuauauuuaaacuucuucggccccaauuucuaaaucuuuuaagaugggguuauugaaaaauuggggagaguaaagagucaguguauaugaauucccuacauaagaaacuauucuagggcuggagagauggcucaguaguuaagagcacugacuguucucccaaagguccugaguucaauucccagcaaccacaugauggcucacaaccauguguaauggggucggauucacuuuucuggugugucugaagacagugacaguguacucauauaaauaaaaauaaauaaacuuuaaaagaaacuauucuauauuuuuacaaaaauaacagcauauauauuuuuccucuuguaaauugauauuuagcaguguugcauauguauuaguaaagcauuguuauauaaaaagcucagaauugucauauuugaugguguuuuuaagugagaucuuuuugguuugggagucuucugucuuuucugacuucuaaauuuuucugcuguuuaagucauuuucuuaccuugacagucaguuuucaucuuucuauacuuugugaauucucuugcuuuccuuucuuauuugaaguuucuaguuaccugaagagaaaugccauagcugaauuaauuuaggaacguaucuuagggguuggguggagugguguauagcucagaaccuagauaguugagacugaagaaugagaguucaaggccagucugggcuacauagucauuuuucuugccucccaaguaugugauagauguguaauuuuggugaccuuuacacuuacauuucuuuuacugcacuuuagaugaauuugagacccagaauucuuuugggggggggguuguuuguuuguuuguuuuucaagacaggguuucucuguguagcccuggcuguccuggcacucacuuuguagaccaggcuggccucgaacucagaagucugccugccccugccuccugagugcugggauuaaaggcuugugccaccaugcucggcugagacccagaauucuuaauuuaaagcuucuuuuuuuuuuuuuuuuaaaaaaaagaaacuauagauuuuccaaaaacugauuuauuaggguagacuaugccguucagauuuuuuuaauguuaaaauuguuaaggaauggaguaucuuuuuuuccuuaaagucuuuaaaagguuaguuauaagaaaaagccccauuuuguuucuaguaaaagaaugugacucucccaccuagaguaaaacuauuuuaaaccauguuuucaugaucauucucuuucaauaaucagacaagugaauaguuuggcuauguaaguucuuaggcauugauacuccugcccuguucugugucugucuuguucacuuuagauuuugaaaugaaaguuuuaguguauuuucugauuuaacuccugaagcacacucuacuuguuuuacauacacauacuugguuuguuuacagucaguucuuucucaauuuuaaccaugauacccuacguagaaaagaaguguaagaguaaaaauagauguaguagugugaaugagacugcgcaguaggaaaaagugagugccgugugcagcugcuauauuggugagugugggcuggccgcauccuuaccugaacuacuuucugguagucuacauccacacuagcagcaaguccgucauuuuaaagccuuugaaauauagaucaggaugugggccugauagauacuauaauucagcauuucuagagucugaaggaagaccaucaauucugaaaucaugaguuuguuuguguacuggcuaguuuugugucaacuugacacaguuggaguuaucacagagaaaggaccuucaauugaggaaaugccuccaugagauccaacuguaaggcauuuucucaauuagugaucaagggggaaaggccccuugugggugggaccaucucugggcugguagucuugguucuauaagagagcaggcugagcaagccaggggaagcaagccaguaaguaacaucccuccauggcuucugcaucagcuccuguuuccugaccuccuugaguuccaguccugacuuccuuggugaugaacagcaguauggaaguguaagccgaauaaaccccguuucuccccaauuugcuucuuggucaugguguuugugcaggaauagaaacccugauuaagacaguuuguaacaaggucuuacuauuuacccucauuugaucugcuuaguucucccuaugaaguucagguuggccucacauuggugacaugcuaccuacuucaaccuccuaagugcugaguucacaggcuuacaacaccagagccagccuucaguaguaucuuuugagucaaugcagugaggguaagaaguaguuaaacugguaagagaaacaccugaucuuaugccaacauuaguauggcgaagacguguggaaagugguuuaagucagauucuugaggcuaggaaguacuggaguagugggccucuuggugcugaggaucaccugcuggccuaacugccuaggcagaaaauaauacacaaguuaaaggcuuuucugaauucucccuccaccccugcucucagcccucaagcagcgccauggacaaaguuacuucucucauuugccuauuugagucuacuauaagauuagcucuugauggugagugucagaaaguaaggaggguacacaagcuuuccugccuucugaguuauugcuguggccauuuuccaguuuccucacagcuugacuuugcucccuauagugacuggcucucaucucccuggccucuuuuuuuuuuuuuuuuuuuuuuuuuuggucaggaagaguauuauauaugugcacuuuaucucugaauacugaaagaguacuuguuaaacugacaguagauaugacuguugguugcuacuugacagagagauugacaccuaacagucugcgucucagugaagggcauuuaggagauugaugugagaagcugugcuuuaacagggaaaaaacuguauugaugaacaacucguauuuguaguacuaaaaaguguccuuucuguguauauucugagauaagguguauucagggugguauagccacuguggaacggucuguguguguguguguguguguguguguguguguguguguauguguauguauauauauauguguguguguguguguguguguguacacauacacacauauauguuuguguguguauaaauauaucuauucuguauauauggcuuugucuuauagaucuucauacaauaaauaaaaacaugacaaacacugaaaaauuugaagacucuaguggcuaguagccagcaaaauuuaucucauccauuuauuuuuuacaucucauugauucuucuccuguuuugacagucgcaguguuuaguaauauaacacugugaccaauacaugaggcauuucauaauacccuguccccaacacagacuuaccuuccaaaguagugcgccuuaccucccucuaauacucccuuccuugugugcuccagcuuccaugcgguuccucaugggcucuccaggccugucuuggaaaggagagggucaaguucuuuauuuuuuuucagguucuaaucucuucugcauguauguugccuuuaguaggguucuguaacuugaagaauguuugaaagugacuccaucuguguggcugaaugguaaguccauguaucucucacugacacccaucucucaugugccucucuacucacacacuuccaagacuucuccccuccaccugcuguggcuuuccuuuccucgguacuuccugcucuccagcccucauaacaugcuagacuuucuuauuacuuucaguaguugacaguuuaggcccacaguuuguaugaauguauucuaaaguauugauggauaauguguuaauaaaugugucagugauuaugauacuguauuuuauuuuaaccugguguuauuuaaaaauaaagcaagcuguauaucuaauguagguuauguuuuuucugaguuuuguuauuucaaauuuuacagaaaaguuauauuuaucccaauaguugauuuuuuuuuuuccuccuuagcuccuggacaaaugguguacuauaaauuucuaacaauuacugaaaaaauuuuaauaacuauagugcauuuuacaggaaaacauguuauuuuccuuuuauuuuagugguaaaauacuuaguacucuaaaauauuuagucugauauuacagauuuuuaaauuuauauaguauauguaaaguaucuuauaaagacaauucuuuuuauuucuauuuauuuuuaauuuuuauuucucugaauauguccauguauguguaugugugagacagagggcacaggaaacuguccagagucagccuucucuuucaaacccguggaucccaggugacaacaggcuuacuggcguuuuuauccacugagcuaucuagccagcccugggaauguuugaaguuucagguuucaugcuuuagaaguaggaugucagugacugaugcaguuuuguuuggcauuuuccacuguggaaaugaagcucaacagucuguaaaggguaaacacuaaugucucaggcauucaaaucaguccugggaagucaguggcugaacagaaaugacuggccccuccaggccguaggcuuuuuguuuauuuugauuuuaauguuugaacacaguuuugguuguuaaagcugaaguggcauaaucacuacuggcuuuuacugaguagccacuaauaucauaccuugaacaacauacuuaaaccauaaauacuguucuagccccaaaucccuauagucccaagauugugaaaggugaacuuuauaaagauaaaugaugcucuaauguuucuguguagucaugcaaguuuagauacccuagugauucccuuuuaaagcguuuugaacaaacauuuucgugaaaaagccuaguguggaggucuacacuuuauucucagcacucuggaggcagaagcagacugauuucuaugacucugaguccagccuggucuacacaaugaguuccaguuggcaggcuuaguaauuauauuuguguauauuccuccuuauaucuguuaacaaucaguaucagugagaugaaauaaaaauuaguuguaguuuauauuucuaucaacaguggaauuugaaagcuuuuguauaaacuaacggcagcucaguucagacuccaaagucaccauugaacagaauagaccuguuuccuaaucggcagaauugcuuucuacuaaagauuuaacuaaaacagcacuuuuuuuguuaacugucuagccuacaguccuagcacugcaaaggccgagacaggagagucacaaauucaaguugggccccaugguaugacccuaucuuagagaaaugaaaaaguuuuaguauuuccccuuccaccaccugccuuauuacccaaacacguugcugccacugucuaugcuuaagguaacacuaaaguauacuacuguuaacaucuauauuuucaguacccuuucccauacauguauaaugagcauuugaaaaauauguguuucacgcuaugaaauacauagagauuaauuuguugguuauuuuaacuuaccucucugaagcauauuuucucacuuuuacacuacauacucccugguuaauauggugcuucguuuuuuaucccaugugcacgaagggcuuggcugggguagaaugaggauuaaaccaggaccucuccugugguuagcaaaagccguaacccuugagcuguaucccaccccuugacuuuucuuuguaauggaugugccagcauuuauuaagcuacucuuuaagauacuuaguugguuucaacuuuuugaaacuauuuugaacaauauuaugucuaaauuucauuuucuuuuuuuuuuauuacguauuuuccucaauuacauuuccaaugcuaucccaaaagucccccauacccuccccccccacucuccccccucccacuuuuuuggcccuggcguuccccuguacuggggcauauaaaguuugcaugaccaauuggccucucuuuccauugauggccgacuaggccaucuuuugauacauaugcagcuagagucaagagcuccgggguacugguuaguucauaauguuguugcaccuacaggguugcagaucccuuuagcuccuuggauacuuucucuagcuccuccauugggggcccugugauccauccaauaguugacugugagcauccacuucuguguuugcuaggccccggccuagucucacaagggacagcuauaucaggguccuuucagcaaacgcuaguguaugcaauggugucaucguuuggagcuaauuauaggauggaucccuggauauggcagucucuagaugguccauccuuuugucucagcuccaaacuuugucucuguaacuccuuccaugggugauuguuuccaauucuaagaaggggcaaaguguccacacuuuggucuucguucuucuugaguuucauguguuuuacaaauugucucuuauaucuuggguauacuaaguuucugggcuaauauccacuuaucagugagcacauauugugugaguuccuuugugauuguguuaccucacucaggaugaugcccuccagguccauccauuugccuaggaauuucauaaauucauucuuuuuaauagcugaguaguacucccuuguguaaauguaccacauuuuuuguauccauuucucuguugaggggcaucuggguucuuuccaccuucuggcuauuauaaauaaggcugcuaugaacauaguggagcauguguccuucuuaccaguuggggcaucuucuggauauaugcccaggagagguauugcgggauccuccgguaguacuauguccaauuuucugaggaaccgccagacugauuuccagagugguuguacaagccugcaaucucaccaacaauggaggaguguuccucuuucuccacauccucgccagcaucugcugucaccugaguuuuugaucuuagccauucugacuggugugagguggaaucuuuugcauuucucugcugauuaaggaugcugagcauuuuuucaggugcuucucagccauucgguauuccucaggugagaauucuuuguuuagcucugagccccauaaauuucauuuucuaacaauguaauuguuuaguuguauuuagugcuaagaaggaguaaugaggacaagguacauugucugcacuugaucuuuuucuggaaauugcauuugauagauauuuuauuacacacugugugauaacuuuaugucacaaaagacucugccuccucacaauuuugauuacuccucagcuuggguaggucccaccccaccccaacccccacucccacccccacccccgggugugacuccugccuuaaaggagacaaacaacuauuucaggcaagacaaauuuuacaaaaaacccugcaggucucuugaauguagaaagaaaugcuuauaaauuauguagguaaauagauuauuuuaagaaauauuuuaaauuucaaaaccgguaaaagguaaaacagaccaaaacaaugaauugcuuuauugauaaaaagauccuaaagcuaucuuuagauaaguuucucaguuuugaaaugugcuuauuuaucugauaauuaugcaucuuuggauaccaaguaaauguuagauucauuaaucugcaaaguagguuguaaaauacuccagauucuaguucuagaugugcuguuguugacuaguuguacaaauaugucagaguuuuaccuccugggaucucuuuuucuuauuguauacuugaauuguuuuuaaauuuuucaguucuccaguguucuggucuauuaacuugcacauucuuuuaaaggaaugugugauauaaucauauauucauuuaauaaggcugucuucaaauuuacauuuccccaaguuauugcagaauaaauagaucaacaacauugaaaagccagaagggaacugaaggugagaagcauuuuuacuuaaaaguuuuuugguucuuaaccaacauuugguaugauacuugcucugugugugugucugugugcgugagugugugaguguguguguguauguugaaauucaucaaccaucaaccaagaagauuauuuucuauuccagauauuuuauaaaacaucauuuauucuguuuuucuuccccaaaagacauuuggaacucaaauuuacauaucuaaguggcaaagcgcuaaacuuuaauuauccaguaguuuaacauaaaaucauacuguaacagucauuaacauauuugaguaugcuauauaaguucagaguaugaauuauguauuagugagcaaugcugcauugagguaauuuuuauguuguuggauugugcuuacaauaagaaagcaauuuuuagagaugauacuguuuccagauguuuagaaaaauguuuuuaugguauuuugaaugaccuaugcaauuugaaagucuuaugcuuuugaaacauuguuaugaaacauuaaccuuuccaauagauuuauuucaugguuuuauauuuuaaaaauccauucacuauaucacuaucuaauuaagaauaugauauuuuaaaaucugcuuuuaagaaauaaugugcuauuucccugaucaauaguauagaacuagaauuagguuuaacagaaugaaugcuucuggacuguucuacaaccaagagacuuaauuuuaaucucuugugcuauuucagaauuuuuauuauuauguuugauaauucugcauuguuggaaaaaguaguucgugacaaacagauuuaaggcauagaagauacucuuuuccaacauugacaguaauaaguuuaauuucuaagcauucagggguuuuugcauuuuuuauggaggcugaauuauuagccuuugugaagcuaauuuuacaaaguaguugaagaaagggaaauuucuuuuguaaucucagaaauuagggucaagagaauaagaacuuuauuuuguagguuauauuaaauuuuaauaacauugauauucugcuugcuuuacaaaaccuuuauuacaaacaguuaugaauaugaacaucucauuugacuacugaugaacagaggggaaaaucuaaauuaaaacuuuaaauaccacuauuuaauuacccaaauggcuuugccuguguuaaagagugccugggauuauucuguuuuucaauuuguuuuaaugcuuccuugguaaaagcugauggauucccaggcccauugcugucacugaugaacuauauaaagauaaaugacauuaugguaaauuccacuuaaugacacauuuuuaauuuucagaacacagacauuuucaggcuagugaaugaaggcuaauuaccucaagaucagaacaaaauaacuccucauuucgaaagauaauagaaaagaaauguugcagauuaaugaugcuauuuaucuuuaaaggaaaaaaauuuuaucuuuauccagauagcuuagcucccggaggagcaugguuauaaaaugaaucugaagucgcaacuuaauagguuauuaaaauugugagugcaggcucuccugcuuagucuuuccauaaauuuaaauggaaggucugcuguauucaggaagcagcagcuuguuuaugaggccagggggaacaacaucaguuacugacaaaagaagcacuuaaccucauucuaacaccuucuuuauuucucugaaugaagcccaacuauuugaaaagauauuuugaaauuauguuaccacuuuuaauugauaccugcauggaagaaccacaguuggacuuacucaauuaagaauaaaauaaaaacgaauucuaaaugcuugauacuuuuacugaauacauauaaauaauuuuguaauccaauuuuauuguaugcugauauguguacaacuuuaaauauuuucauuuuguuacauaagaagguuccguuuuuguggucauaguugaaauugacuuuaaaacuguucaauaaacuguuauucacaguuagaggauuagcaauaauccuuuuucuguacccacagaauaaacaguguagugguacagguuuuauuacuucugacuaugucuacgucuacacuguaaucauuugcucugguacuacaguauuuuuaacuauggaaucauauagaauauuguauccuuccauuauuuuuagauacugugguuugcucauguauuuauuauauuucugggccacuuaaaagugcuuauuauggccacucuaccuuagaaauaaacauguuccuuacauuauauagaaauugcaguauauuuuauuauuuuucuuugugauuuuuaucugccccaaauaguuagaagauauguguuuuaucucuuagggacaauagccucaaucuguuaagaugcuucauagacgaguuaacaauaagauuccuuguaauuugauaguauuuuugcugcuaugaaagccucuuuauuuuuaacacauuccuaaguaauuuugauucuguacucuagaggugauuuuaauuucugauaagacaaccuaaaauuuauucugaagucacauaauuuauuuuaaaagauauaaguucuauaaaaugcacuuauuuauguauuaagacagaugugucuuaacacaaccaccacccaauacuaagagucaaacccaggacuuugcaaaugcugagugcuuuuuuuuuuuuuuucccuuuuccuuuuuuuccuuucuccgagacaggguuucucuguguagcccuggcuguccuggaacucacucuguagaccaggcuggccucugccucccaagcugagugcuuuauauugagugauaaaucuggauaucucucucucucucucucucucucucucucucucucuaauguugguauuaauuuauugccauuuauuugaaguaucuagcacuauacccuaucagauuuuucuuuuuccuuucuuuccuuucuuucuuucucuuccuuuucuuaaacaaacaaacaauuugcuauaggagccgggcgugguggcacacgccuuuaaucccagcacuugggaggcagaggcaggcggauuucugaguucgaggccagccuggucuacaaagugagcuccagcacagccagagcuauaaagagaaacccugucucgaaaaaccaaaaaaaaccaaaaaccaaaccaaaccaaaacaaaacaaaacaacaaaaaaaaaaacuagacuccacaauuugcuauagguuuacccaucuuaacagugucuuggaaaagaaacugauaagaacucugugguuuauguuuuauggucaauauauuuuuacuauggaagcaacugaauuggcuuaauauugggcacauuugcuucuauaaugaucuucuuucuaguucucaauaagaauaaucacaaaagugaaaagaaaggauguguuguguguaagagaaauugcuaaaaugcauuguucuguaaguuccauuuccaaauauggcaggcaguaugugguguaaaucacagacuucacuguacaucugugaacaugacauggcuguuauuucucaguggcucuagucuuauguuauuauacuaggugcccuauuaaccgugcauacggaagaacugaaaauugugcagaauggaaagaaaacuaggauggucuguaaugauaguuggcauacucuaccuugaaaucaaucauacgaaauuuaugcuaaacacuguaguaagauggagagauggccaguauugaagaccacuuguaacuccuccagagaacccacgucaguaccuagcaccccaucagacagcucaccagccaccugacaguuccaaggauccagcacccucucuggcuucugaguccacacaugcgugcaugcguacacacacagacacauaccaccuuuuaaaaacaaguuuaauaaauacauauaccaguauuuuguaggauuggucauauaaaaaauucuuucuguuuauuaacaauggauaguaaacuaauucuuuuaaaugacacuugcuaaaaaaugaaauauguacagaguagucgcauuaaagguagguaauagcuuuacacugaaaacuaaaacacaaaguagagaaccuaaaaugaaaagccauguaauauauguauuguucuuaccuaugucagugaaaagguaaguggcuguccuuuguuuuuacuuggauggcacuaucugagcuggugauaguacauuugggaauacaaaagaauguagagcagagugaagaucaugagaugcucuagacagagaaaugggacugguuuucaaccaugaaaugauaggcuuucuaacacauuuuuacuaaaccaaucagauagcuaaaaugcugaaaauaaacuggugucuuccaucacgugacgugagcaguugacuuguaacauuucauaggguuaaauuugagaauaaaugaaagauccaaacacaaaauggacaccuuggaugaaucaaauauuagaagaacaagaccuaagaaacacaaacuagaagcagaaaauguuaaauguuuauuuuucagagauauuuaaggaacuaaagcgcaagccacagaccuggaaaaaguauuuacaaaggaucuguguccagaggacacaaagaacuucacaacuuaagaggaagauaauaaucaaggggaaguuggguaaagaacuuagauuuauuuaccacagaagauauuuagauggcauaaauguuuaugaaaaaaauaagucauuagccacuaggaaauuaaacuugaagucacuugccugauaugugcaaggcuccuggcucagucuccguaccaaaacaccaaacaaucauuuaggauggauuauggagugauaucuguauuuacucuccaauguccauuugccaguuucuuuuuugcuuuuuguauuuuucugauaaucagauuguugagcuuuauauauuuaucuuuuauuagacuaucuuauugaaaaucauauauuuuaacucagcaugaaguugauugauguaaaaguuuaaaauauuuuaauuguauuauuuauuugugugugcguuugugugauuguaucuguguggggcugcaugcgugcuauugcacggguguggaggccagaggacaaguggcaggaguugguucuucuuccacaacauugguucuuggggucaaacucaggucaccaagcuugguaggaagcacuuuauucacugaacccuuuuuccagccccagaaugaaagucuuuauggcuuauaaaacauaugauuuuuaugguugagaacuuggcuguucuuauuucuauauccuaacuagaacuuuuugaugugauagugaagcauucacuguuuaaagcugaagagaugcugaguucagauguauguauggugguaucucagcuaccccucgcaacauuaggccagaauccuggagaagcuuuaaggauugugaugugucuaaccucagcaaaugauuguugagccauaguuaauaggugaaagaugguguccauguuugguacugucauaugaguccacaguuauuuacauaucuucacuguuuuuauuccuuccuucuguccuauuauauaauccuggagggguuuuuguuuuuguuuuucugguaguuacuuuucuggaaacaguuuuauuauguuugugguuauuuugaacacauguguuucucuuaauacuguugucauuaauguuuacacuuucuuacuuuguaaauugcacgugugcacuuuguggaacacauucucuuggguuuuuuguuguuguugcuuuguuuuguuuguuuuucgagacaggguuucucuguguagcccuggcuguccuggaacucacucuguagaccaggcuggccucgaacucagaaauccaccugccucugccucccaagugcuggaacuaaaggcaugugcuaccagugcccagcacacauucucuucuuccauuuuugucugaauuccugggcucagacucaggucuccaggcuuacagagcaaacaucuuaccugcugagccaucuuuccagcauaguaccugcauuuguucagcugaguuuguuaaaggagaggaauauguucuauauagaaaaaaacaaaucuguuaaucacaucuguaugaagcaccuggauauaaaucaauaaugcagagacucaaagacucugaaagaguguaucuugcuaaaacucaagaaguuguacauucuucauuuggugauucuauauucuguacccuucaauuuuggauacccaucagaaucaucuggauaauuuaaagccuuguuuccugccuuaaccuugucuagagaaauucuugaugugagaaucccauggaauuuuaaauucugucuacaacugaagucauauauccuggcccuaucucaccucccugcuuugucaaguggugcuaaauccagaacuuugugcauacuagacaaaguguucuauaccuauauccccaucucugauugaaauuuucuuaaacucaaaugacuuuuccucuucucuccccuucccugaccucaauuuucuuucaagaucgccccaaguugaccucagacuugccuuccucuugauuuaguuucccagugcuaagaugacaagcccaagagacuuuuagauggauaguuaaaaucuuucauuuaaucucuuaaaugaaagauucucuuuugaugcaaguauaaauucaugguuuuguuguuuugauauauaagaagagaaguugcuggcucaacuuuaguacucauuuaagggcuggagagauggcucagcaguuaagagcaccagcugcucuuccagagguccugaguucaauuucuagcaaccacaggguggcucacaaccaucuguaaugggaucugauguggcuucuucuggugucugaagacagcuacaguguacuuauauauaaaauaaucauuuauaaguaugagaaacuugugguuugugcuuucuguuuaaaguuauucauuaucauuucucaaagagcaauaucauggauuugaugauacugguuagugguuuaaguaacauuuaacuucccaucccauuuccaauuguacuuggguugcuauagaugaauuuuccugaguacauuaauagcuucaaaguaaaagcugccucagcuccuaaaguacaccugaauguaaauuauuuuacgguugaauuuaaaguuuuuaugaaauucccacugugugcacaggauuucucuggauaugguggaguagagucaguuuugacuucuuuuuuguuuguuuguuuguguuuuuauuugguuuaucuauuuuacccuaacucuucuaagggugggaauuaaaaauucuaaaugcuucccuuuuccuuggcaaauuuuaaacaauaaucuggaucaugcugcugccauucaugaucucgaucucucucucucucucucucucucucucucucccccucccucccucucucccccccucccucccucccucucucccucccucccucuccccuccacccuaccccuuucuugcuugcuugcuuggcuuuuagauuuugagcuauaaaaguuauuccuuguggcugaacuucuucaugaaggaacuuaggaacuuucuguaacaguucguuuucucaccaaguauggaaucacuacuauacgugaacuuggcaauuaugcucuccuguagaacuuugaaacuuugcucuccagaugcuacuaugcauccuuuguucaguggcaaaguucgguaauaagaaagguaacagacauuccugccacucaggccuuacucugucaucuuuaguacugcaguggagacaggaauuguugggaauggcagcggauggcacuacaugaauggcagagacagacaagaugaagagaaagugcaguucuuucuuucccgagaggaagaacaagggugaugauucauuuguuuauauauaauuaggaaauucguguauuguugugacuucaacauggccugaucauucuagaaucucaauuacaccucauuucuuaguucuaauuuucucugugcuggcuuauucuuucuuaggcuggcuauagauagaauaaagugaacauugacagcuucagagcugacaugagccuuaguaccucugucucagaggcuuugucaaggcaccccaguccugggaaugcaacuaggacaagugugcuagaaaaguccucugcugaacaguucuuuauucagcucagcuuauguuauucccaacuacccagugcauacagagaauauuugaauggagguuggauauguggcuaccucacuaacaggugcaguagacuggggcugggacuuagugucuaaacccuauaugguaguuguaugguaagauacuguuauguugccagaagaaauagagaauaccaaggaggaaaaauaauuaagcuuuaccaaacuuaguacacaaggcuucugugugaaauuacauauuguagucuuauugcagacuacauuuaaaaccgaaguaugcuugaauauucuuuauagccuguggaugguggagguacugggaaaaugauucagucaguagugcuggccuugcacauaugaagaccugaguuuaauccccaggugugaaaauaccaggugaggcagcauguguuuaaaauccagcucuguugcuuacagucuuagugcuagagggagaaacagaccugggggcauuggccaaccagucaagucaacuuggcaaacucuaggccagugagagacucuaucucaaaaauaagggggauggcaccugaggaaaaccauucccaagguuaacuucugcuccauacacacggcacaugugguuauccagaccuuuauacuucucaucaaaauuucucaguguaauuguaugaaagucaugucauuuuggccauucuuucaacaauguauuggaugccuauuauguuauuuugccuauaauuuuuuuugaaaaauaauuuuaaaacuuuuauguagagaucuagauuucaagauuauuuaaaagugauuccccccuccucccccccccccccccauuuugucucaguuucucaaauaaccagucuagaggauuuaugcaagcuaagaaauaccaaguuauauuuuaaaacauuuaccaagccucgcuggguaucucccuccuuuucauuuaucuaaagugcucugggauuuuaaaugucuacacaaagcauagaguaagccucaucuggaagacccaagcccagcacauugcaggcuacucaauuuaucuaccuuggaaggaugaaaggcuaaguugaaaaaucauuuaucaguuccacuccaguuguuacauuuuugcuucagaaacauccuucaucuccugagucucauaaucucuugccuuugagguuguuucauagacaugcuuucacucaaacgcuuucaauuugaacuucuucaagaggguugccuaucucccagaauucgccucuagggacuauuuuauagcuguuauuucagcuccucccauucuggcuguugaagaaaguccucuaaccaaaggcauuucuaauaggagccgggcuagucaguauagcugcucucucaggacugagcgcccaaccuggaguucugagaggggaaaacaggacagaacaagaaagcccaaagagaugguacaacauacccuuugcucuucuaaagaagcauaaacccugcuuuccucuugugauugacagaauuccacuaaaauaauguagucuggguuuuuauaugaaaauaauucucugagaaaugugugccuuugccuuauccaaagcacccagugcacaagaccuaacugaaaucacgguuuccaguugacaucuucaugaguguguaguggagccugucacguguuggggauucagccuucagccuucuccucauccucuggcuuccugcccugacacugcaucucacccugcucuucagccuugccuugccuugccuugccuugccauguuccaccucuucaacccuguuacagacucucacacccaggaguucugcucugucucuauuuauuuuguauuuuuacaaacugucaaguaacuauuuauuuuuggagauuaagguacuuaguuuaaauaauacauaauuucuuauaucaucuagcuauuauggcagacacaaugaaaaguaagacauagcuccuuccugccaucaaagagcuugaacccuuuagaaacugugucacaugugugucuaauguaaaugugucacaugugugucuaauguaaauguguuacaugugugucuaauguaaaugugucacaugugugucuaauguaaauggaucacucaggacagggcagcuugacuucaggaaaacaggguagaucucgugaccucaguggccauggauuauuccugguauaucuuagauuaauggucaguugaguaggucacucauuauaagaaacauugaaaaggaaagcaguaaugaccagugucccucacauguauaguucuuagugagaaaaacucuugccuaagagguguuuuguuuuguuuuaucucaugugcuucuaaaccuaggaaucaguggauguuguauuuacuaugugaaauguaugugaaagucuccugugcagcuuucaaaguccuguucuguuuucugauuuccuugaugaucagaaaacagaauuaucaaucuugucuuuucugcuguggucuuuuguauugagauuaacacucaaaaagaaaggagagauuucuuguuucuggcagcugcccugacaggucagcacugauccuacccugcuugaccagacuuguuaaggacuuuuuauaauacuauuacagcacuccuucugucuccuccuaccaaaaaaaugaaauaggaaauuuugugcguuuggacuauuucuggauuuuuaaaaaaucauuuauaucuguuaaauguuucuauaaaaugauuuuggcuuuugggauaggauagguauccugcuaaaguauaugaaacuacuauaauguuuuacuaaauaauuuuucucuuuaacagaauuguauuuuaauuuuuugauucuuuguuuccauuauguucagauaguuauugaagugagagaaaucuuacugaacuaauagauuuuuauguuaccagaaaacugccucagagucaucuguuuuccacccaccugauguccaccucccuuuaaaccagccuuuccugaaaguaaauuuugguuuugauuuuguuaaaaaucaaauuuuaucaucauugcaucacucuggaccggugucuugccuggaugguaucucuguuucucucuguauuucaaauugccaaaaucaguuuauccacugcaggauuggcguacaaaugaacguaauggcagcaacuaauauuaugacugcaacuaaaacuaauaaguaaacagaaauuucauuaauaacuagcauguuuuugcccacaguuauaucaguaauaagaaauaguagcagaggaaauaaaaccagaaaagcuacauuuuauaaauaauuaugaaauuauuuucaauuuccuccauauguauuuaugcuuauuuuccauguugauugcuuuugccacguggcuccagguucuucuuauuuguaguuaacuucauuuuaaacuuuggaacaacauaaugaguaagaagagucagaguucuacauagauuaaaggaaguguauuauuaaugagauagagcccagauggaaacaugcugucacucaaagguaaauuuagguauacugcuuccuaguuaagggauuguugucuccuuguauuuauagaacuuaaauuugaaaauaaguaauagguauuauuucauuucauauugaacaguaucauugauacaucuaccccaaaaaaagccauguuuacuauuucucauaauuaucaguauuuuauauagaccagucuuuuuguugaaauaagauucuuauuguaaugccuuauuucuuuccccugcgauguugcuuuguuggcuuguucaucuaccuuguagaccuugguggacccccccccccgcccccccagguucuaguuuuugacuuuuuaguaggcugaaccaaaagaaagcccuugguugcuggcaagagagcugaacaaaggcaggaaggaagggcuuuaugcgggggacucuggcacagaaaaagcagccuguauuccagcucauguaggaagccagcuuuguaggguuaugccaccguguugccaguucacuuacuacuguccuguugccucugcacuguugaaaaguuauuucaugauagaacgaccugaaaaaaaaaagagcuuguuaaaaccuuuaaaguuuucugcaucauauagccaugcaucuguuugggaacagccugccuuuuaacuguauugugcuucagcucuauguuuauagugagauugauuuuuaugccuuugaaacaaagaccuuuuuaaaaaaaaaaaaaacacccuuuuuucuuugauuucaguauugaaguaaaaauguguuagaaccauucagcucuggucaggagacauuaacguaagcaaggacaccucugccacagaaaagaaugccuagcccagcucaguguggccagcaccuggggcaggagcuucaggaaguggucaggccgcauagggcaaaucauauauuacaagguaauuauuaccguggugagcuacaugaaaaccuggcuuaugcaucauuggaagauaaauugcuguugaggcguuuggaccuaaagaucauuaauauaucuuacauuauacauuugagucugucaauguuuuugugaccuauuauguaaaggaaacaaacacagaggaguuuccaccacccuuuuccaugguuggguugugaaaaccagugcuagucuucucauugccgccacagggagagaagcccguguauuuuucuguuucaguuuacaaauuuuaagcaguuuuugagauaauuuauauauauauuuaaguuucauauucuucuuaaguauuacuagagacauuuuauagacgguaaaaaagagacagacaaaauuuguucuucuagccacuuuugcauauuauuguuaagacccgaccaggauuaaaaucaguuuaauaaaaauaaagucgaacuuacauauaauaaauaaauaaaucuuuuaaaaaauaaaaauaaagucaaaugcugaugcaaaggaaauuuguauuuguuucaauuguguagauaauuguaaauggacaauuuagauacacagauuuuuaguaaggauauuuuuacaguuauaggguggugauguauuggauaaauuuucacauuuaaaaauacaguucauuuaacagaauaauuuguaaaguuuaccucagcacacuuagaucucucauuuaucaaggaauucagacauauaauaguauguauguauguauguauguauguauguaugcaugcaugcaugcaugacuauaagguagaguaaaaauguuuugcuugguuuuaaggcauauuuaggaauuuggucuauaaugugucagacaguaagcuacucagauauguuccaguaauagucaaaauuuuuaugcugcagcuggccuauggguugguauuaacugguuaaugaguguauaacaaaaugccccaaauggaaagcuauuucugauuuaaacucaugacucuuccacauuaguguuuguauaauugaugucuuccuaguucccaguagaaguaguuuauaaugccacaguaaagcuuggcuaggaacgagaagugcugucuccuggaaguucucucauauuucagcuaaaacauacucagcaaaaaagauauguaaauuaaaagaaaaucuccaauuuccuauucuaaggaaagcuuugauuucugcugauucaggaaggaagguugacacugcagcuucucauuucaucuggaauaaucacuuucccuuuugaaaagucuuucauuuuagcagcaguaucuucuaaaacaguccauuuugcauggaugaaccuguuugucucuagauaacacagaaaauacaacuaucauaaacgguagccugcuuuuuacaguauugcuuuccuggguguccagugagauacuaaagugccaggcugcucaugcugaagguuucacugauuuucuuugcgaccuuccuaccccaaacccaaauaacaagaauuuuauaucuuccgaauugacuacugcuauaaaauauuuaacucuaggauuaaaauaagaugcugacaagcuaaugaagaugguugauaucaguggcauucuccccuaagccugugucucaccuuaguucuagcucugugucucagcaggacucuuguuuuuccacauugcacuauuugauuaggcuagcuauuggaugaucuuacuaagcccaguguuuucucgauguuucuugugucuuucuguagcacacagcagauacagcuaagacauaauaacaagcuugcucugacugcgaggugagcacagagcugcucacuggguccuucuguuuggcugcucacuguggaaaggaucacugcuuacugucuaaguaggaagaaaaguuacaagcauuugaaaaauaaguuuggcauaaucuauauacagccuacuuaaauuuccaaaggucaaauucuuuguuuagauuucugccaaauuaugcucuaagcaaacugaauuuuuuuuuuuaaguuuguauggaagauauaaauguauauguguugucuggccuugcccagaggguugugcauggauccauugugugccaguuauuuaauuucugugcuuuguauaugaaguaugcccuugcuucucauaguacuugggacaugcucucaaugggacauuacauggcagugcucgcuuagguaaucuugaacacuauauuucucauacuauauuuauaccguuacugcuucaugcuaccaaguacuuacaucaaauuuuguauucuguauagacauugcuuuuuuauuuccuccugauagcacauuuuguaauauuaauacaauaaagccaagaugacaggaugacagaguaaagcuauuauuaaaaacauguucuaauuguugcagagauauuaauggaaagcuagagccuacugccuccaguucuuucaaauuauguauuuuauauuuacaguuuacauuuacauacuaauuuuaucuauuaagaauugcuuucaaauuaaaagauuuacauauguuuaaacaaaagcaugaaauuacauuugaacuccauaaaugaauucauuguaucagcaaacugaaugcuuauucuacauuaaggaaggccaguuucauugagaaguuugacucucacguuauaaauuaggaugaaggaaggcagcaagaaaagcauauuuagauaucccaaaugcucagauuacuaugauuaaaauguaaauguauuuuuuaaccaaaguagagagaugaauuagguuggaauuuuaaaauuauuucuuagcaagguuuccaacuuaaaaauagcucaucuuuuaaggaguuagugaguuauacauuuuaaaguaaaaaagcauuuaaauuguguguguguguguguguguguguguauguuuuaucuugaugucguaagugugccuuauaagauuuaagcaugugauaaaaauaaucuuaaguccuuucuuugagaauucaaaaccuuuguuauaaaaugagcagucaguauucuagguugucuaauacugagaaaucauuucaccauguuguacgacuaccuacaagugcuuuggaaaaaaucuuuaauccagauguuuuuguccuuuaaaauacacaucauuugagaagaaccuauuuuagaagggauaaaaaugugacuuuauccuuuauucuguuuugaaagccaucauuugugcuuuaucaguaaaucauaaguaccacaaaaagcauugucaagauguacucauuuauggugaaauucuucugcauuucuagacacaugaauaucuaaacaaccauuuagaccaaaguguggguugugcuaggauaguuugugugcuuucuuuucagacauggucaauuggaaauaucagcaaaggugaucccggcaguacccugaaacucuuucagucugcauagaacuguaacagcagagugcugaccagaguucagaugcagacauuacucauuauucuagcuucucuuuagucuuuucauuaguuagcucacaaagagaaggauacgcuguguguuugugugguaguaacaaauugcuguaauguuaaugguaugggaccuuucauggcguuugucugcugugcaucuaaacuuucaguccugcacauugugacucugcucuacucuuguguguucaucaauaauggguuaccuuaaaguaagcauuucagguaucccuauuguuucccaagccugcuuuguagcuccauaggguuccugcuuggcuuagcuuagaaccucagucuuuuugcucuuuguaucggccucuaugcagcccuagccucuuuguuggacuaguuaguccuuauggagugaaguaugaggcccugugcuggauuggcuuuauaaaauaaacagcaaacacagcaagcaaaacacaagcugcucuacagcaagguguguuggaauauagcacuuagguuuuguuuagauagaaugguuuuuuuaaaugguucaguuuaauauaaaaauaagcacaaaauuaauaaaaagauuaaaacaaaauaccuaucaguucuuuaaaaggcaacuccugguauuuuaaauacuugauuguaguaaacuugaugaauaaaggagauauuuuuuagucuuuauguauuaaaugggagaagugguagacaguuauuguugccaagaucuucuccuuuuuaaaacccaacuaauccuauuguuuuugcucuuuuuccuuuuauuuaaaacacuggguuaguugaugcuuuccucugcuuaucuacugugguuaagccuagacuacucuacuaugauuaaucugggagggucacuuugugugugugugugugugugugugugugugugugugugugugugucucacuguggaagagaaaccaaugcugaauuuuucuauuuuguuuuauauugaauaguguagaauaaagaagaacauuuauugcauugauuaacuuauaauagcuaauuucucugaaggaagcucaccaaaacaucagauguaucucacuuagcaggguuagcagggauguuaucuaugagguaauucaaccuuauuauaacuuuguuauauagcccuaucaauuucuauuuucucacaacuuuuaaaauguaaaaucagagauucauucuucuacaaaaugacuucauuuuuaagacaaaaaaguuuaacguuuuagacaaaucauauuuagguaaaugaauuugucagauuauacaaacaguauagauacuccuaucugccuauccuaaauaauaacuacacuacaguaagagcauuuuuucagaugcgcauucuguccuugauaugcucuagcagaguggguagcuuucuuuacuguucaacauuuuuccuucuacgauguuucagaaaaccgucagcagugcggcggaugauauuaggaaguagaaacccauuauugccuucaagucgauuuagcagggagugagacacguaauacuuacagugcaaacagacagugucuugauagauuuaaguauaggacagaauggguacacauaggaaggccuaacucaguuuuggaagauuaaggguaagccaaacagagggaaaauguaaaaaguguuuugugggaaauagcagguauauguagcccaaauauguacugguuugcuccaaaaaguuaaaugggugacuggcacauaggguauuaaaaacaauggggagaguuggagauuagugugcagugauaaauugaccaaguuauaaaggucuuuagaagcauggucagaaaauuuaagaguuucaagaugauaucuuugugggcugguguuaagaucagagucaccuuuuagaaauuaauuugguggggaauggagagcagcagcagccaggcaagagaagcgggcggcgucagaacaggugagucacgauggagccgcucuucccagugacugcuauuagaggaagcccaguguugggaaagggaaauguuggcuuaguucucaacauuuaguuuggugugccuguggacugucuaauuguugauucuuagacagcaguggcauauaugagcauaggacuaagcaagagggaagcagcuggccaggugcagggauuuagaagcgaggcuauaaaaguaacugaagucacagauuccaggaguccucacauauauuuuguuacucaaucuauguuuguguggccacaugacauauugugaacuacuuacuaaacagaaguauacauuucauacacacauugcuauggcauaaaaagauuaguauagugaaucaggcugccacuuggaacagagaaacaacuuguacagugaaccuuuuguuauacuaauauuuauuuguuaauaguaaaauuuuaucugauucuuuugcuuuaggaacagauuaccccuuuagauuuuaggaauggcuuaccccuguaaucuuaacacuugaaaagcuguuacaugagaauagccauugaguuugaggacagccugagcuacauauaugagguccagacuagccugagcuacacagcaaaccugucucaaacaagauuauacaauaauaauuagggaggaauaaaggaacuguuucaagcacuguaguuugcauauauauauacguuucaauacuuuauauuaccuuuuauccugaaaagaguauauuuauuauauaugacuucuuuuguaaaauguauaguagcauggguuggccaaagcaugcuaauaaacacguuucacuuuauauacuguacuuuuuguggcaaacauacaagcuguggcaaauuugaaaaauacuauucauuguuauuaacuauagucacuuguauuuauuuauaacuuaauagucuuaaacugacuaaaagaacaaaguaucuuucaaccaacagaacgauauccccucuaacuaccauuuuacccccaaauucucuagaaugcugguuucuaccaagauaauuagugaucuugucaguuaacuguccugaagcuuugcucgcuugugaguuucagaugaaaacuaugaugauagaccaagguagagagaaauaacuagugggagaagacuuacaacaggaaguccaaacguuucacugaaagcugugugagcugcaguaaagaauccugagguacacauuagcccuguccucugauagugauugaacuagacaagugcguucccaccaagcuccuuccuacccaaacccugacuaacacuacuccacucuagggcugauuguguucuggguacaguagucaguauccgcaagccaucuucuucugagaaugaucucuaaaaugacaguaguaagaguguuaggauggucccaguuuuagcacagugaaauuagaaguacaggauaucugauggucuccuugccgcuugacuugacagugaguccuaacccugaaggcugguguaguuggguugccauuguuuccuuuccucuagggauuugucucuuagaauuuguuuucacuguuguguauauguaagccaacagaaauuauauuaaaauguguuuguacugcuuugauuuuaaguacuuugacuuagcauggaaacuccagugcuucugagggacagucaggauggcuauuaauagaauuucaaguuugaaggaauagauuuggaagguggagccacuuauuuaagauuuaguguuuuuccuauuacauuuuccagauucuagauguauauauaaucugugaauuuucaaauccaaauaauaccauggauaauucuuauucaaaucauucaaauaauaucacaaauaauucuuugugcuuagugcuuagaagcuucuuggagaaaauuuugugaaaauugagccugcuauuuauaguaugcuucugcccuuggcuaaguuaauguguuaaguagugcuuuguuauauuuuccuucuaaaacccuucagugguuuauuauuuccuaacacaagcucucacuccgacauggugagcgccguaauacagaucaucucccuguuucuuuuucugguuaccugaauuuuguacuauuuucaaguucuuugaaagaccuccuccuuccauuuguuuuacuucauggaaaguuuuugccuuuuuauguucauaacuuuuacucucuaugagccauguguucaucuuuccaagagaaguccuauggcacguggaagcuuguguuaagaaagaacuaagugauggugaugaggaaagaggguagugagguuuuguugcugguucaguaguuguaauuugacauagauguuagccuaugggacuucugcccaauacuugaaaccacucugguguguuuugcuaagaaggguagcuuguugggagaagagaucuaucccugugucuuuuagcuaauguaagaguagauggcuaaggucccaaagauuguggugacuauauauuagggauaucaguugugagaucuacagagacagcugagagagaaaugguagccuuguacuauuuaucugauguugcuuuacagugcagcucugaucuuucuguacaucugaaucaaacauguaauuuaccaguucaaaugucaggaaaucuaacaguaaugagucauucccagccacacagaaguguuucuguucaucagcuuucuaaagaauuaauuuucuuaccugaaauugcaauacacaggauuaaguaagcauuccacuguuuuucuauagcauccuuaaaauagggacauggaauguacaaaauauggguuuucuugcugugccaaguugugugucuucugcgggaaagaggcucccuccauccucuuccuucuuaauguuugcuuuugacccugggacaagggacugaggugcauaucuuacauaccaaagcagaucuggccuacagguucucccaacaucucucaguaggaauaccuaggauacccugccuccaaugcugaacuuuccagcccagccagggcagggcuccccuucccccagagguucuucccuaugcaguggagacauuuuggucucuccucuucuccuagucucucucugcaugcacacccccuucucuuucucccuuauaccgccccucccccccuuuccccauggugacuucgcuggccuugguucucggggccaguaaacuugcuccccugagaguagcuucucaauacccugguguuacaguaaacacagggguuggaugcaaacagguggauucugauuccuauuccaguaaagcaucuuacuagccagauuuccucacuuuaaaauucuuguauauuguuucagauguucaauucugugaaagucucuaauaugguucucauuauaguuucuacauuauauauaacauauuauuuauaauguaauuaacuaauauaaucuauuauaauauagcuuauaauaauuucuucauacauguggccucccugucuggcuuaucuaauauuuucccagguuuaacacuucugcauccaaggcuccuccucuucuucccuuguucaccugauuuucuaaacuuguuagccauucauucuuugaagcaagaauagucaaauuauacuguaaaaguuugauguuuuuuacauuuauuuuaugugugaauauuuauagcuuguguauauauauauauauauauauauauauauauauauauauauauguauguauauguauguauguaugugcgugcacuauaugcauaccugguauauagaggucagaagagggcaccagauuccuugggccuggaauuacauaugguugugagcugccaggugggugcugugaaucaaaccagaguccucugcaauagcaacccaugcucuuaacuaggaaccacuucagccuagauccuguuuccagcagcuggcucaguucuggggcuuugcauaugcucuaccacagagcuaccccuuguguccuacgagguagauuuuaaguagacccuggucuuauguagaugaugcuaauuauuguuugcuuuuuaggguacucuuauuuaauguuucagguuauguuauauaguuguguuauugacuuguuuuguaaccaaccaaaccuuucauauauuaauuggccugaaauggguguaugauacagaguuacuuguaaagugguggauauucugacucuugcccugaugggaaggcucuggccauguugaacaagcugccugaguagacauaguugaauaaguucuuuaugucagaaacaguuaagucuguaaaccugucuuguaaaauucaaguuuuuauaagcuauuauguuauagugaguuauaaaaaugauuauaguguuaguauucuucacagcuuuauuuuaauacuucagaacccaaauauuaguuuaguuuauuuauauguuaccugucuuguguucuaaugagaaaguauuuuacaauuaugacugcuuucuaguuaucuaguuaucuuuguuuuugacuuuuacacccaucuuuuguucauuuauuaauuuaaaauuuaacuaaaaaauaacuaucugguguguuuuuguuaaugucguggcuuuaugucaagauacugaaaaguaucucuccaaauuguuguucugcuauaguuauuucucucaaagaaggccucuuguauggcuauuuguugaauuguguaccuacugaauuagucaaagcucuagcuaaaaccauuuuuuucuuuacuucuccccucccccccaagcuugcuuuuguuauguauuggcuugcuaauccuuguguugagcaguaucagacaucaccuuucuugggggcaguuaguccacucuuccgcuuucuuugucaaagggcucccuuaauaggagaagucaacagggaggacaaaaaggauugaaaguuguauuuaaucagggucagagaggugguguucagagugacgggcccacaggcaggcuggccuuuuaugcuugccgacgcagauggucccagagcauucagcuaagugaagagaaagcugcccagugaaaccuauuguaggguagcaucguuacaguugagaaagguugccagggguaacuagagaguaucaccaguaucgugugaucacuaggcugugccauugaaaauguuagacugagaauuguauugggucccuuggcaucuugauguucauauguaagcaguauuagcuuauauuaguguuuuuaauuuaauuuuuguacaguuuucuuccuuuuguuuuugcucuaccuuuuuuuuaacacauuaaaaacuggguauauuuaauuaaugauuuaaaacuugcuggugagagaaaauaacuaauauauuuauuguagauuuuauaagcuacaccaaauuaugauggaguuuagguuuaugaaaauaaaauauauauuagaagacgauuuuuugaaauuguucugaagcuucaccaguguauaucauauugaauaguuugaugcuucccuguaauuaucaauuauaaaagauuacagugcuaauuaucugaaaauaguauguaacagugaaagauugggucaagaaauuucauacuuuuaagaaaucugacuuuaguuuuuacccaaagcaaaaguaaaaauauacaugccaagcaaguccaaguuaguagcauaacaguuauuacucuuaauauacuaaauaugauuuuaauaaccaauuuuagaauucuuuaauuuuagccuuucuccuauuuuuguacuucaagaaauuauuuguagucacauauaaaauguaaauucagcaaucuccuacagugaguagaagaaaaugcagagauuucaagauaguauaaaugugaaauuugaaguauaacugagauuuaagguaaaguagcaauagacucgcaaagauuagcuuuaaauuagauuagcagucaacucaacauaauuaacuuuaugcuagcuagaauugucuuuagcuuauaccuguuacccacugauaaguaagacauugggugaagacaacaggauacuguaccauaccaccaauaauuucauagucucacgaggcgugggggacaaacucauauuaaaaugagcaacuuagcuuuuucuccauguuaaaauauaaaugaauuuuuauauuuuaggcaguucauaaccacugauauaaagauaaaagcacuacauguaugugccugcgcaugcaugcacgcacacacacguacagauuggggguggguagaauuuguugauguuuagcauaagcuucuaaauguccacaauuacaaagaggucugcugacauaaugacaaagaucuucauuggaaaaauuacccuuuacacuaguacgaaugacagagauggugauuucuuauuuccuagaaaacaaguuaaaaauagcuagcuugugcuagucuuuaucauagguucuuucucaaagagaauuaaaguauggcuucuuaaaagauuugugggcaaaguacaagauuuuuaaauagaggugggagugucaaaguaauuuuaauugaauuacuauacuagugagccuugguaaaucaaagagaucaauaccuuaauuuauggcucguaaucuuuuggauugucaaucgccuuuugcuuuguuguuauuuuuaagacauggacucacuauauagcccugcugcucugaaacucaugauguaaaucaggcuggcauugaaagcagagauuugucugccucugccucaagcaccuggauuagaggagugugccauuauucccagcuugccuuuuucuuuaucuuuaugcucaugccaaauauuugacugaacacaugguaaauggcuuaaaauuauaguaaaaaacaaauuuuaaauauauaugucacguauuuucaccuauauugacucuaugauauaaacaucuguauggucagaccagaaugguuggcauaaaaauguuacauuaaaucucagcuuagagucccuaucacucugaucuuugaagccuugcagguagcauaaauaugagaggaaacauaaaauauguguugccaucucaacaaagauuaaaaacaaaacugucuuuaaaacucaaagauaaaaauauauuuccuugaaaauugcuuuaacuuuacugguagucugguuuuuuuuaauuaagccauuuucucuucucuccuccacauaauauaaacacacucuauauguuaaauauuauauauacauauguacauauauugcauguuuuguguaugugagaaagacagagggagagagaauaugugggcacuugaauuccacaguacuuguguugagguucuagaccaacuuuuggaguuaguucuuccaccuuuauauauauauuuuaaguguagauuuggcuccugcuagcuuuaaauuagaaaccaggaaccagaaaccuaauuuagaucuugcugauugaguuuuacuaaaaucugaagcacaaagccuuucuuuguuuaacucccuuuuucuguaaucauaauauauaauuguuaaugggauauuaguaauuggaaucuuauggcagaacuuauuaauaauagugccaaaucucucuaaauaucuuaaguauuuggaacuuguaguaagaaaguacaaccagaauaguuacaaugaaaaccaucaugccaauacugacagauuucuucaguaacaauaguuaugcugacugaucuauacaucaggaacucaaaugcuugcuaaguguguaaucuuggcuuaagauaauucuaagaauuggcuuacauaguuaaggaaaaagacuuugucaccaauauaaaauaaaauagaaugaaucuugugaaauuuggaacaagcauggugauguucacaauuguguuauuuauuggcuuggagaaaauucaugaaugggaaauuauauuauuucugaguuucaaagaaauaggaaauucuaaaaugcaauuaagugugcaguuaauuaaccacaugcaauauugaagacagaagaaagggcuuuaaaauauuuuuaucauaaagagauuaaugcuugaggagacaguuauguuuaaccugauuauacaauguauauaucaaguacaaauuuauuuuuaaugugcagaaaccuuguugguuuaauauuugccuaaaaaauuagaaagcucaggcuauuucuuaugacuaucaguuauguuucaaauguguuuagauuaauuuauuuuuauauuuuguuuugccugugugcauuauguaaaugcuuggugcuuguggaggccagaagagggcaucaguccccugaaacuggagguacagaugguugugagccaccaugugggugcuggaagccaaacucuagaucuuugcaggaauaaaugcucuuaacuagugagccaucuuuccagcuccagaauaucaguuauuuuucaaaaacaggaugugagguacacaggauucagcuucguguaaugcuuugcuggcaccauacugaauuccaaaaaaguaucgaacagagcuccucauuuuaucuugagcagagccccucauuuuaucuugaacagagccccucauuuuaucuugaguagacccugcagauuauuauuuaguucugauaaaggccacaaaaucuuuucauuuuggacaaaucugucaauauccuuuguccucauuccugucucaguaagguaguaaccuuuuccauagugauaauucgaggacuuggucaucuuuacaguagccuuucuuuuagcccccuccucucccuguuaaggacuacaagaaaggacaguaaaacagccaaaaauauugggguuuauuagcuauuuauaaaagcauaaaauaugccuaccuacuucuagaaguacuccauacaugaaauuaaaauauguuaaauccuucaaaaaauuaaacagugguucaaauaauaagugauacugaucaaauaacaaucacuguuaaugccuuguaacuggcauagagcaguccugcagauaugcuuauauuugccaacauuaguccuuuguaacugauuacuuuggggaaaguguaaguagcugaauagguguugauagauaagcaugauaacacccuauuuuuggaguccauucauuuacgugguuuuagcacuuugucuuaauucguuuuauuaagacuacuauaaaugacacaugauaggucuggaaucuaagaauaaaacauaauuucauauauguuuauuauggguuuugauuaugaaagacuccgagaggagccccucgcucaggccucaggacaauaguggacacccaagaacucacgacagaccgagcuuguugcaaaccacaugaggcuuuauuuggggaaagccagagcucuggggacgacucauaucccacgcagggguagaggagucgaccucgaggggaaagaguucccaguuuuuauaggcccucaggggggaaaggagaagggggagauuaggggauuuccagaucuaaacaauaucuauucucaagaaauggguaugggagggguacaaggaaagagucuaaugaaggugcagcaaugggcacacaccuggucagaacauuggcagacacacagguucaaggaguggccagagcauugugcaccucuauuuuucuaaaucagugaagcuaguucugcuaacacugacgucuaucuugccaauuucagggcuucuguguccuuuuacauucugccaggaucuuucauuuauaugcacucuauacuuucuuuucuacuccuggcagugccauugaaacuugggaaacuuaauaaaggucagaucauucccaaaaaauauugucucuccuuuucacagcagcuauuaguugccaggaguaaggccugugagucccucccucauccauacuggacuuuuaacuagcuugaacuugggcagggcagguaacuacagcugauuugaguucaugaguacaguagccauaguauauucaaaagguagcauuucacagcauuccucccugucuuuggcucuuacauuucuuucuaucucuacuucuagacugagucuuggguggguugauuuagaugucccauuuagaacacucagaggacucagagucauuuauuuucagucacuuaugaccaauuaugagucucuguauuaacuguuacucccugcaaauagagguuucucugacaaaaguugagaagagcaaagaucuauggguaucuuugucaacaugaaaagcuguuugacaaugaccauuuagcaaaacaucaauacuagauuuuccugugaauuucccuaccauggaauuuugaucaaguuuacaguaccaggcaucaauuucuuccuguggagcagaccucaguccagucagaaagccguugguuauuuccuuaacaaucaugccacucucauaccaauaugcaaaacuugccaggcugauugaugguuuaguacucauggcuuuuucuccucugguaggcugcauaacaccugcuacuuuuagugcaaugaaaguuaguuccagcuugauuucucuguaucuugaaacaaaaguacaggguuucucuguguagccuuggcuuuccuggaauucacucuguagaccaggcuggccuagaacucagaaaucugccugccccugccucccaagugcugggagauuaaaggcgugagccaccacacccagcuugucaaccauauucuuaauagugguaaagugaauugucuuaagagcuucguaaauaucuaaauucaugaauaucacuauuuucuuaccuuucuuuuccuccauauaauauguauuuccuuccaacagauauuggccuguugagaucaaccuuagcagugacuuuuaaauuuuauuuugucccuguaugaaugaguguuuugccuacauauauauuuguguacuacaugaaugccucaugcugaggaggccauagguagguaucagauuccuggggacuagucacagaggguuguuaaucaccaugugggggcugggaauagaaccugugucacaugguugagaauacccagugcucuuaacuauugagcccucucuccagccccacggaugacuuuuaaaaaaccauuagugaguguguguguguguguguguguguguguguguguguguguguguguguaggaagaggaggaggaggaggaggaagucaggcuaucagauucucuggagcuggaguuacaguauagguguugggaauagaacucugaucaucugcaagaacaguauguacucauaacaacugagccaucucucuggccacccagaagugacucucuaauaaggcuuaucuuuuugguuuuucaagacaggguuucucuguguagcccuggcuguccuggaacucacucuguagaccaggcuggccucgaacucagaaauccgccugccucugccucccaagugcugggauuaaaggcgugcgccaccacacccggcuugucauuuuuuuaaaagaagcaauguuuucaucauuuauaugaggauacuguaaucagaugccauuaauaacugacuagauuuuuuacagcaaaacuuccaaacaccuguacagauuccuuucagguugauaaaucaccacgguuuuuagaaacuaucaucguuugggguuuuuguauuucuuuacaaauugucaaaaacacaucgcaaguaugggucagcuucaugucuucuuagaugagccagcagccugaaguggugagccucaaaguuuaguuugagaaccuuugguugucuugagucuguuucuucaaguucagacauacuuucacaaugcuaauaaaaguuauuaaguaaauuaauaaaaguuacuguguuggcaaaagcaguggugauuaagccugcugacucuuugcccaaaucaagacaguugcaucaguucuuacuagaaauagucauuaugcucauuauuucuccacauucuacacccccacacacacacuccuucccaccccacaccccccaaaagaaauccuuucuggaugaaacuauuuuuaaaacauaaacaaaaaacugguugugguauuagacuuuugaaauccuaaaacucagaaggccaagaaaggaguaucaaguauucaaggccagccucaacuacauaauugccagaccagcaugggcuacaugagacucugucuuaaaacaacaaauuaaauauaagaagaaacuuacuaagucucaguacuuaaauacacuuuuaaaauauucuguaugauaaaauggaaguauaaaguucaguaaaccaguauauuuuugugcgugaauauguuaauaccugcucagaaguuuucugggaaagaaaaaaaaaaaaaaaaagacuuggaguuccagggauggguucacagagcuuugaauuggagguuuaggaaggcaaggagagugguuuacuuuaacacuuacuuacgucacaagccuugcaaacauucauucugcaaggaucuguaguuggaguuuuggucaucuaauauacauacaagauaaaagagucuauauacuccuguagaguaggaauauccagaaaacaguucaggaaccucgugguucgaaucuugaguugcuuuguacaacugagcuccaggacagccagggcuacacagagaaacccugucucggaaaaacaaaaacaaaagaagcaagauuugagggcucaugauuuuauauaauauagcaaauacuuuuaaacucauauuuugauaaauuauagauuuucuacuuuuucugcaaauauauuucucacaucaucaaacuuuauacuuuaggcaacuuuagcuaguauaaaguaauauuagucacuuuaguaagugcaaguuuacagauauuucuauaauaauuuuuaauguaauuuuuaaauuuguuuuucuuuguuucucucucuuucuuuguuuccuuguuuccuucuuucuaagcuuuguguaugaguguuauuccuguguguguguauaugugccuagugucuguggaacucagaauaaguuggcaaaugcucuggcccuggagaaaucaaugguuauguaugagucacuauuugagugcuagaaaccaaaccuugguccucuacaagagaacaaaugcucuuaacagcuaagccaacucuccagccgcuuugugaugacuuuuaauuauacaguagaacuugaauacucccucuguacuuagaagccaugcaugagucaagugauuucuugauuuauaugcaauucagaauaaucucuugauuuauucuauuaugcuauuuucaauuuaaguggaaaauaauuuaaaaauugccuuacuugauaauuaguucaucuguggcuaaauaaaaaaaguauucuaucaaauacuauucucuuuacgauaauugucuuuguuugucuguauuuacuuugcaaugugcaacuuaaaaacaaaugagcagauaagugcuuuccugaauucugcugagucccuaguaugcuguuugcuuucauguccuuuuauguucuuguacuagcaccuuguguuuuggugcucagguuuucuuuucacacacaguuaggauggcucccaggaaagcuggcuuucuaccacuuaagccucaguaaaaugccaccccucuuuccuggggcuauugucaccauuguuagcaucauccagguuuaacucuaccuccugagagccugugauguccucuauaaaucuagguguguacauuugagcuaggccaauugcuugauccauauucagacaucugaccuguuccuuguggacauguuccacuguucuguucuucacguagaaaggacaaguucaggaauaaaaugaacaacaauuaaagguggcagcaacaaagcauucugucaggcagaaucccacacuggaaggaaacccuguauaaugcucagguugcaugcuccguguaagcuggcaccgccugcuuguccaucagaauaaagcacacaauugcuaaacuguaaacauaaagaucuuuaagggcuuuauggauacaccuagcacuguaauguugggucaagcugagauucuaagaggcagaccuuugauaggaaguucaaauuacuuaaaauacucauuuuuguuauauuuaucuuuuaaauguuuuauuuaucuuuaaaaugacuugaguuguauuaucucugacuuguucuucuuguuguuguuguuaaaaaggaggguucaaccauggauuguuauaauuauuguuuagcucugcccuacgccucuucauucauagccuacugguccucaaugcuaguaacuaaaguuuugugcacugcuaauacagaccccucuccacucuucaucuugugcuuuuugucagagaaagucuucaagacucaaaccaauauauauauaucauauucauuuuuuccuuuuuuaaaguuucauuuuuuuuacaagaaguuucucuaauugaaugcaguuuuaccuuguugaaguggauagaauuugaagcaaugagugcauacaaagacaaagaaagacaagguuacacuuggccacugcccugccuacuggaaaccaccuuccauguuauaaaaugauaccaccacagaaguagggcugcaacuccuacuuucauuccuccuccguuaucccguuaccuuuggacagagauacauaucagaauucgguaacuagugugucaggugauuaagauauggccugcuucuaucuucaggguggcccaguaaggucuugaacauccugggcuuugggguugauugucucugaauggaauagccucauaauuuauccuaauauguuguuuaaacuucauuuuguuugaaccuuaugauaugaaaagggauuacugccuuaaacuucaaauuaaaaacucauaagagggcuggugagauggcucaguggguaaagguacccgaaugcucuuccaaagguccagaguucaaaucccagcaaccacaugguggcucacaaccauccgaaaugagaucugacgcccucuucugguguguuugaagacagcugcaguguacuuacauauaauaaauaaauaaaucuuuaaaaaaaaacucauaagaaaaugaaauucugcauuuaaacaguaacuagguuuuauauaguuaaagcaauaaccuuuuaacuauauuuaaucauuauggguuuuguguauuuuuugacguuguauuuaaaguaagcauuaauuaauaggcuguacacugauaaagauaaacauugagagacuuagagucaaauagcuuugcuccugguugcuuuguuauaagaaccagagcucuuacagacaaaugacuagccaaguauggcagugugcaguuugaccucagcauucuaagguagagcuaggcaggcuagcuggagcuacacaaggcccugucucacaaagaaaagaaguuagcaaauuguguacuaguccaucuccuggcauuaggaaugucuggucugauuaaggacauaguuucauauuugauuaagguuauaguaacaacauagauuuuacacugaaccugcauuggugauaagugaaauccaagaaaaauaccaaguuuugaaauguauucauguccccaacuccacaaauccacugauagacuguguuugaucacauuuauuguaaauuuugaauuuauuguaguuaguaaauuguuuagauaagugaguuuauauaaacuguaugaauugucaaaugaguacuguaguaagaaaagauaguaaauuuauauuauugaucauaaugacuguaauucuaguucuuguuuauuugcaguugucagaggagagcaagaacuucagcaucauuuuaugaguuucaauuuacauaucaaaaguauuucuuacuagcuguuguaaugacuugugcuguuauuuuauccgauucuuacaaucuuuaauggcaauauuuucucauucauucaauauaaguagacuauucccuugauagcaaagaaaauucacauuuuuaagaguucuuguagcuguaguggugagcugcccucuccuggucauccgugccauauagaacucccaaugggacuaaaggaaaugagaucuauaggcaaguugaugagucaauuguccuagaugccagccuaugcucuuuaaaaagacccugacaggacaggugaugguugucuucucucucacacaugguugguuaucauuccuugcaacugagaaucucaccauugcaucagccuuaacugggcugugugcugucuuucuucaucuacgucuucagguucauuccuuugugugucugagucucuagagguuaguuucuaaaagaccuuacagguggguggaucucccaugauguucuuucuuagaagauauucuuacauauuuucuuaagaaacucuuacauguugucaucgucgucuucuucuucuucuucuucuucuuccuuuuccuccuccuccuccuccuccuccuccuuuuuuuuuuuuuuuuuuuuuuuugguuucuugagacagggucucucuguguagcccuagcuguccuggaacucacuuuguagaccaggcuggccucaaacucagaaacacacuugccucugccucccaagugcugggauuaaaggcaugcgccaccaccgcccggcuugcauguuuuuuaaaaagaugggcauaaaaguauguuucaugaugcauauggguugacuagugauuuuucuuaaaaccacuuacuauggauuuuuuuauucuagauuauuaauguccuauuucuuuuaagcccauccuuaacucauuuuuauacucuagcuuuauggaccuaugagguuaauauccguuauuguacuuaacaaaaccagaaccagaauauugauaaaaauucauuuuagauuuuuauuuucuuauugaaaauaacagacuauccccuuuuuuuuauuuacuaagaaauauuuagacuuuguuuucauguuuuaaaaauguaagaaaagaaaaacaagaccuaauaguuuuuauuguauguuuuuuucaguaaaauucauaguuugcuauugguuacuauuuaucuuaugaauuauauauugaugacauauuuuauuuuugaaguucauauacauuuuaauaauucagccuaucucacccauugcaauccaacuguugacacaagacuagagaaugucagaccuuuucuugaguauuuuuucuuucagggagucuuguaugauuauuuuuuacuuggaaaaaaauguuuguuaagcacaugugucugcacacaugcaugugcaugaagccagacggcccuacuuggcaaauuccacuuaaaggagacugaucgcaaggaucaguuaggacauuuggauuccccucugcccccuccccacccccacccucaugaguugcauagaauuuuucuugguuucaacuuaaaacagaaaacugacuuuguucuuagaaauuuuaaaacuauaaucaaaacuugaaaauuauuugugaaacaaaauacugaaaguaugacuuuuaaacuucugcuucaaaaguacacauuaaaauugugagagggaguucuuugaaaccaggacugggcaggugcccuuuaagccccccccagucaguuuguuuuuuugucuaaggguuuauggauagccaagacccaacuuaaacuugcuguccaugaauaaauaaaauugaagucuuccuaauugaaugcauucccagcauguacaaauuaauaagcucccuccccuuggugaggaaaguagugaguugucuuaauaccugaccaagcccucuugagccacuucuucauuacaugguaauagugaagaaaaaaauuccauuuucccagaaaauggaaaugaugcuaauucucaagcaggguacuugugaagauuacaucaaaauauuaacaaaagcauuuuaaacuaucagauaguauacacuauaaaauaguauuucuuacaaauuaguuguucuuaauucuuuuaaacuaauaugaagucagacuuaauggaagucuuuacuuucuucucaaaauaacguaauuauuuuuuuggugucaaaccuauaucuugaugaauauuuuuaacuuggcaguuuugguggaggacagggauaacauucauacacccuucugcauuuucuguugugugucugcagaccauagcaugauguaaaucucucucucuuucauuaagucuuguuuuuccuuguuuauuucugagaagaauagaaauuaagaauagaaaaaauaggaaagucuguguuuaauacauuaguauuuauuucaccaggcuuuuuuuuuuuuuuuuuuuuuuuuuugguuugguuuuucgagacaggguuucucuguguagcccuggcuguccuggaacucacucuguagaccaggcuggccucgaacucaaaaauccaccugccucugccucccgagugcagggauuaaaggcaugcgccaccaugcccggcauucaccagguuuuuuugccugauauuuuuauauacaugucuucauaaauauaaggauagcaccaaaaauuuagaauggccagauuuggugccacuuuuuauuaauuaggaacccugcauauuguacauuguuuucucuaauccuccccuggcaguuagacuugaaaagacaugcuuagagccacaaauuugaggcauaagaccaggcucugauaauguuuggaaguuaccuuauacuuuaucuguguuuucuugcauuugagaguauuuucagccuuuauguauuuaugugacagugaagaggagaggauaaauuugguaaccuagaaauccuaugucccaucaggaggaaaacauguucuuccuccugguaaggaacagaagcuacagcuauccauugagcagcuagaaauuucuucuuagauaauacuccuagagauggucagggcuacuuaaagaucagcauuuccaugccagucagccccaaaccagcaguuauuucuagccaagcucuucuguacagcauucugaucuuaaauuguuuugauuaaagugauacugucaaguaagaaccugcgucugucuucccccacucacacacccccguuagcccuugcccuuuacccagaguaguuaggaccucacccugcuuaccugucgucuugcuguuuccagcugcuuucacauugcuguacaacuaacuuguuaaaguaagucuuuugucauggcuuugcuguuuuaaaagauugucccauugucuguaaaaauuaaauauagccuauuuaccuuagaguuggaacucaguggugaccugcccugucuguuuugccuguguaugcuauaguacucauucuuaaggcacaaaguuggguucaguaucuucuuugaacccuguguaaugucauucauucaacuguuuuucauguacuagcuuuaucuuucucuccuuuaucauuuuauuuccugacuucauuaccaguuucucaaagcaagaacaguuuuaggauuuuuguucucuaugauacucagaacagaacauauauuugaagcccuucaaaccuaguaugcuuucuaaacaaacaagcuacaauuguaagguacuauggcgucauaaugguauuucauguguucuuuguuucuguuccugaccaagaagacaugcaaaggcugcagacuuuuuggcuguucauuuuaacaucaacagaaucuuacauuucaaaagccaugaauguugucuucaagacuguacuaauaacuuuucuuuaaaaauucaguagaauuucugguguuucuacugccaaucuguugccucaaccaugaauucagucauugucgcugcuggcauucaguuuagaaugggaacuuucaugaguaauguguaaguuuaaauccaaaucgugagagagaauuaacuaguugaaaugguaagguaaagggagguuuuagaccaagaaagaaguaacauguacaagggcucacugguagacaagacagugacuccuuucucuccugacagaaagccaauaaucaguacacacacaaaauaagauggagccauagaggcacggucaaaacuugcagacacuaaaggccaugguaagauuuuuuucaaauauuuauuuauuuauuauauauauaguguucugccugcauguaugccuguaggccagaagaagagaccagaucucauuacagaugguugugagccaacaugugguuacugagaauugaacucaggaccucuggacgagcauccagugcuuuugacuucugagccaucucuccagcccauguuaaguuuuucuaucucuauuuuuagaguaguuguaaguuauuggaguacguuauaguagcuacauggucauauuuguguuuucauuaaagcuguagaauugagaauugucacaugggcuguauaauagauugaaaaagaccaguugugaggcugguauguuacuguaguaaauagugcaguagcagagaggaagggaauggauucauugcuauguuucaaaaaaguaaaaaucaaugggagucaguaaaaccucuauguaaucgauaaggaagaagaacgcaauauuuccuggauuucuuauuauacauugcccauauaaagaugucauaaucugugaaaauaugggaaggggacuagauuuagaaagaugaguuuugcugugagauugaguuugagguaccuagauacuuggauuuauaggaauagucagccuaagagggguuuuuccucauaaacauguauaggcaaucucauuuagauuuucauaguguagaacucuguugcucaauaugguagacauucacuacguguuauaauugggcacauggaaugugucugcucuacagugaaauaugcuauacucuaaaagcaguguuaaaaaauauaaagucauuaauaauuuuuauccuuauuacauacuaaaugauauuuuagauauauuaaguaauaaaacacacuaccaaauauuggagcuacuagaagcucuguguguguguguauuagucaggguucucuagagucacagaacuuauggauagucucuagauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcagaagguguagcccagauuaaaguuguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccaccacaauccaccccuugucaacuugacacaaauaauaucucauguucacaugaaacaauaacaagguuguaaauacgccuaacaugauauaacuaucccucguacaaucgcaaacgcauuaguaaauuuacagugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccuauacuccagacauaaucuugcuuacuaccauugugaagagguaauccaauuuccccaugguaaucuggaucuaucaccccuccuaacacuguuauuccuuuuuuaaccuguugguuuaagggcauuagaagcccaaaaugaccagggggaagucugagcuuccaguucaauggaauguuuguuguagcuccugguaggagcacuccccucucuggagccaaaacuucuaagccagcagaacuuagaguuauggggacaggaagcaaaaauuuuccuagagggucacuaggagugauaguaaguggaacucuucccuuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagaccagcugcuucaggaugauggggaacgugguaagaccagugaauuccaugaucgugggcccacugucguacuucucuggcugugaaaugaguuccuuggucagaagcaauacuguguggaauaccaugacgauagauaagggucacuggugagccuuccaauuccggauuguaguucauuccaaauauugucaaguugacaaccaggaauagccaccacaguguguguguguguguguguguguguguguguguguguguguguugccuauguauaugaggauacacuuauccaugcaggcauaguuacaguauggaaauuaauaucaggaugucuucuucaauccuucuucuacaauauuuuuguuuugaaacaaacucucucacuaaaucuggagcuagccauuucagcuuaacuggauggccagagaagccccagaauccuccugucuccuccccagucugggggguuacagacaccugcuuccauaccaagguuuuuuucuuaguguugaugguuuuuuuuuaaauuggguauuuauuucuuuuacauuuucaaugcuaucccaaaaguucccaacaugcucccccacccacucccacuucuuggcccuggcauuccucuguacugaggcauauaaaguuugcacgaccaauggaccucucuuuccacugauggccaacuaggccaucuucugauucauaugcagcuagagacacgagcuccgggggguacugguuaguucauaauguuguuccaccuauaggauugcagaucccuucagcuccuuggguacuuucucuagcuccuccauugggggcccugugauccauccaauagcugacugugagcauccacuucuguguuugccaggccccggcauagucucacaagagacagcuauaucaggguccuuucagcaaaaucuugcaauggugucagcguuuggaagcuuauuaugggauggauccccggauauggcagucucuagaugguucauccuuuugucucagcuucaaacuuugucucuguaacuccuuccauggguguuuuguucccaauucuaagaaggggcaaaguguccacacuuuggucuucguucuucuugaguuucaugcguuuagcaaauuguaucuuaugucuuggguauucuaaguuucugggcuaauauccacuuaucagugaguacauauugugugaguucuuuugugauuggguuaccucacucaggaugaugcccuccagguccauccauuugccuaggaauuucauaaauucauucuuuuuaauagcugaguaguacuccauuguguaaauguaccacauuuuuuguauccauuucucuguugaggggcaucuggguucuuuccaccuucuggcuauuauaaauaaggcugcuaugaacauaguggagcauguguccuucuuaucaguuggaacaucaucuggauauaugcccaggagagguauugcgguauugcgggauccuccgguaguacuauguccaauuuucugaggaaccgccagacugauuuccagagugguuguacaagcuugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucagccauucgguauuucucaggugagaauucuuuguuuagcucugagccccauuuuuuaaugggguuauuuguuuuucuggaguccaccuucuugaguucuuuauauauauuggauauuaguccccuaccugauuuaggauagguaaagauccuuucccagucuguugguggccuuuuugucuuauugacggugucuuuugccuugcagaagcuuugcaguuuuaugaggucccauuuguugauucucgaucuuacagcacaagccauugcuguucuauucaggaauuuuuccucuguacccauaucuucgaggguuuucccuacuuucuccucuauaaguuucagugucucugguuuuauguggaguuccuuaauccacuuagauuugaccuuaguacaaggauauaggaaugguucaauucgcacucuucuacaugauaaccaccaguugugaugguuuuuaaauuuagguucuagaggaucugaacucagcuccucuuauuuuugcagcaaguacuuuaucuguugauucauugcucuagccucgcuucuagaaauuucaggauuaucaaucuuacauuuaaaacuauagauauuucuuuugugcauugcuauuaaaaacuuaaaauuaggcuuuacagugguuuggauuagaguggcccccauaggcucauguauuuggauauuuagucaucaggaguuguuacuacuugagaggaauuaaguguggccuaauuggaguagcuguggucuuguuugaggaaguauuucacuagggguggacccugcaguuucaaaagcucaagccuggcucauaaucucuuuuccugcugccuauggauccagaggaagaacucucagcuaccuccccaacaccaugucugacagcaugccaccaccauaauggacuuaaccucugaaaguguaagccagacccaauuaaaugcuuucuuuuguaagaguugccauggccauggugucucuucacagccauagaacaaugacuaagacagaccuugacauaaucucaacauuuauuuguauuuuauuaccagaacagucaaauucuugacaucuccauuaaaauacuuuggacacacugcauacuuaagauuucagcccugaaagaaaccucuuaaaaucuuacuugguuaaaaauguaagacauuuucucuccccaccucccuucugaggagguaucaccaaaaauaguuucauugaaagaggaacuggcuuaucucugcuuuauuucugaagaagcagagauaauacuguauggcuugaauuuuuaagauauccucaauuacugugucaaucuuagggaacaaagagauacuaguuaccuuacaucaggagauacuaguuaccuuacaucaggagauacuaguuaccuuacaucaggagauacuaguuaccuuacaucggagguuccccuucuaggaaagacuuaaaaaugaacagacuaguuugcacaccaacacuuuauagcuucuaaugaaguaacaauucaaaagauuaucaguggcugucagcuugaccaaaugacuaaccuagacaauacggcuuuucaaagagugcaugcuucccuagaaauaauucuuuaaaaguugugagagucaaaucuaaauguagucagucuucuugauuucacuauugcgccuaagaaguucauggauaugcacuauaaaaauaugaucagcuaaaucuagaaugggggaaauagaaagacuaucaaauuauuuaacaaaucauuuaagggaacaagaggaaguauuuugaagggaggaauuauggaaggaggaaauccauaaauucagagauauaaauauaaguuuauuacaauggaacauuuauagucuuauaaacuacauuuuuaguugauuauagacauuucaauacagauaugugccauugauaugauuaauuuuaaaagcaugacuuaguuaacaugauuaccaaagaguuuuugagauaacauacugaauuuuuuauauuaauuaauauauauucuagggcaugucgacaagaauaauggauuugaucagauugucaguggguuaaugauuguugaggcuauaucuguggggguucuuuuuuuuuauuuaacccuuuucucuacuuuuguauguuugaaacuuuccaaaauagugaaaagaguaagcagaggcucuguacaggaaacaugaaaggagaaaaugggccuuuguuucagaagcucuaggaauagagaaccaacauuucaagauucauucccauaauuuguccccuugauuuucauaaggaccugccaggucugguauuuugacuaguaaauaggauuugugcucuuccuaaagcaaaugcauugucuuuuguuuuuguuuuugcuuuuguuuuuguuuuucgagacaggguuucucuguguagccuggcuguccuggaacucacucuguagaccaggcuggccucaaacucagaaaucugccugccucugccucccaagugcugggauuaaaggcgugcgccaccacgccuggcuaugcguugucuuuuuaaccuucucuuaguuacuucaucuuacuuuguaaguuguguaacuuguguuuaucuuuuccaugaauaucauuaccacaaauauuucaaaauauacauaagauuuauaaggaaauauaugaacaucuauguaaccauuacugaagccaggaaauggggccucaaaguucccucgaagcacaggcuuuucauaccccagaucuuguuuguucucccugacacugccauuggauaucucuauugcucugauuguggaaaucauuuccuuguuucucuucuaguaucucaaaaacauauuuaucuuuacuccuguguauucuuuuccuuacuauacacuuaaauauguauauuguuguuuuuuuauauucucaauuauauaaauugauacuaccuuauaaacauucuucugaagucucuucaguuugcaucuaucuagaagacucauuaagguuacuaguagugccugugguuucuuuuucauuguuuugaagugggaucucuuucaugccagguuggcaucuaauucuauauagugaagaaugaaguggauccuccugucuccacgucacaaauguuggggcuacaggaaucggccaauauaccuaacccaugggauguagggcaucaaacccggggcuuuguacaugguagacaaguacauuaccauugagccacauuccuaguucuaguucagugugugugugugugugugugugugugugugugugugugugcaugugcacaaaugugccacagaauacccauggaggucaguggaaaacuugauuccagggauugaacucagguugucagacuuggcaucagcaccuuuaccuacuaagccaucuagcuagcccuagauucauuucuuuuauuauauauaugagucaaauaugagauaaauaucacaccagcugccaucucauucaccucauguuuaugucaggaggccuauauaaaccauaaaguacacucuauaauguuuacaccacaguggaugcaccuauugucucaaaaugugccccgucauuaagcaacacacagcugcauucuauguaugacccuucugucagugaauuuauucuuucauuuauagaccuuagauuguuaucuuuugcaaugauaaaguguucuugguguauauauaugaguauaucuauagagcaaagcuugcuagagugugacucauagacaaguuuuucuguuuuuauuacaguaaaacuuucacagaauagguaugccuaguuguacaugcugucugugaguacuuucagucaagaguggcagaaccagccuaaaauuuuugcuaccuauccauuuaagaaaaacuugcugauucugauauucugauuccugcuccaggauaaucuucagaaucacuaaauuuuaggagccaaauuuugauuguauucauguauuuccugcucaaugucuuuuccuguagucuuuuuuuuaacagaaauuucuauguauuuaauacuguguguguguguguguguguggucuaggaauucaaauaauguuuuuguguagguccuuaccuuuccacacuuugagacagggccucuuuuuaagcuagaaaagcuagccugcaaguuucaggagguuauccugucuccaucucccuuccauagaggcaugcugggauugcagacauuuaggcuacugcaucuaucuuucacauagauucugaaguucuaaccuuaagucaucagguuugcacaacugagccauuuccccauggcaauaucugcagacauuuagcuguucuaguguguauuuacucugauuauacauacuguuacuaacaauaggauaggugucaacuucauauauuuauaucaauaugacuuuauauaaacuaccaaacauaauuaauggugucaucaugugucuauguuuaugucauagaaaugcacgguauacaugaggauagaggcccaaaguugacaucaggugucuaccacaaucucugauuuuuuuuuucuuaauuaagccagauugucucaaagaauccagaaccugcuaauucuagcuagucuaccgagauaguuuaccucagagaccccacagcagugccuccugaaugaugcugugauugcagagggcccgcauaccugcuuggcuuuuacauggguguuagggagcugaacucugaugcucacaccuaaaugacaagcacuuuacccacugaaccauauuccuaccccaagauaaauauuaauagacucaacauaggacagauaguuuaggauuucuacauaaaauauugcauagucuuuuuguuugucugcuuuuguugauguaugagcuuucauucuaugacuaccaguuuauccuccuuucuguuuggacauuuugacuuugcuggugauauuucucuuaacauggguguuuugugcuucuuuuuagaugcacauugagaagcagaauuaauugcuuuucaugccuauucuccauuuuagugcauuaugacaaugcuuuuuccaaaguguuuuugccaguuuguaacauaacagacaguauacuagaguuuccauuaucuacacccuugccaacauuugauaugggaagugucuuaguuauauugugguagaugaguaguagcauuuuacugugggguuaauauccauuugccagauaacuaaaugaagucaaaucaguaucuaccuaagggccugucuauuugggcuugguaguuucauauuuauguuacuaacucauaggaauggcucauguucucaacaggaaucuuuuauaugucuguccccugcuuuuucgaucuuaaugacauuuguuuguuuucuuuggugaaaacagauuaucauuacucaauuucaguguagucaaaacugaaaauaaaaaaggaccauuuggaaaggugaaggguauuaggggaggcaggacaacagucagcaaugugugaaagaugauaacuauagucaaaguacauuguaugcauuaugaaaaugucaaugaaauucauuauuuuauauaauuuacuauauaguaauacaaguaaauucaaauagaagaugggaaguaugaugauuucaguuuuuaaaaaaguuuaaauauuugaauucacgcuccacauguaaccuacuguaugaccuuggccagcuuuugaacuucacuuuccuuaucuguaaauagaugguaauaauauccaugucauagaauaauugagaagacuagccaagauaaaacacuuacuauagagccauucaccuaacagucccucaauaaauguuaauugccuccccaucauuuagggugcucauuuucauccugccuuuugggaaauuggguaguauucaugagcuauuugcaaaugaauguuuuggaaauuagaaucucauauaauuauccuaggaauuuagaagguggccuaaaauaguaaaccauaauuaauuugcccagagaacuaaaauguaaaauuuucucuaaugaaaagaauucacagucaauaugggauccuugaauaauacaaaucaugacuagaguaucuuaucuaggacaggagaagggaucaguuagagcaacucuaaaccuauacauauugcaucagauucuuaaucaagcaaggguagaccuuaaauugcuagucauuccagcccaaagaaccuucuccaacucuuuggaauuuucuggugcuuguugauugauuuucauuuucucuuguuccauuguucauugacaauaacuguacaaaauauauuauguuuaaguggacuagcaccaaacacugaaaacuauagacuuacuccuaccucagugaagcuaaguaaaaugaguagaagacuuuguaaacagaucccagcaccaugcaucuuuugaucccaaaguuccucuucugauaauaauagaaaggaccaaccuucccacaaauaaucaugcaguaaucaaaacauuauggcauauuuauuaauacacauaucauuuaauacauguuacaguuguuucuauguaaauacauaacuaaaagaguacuuccauacuuauacauaugaagguaacaaaaacaaaucaaugagaaacugauagaaagccuauacuugcaguaaagaaacugcauuagauaaauuuccugguuuuauacagcuuuuuuacaugaaguuagucacuaauugauuaaacaugaagaugacuaggaccaagaaguaaagucccagauuuacugauuugagaaaucaggaaacugccuacuuuaaaaugaaggagaaucaauauaaagagacaccaaauucugccuguauauguuugccaaauguuugauccuuuaacaaaucaauacucuucagaggaauaaaauagaauacauagucucuuaaaagucugguucauaucuaagccacaauucagaauuaccaaacauauguagaaacuggaagauguggugcaggcuuaagagacauucaguaaacacucuguggugacugaacuugguaucaguagacaaggauuuuaaagccaguauuaggaauuuacucaaagauguaaaauaagcauaugaugaaauaaauauaaaaucuccauauagaaaaaacuauaaaagaacuaaauggaacauuuagaacuaaaauacguauuuucugaaguaaaaauucucugaaugcacuuaacaguaaguguaaaaucccaaugaauugagagaucaaauuuacccaaucugaaaaacaaaaauaauuuagaacauaauuuucauauaauacauuuuaaugucuuaacccauuaaacaauguuuaaagaacuaacaugucauugggauuacaagagaggaaaggaaaauuguaaaugaaacuguaaaguauuuuaugagugcuauuguucagguuuauagcaaagagucaaacuuaaagcucagauaucacgcacaucuuggaauggcuuauacuaccuguuuauauacucuggauuugugaguguauguuauauacccaugcacagauguauacacaugcauacauccagaguggcaugcaaguccaagagucagaccugguggcaagcauuuuuacuuuuugagucaucuugccaggccacacauuagcuguuuuaacacucuuguucagauugucagucaaaaacgaaggugugcuuuaguguguccuaguuguacauuaaucugugguguuugugguuucucuaaugaugucauuucuccgauuguaauuuauauggcuuucauagggccacagucuuacucugccuuacuugguuacauaguuggacacagaagagagguaaauauaaaauucuggguucaugcacaaucccagaugggaaggaaagugagcuguuagagaugauuauagaauauaauuauauaauccuuuauuccauauuuuaaaagcuaacaguaaaaucugacacuuuuauacuacuuggauauauauaggguuuuuugauaaaaaauggauaguaguaaaauugucagauuuguauguauguguguccaagaaaaucuaugucagacuguuaucuauauacuguuuauugaagcaguauuuacaaugacaaagguaaccaaccaggauguacauugacagaugaauguauaaagaaaacauguccuguauauacuauagaauauuauuuggccacaaagauugaaaucuggucauuuacagcaacaggguagaauugcagggcauuguguuaagugaaauaagccuagcacaaaaugggaaauuuuggugguuuucucucauagauacacuuacaaucucaaguaacugggcaggggggagaaguuccuaacauaaagaaaccugauuugaccauugacaguguagauggacauuaaauuaucacaccuuuaaaaauagaacauguucauauacugguaagaaaaauaugucaaaaugcaacgaauccuuuuuuugauauuuuuauaaaaaaugguguuggucauugagguaaaauugguuuuauuuuucauuuagauuggugcuccaauaguuuauagucaacauauuguaauuauaauauauuaaauguauaaaggggauuggcagcccaguagcuuuucugucucacuagguucaggaguuacuugguagaaguggguauccaauaucacccaccauauaaaaugaaaauuuauauucauguuuucagaggucuauaagcuaaauuaucuuacucauaacaugguaaaguuuagcuugcuuuucugugcucacccuucacccugugacuuccuacaucuaucgugccagcuccaggcucuccaagaacucuguugcuuucaaauggauucucugugugucccuccucuccugaauuuuuuuauuauuauuauuuugaaaggaaaaauagaagagcauucaacaugauccucauuuagcugauucuuuucucaucuggcacccuguuucugcucaaauuucacaaguuuuguuugaaauuuuuccugaguuccuuuuuuuuuuuuuuuuuuuuuuuuuuuuauaguaagaugauuggagauagaguuugguuaaagacauucggauuacaauaguuuagugauuuggugacauaagaaaaaucugacucauaagauuaucagaaagagaauuucagguuuauuuaacagaaaggacaguugguuugguuuagucaucaaaauaaaguccggccuacuggauaccguguauuuugcauuuccauugggaaugcagcacuccccugucccuuucugcuguuuaacuuaagcugcagugcucacuaagagaacagccguggggcugagcagcuuauuuuuuuuaaucuauucauuuuauacuuucagacagauuuuucccuggggugaaacaaagguuaacugaaauuuccucuguuguguaccugaacgaaucagcaguucgaggaggaaaucccauugaugggccaagagagugacaggcucuauuuaaagaauucccccgacugugugguagaccagccaugccaugaauuuaacuguuccugugguccccauacuuguacccaccaaaaagaggagagagagagagagaaagcgacuuuguucugagcuuugaaaaccaugagccauugaguuuugugaauucaaguuagacagcaacagagcccaaagcucuaggggacaaaaucugaaagggaauacacaaaacagguagaagcuguuuaacuguuuauugcucuguguaugugcauacuagugcuuuguguguacacaccaaaaacuacacuuucauauguuaugcagauagcccucauuacagcucagcaugggcuuuuguuaaauaucucuugacauaugacaaguaagaggguuuuuuguuuauacagcuuucugcuccauuaaauaguuuguuuuuaaucuauaaguguacauauaagaaaugaaaguaaauaccauaugagucuaaauuauuuucuuuaaaguuuauauuaauuagccuguagaagcuuuauuuucagagauagcucauguauuuuguauuuuuccuguuuaaaggaaacugcuuuaaauaugaaaagaugguaucuuaaguuggauuaaacauccuuaauucauguguauuuaaccucaggacuugugcgccuuguugaaaaaaaacagccuuaaaacccugccuaguaggccucaauagugcauacugcacauggauuauaaauagacauugucuucucugaaguagaaguuaguauguauucucaggaggaaugaacugaauaugugacaaauauuucacauguauuucuauguauaaaauuaaaauauaauuaauuuuuuccuuuguaauuugaagguucuguuaucaaauuuuucuuacauguacccucuguaguaugaauuggaacuuaaagagauuuugaaggauacuaaaauuaauagagaaaaguuucugcaucuggagugacuggcuuuugucuggggacuuugaagaagcagauacuuuuaacacugauggggauuuauuuuagagauuaugugauggcuggauuucaugcucacaaauaggaaauugaaaucucaagaaugaaaauguuucgcauguagucacgaaauguguugugaagaagcuagcucuuaguccgcaccaucuguuucgccacucuuuuauuuggagauauuuagagauaguuucuuaaucuguuuucugacauuuucuuuucucuuuuugugcuuugucuuucuuuugauaucuuggucuuccugcuguuauagcacuguaaggaacagacugguagguaauagauuuaucuaacuagcccaugugaugcauaaagagcuccauugcucuuuuucaaugcuauucagaaucaaaauuauauuuaccuagauauuuuagcaaguuacaaacugauaguugucaguugcugcucauguaaguacaagaguggccaauacccugaaagauacuaaugaucaguauagggcccgcugcauggcuuaaccgguaaaggcaccugcugacaugucccaggaccacauagaugggaagaguuaacuugugcacguuguccuuugaccuguacccacaugugugugcccauacauauacaaaauuaauaaaauauguaaaagcaaacauuuuaauaaaaugacuuuuuaagaaucacuuaguucuucaaaacuuuucaaaugcuauauaguggacacuagacaagugcuaagauauaagagagcaaguggaacuugucucugccucaugcagucuuacguggugccucacccugaggaaccacaacuguagaugugaggcauuauucuuacaguaccucaguggaagacuggcauugcuccucacauaccauucauagcuaugucaaauacaauucuguauuaaaaguagaguggaguucacauuaguacuugaaugugcuguaugauaaacggagaucuuguagaaguaaaugucagcaacuuauguuuucauguacugggucccauuucaaccuuaacuuucuauguggacgaaggucucugggugggaauuugaaaggacguguucuuuaggucuagugaauauuuucuuugaaguguuguacauuuauauaaaaaaauguaaguucuccuuugaacacggcuuuauauaauuuuagucucaugccuuuugcuuacuuucugacagucucagucuauauaaguaauaauuauuguaggugcaauaauggauacuuguguuuggaauuuuugucuuugucucuguguacccggcucuccuggaacuuguacuguagaccagucuggccucaaacucgcagaaauugaccugccucugccucccaaguacuauaauuaaaggcauaugccaccucugucuggcuuauguuuuuggaauuuaaggacaauuuaaucauguauuuuuccugggguuaaauugccuugugagucaguuauggagcuggcuguuaaaguaguaccugaagucuccccacagacuaggucacuugcugccauaguagaagaugcaacuuuuaagcuugauaggguaccaguauuuagaauugguaacacgucucagacagcugccuguccuuauuguucaugaauucuuuccuucauuucucuuuucaguucagucagguuguuuucacacucuauccaaccucuguugagaucaccaguggcuuuguuaauaagucuaaagucggcauucaggcuuuaucugaguuuggauacauugcuucaagucagccaaaguacauggguccuucugcucagguuugcccgcaccucagugauuuacauccuuacucuucugcuugaccuguauucauucccuuaguggucuucacccagaaugaagcugaguguuauccccaugucucuauuggggaauuucuaguuccaauucucugucuccuaaauuggaauugacagauucaguagcagcuucuucauuucaauauuuuaauacuauuguaagccuagccuguccaaaacuaaaccuaacucccuugacaugguauuugcagguuuuguuacaguaacccccuucucuuaggucaaacacuaaggaucacccuugacucaauucuuucguguuuaucucuaauucucccauagacuuuauuagcuuuaccuugaguguauucaaaguguauuacuguacuucucauucaucuagcgugaucagaggcccuauuauuuguuaauuaaacuacuuucuugacuuguccccuacucacauacuugcugccauauuuuauuaucaguagaguaauucuuuacaagucaaaucauaucuuugcucacuguacuccagugacaaccuuugacuaacaaugaaggcccaagucuguauaaugcccuaaaccuuauaaaggugugccuauaccuaauggacuucacccugcaacccuccauucacuguucuagccacacugcacacugcugucucauaagcacuuugccauagcacuugcuauugcuuggaaugcucuuauccagaaaugcaugacuugauucugucaucauucuacauaaaaguguaagccauacccaacacgcucagcuucugcugcaugcucuacuguuuuauccaaagugcuuaugaccccacaacaagcaucauuuaugguuacuuuuuguuauguauugguuuucucucucucacacacacacacuaaaauuuaaauccuauuaaagaaucagugucuaucuuguugacugaaauauucugagccccuaaaaugcugucugcuauguggaaauaauuagcuaaauauuuguugagugaauaaaucagugguaagauuugagaucauucuuuaguugaacagucagucuaauaucaauuucauugcuguuguuuuuauauauuauuuuaguacuaggauuuuuuacaaaacucaugauaaaaauucacaaugaaauauaaaauaguuuagagaaaaucuauccuguauguaaaugaaguugaagguguaccaacacaacagccuucagucuuagggcauaaguaaguucugaagacuauaacaaaacagaaaaguuaacugugcuacagagaugaggaaagagauagacuguggaacguacgacccgagcuguuuggaucgugagugauuauuggguugaaaugaaagcuacauuugagcuauuaauagcuacaaggugaagguauuugagcccuuuuaagguaaaguuauaaagaugaguuuugcuuuggauauguuaugcuuauaauggcuuauaucaacaugcuuaagacccuggguucugucacaaaaagaaaaaagaaaaaucauagaugucaauguagguauauauuugaucuaacaucuagagagagauucggugacuuguucuaccaagaagagaguaaguacagaaucaaacacuggagaaaaaagaaguggaaaggagacaaggaaguguucaaagaaauagaacaaaugaaagacuaguuuuuuuuuuuuuuuuugaacaaaugaaagacuaguuuuguuguuguuguuguuauuuuuuuuccauuuuuuauuagguauuuagcucacuuacauuuccaaugcuauaccaaaagucccccauacccacccaccccacuccccuacccacccacucccucuuuuuggcccugguguuccccuguacuggggcauauaaaguuugcaaguccaaugggccucucuuugcagugauggccgacuaggccagaaaaacuaguuuucaaauugaaauugcuagugcccacaccagcacagggcugaccuguuuucuacagccucuaccugccaccucugaagccuucuaaaaggagccucugaauuaauauuguuauuugugcuuaaguuuuuacagauacucugggcagggagguggggggauguggaaguggaaaucagguauuuaucuauugauaccuuuuacuaguaggaguauuuugcuaacaucuuacaagaagaaaaagacuuccugaccccacuguacuguugaccuuugaugguuuuguucagccuacuucugucgcuuggaauuaauuuuguugcuuguucuuagggguuuguuuguuuguuugcuuagacaggaucuuaaacaacuccugcugcuuuuauacuuuauguaguugagggugaccuugaacuccugauuuucuugcaucuaccucccaagggcuaagauuacaggccugagugaccauucccagcuucaguuucuaaauaagaaucucuuaacguguuaacucacugaugaaauauuagggcuuagggacuggaggauauuugauaacugucuuuauguccauucccucuaacaauagacuuuuauauuuuacguauaaaauauacaauguaaacauaaaauauacauuuuuauauauaaacugugaagagcucuuuguaaccccaagcuaagcaccugcacuuauuuccucuuucuucuucuuccucuaucucuaaaaaaagaaaagucaaauccucauuuaucuuuuacauaauuuuaaguauaagcuguuucugguaaauuuauaugauuaaauaagauaauaugauuaaaauaagaugaacauuuucuuucuuauaaauucuuauguuaaaauuuguuuuucuuaagcaguugccaguuauauagcacaaaauuauaaugauuaaauugauuaauuucugccugguguuaaaaugaaaaaucauaaauaugaggaaaaaggagagauagaaugugcacacaagugcacgguuugagaagaaugcaagugaauaaaauggcuguguccucagggguuuaguguggcauuguguguuucucaaaaguuuccguugaaguaacagaugcugcugccgagguugggaauccuaaguucacuuguggcuuuuucuguugcuuauuagaagugagaagcucccagagggaaucuggugugguagcguuagcucagggaaggcugugacgaacacgugacagcuuugucuuugugaccucuaaucuacauguaagcacaggcacaguuaucuuacaauuuauguagcucuugggucuaucucaguguuauuauucaauaauggugauugguuuuucaaguucuuuugaguucuuuaaaguuuuucucuaaaaauucuauucuuucuuagccauaaaaaauuaucuugcuggggcuggugagauggcucaguggguaagagcacccgacugcucuucugaagguccagaguucaaaucccagcaaccacaugguggcucacaaccauccguaacgagaucugauucccucuucuggaaugucugaagaagcuacaauguacuuacauauaauaaauaaauaaaucuuuuaaaaaauuaucuugcuaaacauuuacuguauaucagcaagcaaauaaauuauauauuagcuacaugucucaacucaaaauagugcuuauucauacaauaguacuuaugauuuaaugugauuuauuuuucuaauuuuaauuauacaagauaaugugaucaguggacacauagauaaaacauguagucuccauccacagacagcuuugauauagaaaggaauaaauuauuucuuaguagcacccuuaauuuaggccuuuaaaugcauaguagccuaaaagaugcagguaaugagggagaaaagacuuuacaaaagggauaucaaugggaauagaaauguuacuuaguuuacuuacugguugguuuuugaauuuuuauuuuuaccuuaguuaaguguacguguggguaugugcacauuugaguggagaugccacaggaguccagaaggaagcuaucagaucccuuggugcuagagucacaggcaguagugaacuaccuggugugggugcugagaaucauacuccagaagaauagcaaauacucugcaccacugugucaucucaccagcuccuuuaguuaaguuaaggagauaucaguacccccgauaacuagguagucauacuuugguguuaggaagcuacaaagagaaaugccacaguucaaguccaaaauguuacagaguuguaauugauccucccugauuugaagaaguaagagguggcaguaagagagaacuuucaaggcuagucuaagaacccagugaaugaaauggcggggagucuugagaguuucagucagggagaguaggugacaacucuuuagcuguuacuuuucuaauggagaaagucuuaccuuaugcccuguaauaggcuaaugggcaugcacuuaaccuuuaccuggguucuuuuaguuuccuugacaauuuaacuguguucucucucagugguggaagagugcuguuucagagcagucaaaguuggcuuuauaaugcaaauaaaaaauaaauauugugaaaagacucagauuuugcuucuuugggaauuacagguuuaggcuaaucauuagcuuccccccccccccacacacacacacagaggcuuacucuauauaguauaugaauucauaguuaugaagagguuuacaaacuuaguuguucaagcuacuuuacaaauaaggauuggguguuguugucauacauuagucacuuguuuguagaaaucaguacuuuuugcuaaauagcuuauuuucccaaauaauauugggcucucuuucgcccaggcgugugcucucucucucucucucucucucucucucugcuuguuuguuuguuuguuuguuuguuugaagcaagguuucucugucucaaaacaacccuagcuguccuggaacucacucuguaaaccagguugaacucacagagaucagccugucucugccucccaaguacugggauuuaaagacguaugccaccacugccuauugggcuuucugccuucuuaaaaaacuuaguuacccauuaucgagguacaugccugugaucucaucaaugggaggcugagacggaagaaucacaaguuagaagccagcuguguuuauuaaucucaguugucaacuuuugacaagaucuagaaucaccugguggucuggugaaucuaggcuacuaggcuccagugguuccuggucacacacagauaguccugauuaaacucagucacaaacaaaacaaaaagauaagaauaagggaaauggccucaucaugggagccuugucaaaaaagggcaggagaugagagugggaugacaguaaccuguacuacguacagguaugaaauugucaaggaacaaauuuaauaaaaguuauaauuaaaagaaacaaaugagacugcuaaauaauauguagaugaaauuuuuuugcuaaaugaacugaaguacaaauuagauaaagaaaaagaauaagagaaaauuauuaaauaagucacaaauuacuaaaauuggcccaauuuuuaaaaaaggaaauauagaaggaucauaucuacucaagaaauagaauaacuuuuuuuuuuugguuuuucgagacaggguuucucuguauagccuuggcuguccuggaacucacucuauagaccaggcuggccucgaacucagaaauccgccugccucugccucccaaguacuaggauuaaaggcaugcgccaccacgcccggcuuagaauuacuuuuuaaagacuauucuacaaguaaaauuccugacccacaaaaccaaaaccacaucuggugaauucuaucuauuaaggaaggacacaauuuuucccaguucuuaugaguccagucuuauaccacuaucaaaaccacacaaagauauuaugaggaaacucuaaaucaacaucccuguguuaguuacuuuugcaucacgaaguaccuaauagaaacaacuuagaaaaagaaauacuuauuuugccucaugguuuugggauuuaucaguccauuacaauucagugauggcccagaaguucugucccugguggcucuucaugugacauuagacaggaaacagagagggagaacaagccuggacugagauauccauaacuuccaaaagccugcccacagugacccacuucugccccuuccuccuaaagucacagccucccaguacagugccaccagccagcuucuaaguguucaaaacauggccuccaggggucaucucauauccaaccuacgauucuucaugaaugcaguuacaaacuucugacuuauguaaaguaagaaguucuuguucuuuaaagauacuacauauuaacccaguuaguuccaaaauaaaggcucagccugacauuugaaaccaaauuacuguggcuguucaggaagaaauaggaaaaaucauggacuucucaacuuguugcaaaaaaugccauuugauaaaauucacuaucuguuuucagcaaacuggaaauagaaagaaauuuauuuagcuauaaaauuuuccuaaaaacagucuauguaagagaagagggagggcaagggggaaacaguguaugcaguuguaaaagaaaacaguuuauuuccuaagacugggaacugaacagagaucugcuguucccgacuacauuuaacauccgucuguaggaggccugaguaucagugacauaagagaaagaaaggagagcaugggacuugccagggagagccagaacaaacaagacauuccagagguaaggcacuugcugccacgccuaccacagaacccgaguuuagaucccugggacccacaugauggaaagaaagaaccaacuuucacaaguugcccucugaccuccucauacauguguguacaaacaaauaaaaauguuaagaaaggaggaaguaaaacuaucuuuacuuacaggugguaugaacauguauauugaaaauuggcagaagcaugcaacacaaacuaagagaccacaacaaguuacacaguguaauaugaguauauaaaaagucacuuauauuuuauaaacauaaucaaaaacuggaaaagcauuaccaugaaaacuuaagcuaaaguagauugagagauguaucaguguauauggagacuugguauuacaauagccugcuauauggauucaauacaauaucaaucaaaaucccagcagacuuuuuacugaaauuaacauguuuauucuaaaauauauacccacaaucaaaggugcuagaauagccaaaacauucuugaaaaaaaugaaagucaaggguguguguaccccauguuucauuuuuuguuguuguuggguuggguuggguuggguugguugagacaggcucacaguguagccuuggcugcacugaaacgcacaaagaucugucuguuucugcuuuccaaguguugggauuaauugcaugccccacuaugcccagccugcauuuaauuuuuuaagaauaaaaauaaaucagcgugaggaguugagggaaugguuuagucagcaaagugcuugcuauacaaaguguuugcauaaggaccugaguucagucccuagcacccaugcaaaaaucuggaugcagccugcaucugcaguggggaggugaagacagaugagacagaucccucaguuuccauggugaaacuaaucuagccaaauggugagcccccaguucaaugagaaacacagucucaaaaaguaauguagagagauacugaagaagacaaaagaugucuaccucgggccucugcacaagcaugugugcagacacacagcccccaaaaagaagaaaaaauuaaaugaguuuugcaauuaaagugauuacaaggugucauuaaauuuuagugaugaaugucacugggauacauaagguagcucugaaaaugacagcccauaugucacuuaccugcauauuuugaaugaaagaauaauauggugggaugaagaaaugaggcugcugcuauuuaauauauccucacucuucaguacaugugugcagccuccagacuccacaaagaaaaucagcagcagcacagcgccucugcuucccuaugaauugaccuuuuuguaaagcagccucauaauuuuuuuuaguacagguauuuuauuuuaaaauauguuucuagacacuuaacccugguaggccugaaaaaauguagauuacuucaugucucuucaaaauucuuuucagagaagcgagucaagcuugauuuguguuuuugagauagguggaaguaguaagguuagacggaggaggaaaucauaacucggcuuuuaguccuuuguugacaccuccuuagcgucugcauuagucauaggucccuuccuucugguccggagagggacuaaaggaauaggagguauuugcagguuuguaaagagcaaugcaaagaaaaggaaauagcugacacagaaaaaugcuguuaguccucccguuuuacaguuguauuuuuagauucauacuuacagguuuauggauauuuggggguuugggguuuguuuuuauuuugaggaaaggcuuugcaucuguggcuagccugagcucacuuguguaggcuguaugcucacuauauuggccaagcugccuuuaggccagcagcaguccugccuccucugccucugcaugcaucaccccacccagaaggaaaacaaguuaggccucuuguuuugcuccuaugucacuauuuuugauguuguuaauguaauacaaaguuccuaacauacaaaguagaccaguuuucaaggucuguuguugucagaauguuucaguggaggcaagcaagauggaauaagagcugguaaaggugcuugccugcaggcuugaugacucuugugugaacccuggaaugcagaugguggucggagagaaccaccucccucaaacuguccucugaccucgugcacauagaugucaacaaacaggccaaagaaauaaauagauaauucuuucaaagguuuuugaugcuguaguggaagucaucuagaaaaaccaguagacauuguuaaugcugauauugagauaaagaauuucucuucuaccaacuuagguggaaaugagauugugugacuuuccaccacuggacagaauaagugaagacaagaugcagucaguugacacugcugggaggacucauuaaugagcaacuuguugaagaguuuagauagauaguggucacaguuuauacaccaacuucacacaauagccagguucagagaaucaaaagacaagauucugaggcuuguuuauaaaauauuuuggaaugucccagugucuagggucuagaaaaauaaaaaggguugggaucauugaaacaucuccucucuaaguaaaguucugcuuggucagguaggaaauugacauaaauuuauuucuacaucugcuguugagcccuuugcuuauuuuuucuguauuuguauuugagcuugguauacaaagccauuuuucacaaaucucauuugauucuuacaaaagauuuuagguaggcagggcaaauacuauaaauacuauuaucccuauuuuacaggcaaaaaauaugaggcacagggugaauaauuauuuguugagagucacacaacugauaugagugcuuuuaagcaaaguguugcauagauggcucaggugggugagagcaguuguugcaccagcuaggaccugaguugggauccccagcacccauguauaaaguaggcaugggcacacauguaccuguaaccuuagcuuugugcuaagcagaggcaaaguucacugccagugagagaggcugucacaaaggaauaagguagagugcuggcgaguaggauacugauauacucccugcccucauagauauccucucacaugugcagcugcacauacagacacacacaaaaccagugguauuagugcuuuguuuggcauacuuaaagccuacuaccacaaaaaaauaauaaagaauuuuagggcuagaaagaaggcucaucaguuaugaacacuugcugcccuugcagagguucaaaguucauuucccgggacccacauggagagaguccagguucagggagaucugacacccucuucuggcauccauaggcacauauacucauaugcauagacacacaauuuuaaauaaauaaaaagucugaaaaauaguauuuuucacuuacaugagaauuuuagauguuuaacccuuuucauuuauaccuucucuuaaacuucucauuuauaccaguuugaauacuaacacauuugaagucccauugucugugugugacuuaaggcacuaaaaguaaauuuguuuuauuuucuagaugauguaaauugguucaucagugacaaagacaucgagguaagaucaauuuuuuuaagcuaauauuguccuuugaucuacauauuuccauuuguuauuuuccauaauuuggggggggguauaaacuuuuuuaaaaagauguagucccauaacuuagaagagaaaguuugguuuuaguauguauguaauuuaacuuuucagaaauguaacucaacuuugauuuuugucagaugauaaguagcuauaaaucacccuucuguuuauauuucuucucugccuuaaugauuccuguuagccccuauggucuaguacuacuaagaucaacaccggaaauaacuguuucuucaguguaaggaaauggucagucuauauuuagaacauggcaggugcuugugucaauuauuagccuuauuguaacaaauacuuaaaaauaaaaaaaauuaaaagguuguuuucaacuugauagucaaguuuuaagauauuacuagauuggagauaguugacaaccaauucaggagaauaacagguaaaaaaaaaaugaagcuuuuucaaaaauggaauuuauuuuauuuauuuauguauguauuuuucucuuuuugagacagggucuccuacauagccuaggcuguccuugaacucgagauccuccugccccuaccucccaaguguugggauuauaggcaugaaccaccaugccugacuuuaaagacggaauucugccaaacaagauaagcgcaugguugggauuucguauuccucuuuagguauuucauaugauguacuuugcucauguucuuucauauauaguagaauuugacuagaauaagagacaacuagaauugggucacuauguggcugauaguggaagaauauugucucauauucuuagaaguugucauuaguuuuauaggcaauagagguagcccugugcuuuucaaaaaaagguuauauuugguaguuauauaguuuuguaauguuuuaaagcacaaaaucauaaaaauaccauucccuaacuaaaacuuuaagcaagccucucauucagaacuaaaugguguauguuuagauguagaaguuagcagcagcugaauguagcauagccauauuccugcuagaccugaucccuaaucgaaucuggcaagugggggcagucacgugggcaagagccaaagaaauagcgcuaucccugcgcucaccucucggggcuggagucugcuucuggguguuagguugaacagaggugucuguuccuucuuuuguuguaccaaaguauuaaagcugacuuaaaauuuaauguuucucacucaguaguuuuaagaggaagaauagguagguuuccuuaaacugaaauaauuuuaauucuuaauuuuuuuccuucuacucuuaggccaagauagauaauaacagaucaucuggaagguggaacaaccgauacuauucagucaacaaaaaugucaccuguagaaauugugauaaacguggccauuugucaaaaaacugccccuuaccacaaguacgugagaugcaugaugcuucuuccuguguuaaaggccucgagcccuggcuccuagacucagcucuggcugaacucagcauguuggauuacagggagcucaugagcauggcauggguguagugucugcaacccugggcuccauuucagcuuucccauuaugagcuuagugguggcagauacgucauacucugugccuagauuuucuuguccacaagaugagaagacugagugaaaggauuuccuuuuaaaacuuuguccucuguagacagcacauuucauugugcaauaauucucacuauuagagauuuguacuucuuuuugucuauauguguguaguaauggcaaagcaagcauauuuauuugaguucugcguuaugguauguaguggcucuggacacacaguccuuucauuaccuaaugccuccuaaagcagcucgugguaggcauacaacugcuucucugucuguuccuccuguggcuugauauccagacacacucauccuauuauccuagauauuucuacuuuaugacugaauaaguagaaauauaagauaagcuaaggcauauguccagacuuuguggcaacaacauacugauagcugcguucgaucucugaguucggacauuuggcugauuuuauaauucugcucaagguuggaccuucccugaguuucaaguuagaaauaacuugauauaggaaagaaaaaccaauguucuaccauuugagaccgauauguuuuugcuaaagagaguuuguguuugucugccauauagaaaguccgggccugcugccucugcucagagagaggacaucuccaguauggcuguccagcccguuacugcuuagacugcucuuugcccaugucuuccaaccacagauguuuugaaagauuguccuggagaaaacgaugugaccgaugugauaugauaggccaccaugcugacguaaguauuuuuaaugaacuaauuugucaagacuuuggacaguguagcaguucauaaccaucagccauccuacuugaaagaaugucuguugguagguuuguuuguuguuuucuugaaauaggauuucucuguguagcucuggcuguccuuguucugugaaacaggcuggccucaaacucagagauacaaaugucucuaccuccugcaugcugggauacaaggugugcacuaccacagcuggcuuuagaagaauguacacuugauguuuuguacagaugugcauaugaaaacugaucugaaauucuuguuggugauuuuacuagugguaaaauagucugugacaauaaguacaugcuucccgguacuuuaaauaugccugcuuucuuaguuaggucuuguuauagauuucaaaaguaacuuaggcauuguaguguggccucuaauuccagcaccucggaguccuaauccaaagggauuucaaguuuugaaaccaauuaaacucugucucaaaaaguauguauuuguuaauauuaagaaaguacaagaaauuuagaaaacacuucaguuacuuaaaacaaaaucagaacggugcauuggaccugccccuccuguuguaacucugugugggguugaaggguuaucaguucuaaccacagugucaaagcccaggaaggcuaauggcuuugauaaggaauguggagcuuccuacagucaauuuacuccuuuuauggaagguucuagaaccuugucgaauuugagaauuuuaacauuuuauaaguuuaaaaaucaaaugggagccagcaagaugggucaguggauaaaaucacuugcacaccaaaccugauucauagguuggauccccagaacuuacauggcagaaaaggagaacagacucucauagguugucuucugaucuccauaccacagcaugcacucauauucacacugaauaaauauuuuuuaagauuuaaauagaucaccaaaguuucucuucccauggccauccuugaacgucugcuuugccagaaccagauacguacgugcaaagaaaguucauaauaaaaacugaugaguuguguucagacucuugcuauauuugaaauaccucaauaguuaccaacaauguaaaaaccauuugacugaaaucccuguuuuauaaugugaaggacagauagaguauaagaccuaagucagccugcaccagugguuauggcccuccaaaugaugagacugugugaagaguaagaaaagauuucccauccugaaacugccaaugacucuguccucuucccaaaaacucuuagaggaagaguccucuuagguauuucaggcuggccuugaacucccaauccuccugcucuuugaaugcugagauaacuuaugcacauuauagauauucuguaucugguuuuaauagcuuucuuccuuugcuuuuaaauagggucuuacuauguaggcucagagacacaaaaucauauuugaaaaaguuuagcuguucugaacuguuguguuguguuuuguuuucuccuugcucugucaguuccagucuugaaaggcuaugauguuuuaucagaagcugaacuguuuuagcagugaugugaaagaaccauucacaguauagagucuuaaccacugucaucguacuuguuacuauccugcacagucugugaauauuaacucuggacuauuaugaacaguucccacuuugcccuuuucucuuuucucaguaggcagcuagugucaucagucauucuuguuugggguuugguuugguuugguuugguuugguuugguuugguuuggcuuuggugguuguuauucauguuggugguggugguagugguagugguuguauuucuguguggcaagauaugcagcuggggguauauaccagcauaaccuucugccuccuaaaugcugggauuaggccaccaagccuuucuaaacauguuucagcuuacaucaacccaaguuuguaugacuuuguuucagagucauaacucgggcucauacagucugcaucugggcugugugugcucuaacuucuugaccauagggaucccugcagcuuacuuuauuuagaugauuuccuugaaagaccaaauaaaccuuucucuguauccucuguuacuuuuccacuuaguuacccacaagaacuuacuuccucaucuuuauugcaucuccccaaaugucuccuuuugcccacccuggguacaauagcacauacaucccuacacccuccacuuuccuugcccucuuuuucugauuuuccuccuuuuuuucaaagaguuacuuauuuauguauaugaguacaauguagcugucuucagacacacaagaagaaggcaucggauuccauuacagaugguugugagucaccaugugguuucugggauuugaacucagaaccucuagaagagccgucagugcucuuaaccacugagaugucucuccagcccccucucuaaacuuugguuucuuguuuuauuuuagucaacauuguuguugcuacaaaacaguuuaaauauacaaugauaaagaaggaaggggcuuauuuugaaaauaaaaucaccucugagcuggugcgauggguccaugaguaaaaguauuuaccaccaagcuuggcacccugaguucaguucccuguucccauaugguaggagagaaccaauucuugaaaguugucuaaugacuuaaacacacacacacacacacauacuuguggugguaugggcacacucacacauguacaguaauuaaaguaauaaaauaauuuaaauuauccaaaauguuccagaauuucugauugauugauugauugauugauugauugauugauugauuuaaauaaaugugugguccuugagaugaucaucacaccaguuuggagaauaaagaagacauauuuguuuuuuucuuuuuuuuuuaauuuuuuauuagguauuuuccucauuuacauuuccaaugcuaucccagaagucucccauacccucccucccacuccccuaccuacccacucccacuuuuuggcccuggcauuccccuguacuggggcauauaaaguuuacaaguccaaugggccucuccuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauuggggacccugugauccauccaauagcugacugugagcauccacuucuguguuugcuaggccccggcaucgucucacaagaggcgauaucaggguccuuucagcaaaaucuugcuaguguaugcaauggugucagcguuuggaagcugauuaugggauggaucccuggauauggcaaucacuagaugguccauccuuucgucacagcuccaaauuuugucucuguaacuccucauauuuguuuuuuuaagcauaauauuggagcuaagagacaugacugggauagauugauuuacuuaaagguaaucauugaauggacuuuugagugcuucucuagcugcgaggcucgggauacuaauagaaaaguaaguugaccucugcacugucuuuuuguuaguccuaacuaauuuagggaucagaggugugggcacacaugccgugauauuugaguggaggucagaggacgauucugaggaguggcuuugcuccuugcacccuauugagggaagucucucaugcugccgccgugcauauuccaggcugaccgauccuugagcuuuaggaaucucuugucuccucacugagucgaccacagaaauugcccuacuuugauucuauguugcugcaagaaaaacugaccaaaacugacuuggggacauuuucucaguugagauccccucuuuccagaugagcauaugucaaguugacaaaaaugacuuagcacagcagugaucagacugaagauacaugccauugcaucuaacuuuuuagauaggccuaggcauugaacuuggguccucagguuggugcggcuagcacguuuaccaacuaagccgucugcccagcccugcuucuguccucacagucauuucagugaaacucauuuauguguucauuuaagagaauaaaucccaagcuaagaauuaaucauucauuaaaacuguucacaagccacuuaacuaauaaauaaauaucugaacuguuugggauugcauauacauagucuacauuuuaaauugaagcuauguaccuuaacacauuuaaacuuugaaggagaauccagccuuguuuugaaauuguguaaaacaguuuccuuucucaacaucucuaaucugaauucccccacccucucaagcugucuuagagcacaugccucacuguccagcacuuggcccuaguagugagccuagcagcuuaauggaaagauuucuuuguugaaacuaagaauaugcuaguagaggauagaaacagcucuuucuccagaagggagauuguccuccucugagucuguggugucauugagaauuaugugguccuuagaaauggacuuacccuuaauccaggccuaugugagacugacaaaguaaacuggugccagaagugacugucagacucauugaacaucucaccugcuuuuacaauucagcuguacaugucuacauagacuuggauuucauucuuagaucucuaauaaggacaaauucugauacaauugaucuaugaaauuaaggaagucagauccacauuaaugccuaugaggcuacaaacauaauuaaauacugcaaaccaaggucaacucuccuaaacuucauugauucuagauagcuucugaaccagauuuugcaaaucuccuucaaaccauacaguuagauacuaauucauucacuuaaacaugcagugguccaaccuugucugcagaauaacuuuguuuugaguuaaaaaguggacucagagcugggcgugguggugcacgccuuuaaucccagcacucgggaggcagaggcagguggaucucugaguucgaggccagccuggucuacaaagugaguuccaggacagccagggcuauacagagaaacccugccucggaaaaaaaaaaaaaccaaaaaaaaguggacucaguucuguguaauauguauaugugcucauuuauauauauuacuuuauccuauuaaauaggauaaaagauuacauaccagguuauuagccuugauuuuccucugcacacuaagaauagagacaggcugagaaauguaauuaguuucccucuacuuuuuaucauaauucaguuuuuuaaaaaagagagaaaaggauaauuauuucugaaagacuucaguuuaagccagacuugauaccauagccuguaaucccagcuacucaggaggcugaagcagaaggaucaccaaguucaagaucagccuggucagcuuaaugagaacauauuuccuaggaaaauaccccaguuaggauugcugacauggcucagugguaagccacuuacccagucuauguggugauguuacuguaguuaggucagaacucauagaugcauuuguauauguuguucuuuauuuccuuuuuuauagugacuuguauuuauguuuuauuuauauauucaaggcauaauaugcccuauucuauuacuuacaaguauuauauguuauaaauucuuugugaauaguauagucaauagccacguuucaguacuguuggaugguuuuuagccauucuaauaacugcauaguaucacuguuuuugugguucuaauuugugucuggccagggacuaacccugcugaauauccuuucgugugcucauuuuuauucuugugucguuccuggugaugugucuagauuccuucccauuuuuaacugugguccuuauuuucuuauuauuucagauauuacucaauauagugaguguucuaacccaaaaauacaauauauuucuuacuacuuauucugugcuucuuugcuuuauguuucaagaauuuugaagauuacaguauaugcauuucuucauauuuagauuuacacauuuuuauuggaauuguaccaguuuuuuuuaccaaauugcuuuucagucauuuauuguuuauguauagaaaaauauuuuauuaaauauuugcaguaguucuccaguguuacaacuauauuuaacuuauuuuuuugguugccuggauuuuuuauauuuaaaaugaauguucaguacuuguaauaaugguaugugucugugugcaugcacacaugcguacauauguaggccccagagauugaugucaagugucuucuucaaacacuuuccccuuauuuuuugagacagagucucugacugaagcuagagcucccuggucuggauagacuggccagcuggcaagcagccacuugccuccacuucccaacacuggccuuugaaggaguguaaggccaccacacccugcucuucacaugaguacuggggauccagacucaccgagcaccuccccaauucauaucaugauucuuuuuaagaugagcuuuuaaauuacaauugugacagcaucaaauagcacaacucuauacccaaaguuuaucuaauauacccuggauacuaugagcaucuugagagaaaaagaaaagguaauuccaaagaagaauuaauuccauguuacuuacauaacuaaaacugaaugauaaaacaugaucaugauuagaaguagcuuaauguaguuaccaagggaaauaacuuacaucauuagguguuggucauuugagaugcugcuuauauuuuuauauauguaaauauaaaauaagugucugucagugucagcacucagaaacucacuguucauugggcauuaucaaagugcuccugacaggauuaaagaauacugucaaccuaaaguuuuguuauuguucagggauaggaagguuaguauauaagaaaggaagccucuaggcuaguaugauggcuuaacaaguaaggguguuugccacuaagccuuauuacuugaguuuaguccccagaaucuacaugauagcagggaaaaccaauuccagcaaguuguccuuugaccuccacaugcaugaacacuuagagaugcacacacacaaaaucaauguaaaagguuguuuuaaaagaaauggaggcaauggagagauggggcaguggguaagagaguuacugcauggcacaagacccaaauucaauucccagcacccacaugguggcucaaaaacgucuauaacugcagcuacagaaggcaucaggcaccagcuauaaacagcgcacaaugcauguaauguaaaaaaaguuuaauuaaaagaaaagaaggggagcuggagagaugguucagcgguuaagagcuccgacugcacuuccgaagguccugaguucaaaucccagcaaucacauggugguucacuaccaucugaaugagaucagacgcccucuucuggagugucugaagauagcuaccguguacuuacauauaauaauaaauaaauccuuuaaaaaaaagaaagaaaagaacagaacagaaauggagguucuuggcacauguaauugcagcauccaggaagcuaagagcaggauuacggcuucaaguccaggcugggcuacauagggauaacauuccauuuaccuuccaaauuucucuccuucaagagagaguuuccuggaaggaaaucucugguaacuguuaaaaaggaaaugcuggaaaaaacgcugugcccauuauuauuuagacauucuaggaaaaagaacugaccugagcuugaguaaacaagucccuuugagaauaggguggaucaucaguggccaaaauagcuuaaaaauuuuguagucagaaguuaacucuaaauacaaucugauccaguauccuuuucuaugauuguaaacaacuaaaaacauuaaguagaucucaucugaauguaaaacuaaauggauaacuuaagugcuaaugguuuuggucucuccucaacucccaugacgaagggagucacaagcagcaauaucuaaaugaaaugucguuuguucucuccuuuuacauuuguuucugggagucuuugcuuuccuaccaagcucaaccacucuccgauggagucucagcuaccuuauugauguccguuuguccaugaccauagagcuuugauagaguauagagagugccacucucaugugacuguagucaugacuaauaacaguugagccuugcuauuuagcaggcuuuguucuaaagaauuaaucuucucagcucuaaccaucacagcagcacauugagagaguucugggagcccuguuucauaaauacaaaagccgagacgcagcaguauguaauuugccuaggacaguaaguagcagggccaggauuugaacccagccuuuucuuugguucugcauaucuaauguuagcuguugugcucgcaugacucauugucuucuuuuucuccuauuguuugacguuucauuuuccuuagcuaaaagcagugucagagaauuagcagcucuuuguaaaauaaacaaacauaugucagucaucuagaaucagaguaucuccagacauugugauuccuuauuaaaaaacucuuuuucuaaagaaaauguuacauaagagaacugagugugugugaguauauugagggucuuuugugaucaauuuuaaauauuuuucuguaaaguaggacaauugcauuuccaauaaaacugaaauauaauuuaacaaacuuuaugcccuuauaacuacacuuaacuuaggagaauacaaaaaaagagaauauuuucugcaaaaaaaaaaaauagcuuguuaguuuuccugauuauagagaauuuugaguauaaacacugacuaaaauuugacuuuaaaucaaaaguuaguuuuauggagucuaguucauuugggaagcagcuuugagguagugaucagugaauggauuuucauacuuauugcugaaaaauauauagauucuguauacauugccacacuauagguguugaauauaugucuaaaccuauuuguguuuauguauuuaucuccuuaccaagaauagccauuuuuaugcaaaguagaaauauaguaaacaaucuuaaaacauuuugaauuuuaauuguagauuucuguaauguuagaccuuagagcugucuuuauguagaauuuugguuuaagguaaauguuagaauauucucuuaauuuucuucccuccuaagauaaacuccagcucacauaaauauaucgggagaaccccaugcauacacggugguuaggcaaguguuuggacaguuggaugacuugagagucuuugugaagagucugcugaccagguuucaguguagggcugucccuugcaauggaaggugcuuaaaacagcaucaguguguggggagacucacacucacagucauuccagagaugggauuauuuuucuugccaucacuucucagucaacagauuuuaaacaaaauuauucucuuuauuuuuuuuaauuuaaguuauucagcauugauaagcauugcuuguuuuauuaaaucuuuuguuuugcugcagugacuuaaggggccagcucuuaacagcagaggcuuugacaaagcaccagaggauucuguuaaaaaguuguguuucguaauuguaguugucgugucagagccuaacugacuuggagcugaaggauuuuugugagaugaguagcugugccagcagggacccaagucuccugggcuggccgcgcucucauuaagauuugccgcuagcaguggcgguggugagcauguaugugacgugcauucuguuauuguaugcuuggcuugucagccugcagcuuccugacacucacuuaugucacucuuuauucagagaggaagaagcuuuugauaauuugacaagacaagcucuuaaacgaucuaggucauggccuucacugucugugauugugaacauauuuccugaaagcccugucacucaucacagcuacauuuucucccggggagccacaggccuguccuggucucuugucagcucauacauuuugguuauucauauaccaaauacaguacuggggguuuuuuucuucccuuuugcaaaugcucgcauguuaguaaggcuaauccuuucuccugugcugugcucccagcagggcugcguuccaggcucccucaguacaaggcagacaacuggccgaggggagcugaggaggaggaaaggccgcuuagccuuguuuuguguuuguucauuguuguggaaauaugagaacugguggcaagggccuugucuguugagcacuugagucuuggucugcugucaggggcuguuuaagauugaguguuuuauuuucuuugauguacgcauuugagaauagggaagugggaauuaaacaacagaugcacuaagccguuguucucauaaaacaauaauuagcaccugauaaaauucaauaugguucaaaaugcacaauauaaacucucaauucaucuggcauggcaaaguauguugauucaucuuugaauguuaugaauaauaacacucaguuauucauguauguuuauuauccaaaguacaauagacaggaaaacuaguugggcaaaaguuggcaagcagugaaccacauugccgaaacagauguacgagugcgcuguguguguucugguguucaucuaccuaaaugccaggaaggugggagccgugggccaggacugcaugaugaugcuguguguguuuucacuucagcugacuacccauucagucuaaauguuuuaaucagaccaaguuuucacuugcaguaguuagcuucuuucuuuagaaguuuauucuaucuaaauuuuccaugcuuagccauucugcuugcugagaauuuuuaaaauaucucuguguacaauacucaggaguguuaaaaagaagucaccaaaguuuagcauguaggaaaaauaggauuuuaaauuuugauuaaugauugcgguuacauuuuguauuuagaauuaacauguaugcucuccaaugaccucugcuuugaagucuuuuuuaauuguaguacuguuaucuaauaaaagagaagaaguuucauaucauccacucccauaucagucaucaucuuccuguacagggcaaucagaugauuguucaaaaacuaaggaauucuuuauuacuaaauugcuacuacaccagaaaaggucacaugguagaguagcauucugccagucuaugacaacucagugauugugauuuuucaaccauauuauucugaggauacugugguaaucaagaacuauccauaacuaauguauaaauaacugcuugcuaucucuauaguaauugaacucaaauuauauguacauagcaaaaguuuuaugccagaaggcaggaagugaguacuugaagauauaucguacauuaaguuuuguauguaaguauguuugagugugucauccuuaaccugagaaccaaaaaagcuacuuuuaauuuuauaaaaguauuuuucuuucaguuagcauuacuaguagagaaaucauugacuuaaguaauggguuuuccagauacuacauauuugaugaauaugccgcuagaacugggaggaagaccacuggacauuuuaauuuacaugcuuuccuauagaaaauugcacaggcuaguuaagccuaaaguauauaaugugugcuuuuucaccugaguuauauaucuuuguucuaacuacauaugugguauuuucaguagagauuuugcugugcauaguuacuguuaaaacauucuucuucuguaaggaugguuaacugaugagcgaaacagugcugcuagagacaguuuccucugggagagaucagugugugacucaggaaaagggucucuugcuggugucuguuccuggugcugaggauuuuuguuaucuauucugauuucaguaaguucaucuugaacagauuuuuugagguuucauuguuuuguuuuuagauuauuucucgauaaauaugaacauguaaaauuuugauguauaagagaaaggcuauagauuuuagggauuuugcuuucuuugguuuggcuuggcuuuccuuuuuuauucucuuuuucauuaaguuuuaaguuagcaccaacagacauuacagauaaguacacugcacaguuaaagcaucuuaaaaguggugcucuuuuaaaagacacucuagguuagucuuacagaucuagaccacugcucuugauuuaccaguuuaacugaguuacggcccagcaucauaccaaacuucuaaccugugaagaaagagaggaaaacuuuguaacuggcuuccugacaauggcagggaguguguuaaagcaguguaaaauucaauuaaaccgucuagccagguuuuugaagcugaaaugcagacccuuucuguuaagcuucuuauuuuccugugaccgacaccgguggaugcuggguuaugccaaaaccaacaggcuguaaaguaccuuguuucaugcucccagcugaucaauauuuuuauuuuccaggcuugcccagaaaucuggaggcaguaucaccuaacggugaguaaaaacaccuuuuuauuuuccccaagacccagccuauuuacccuucucugaacugcugaccauaaaauauagacaagcaucuucugcagcaagauaauaaacaucuggagaguuuguacugagaaagcaauaaugcaccucucccuuucuccugcccacugccugcucuuuauuuuccuguuuuuaaaagauuucagcugauuuuuauuacucaugucauuaaaugauucuaucauaauacccucaggcuuagauuauauucacuaaauuaaagggggaaaguauuuuagaggcuauaaaacugcgucuuuagaacacuguguuaccacaguccauaagcauacagcccacaauaucauccauuaucacuuucugcuuuugcugaaauacauucuuaacugcagcuagaaaaagcuuaguguaccuuucauauaggacaauucaacucuccuauccuuaaaagucuauacuuguuugaauuauagacauauauauuuaauagucaauuucugauuuauuauucaauucugauuuauuaugauuuuagucuuacugaaagcagaaaauaacuauugauguauaauccguuugauuaauucucaauauaaagucagcucacuuugacuuuccaguuuaaauaaugucaguaauucaauauugucuuacuauuuaauacauuuuugauguauuaaauaguacugagagaccauuucuuuuaauuauacaguuauauagcacaauauaauuaauaguuguugaaguuuaguauauaaaagauuuuguaugauacaguucagaaaagagaaaaggcaguuuuuuuaaaacauaucuuuauacugcuuuccucuuacagagauauaaagugagccaacaggcagacucaucuaccauugucugcccgggccacagugcaagggauaguaguauaucugcaggguuaucuaaaacuuuaguguuauauuaaauaaaagucauauacaugucuauauauuauauacauauaugugacaaaugcagucaguggauuauauuuuggcauuguagcagcucuuugguaacauaauaaugguaaagcccuuauagccuaaaccugauaagaacagaauuauucuuguaucucucaaggucucagagucucuguauagugguguggcaguacucguuacuuuuauuaaguaauaccaucauacauuugacuuuguagcucuuuuagcuuuuccacuaauuuaaagaauuuuuaugugacuguuauugaaugauaaaaauuagcuucaaauguaacagaagguuaaaagguuuguugaguauuuuuuuagcuuuucagaaacaaauuauaaaaagaauagagaucuuuaaaaaugaaaacaaaauaaauucaucuuuauuagaauauaauauauucuaucuguaagaauaacaaauucaauuugaaguuuucuuuauauggaaaccugguugauuuucuuucagaaaauguugaaguaaucauuguaauucacaacuaucagguuuuaauuaacagugaguuauuaugcaagaauaacuacaacaauaguaugcuuauaaauguguaaauacuuuuaucaauccaucuaaaauauaaucauuuuccaauuauuuaaauugccuuaucaguauauggacaauauuugaaugccuguaauuaagcaguauuaaauauugagugaaagcacacugcaugcugauuuuagccaucuucagcccuuuuacuaggcgauggacugccaucuauugacucagaguagcccucacaugugaacaguggcaucagucacagcaguggccacagaaggaaggaaguuugaauugccucuuauguacucauuucaaccagccugcuuaaggcuguaaaggucgagagaucauugugauacauucacuucuccucugaccacaaaguaucuauuucuaacuccaaaggcacuggacuuugggguuacauuucuuuuagaacuuguguuuggaacuguugacauuugagugcuuuucacuugcugugccugauucccaacugauaagaucuggaggaucauuuccagaacaaguacacuuuaagcagcuacaaaaucgggucuaggaagccucucucuuauaaacaugcaagaaagaugaagauaaguaacauagacuuaggaauuuucaauuuuuccuuacaauauugugaaauaagauuucaaaagagaaguuuucauuauuuucgguaauaucaaugguaaaaugagguuucuaauagauuauaucuaaauaaagagcuuuuaaacaaacuugacuugaaugcauuaauaaaaggcaaauccaucauuucaaaagacacacagugauacugagacucuaaagcacacccccagcacagcauguggcucuacugcuuuucuuuauccauuucgaugacuaauuuaaaaaaaaaaauguaccuuuugaugucuuuguugaucuggagacauaugugagagaauuuauuuaaaaauuaccuauacuuccuuuuaaaaaaaagaaaaagcaagccuuuugauaucuuugcugaucuggagacaaacaugaggcgggaaaauuaacaauuauguaguuuccuccaauagcuaacacuuuuacuuccucaaaaaguuaaaguuuuuacaugucuuaaucauauaacccuauucuuuacauuguaacuucugcuuucagauuuuuagcaaagccuugucuuuuucuucauucacauaguuccuuguagauuauuucccuaugaaaaaagaaaguccuuucuccaucucuuccuuucuuauguuauagcaaaaacacuaggcuaauauggcacccacagaguuauauagcccauaguauuuuucucugauagaaacuauaauuuaacaugcauuagacauucuuaucguguuuacuuaaaaaguaaucagaaaauugcaauucaaaagcuguauauauuaagaaccaaaaagguuaaugcaucuuuuauguuuaauuuugugcuuguuuuuuaauguauuuaaaaugcauuacaaccuuacuacuucuuaguuuaacuaaaaauuucagaauauggaagaggauauaauuuuuauaugagguuaaguuuuggaaugcuuagaauuuauacuucaaaaauggaaauuuuuauuaacuagggaagagaagaaaaauacauuuccuugucuuccuuucuggucaguguugacuagcagucaagaguacaacccugaacccgcugaauggcggagucuuccagacugcaguucaagugcuccauucguuuucccgguccacauucucuccuuaccugggaacaucagccuacaaguauacugcugaguuuucacagaaugauuuuuacagcaaaucagaauuuuaucaucuaaaaaauucuaugcuuuuugccacagaauggugccccaaauaucagcagacuaaagcuaacuucagaacuacuguuugacaguccagaagaagagaacaggagauaggugcuaaagcuacagccauucaaauaucuuuuaccuugggauugagguguaaggcaggguaaauauaacaucccaugcuuuucuuuaaaaaaaaaaaaaaaaguuuuuuaaagucaccaacaauggagacauuuuucuauucacguuuuucaaaaaaagaaacuuccuuuuaauguguuccgagcauguguuuggagucuuggguggcuuugucagcuccccaagcagaccugccaaacgugcgagcaccauccacaugcugcucaccugaggaguccucaucuuuccugugucuguuugcacgugggagggagggaaacagcccaggcguauauuuaagaaaauagcauugauugggcauuaucauuagaauuauauauuccaaaauagggugaggccugccucauuuucacuauuaaaaaacaaaaauguugugccaucuuuaagggccugacagaaacuaucauaaacaacaauuuuauaaauucauuugauagugcaauccacaaugccaacucccagaaccaagaauacucauaacucauaggcauuuuccucugcugcugggucagugcugugauuguuauguugcuauuaagacacuagagcuguuaaauuucaaagauucagcugucuuuaaaaucuccuuaaauccugaaacugcuaaaguuaaugugcugugaccuggugauugagaacgcauacaccuuguuugcaguccgugaggauguauuuuuuucuuacaggacucggaaguaaagcuuuauuucuuuuucaaguugcuuaauaucugaaaaacaugauuugguugguugguuuuuggugcugggucuaaacgcagggcguuauguuugcuaacuauguacucugccacugaguauaccccaagcaccaaugagauuuuuuaaauuagcauugaugacuucuauaauaagaagaaauauauuugaacauuaacaugacaucauuuuugaagauuuuucacuuggaaauauuaucuaaaagaguuuaguauuuguccuucccuuaaugucaaaaucaugauagauuuuuuuuauuucagucuuaucauuuuuaacuuaauauauaaaaagugauuacuacauuuaaagaauuaaaauuacugauguuuuauaguaauucaguuacauuccagaauuaauccuugaaaucaauaagaaaauacacuuucaaagagggugaaaccuggaauuauaaaucucaauaaaugaacuucauuuuaaaauaaauauaauuugccaaaucaccaaaaagcaguuugcuaaagugcuuucuauaaaagaaaguggaaaaguauagaaguugugcauguuauuuuuauacauguuauuuuuccuuucauguuucuucaggccauguacaugugcauauaauauagaaauuuucuuuugaaggaauaugaguuauccuuucagaaauuuuuuagcauacaugauuuuuaauauuuuaauucaaaaguaauuuggccuggacaggaaaucaauaugguauuuuuuucuauaggcuuauucuuguauaaauauauuugaauacuaucaaggcuuccuggcgaugguccugauguaaauacaagcauuugagguagugaaggcggaagugugcaucgccugugcagcuuguggaugaccuaggaagccaagccugugcuuugccaccucccggacgucugcgcucaccucagcagcagcucccauguuagauaggaacacuguucaauaauaaguuaguuuaaucugaagaucuccuauaguugguaacuucugucucauaaagucucucugcuuuuccaccucucauacuggcuggagagaaugacccgcacacucaggauucgcauagucacuagaugagcuucuagugugagggcugcuuuaaauuugaaagaaauucuuauagucauuaauuuucuaaucuaacagaaagguagaaaguuacauuuagacauuuuaucauccuuuaccccuccgccccuguuauguucauuuuuaguuacaaaugaacuauguuuauucguuacagggaaaagugauuaauaauuaaauauguagcaguuaaauuccauuucuagguguuuacauuuuaaaauauggcacacuuugaauuuuuuuguuuugucucuuuagaaacauauauauuagucaugucaucccagagaaaauuguaucccuuuuuacuagugacucuguacuuugaaagaauuccauuuuaagugaaaaugaauauaauuaaauaaaacacuuaaacuaaauuuucucagacuucuaguugaccaccauauacuaucuaauaccagaaauuacaguuuucacaucugaaauguuuagccauuccaauuuuguaagauuaccuacacaucagaacagaagaauaaaaugcaguauaauuuuagcacauuuuucauauguuagauaaauagggggcuuaugccauuccuuaaagugcauucuaaguaacugacucuguuguaugcuuuucuggauauuucaaugcagcaauaaauguaaauaggguauacaaaaccagugucauuugcacuagcuaauuacaguuaggaucaauauagucuuagaagucagcucagccauuugaaggccucuuuccaugagcagugucugagccagagcuggguuuugacguuacgcaugcuucuguaauuaacaaguuacgcuggcaguaagauuucaaacacuacucucacuuaagugacuggaaaucugugaaugacuuaacagauugaccugacuaggcuugaaauucauugauaguuuaacucccucguguauuagaaagucaagagaguuauauguagacuuguacaucuguaaauauuucuccaagcuguuugagaauuggccuuucaguaauauuaguaauuuacaugaagaaaaaugcuacaaaguuuggaaggcauugaacaauuaaaagaaagcuugaauagcuauuauguaauccaaauauacauauauguaugcaugcaugcaugcauacacacauaaauguauuugagauuaaguuauacauucacuuuagcugguuuuccaacauaugaauugauucuuuuucagaaauaagaauuauuuuaaugugagagaucagaaaucuauuggugaaaauaauucauacauacaaacacauucaucaauuacaguaaggcuaccagaaucuuuuguuuugagacagguaguuccuccugccucagccucauacugcugggcuugcaggcauaaacuaacaugcccagcuuuauuuucauugcuuguuuuaaaaacuguguauguguguaugcaucauauaugcuaugcuguauacaugcacacaaauuuaacugaaucuacuagauauaaauccaucuuuauaauuuuguaaugucugaucuuauaaauacccaccugagguuucugcauauuaguuuccuuuuaugaggcuagucugggcugaccuuggauuacuggugucuugcuucagccuccaaagagcuaggauuacaggcauagacuaucauucccagcuaaaugccuucauaggaguaugcuuguaugcagauauuugcagucaggagcacuaaguuuggggcuguguuuuuuaauuucauuuauaaaauaugucuccauuuuuguaugucuuagaucuauaauauuucuuuuguuuuauaguuauauauguuuuuuuaaagaaaaauaugcuuugaaauuuggacagaagggcaggcuugccaaugaguuaauguucuguauuacaauauaaggaaaagaaugccaacuuaagguugugcucugguuucaaguuugauuccuuuguguaguauguacacagagguugugguuaaaauguuuaacucagaagagccuuaguuguguaucugaaaaugagugguagugcccacaggacuugugaguaugcagugagauggucacugcagugccucacagcuccucauaaagcagguuacaccagguaagcacugccagcgcaagcccaugggcaccugcacaagaggugcgcugggcaaugucucugcucaaggugaggcuguaaugaccucuuguagccuccuaacaauguuuccuccuuacaguuacugaaguuaaauacagcguucuucuuuucuuacuauuuauacuugucuuacuuguuucaaaaaauguaggugaguaacuucuuuuuuuuuuuucuuuuuucccaagacagggucuugcuauguagcccgggcuggccuggaaucgcuauauugcccaagcuggccuggaacucaagauccuccugccucagcuucaugagugcugagauuacaggcgugcgccaccacgcccgguuuaggugaguaacucuuaauuaaguacugcaacaaguuauuuucuuaauuugauuuaccuuaacaucagcauaaacauuuaagauuauaucacaaaagauuuaaguuacuuccuuuccuauaaaaaugacaaaguaaaguacauuucauaauaaaagugcagugcacguuuagacuggcuuuaaucuccaccauuaaaggaagcaaagaagcaagaaagggaggggggauaaguaaugacaucacucuaaaauaccugaauuaugcuauuaugugcauaauuuuaacagauaacuucaauguccuaugacuaguuacuguaagcaaauuauguaaaucuuuauaaugagaauaguaugaaaucaaacagcucacaguaauuauagugcuuuaugcaaggaagagagggaucuuuuuaauaagacaagaaaggaaaccaaauaauauaccagggauuugcacuucagauaaaacuaguugugccugcacaugaccgauaccagaaaugagccagagagagucacaaacuagaauagcgugagaccugggugagcuucgugugugcaguauguacccuuggaagagcauuccuaguccauguuccuuauuuuaagacaagcaggggcuaagacagaguguauuauaaaaucagagaccugagcugggagcacuggccgguccuggguuugauucccagcacccacguggugccucagagcugucuguaacuccacuuccaagggauccauccucuuccugcuucugugagcaucaggaagauaugcagacauaagugcaggcaaaacacccacacauauaaaauaaauuuuagaauuuaagaaaggccauuacuuuauuuuuuaaaaaaagaccauuuacuuccuacccugaagguagguccuugaagcugugaacaguauucuaguagaauaagcaggcuugagagggaaguuauaugggguucuaaucaaaauuaaaagcuuggaauuuauuugggucccccuguauuaacuaauaaauacaauagagcuaugguucugaucuguaauuaucaauggagguuuauguaaacaucucauaugguuggaagauauguauuuagcaugauuuccaugccuuacagucuaccccaauaaaccugcagauaaaauaucugugaguuuacacauguguguauccuuuucugucccuucccuuauauccugucuccacacccuccucagcccuccccuacaucaaagcuugugguccuuuuccaucuguguacuaaaagguuccuuuguaaagcaggccauuuguccgucauuguuuggggugcaaacagugguaagauacccugucacugauccgugugcugugaauggcagcuccucucuggacaguugguggggggcugaggauauuccugagaggauuauuuaaccuuucaauuuagagggcacaaagccucgcugauuaaugaacuuucugaugguugccgauaagcggaucuauugcuuuauuuccucuaaaagugauuccuucuccuguccauauuacuauaaucugaaacauaaauguggcaaauagauuaaaaaacugcacuaaagaguuuaucuggcuggcaaacugaaggagcuaaauuaaaauugguaaugacagcaguggcucagccucauauaugguuuuuaaaugcacuguguauuuugaagagacuuauucuccagcuugccugguaaugacugcuuuuggugcaguauggggcuggcuucuguuauccccaccucaugccccccccaaaaaaaaaaugaguuguguuaucuggauggcugcagacacauacgcacccccuuucucacugcaugggcagacaaggucgauagcauuacaagguauuuguggcagugcuuguuucaguuuucagagcugccaguuuccaggcagauuugaauuacaaaagaagaagcuggcaugaaaauugaaagguuuuaucggcuggucugaagccucauagcacauugcuuauuuaugcaguccauuugcaccaggaaauauaaaaaggaaauacauuuuuaaaauaaggccauaaagacccagauauguuuaagauggcaaauaaaauauagauaccuauaauaucuuuccaggaaacgauuuucacuuaauguuacuucagaagagcagagcauuuauguugccgucauaaaugugugcgucugugucacuauguagguagucucuggggauuaagaaggaagcccuaugcuaacuuacuuuaaaauuaaaauagacggagggauagcucugcaguugaagagcuacauuggaaauauuuaaauagggugguaaauuaaacuuaaacuaacauuuuugcauuccauguaaaauuagcuaugggccagugaauaaacgcugcuaccuuuagagaaaauugggaugcuuuuuaagccuagaagauugggagcaucuggaagugcagcgcugggcuccuuccugucuugcauaugcucauuguucuccaguucugagcuuuucuuuuuguuuuuguuguugggguuuuuaguggcguguauuguuuacagaaagauuagaaaguggucaguuuaauaguucccucuuacggaacuuacgcuuuuauuuuagucuuuagauauaugucuuuuagauauagccuauugcuuuuuuaauguaguaaauauguaauuacacuauuaaaauuuaugccaguaacauacauauucaucuuuaacagucuuuuugcuuaccaagaaacgauacgcccauguaauaaacucuugauuacauuaaaugaaggcauaaauacguaagcacuugguacugcaaggccuugaauaauuccuggauuuaccaauggacauuugcaaccguucaacccauggguuuguaaaacucaaguaugucuaagagagagggagggagggaggaagcuagcuguguguuggaaauaucagaucaauaaaacagcacucacucugcugcaauucaaguuaacauuguucaagaaucuguuuuccaguaaagcaaauuacucucagcuaagccauaagaagugcaguuuuuuguaaauuucauuuuugccagugucuggggccauucucauauuuuccugaccucaacuaauuacuucauguaguuuuuuuuuuuuaagcagaaaacuaucaaaaaacauacaugucugcugcaugcuaaugaugugcuguacauuucuuaugaguuuucauaaggauuuuucuauguagcauguguggcuuaaugauguaaucaccugauagacuggaaaaugcgccaaaacagacguuccggucuguuguguacauaauacauauuucagaaaucugccuaauuaaggaauuacccaaugaauugggagucuguuggguauaugacauaguuuuaauacauuaaaaacauauguauauuauuauauauggcacuuagaagaguuaauagcaauguccccuggaaugcaguagaguuguuuuucucaguaagaaaaaaaguaaagcuuacaaccuucauaaaggaagcauuaucuuagcuuggggcaaaaauuucccccaguauuccucaaagaaaaguaaugcuguaaauauuuaucagaacauggaccaagagaaggccuuuuccaaaaccaugauggacagacacaggccuggaguugaggucacggguggaggagacacuguccagagacaccaagagcagaaagcguuagccugcacgcugccaguaccugaggucccagcuguuguucaucacaaacucaaccuugauuucuuuuuuuaaaaaaauuauauauauauauauguauguauguauguauacacacacauauguauauguguguguguguguguguguggucuggaugcugauggucuagcuauugguguguauguucugaagaugucagaggaaggcuaaaggaagcaccugcucuuccaagccuacucgcuagaagcuaaagaaaacacagagagcuaacaaaacucaacaucacuaccaguaaacaaguguauuuuaaauucaaaccuuuuuugcucaaauaucaaguacaugccagaggaucacugcagcuaauggaauucgaauaugagugccccuuuaguuugggauaacauuuucuugaggaaaccuauuuaauuuuguggguuagguuuuuaaaauaucaguauuaaggaagggguucugauacuaauuuguugaaagaguaaaauuauuuguaaauacuuggaauuaauaagguacuucuuaaauauaaauaucacaucaauuuuaagaaguauacauaugaaagauuuuagcuaaucucugcuuuucucaauguuauauuugguuaugaauauacauuuaccuuagccauuuaauaugcuuuuuaaaauaguucauaugaaaacuggcuugauaaguaaaaacauauguucuguucuuugagcauauguaugauuauaaaaauaaauccauuuuucagucacaagaguagcaaauucccccuaauuaguaaaauugauuacauauccuguauaguaaugagcuucaacuagauguuagcccucauuggaucaaagucaguuuagcuaagggcagcccaaggucacagagggaggugcccagcagguuuauuagcauaaaaaauuacuguuagaccgaggacacugaggcagcgcuagcauuuugaucucuuggccuuugucauggagauucuuaguagugaagggaguaaggccagcgucccagauaaugauuaacuguuuuaauggcauucauucauucauuccgcacuaacuauucaugcagaaaaaggguuauguaaagugacauuagaagaaaaucaucuguaaugguugcaucaggcugcacuuugaggagacauuaggaguaaauccauggcguggugggcucaugcuuuaucuucugauaguuacugaguuacuggugcaugaaaagcuuucagcagugccagcagaugggacggaccuuucacagguaaugcugucuaccagguuauuacugcuaucuaucgauaguagagucaucuccaagauaucacccuacaauauagauuauuuaaaugucugucacacauacacacacacacacacacacacacacacagccugcuuucauaaauaguucauuugguagccauugggucaaagucuuuagauauauuuuuuacuuccagaaagucuuaacaaagcuauauucacucccucaccucuauaucuuugucaguaauaccagcucaaaugacagaaccuggaaccuagaguuuaucagcugacauagucuacuuuaaauuggacauuugcuguuaacuaaaaauagagaaauaaauggaccaggaaugguaguguacaucuuuaaucccaguacucagaaggcagagacaggcagaucucuguaagccugaggcuagccuggucuacauagugagauccaggacaaucauggccacaaaguaaaacccugucucgaagagaaggggaauaaaaaggacauguauaagguaguacuaauacuaagguauaaguuuugggucaaaaauuucuauuuccaauacuugaaauagcuuaaagauuuuuauuuaaucuuaguauaaaaacguguccaguggaagucauuauugaguuucugcuacuguauuccaauacagucuucucuaauuagguacaaucuaggcugauuucauuucuauuacguccuaguacaugcuaguuuauuagaaugagagcauguagauagcguuugucaagucauuuacuaauuaauuauugugaaacaguguagaauuucauaacaauauaaauacugcugcuauuuuuauuaguaauaauggaaguuuuuaaauagugacauuauucaguugaaugaacaucaaauguuuaugcuccauccagagcaauaaaugaacacugaggcuguauuucagauuauucucuaaauaaaauaacaaccguugauaugaaacaugcuuugaaaucuugacuaagaaguaucucuucaucucuuggacugaagccugaguuccuccucucucugcauuaccauuucccucuugguuuuccaaguauguaccauguauucucaacaugaaguaugaaaaacaccaaggaaacaauauuauuauuauauucaaguuuuuuaaccuuucauggcaugauuuuuauagguuugcuuuugaggauauaaaagccaauaguuucucaaacaguaucuaaacuguuauuaacaauacccacaaugcaacaguuuuucuaugagcugugugcucuacaucuauaguaccucauccuucacucacuguugacugaacucucaccauaugaccggcccucuuccaggaggcggggccacagggaacaacuuucuccuugccugguggguaggugaggauuguugguaagguaaacuauuuaguauaucuggugcggcauguuuggggucggggcuuguuuuucaaagggaaggggaauagggagcaccaaguggaggccuuacuaggauaaugaccucuuuguaccuggagaacuuucccaguguggagugcaugguauuaaacucucaauagaagaaaguuuguguagaguguccagggaacaucgaagaggccagugaggcgauaagacacaaaaggcaugcagggaggaaggcugugacccacugaaagacucuaggacuuagugaugagaagagaagcuguuacaggagugauaacgcucugugucacaaaccagaagaaucaucuuguauugaaaauaggcugcaaagaaagaaacauccagaccaauuauaaggcucuauuaaucauauaaaugugaggugaacggucagaugguacagguggagugagagagaagaaguggauauagccuauaauaaagccaguauaaacaagagagccacguuuaagcauaguagaugugugccuuuuuaagaggacauuuuuuucuggggguugacuguucguuccucuuaucaucaccuacacacucugcuaaguugccaacugguuacugaguaccuaccuaccauuagcuuccaauccuuugcuagcuuuccaugucacuuaaaauauggacagagcaucuccaccuucgguuuuacaauuuugggugacugacccccuccucgccuucuaaaaccucuucuuccacucuuucaucuacucugucucaagguacugagguuuucuuguuuguuuguuugggggugggguguuuuaauccucuaagagugcaggccuguugcacuugggacuuugcaaagaguaguuguguuggucaguuagcacaauuacaugccugaguuuuuuuuucagcauuaggaucuccaucagcaaaccagucucaggcaccagcugugacuuauucacugucuuauuccaguauuuuguuuauacaaacguauauauguaugugggagaaaaggaguagacauggggagggaguggguuaucucuucucucacuggaaauauaagcagugauuuuuguguugcugacuucucaaauaucagaccuuaggacaaugucugacauggauucugcaguuacuauuuguaaugaauugcugaaaauguaugcaugcacucaugccauaugcucaggacucugacagacaucacuguagaaccauccguggacuuguguucuguucuaccugcucccuuccccuuccauucauggccaaguuccuuugcugucuuuguacuuaagauaaacucacagccaaugagucaacaguuuuccauuaccuacaauucccugacuucuaaguccacuguauuucauaggcuccaucuuagguaauaauacaucauuaaccuuuuucuucuucuuccugguuuuuuuuuuuuuuuuugagaugggucuucuguagcugggagcuugcuguguaauugaagcuggccuugaacuccugaucuuccugccucuaccuccugaauacugggaucacaggugcgugucaccaugcccaaaccaugaauagcuuuuaacagcuuuguccuuaaaaaauuacaauaucucuuugauuuuguuuucuuucuguauguuuugcaguuguauuuccuauuaaaacaacagccauuuuuuuggauaaggaaaaaauauuucuguguaauaauuuaauaacuucuggaacucuaccacccaaaggaaagccacugcagugacacuugccuauacacaugcaucucuguuaacgucuauuuaguaguuuugagaauagucguguuuuucuuguauccuaguuggugauagcugagguuguaaaugcuguuauauguaccaggaucauuuucagcagaaaaggcuggucaaguuuuauuuuucucaaauguaaugaugaaucuuauuaacuugauuaaauuaauagcaacuaggagcuuacuaaggcaugccuuuaguugugucugaggggcagauaguugggguuucuaaccuaaagaaugguuuauucaauuaauagagucaaaucugaauagacuguugggagguggagaaagucaguaaagcugagaaagggugugugugcuccuggagguucugugcugcucuggcauccuccauuacugcucuguuuccugucugcugugcugugagcuucucuagacaccuucccugcugugaugcacugaagucucugagacugagcaaaguacacugucuccccuaaggccuaugucagugcuccaucacagcacugggcaggguaaccagcaauccagcuuuucauucuaagacauaagagcuacaguacgguuuuuuuaaagauucuuuucuuaucuauacacuauuuuucuauaucaagaacuccucucucaccuaugccugcaaccccaaaccaccugauugcagcauuagauaaaauguuaguaagcagacuagcgcucuauuacagaaacucaguaagcaugagagagaaauuuaccaaagugcauacagaaaagggaacaaauaaagauggcauuuucuucuucucgguuaaauccacuaccuucuugagggucugcucuggccccugucuguccucuccuuucaacucucccucucagcuagccucaucuggcugcucccacuaaaaaugccaccaaccaacucuuccuccuaagcacuguccuuuuauccuguccuuccuuguuggugcuucucaauaaucuaugccugcucccuuuugucagcuuauauucaguguagaugcugaaaauacuuaagauauaaguauaauuuaauaaauaagcugcauagcuuucuccacaucccuucuguccuuacccugcucucugcccucccagguucucacagggaggccccauggauggucgaauaugagauagcugugcaucauguugcuagguuucuguugugcuuggcaguguaggucagacccuccuugaaaguauccuuuaaguccugggcucuguccugugucuccucagcccugaaccaucccuucucuguccuuucgugagcucugucugccccuuacauguuguuuccugggcucuaucaugagcccacccucacuccacuccacuccacuccacuccacucuaagaagcaauaucccuaaggauuuucuuaccauagaguucuuuuagaaaggaugggcuuuuagcuuuuccucuaauauguauuaacuucuuauaaauauuuauguugcagaccaaaccuggaccaccaaaaaagccaaagaccccuucuggacaaucagcguuaguguauugcuacaacugugcacagaaaggccauuauggacauguaaguuugaguagcauuugaacaaaaugcaucuugucagggagugguugcugcaaagaugauccccaaauggauguaacuuggaacacuuacuuguuuauccgcuacuaucugguaguaagacuugaauuuucaacuaauuuacuucccugauuccuaccaacaaaaacugacaaagcauaguccuauaugaaaacugacaaagcauaguccuauaugaaaacaaauuuagcuccuaaagguagugaggcagagucagcagcagcauagaaugaggccuggcgccuugcguggccuuuuacugaacuauuuauuggguuuucugcuugguucuucagccuucccugguaccaccacacucacuuaaguuuuuguuguucacaugcgagugugacauucaguagaaacacagaaauuguacagcuguggcucauacaccuacucuccaauucccuuccggccaauacugugcaagucgagacugaaaggaccaggccgugugauggguauaagaagagaggcucccuacuguaagguggugaaucugcucuagcuaguugccacaguaagcaugaaacagcagcucauccgagcugagaccuaguagaaauaggcuucacacccauacacugggaaccgcaaaguugacgaggaaagcaguggcucagggaguagaaauccuugugcaggggauuccuguucuccacagaagcucuaacagccuagaaaccaaggcaaacaucaaccagaucccauggagugaggacgaaacccugcagaggcucaggacagugguagcagaggcagaguggccaguguuucagacuaccccugaauuccagcuguggugccuuucuaguacaggccuugggaguccuacagaaagagggaagaagcagaaacgcugagacaagaaaaagugcugaguuuaucuucugugcucagguagcaggaaccaggacgugcuggguaaaauauaaaugcuaggaaucggaaugcgcagguccuuaguguaaucuuuacucuguccguggcagcuagaugaccuaacuacugucuuccccuuuggcauucagucuuugucuucaaagcuaagaaguuguacagcacugacaugcagaugcuguccccagugugguaaccucacuguagguagcgagguccuaccggauacuuggcauugccuuuguagaauccucacugaaaaccuaccuagagaagagucuugcaggaaauuaccguccccaggcuucuguuguccugugcacgccuccuguugccaacgccuuuuaggaaacacacauauuagcaauccacugccacacacauuacacaggugcguaauuuauaugcuugcuucucuccuuaaagcaaaagaguauacuuuagcauuuguguucaauuaaagaaaaacaguuacaguuggaugcuuccugcuuacuagucacugccguuaauguagaugggauaucaagagcauuuagaauuuauuccugaaaucuagaguuagacaaauuucaauuuacaguaaaacaaauuuggcagccauaguugaaggagcucuagauuauccaacacuaaugaagaagaucauugguguggcuaauccagaacagaagauaaauuauauagccagcuaucaauuaucuguguuaauggaggagaccagugauguggauaaucaaaauauaauuuacauguagcuuuggaaaacauuugugauacgauauagcucuguguaguuacauccuucuagauagaacaguauccaaauaggaggcuaccccaguagugaaagauguccaagcucuccucccugucagucucagagauucagcccucagauguuguuauugaaucacuucauauugccuugccuaacuccacucacucuggcuagagaagcaaggauagcaguaggcacugagagaaauaagauguucaggaggaugugaagggugaaggugcugagagaaucaaaagggucuguugucauggguaccaacuuagcauagcaagauuucuaggauucugauauaaucauaacuuaauaauuuauugaugagucagcuaaauucuaugugguuauuucacaugcuuccuaaaagcauucugauuuucuuaaguacuuaguuaagaaaugcugaacauuaggaaagaagucucaggcaagacauuagaaggcagauaaggucguagagaaagucugaaaaggguguuuccggcucccuugccacaucuguuggugucacccaguguauggggggauaguuagagccaaagggcagagauugggaaagucagucacaggagaaacgggugaaagaagugaccucagaguggcuaagggagcaacaagaagggagaguuuucuucacaccacuaaccucacaguaagaauccuuagcccagggcaaaggagacacaugggaggccauagacugccgggggggggggggggggggggggggcaggcggugaagggaaugggcagagggaacaaagaauauucucaauacacaguauguaccauaagacaaccuuaguuuaaaaaaaaaagucacugucccaguaacuaaugaacguggaguuaaaauaaacugguguauguguauagagaaaaaaacagcagcucccagccacaguuugaggcuagggaggauaagggcaggaaggagcauuugcugugaagacuacugaaggcaacagacaagaaaggacaaagaauucacauaaugcuaaaaacuccagcugaguacaggaaaagucaggguggcacccaccccuccaugcuguuaacucaagacugggagcgggccuuggcaaaagaaaagggagaaauccagggccugaaagauaguauaaggacauaguagggcuuuuggauuggcuagucccuuuccaugguaacaaggacuaauucagcagccacugcaugccauguuugugggugggacucacugcuaaucagcacagaccagaaguucaugaaaagguuuauugaucaaugcaaacuugugaugucauucuuucaaauacaauugcaggaauguacagagagacgaauguuuaaccagacguuuccaacaucuccauucauauauugcuaugauggcaaauaugacauccagcaaagggaucggagaauaaagcgaaaagucaaagguuugucauuaaacuucugcuuacaucacuuuugcagcagcuccaaaaagaucuuuuuauacuaucuuugccuacuuuggaagucacugguuagcacagaaaacacuuaaaaaaaaaaaaaacauucauucauucauucauuuauuauauauacugugaaucaccaugugguugcugggaauugaauucaggucuucuggaagagcaggcagugcucuuaacugcugagccaucucuccagccccugaaaacaguuuuaauaauuauaaaaacuaaaacuuucuugagcuccagaaaacaaaccucuacuuuaaaacuaacuccuauacuguaaucuauucacaguugauauuuuucucagagagagcauuucggaaaccuaagaauguuucaucugucuaugcagagagguaaagacuccuuugaaauguuucuacuugacaaauaauuaucuccccuuuguauaucaaauauuuuccacggagcauggguuucuggugacuccuggggcuuaggcucucacgguucaccacugcaaguggggcuccagguccauugcccccucugugccucaccuagccucagagguucagagcacugcuccuccagaagaccugcacccacaugguggcucccaguugucuguaaugccaacuucaggggaucugaugucuguggccuccacaggcaaacacacucaagugcauguaccugcaugcagacauacacgccuacagauaauuaaaaauaauaaccuaagcuaauaaaugaaugauuuuuuaauuuuaaauccauuuucucugccuuugcucuuucuugguaaaaucaagauguguucccaagguuuccuucaccguugaugauaaaauuguuauguauuuuuuaagcuuuucucugaaaucuuuacugaaucuuaccauuuuuaacuuuuuuucuuuuggcuuguuuucucuugaguuuaggcccuuuuaaauggugcuacucaucuguguggcacauauuccuaguacagcagagaaaugagaggacaugacugacgagcgggcucaauguaagauugccagaaaagcugagcugucugcucugagguccagggccuggcugugugcugacagugagcauugauaaaguauaguaugagaaaaguaguuguuuucuuuuuagcuagguuugacacuuugaggcuaaguuucucccgaccacuucugugauauuccaaggcuccguuagucuccacaccucaccuuagcccgacugcuucugucagaugcucagaacaacuuaccaggucccaccaagaugcaccacagcagcagguggcacugaaaccucugagcuaugcacacaggagugcacgcauacagagaacgccccacccagcagccaccucucuguaggaauaauauccugggugcuacguuaucacaucagaggagaaggccaggcucagccucagagggugauggaaaugucauaugaaaccgugcaaaggccauuucuacaucuugcuucaccucauuuucucaggcuaacucuucccuggaggaacuugaauaggucagacaucccugcugcucuggucuucauugucuaacauuguaaaaaauauuuugaauagaagaaauuauaauaauauuaauaacggauuuggaauguguccccauuuuuagcaguauggauuauaaggaguaccauuuguccacgugccugaaugucugcugccucucucugcuaaguuauuuccaagaaugcaagaacucugcaugggcuaaauaggcaaaauacuuuuauaucuuacagaucucaagaaaaauggagacuuuccaaggcaguucaaaagaccacauguagaagagacagauaagaggcgccaccacgauaugagaaaaagccguuccccaagaaaauacaggagguggccucgagaaaauaaagaaacacagaaagaaaagaccaggaguagagaaggcaagacgcacaggaggggucaccagccucggggugaggaugaagacuuccccaggggcucaaaacccaacgccucuggcugcgcuaacaaccagaagccuucuaagucccuccaccaugcaucccauuaccacaggcugagagaagagcggcuucucagggagagcaagcggagcaagccaaagaaaaggaagaguacagaggacggcagccaugaugauuuguuucuuauuaagcaaaagaagaagaagccuaagccgaguggucucugaccuggucuccgcgcuucaguguccuggaagugcuuaaguaccuguuaaugagacgcugggauugaaugcugaguuccggccaugccuggaguggcuguacagagaccacaaagaguucaggucuguguccacaggcuguuccuagguaggaaggcaaacuugagguagaaaauugucuuuucaugaaaaccuuuuuaaaugcuuuggaaaaauuacaagcucaucagaugauuuuaucuccaauguuugaggacuuaaaagcucauuggaagaaaguuuauuguuaagaaaagucaucacuuuuuuagcuuuuuuuuuaagaacacuggaaaaaucaaugaaaauccaagcccggcuuugcuugcaucagaggcuguuggaaucucucucuguacagaacagcauguaaaaugaagcugucaccauugaauucuggaggagguggaggagaggacauagcaaauacacaaacaaaaugugcgcagugugggcuugcaggacggaggugugaaaggcauccucaaacuugagugcaauggcagggacauuuuguucgcacuguuaacagccauaguucaagagacagggauacauaccaucaaccuaacuuguccucguggauccuuuuaaacacuucaacgcucuuuagaaucuuuuguacuugugagccuuuuuuacccuugugaaagccuaauguuagaauaagaaaaauaaaaugccugaaaccauguguaaauaaaug

SEQ ID NO: 1875 - RNA, 4558 nt, Mus musculus
cuguggucccaagucucuguccuucaggacacagauggauaagcgaggcacaaaccaggcuccaagacuaugagucucauguggagaaggugagccaccaggaccuucaacguuguggacauaagaagguagauuuaggaugagguaaggccucagaacaaggucuggggcugagaucuccucuggaggccagggaaugccucgcucagggugggucuguuuuccccuucuguuguccgcugccugccugcuugcuugcuuuguuugguuuugguuuuguuucuaguuuuucugugggguuuuuuuguuuggguuggguuggguuggguuuuguuguuguguguguguuguuuuguuuuguuuuguuuuguuuuguuuuguuuuguuuuguuuuguuuuguuuuaacaggguuacucuguguggcccuggcuguuucagaacucacuuuauagauggcaggcuagccucaaauucagagaucugccugccucugccucccgaguacugugauuaaaaacaugugccaccaccaagggguuguuugccuugcuucuuaauaagauucaguugggagaauucuucaagaugacacccucacuuuguuuuauaucuucccuuugcccccugaucccaguuuacagagagggcaacacucaguccuagagaaaagaagaggagaggaggggaggagagcugggggggggggguguagggaggaagggaggaggggaggggaggggagaucucccuaguuaauauggugagccaaauucacaagacugaacaggcaaggacaagggucucucagguuugacugaugcuggaggccccccccacacacacacacacacuggagccuccaggaucagggccucagaaagaacugugcucugccguucccagccuugccccggaaggcccuaggccaguaacugccugagugccaacagaguacaccacagagcugagccugcgggccagcagggcuuccuucugaguuucagugggguauuucggguggauuuuucaauuauccagauuagcauuagguaaauccccaugaauaggggcuucucguuuuuuuuuauaauaacagcugucaaaauggaagugagugugcaaaugaccugccuuuugugguuaaacaagaggggacagggauaccagccagguucuaaccccacccucaccugcucgggacugacucccucaccgucugaacaccacagacucugagcuucucgccacaaucugcuuccacauaaaugcagaaccuguuaacuauuucuccagugcaaacccgugaucaagacgcaggguugugugcugcuucaguccuacagcaagggucuguagcaugggaggaugcaggggcucagugggauuuucauagucacugccccaggggccaccucgcccucugugguccccaacugcucacucucgguuccaaagcagugaaugucaggguagcaagaugaacucuaggaccguaaaagugggaguaaaauuaugugguuuauagucagcauauagauucggggacuguguuuauaaagaaagacuauaggaaaauagaaaggcacauaaagaaauacaaaagccagcugggcgugguggcacacgccuuuaaucccagcacucgggaggcagaggcaggcggauuucugaguuugaggccagcuuggucuacagagugaguuccaggacagccagggcuacacagagaaacccugucucgaaaaaacaaacaaaauaacaaaaaacaaaaaacagaaaaaagaaaaagaaaagaaauggaugagggugagcccagcaucccaguggagcccagacaugggcaguggccacucacagcucuccacaccugggguagcccuugagacucuuggucugacuuuguugagccagaaagcccagugugagggacagaaauucugaaguggugugucugacuucguaguuaguuucucaguccauaaaaugugugccuguagugggacaguagaguagaggguacugacugagccguucccagaaaccugccaccaagucuaaacuuuuucucauugaaauacacaucuguauuucagaaguuucaaaaaaauaucgcuggaagaugugucccugugccacgccuugccccuggggucuucauacaguuuugcgugguaccuaaauauguauacaacauucucacccacauguucuaagggaccacucacacaguuuuacaauaugccucuuuuaagaugcauuuuuuucuuagcuguaugcauguaucuccucguuugcaucugugcacaugaguacagaugcccacagaggcaucaaaucucucuguagcuggagucaaaaaaaguuuuguuuuaauuuauuuauuauaugugaguacacuguagcugucuucagacacuccagaagagggcaucaguucuuauuacagaugguugugagccaccaugugguugcugggauuugaacucaggaccucuggaagagcagucagugcucuuaaccucugagccaucucuccagccaccuuaaaagcaguguugagcugcccaacaugggugcugggaccaaacucagguucucuguuagaacagagcaugcucuuaacccugagcuaguucugcgcucauggcucuccuaccgucucagccuucugagugaagcacacccagcucucccugaguucucaucucaggacugcaauuaaggugcaauguauaauuugcuuaacaaguuaucucuagcuuggacagagccucucauuuuuuuuuauuacuauagcauuuauuauuaauuuguaaugauucccuuuucccaaugccuucauaauuuuucucugggguaccucucagagauauguggguaacucagguucauguccucagaagagagcagagaugaaccagcucuggagaggcugggucacaaacuuuguuccaggauucaggauagagaaguuggccuggggguagaucggcaugcuacucccaucccugugaaagucugaagaucagaaguuaggggcuguacuggcuaguuuugugucaacuugacacagcuggaguuaucacagagaaggagcuucaguugaggaaaugccuccaugagauccagcuguaagguauuuucucaauuagugaucaagggggaaaggccccuugugggugggaccaucucuaggcugguagucuugguucuauaagagagcaggcugagcaagccaggggaggcaagccaguaaagaacaucccuccauggccucugcaucagcuccugcuuccugaccugcuugaguuccaguccugacuuucuuggugaugaacagcaguauggaaguguaagccgaauaaacccuuuccuccccaacuugcuucuuggucaugauguuugugcaggaauagaaacccugacuaagacagggcugagcagcgugcucaguggcagcgacagacagucacauauaccgcccgguuaagcacagcccuuccuuguggaaaguuuacauccagauagaucugcacggaaagagaacacucacccaacacaggccaaacucugugcugcacuccaggaugucaccccaccccacccccacccuacccccaccccacccuacccccacccccacugcuccccaaccccuccccaccccacccuacccccacccccuccccuacugcucccccaccccaccucacccccacccccacugcucaggguucuuuccaggaggaggcuguggcuggugcuaagguuuguuccuguguggccguucauaagcaagaacacccaggaaugacccuaccaacaaggaggaccagaguaacucaguuacaagacuaauauccaaguuacacuguugaaaauuguuaacaguguuaaugauuuaaccagggauacugguaaucucgccacucaggagaccagggcuccacagcaacccaaggccagccugcgcuauacagagcaagacccuguuucaauuaauuaauugauagcaaccuuauuuuguagggagaagaaaucuugcccaaagaucaguuuauuccaucgaagaaacaagcauucuaugagaagacgugcucagcaggcuggagggaugccucgugguggcgcccauggcgggcuuugauccaguagaccucugacuugcccuuuggccucuucuagccccugcuccaacccugccgacacucucugcgaagggagcacaucacuagucccccagggccugacagacacacagcugaugaucacagaugaagcuguuuccagcuuguuuguccccucagcauugacuggcccguaacauauaccucaucauagagccacaugugccaguccuucccacagaucauggugccuuuauacucccugcaucugauuggaacucugacugauguccugaguauugacacaugccagggaaguguucuccccagaaguuggccuguccuugcuaaagcuccauuuccauugacuugggaggcuagcacauccaugcuucccagucagaaaacacugugaagauuccucucgugc

SEQ ID NO: 1876 - RNA, 21442 nt, Mus musculus
cccaguuuugauccgugucugugucuaccugcugcucccucugugcuccggguaggugcuccuuuuaaauccccuucacucuccccaaggccaggcuguaagcaccgcacugcaggacuucccacacagccacagagcgggcacugcagagaggcaggacuaacucaaggauggagcgguccuaucuuggaggcucgaacugcugcaguauaguacagaagcgcaucccugcucuguuucaacccaaacggaagcaaaggagaccguguguuuagaggcauggauaugacaaaguuuuaauuuuaaaaucuguuuugaccagcguuagcaccugaaagggugccccuacacuugaugccaccuccaaaagauuguacaugauuaugccgggcuagaauuaaggcuaaaagucaaaagucagguccccaguccccguuagaaucccugugaaacuccaggcugcagcgacccugggcucguuucccagggacccuuggaaaucuuuaagugcuacggcaugucggaggacacuggccucaagcuugcuucucacauggagagacugacuacagagguagaugagauuccagguccacccagcagcagagaggcaggcucuguugagcgccagggacaggccccagagcaaagcccacuuguaucgaagccaaggugaggggcagacuugaagcaccacgucccuaagacagaaaggacaacugcuagucuaugccugugacauuggcuccucauccagcagggccgcucugguucuccaugcugacucccacugguccuuaugaaggugauauagacccaccccaucgugucucaacaggacugcugaccaucagccacacaacaucuucucaagugacuccagugccuucaguggucuugcccacagcugcucagcagcaggaguccagccugccauucgggcuugcuucccuggcaaucagcucagaugucaugccuucucagagcauuacaggucaagccacagauucauggucacaccagcuuaagagaagacacaugcucauuuuuguuuuaggauauacagaaauauguggcucucuaaaguuaaugaauuucucugaauuguguacaaugguuugguaucucugaaaaaaguaugaaaaaaauucuuguccaucuuuagcuuacagauaugcaugaaacugugcuauucuccugggugcaugucaggaugcagcagcccuggcagcaugguuaucaggggacagagaacugaaugccaccccgagaaucuuggguguuuuuggugaauucuaugcuguaggcugccugacucuuccagagccugugaagaacugaggagacaugaacacuccuacaguuaagucugauucaacacugaguuagaggagggacaccacugaacacugagguguagcugugagagcguaugcaacaggaagaaaacuacagcagcgcugcugugguuagucuaacuggcuacgccaggagagguguucuauggcgcuugggagugagacgugacaaggucaagggcagcugaucuuggguggccuugggcauccagauggcaugaaaggcaaaugcgccgugagaacccauacacaggacuccguaucaccagaggaaagacggacacuagcuucccacuuacaucaaacaaguacaguaucagaaauacacguugguuaaaacccugcuaacacagcacgaacagaaacaccucacugucacuccuacaaguacacacuccauuacaacuuuaguucuuaaaacaaacagaaaaguuacuaaaaacaccuaugccauagagauguauucgaaagucuauacaccuguuaguccaagggcauauuucccuggacucagugugagcaccaucagagggcagugccugugacugcaacucagauacaaauaaaaacuccacaggacuuucagaggccugggacuagcucaggauacacuuuaagcaucugugccagacaugcuuguccuccagggccuuuuuuuuuuuuuuccagauagcaccaagucaccugguuacacacaguauguucugcauugcuguacagggauggaauacucccaucacaggauacaggacauuuaauuaaaugcuucacagagcuuuaaaauaguguuaaaauguuuucugcacuuucauuuuuaaauuugauauucuuaacaacaaugacaaccuacuuuaggacugcauuccuccacccuaagaaaugugcaggguaagugcuacaccuaacaguucucugcuuacucuuggcugaaauucaugagagccacuggacagugagaccgaguccagugacaagagcugccugccuacagcgguuuuaguuucagugcagacuggccugugcgcuguggcgagaagcgaucagagcagggugcuggggagguugcugcucugccagcgcaggcaggucguuuucgaguguuuauauagguggcuggacugacugaaccguuugccacacuugaggcaggcguacggcuuuucuccuguguggacccggauguguuucuugcaauccgucagagucaggaagguuuuacagcagauuuugcaggcauacuuucgagcucccuccacaaccaagacauugugcuccgauaaggccuucuugcacuuugacaagacaucagcagaugcccuggucaacugaggagggccaggcugggagguguggccauuuucaaaugagguggccccguucaucauuagcugggaacuggcugaauuuucagagaucugcgagcuccugacagaaguuaccacuggcauuuuuggagcuauucgucgguaauauggaaaguuacuggccccuccucguggggaacccaucauggcccuggagaaggaugaguggagacccaagccagaccuggaaaaauccaucccgaauuguucuccuugguagccugaggucugcacacagggcaggcccaucaccuccugcauaggucugacgaagugggagucugcaggcucacugaacggguucucuacaugggaaccaggggcagaggaaggcccaccugcuggcccagccucuggacucaacagauaaggggccucgcccucgagccuacagucacuggugguguuugggagguugucgucagugcucugacuugcacugaaauuacucccccugcucuuguugagaaaauuggaaauacuaaaagaggucuuauguucuagauuauucgugacuuccaagauguggauguccccgacccugucggugcuggacuggggaucggaaaagcuccggucacugcuuucagggcugaggucuaucuucucggcacugaccaccacuccuuccaccuccacagacucacugcccucugcuugggaggucacgucgcucacuucauccugcggcucgggagagcucaggggcucagacuucaccaccacucucaugugcuccuucuccccgaggccaaccucaggauuuucacacuggaaacugccuuucucagccacggccucuuguucaaaacucguuucaaccugaguugcacgagaggccauguugccagcacugccaucugacuggcugggcacuugagcaucuucuugggcaccaaaaggccgaucaaacaucauggcaccgucuuccugguugucagccaucccaucggguuuaggauuauccacaauuuucagagaauccggugagaagaauuccucccgggaaugaacucccgcaggcccgcucucuggaguaacaucugaaauggcagauuccuccauggaggaucgcaggcgcugccgggcccgcuccucuacagacuguuugcgcuugugaaggcgucucauggggaaggguguccgcugguccaggcugcugcgcauggaugagcucauaggggcugucggcuccucggcacucuggcuggaacugagggcugagcucacaaugcugagucccagcugcugcagcauaaaagagcgcugcaugcgggcacucugcuccugagcacgcucacuagagggagacauggggagcguccuugucgucagguaauguuuacaugccuuaacaacggaguucagaugcaggugagaggcugccaauaagacauccauaacguugcucuccccuagcaugaggguggagguauacaucaugucaaucagggcggcgaaggccucggcugucaccaccucacuaucuagcuggaucauguucauggucugaucuccuuccgccaccgagaacagugcucggaaaugcguacugcaugcugccagcacggagcggugggcuuugaaaugccuguuccccacuacaaugacacagucacacagcugcccaugaagucucugguaguucagcugcugaaagaucugcucaaagugaccaggaaaauccauuguccuauacaagacacaaagggaaaaaggguuaagaccuaacaaagcuuaacucagaacccgaacauagaaugcacuaagagaggugugguagccgggccauggagguaaagccuuuaaucucaguacucagaucucugaguucaaggccagccugaucuacaaaguaaaguaaguuccaggacagccagggcuacacagagagaccgagagacucugucucaaaaaaaaaaaaaaaaaaaaagguuuguggggggucagggcugacaagacgguucagccaguuaauauuccuauaccaagccuaacaaacuuaaguuccaucccuggguaccacauggaggaagaggagaaccaacacccaaaagcugugcugugcccacugaacacccaucaggguacagagacauauguacacauacaaauaagugcaacuuuaaagaauggcuggccacauuuggagcuuuugaagcuugugacaucuaauaaugggcccgcauauaagacccugucaacuauggagcaaaagucaguucagcucaagcuccagauccauuagcccuucauggaacuugcuuagaacacugaggucucuguuaaaaaagccccacugaaaggcugaauugcuccacugaaauuuguuagcauucagcauccccuagaacagugaauuccagcagccuuagcaaccuuagugaaaagggcaaaucgauagcagagaagauuacuagcuauagagacgggaacagccugcaaacaugcacuucccucccacaccccgcacugcagcccugaagccagcacucucuuggagguguuugguuuuuaagguauaaagcagggcuggagagaugcucagcaguuaagagcacugacugcucuuccagaggacccagguucaauucccagcacccacauggugacucaaaaccccuaacuccaguuucaggggaauugaugaccuccucuggccucuuuggcuacuguacacgugguacaaagacauauguagagguaaacacucauaugcaugaaauaaaaauaaauaaaagcuaaaaaauaaaauaaaaucagggcguacaaagguaaauguacagcgguuaauacugagcuggagcugggauggcaggacccagagugugacaguugugucccaguguccuaacuuacaaacugcuacaaggacauggauuacauggauagaauguuuacaguaauaaauuauacauuauagcgccaaaaccaauagacuguaccuuaaaaauaacagaaaauaauaaggaaggaagugaggccacaaaugagcuugacccaaagccacgcuuucagaaaugacagggcacccacagcucuaagcaaaaggacugcucacagugucacuaacagcugauaacauccgaucauucuuccucuagguaguguguuguuucuuuugaaaaguaguauuuuuaaaagauagggaaauauuuaccaacagaacaguaaauuuacuuuaaauauacugcaaaguuuuuauuauaacaaguucaaggagaaaaagaagggcccacauggucuuuuaaugcugagucucgacccaauaaauaucugcauauuucuucaaauuaugugaaauaaaaacuugcuuacuuuuaucuaagaaaugacuacaucuccuaggaacacuguagcuacccauucaugucaggucagucugccugacuaggguggggaucaauaaccccagugaggcucuucugugcccuccacagaaacacaggccauuucguccucuccaggggagaaacccuggccucgaggacugcgaucugaaugaauuaacugcuaagccuggggcacagacgcacacagaauaccuaacaugucgaguacuacagauaaaaggaccaaccagacagauccacacucucggggagaaaagacuaauaaacaaacaacucuaagguacugccaugauaagacgccacaacaggcacaagcacggggcucccgccucugacagccgcgaaggggguccugaaggcuugcuggggaagagcucuucuaggguuggguacugaagcagacccucccgagggcccccagagagugaugagaggaagagaagcucugaguucaagucugcacaccucaccuccacacucccacccaccucuaccugcucaaugacuaacuguaugaauggccagguucagacuucccagggagacuggacuuuuguauauguaggauaacuggaaagcccaauaaaauacuuaggucccauguggcaaaacacauucaucuccaaggacaagccauucacuccgcuuccagucagucaaggcuuccuuucuacugggaaugugaaggagcagcccacacugagaagaaaacaacccucuuaacacaaggccaagcaccagaggcuggagagaugauggcuccuugguuaaagcacuggucgcucuucaggggacacaggugauuccuagguggcagcuccagcuccaggggaucugacagccuuuucuggacuccacuaacaccaggcacacaugugauacagacauacaugcagggggaauacucauaacacacaaaauggaagaauaguucugaugaucgcaaguacaaaauaaacagaacagugcccgggaacauuuggaacaaacaaaugauuuaaggggaaauugaggucaaaacaaaacaaacaucuauggucaauagccucagauaagauagcacauccaugaaauaaaauauuuuucuuucuuuuuuaaaagaugauuuauuuaucuuauguguaagagucuucugucugcacggacaucugugaaccacaugcaugccuggugcuugcugaggcagaagucauuggauggccugaacugguuguaagccuccauauggguacugggcauugaacccagaucuuuucgaagaccaacuagugcucuuacugaaugccugugaugguauaugacugucauccuagcacucaggaggcugaagcagguaugcugagaguucaaagcuagcccgugggggaggggagagaagggaaagagaggaaagaagggcaaaagcagggaagggagagaaagaaaaauuacuggaaauucaaaguggcaaagaauauuaaguuaguagaauuggaagaaaaugagcaaaucucccagguuaagacaaaggagaaacaaaacugaacagcaaacagaagauuagcuaaugaagccuaacucuaaccucagaaacucaaagacagaaaauggaagagaacagcgauucagaaaacaaugcagggucugguucguggcucagaagcuaaggcacuuucugccaagaguucaguccugggagagaaaugauaacugcaaguuguccucugagcuguguaugcacaaacacacaaaucaucaagcaauauuauggaaucuuaaauuaaaaaaaaaaaaaagagugaguuugggauccaguggugagguaguagugacagauuuauaaagaauuaggauaaaauuagcauuagacucuuucaaagcaauacugaagagguuaaaauauaacuccuucaaaauucuccaauaaaaugauuuccaacagagaacuccacucuuagccuaguaaucaauuaugacgguaaacuaaggcauuucagagaagcaaggacucacgggguaucucuuaucucucacaucucagaaaauuacuaacagauguacuuaagcaagcugagaaaacaaaaccaacaaacaacaaaggaaacagaaacaccguaauaccuuggcaggagagaagccauagagagaggcacugaaacaacagagcccaagaauuauagacuagagcccccaaaagauggaucaauggugccaacaacuacacuuagcccuggggcuguucaauuauggauaccacacaugcuauguuuacaccuaacccucaugccaggguuccuaacauggcuuuggaagucacuggaccucuuuaaccucuguaucgguuccucuuccaguguggucacaguggaugcaucuccugucuguuuuucugaauuacuuuucucuuuaauuggcuuacuggggacaaguggcagagccuagcuugauaagacugccaggucccaggcucugacccuucaauguggauaauaaacacaauaacaaagagaagucuaaaaaggaugaaccuccacauggcaagccagguaguucagucuagagcaguaaguuaaguaaucucuccaaggguuaacagggaaugcauagcucugauguggccgaaugucaagaacugagcaguuucaccaaagaagauacaucauugggaaaaaaaaaaaaaguauguaggcagcgggcugcagagcaaacucugcuaagaauauuugcugcucuuccagaggacccaaagucaguuucugcacccacguggcagcucacaacugccuguaacuaugacuccagagacccugacacagucuucugacugucuaaggugccucugugcuucccuuugcuuuucauugaaguuugcuuugggguuuauaggugcaaaugagccauaagcauaaauaguuuauaccuaauuuuauuuuauuccucauuacaagauaauaaaaacaauucuccuuacuuaaaaaaagaaaauacaguauuuucaaaucgaggcaguaucugggggaaaggcggcuacucagugcaucacaccaugcuguucaacuguggacaauauuuguagucauaauauuaggagcaccagccauaucugagacugggagagugagggugccaaaugugcaugggaaguagggagagaagcacugugauaaaggucuucccucuaagaaugccaugugauggccugucucaaaaaucgcugaaaucgaguucagaagucaacaggggaacacagcgcaaacaucugaaaacaguugccucugaggagucagaacguuggaggaaaaaggguagaacaagggacugcugguauuuugucuccuagcuacaagccuaguggaacuaugggauuaaaaacaacauauacacaauaauaauaugcaugcuuuuagucccagcacucuggagucagagaagcaggaggcuuucauugaguuugagguagccugcucuauauagugaguuccagggcagccagaauuacagaaagauccugucucaaaaaaacaaacaagcaagcaccuaucugccgggcaauuguggcgaacgccuuuaaucccagcacucgggaggcagaggcaggcagauuucugaguucaaggccagccuggucuacagagugaguuccaggauagccaggacugcacagagaaacccugucucgaaaaaccaaaaaagaacaaaacaaaacaaaacaaaaaaacccaagcaccuauacguaaagaguaugaguaugaaggaggcuuugccucaugcugccuuugucuguaauccccucagcagaccacacggggacucacaugcaagagauuuaugcuacugggagaagcuggaaccgagaaguagaagaggaaagcaacagcagccaagcaagguccaacuuuauggcagauucagccuuggucuuuucuaacagcggagggcuggaauauuaaaaaaaaaaaaaagccucaggggcuggagauggcucagugguuaagagcaccgacugcucuuccagaggacucagguuugauucccagcaaccacaugguggcucauaaucaucuauaaugagauucgugcccucuucuggccuacaggcauacauacaggcaggccacuguguacaugagcugcaaggaagcccagugaaggucagcugacagaauccuuccagacauguaagcuugacuucaaggugauuucagccccagcaaccaucugacucugccggucacaccccaaggaucauuuugagccgaaauaaaucucugaggugaguaucccaaaugguaggaaacauguuaacauuuugucccacaucaacauucaacuaguaucucuaaaaggcucuuuuggucagucagucagucugucugucugucuacuauaucuuuggaggaaacugcuuucuaccuacuccccaccccccuuuuuggacaguuucauguagcuaucuucucacccaagaaugaccucaaacuucugccacuccugccucuaccuccagaaugcugggauuaagguacaugauuucaggacucaaaccuggggcuuuguggaugcuaugcaaguacucuaccgacugagcuacauccagcccuuuccuacccacucaggauccaaguaguaaaggucauacugcccaagguucucacaggcgauggagaguggccugaccaacuugauacccuccgcacagaggaguuacaacgaccccagccacacuaguuaaagccugcucuaugaacuuuuaauugaugcuaccauggaugccguuuguacccagauuacaaagugugaggggauuuaagucuaucauugaagguagccauuuuuaacaacuggagaaugagaccaaagcaagaaaaagcaggguucaaagaauacauccuaaagauaucaaaaccccaagacccaaucaugacuaaagcugguaucaucauagaacuucuugauuucaggagccaaugacuucuccuuuuaccuuagccuaccaaugugcuuuuuuucauuacuagaaugaaauauacaagcuuacauauaaaacaccucuggucaaagcucugccagcuaucucaccucaugacagauggcaucacaacgguaagaauaaagcaagaggaagagaucauaggaagccagagagcccaacaucuuaacgugacaacucuuguaccaagcuuccaaacuacgaaucucuaggcaacauauuuaagccacaaccaaacuacaguacuuggcuuauguuagauuuuugcuaugaugagguucaaauuacauuucccagaaauaucuaagaaacagcuauuuagcacuguuuuggcgggaggcugcaaagaucaaucacaagcugcucaauccuccauaggaccccagugugauucccaguacccacauagcagcuagcaacccuucguaauuccaguuccaggagccugcugccuccucuggccuucuugggaaccaggcaacacacaugguacacagauggacauaaaggcaauacaugaguauacagauaaaacagaaaucaauucaaaaacucuuuuuaaagccaggugcaauggagcacaucuguaaucucaacucucaggaggaugagacagauggacaccaaguuugaugccagaguauacuaaaaagugaguuucagaccagccuggccuacauagcaagacacuggcuccauauucauaugaccauaacuuuuuggauaaaagagguauucuuaaaauccccuuaguuuguaagauauaaaauuugcuacucuauguucuguaacuggauaucaagaucauuguuauuuaaaacuauuaagcaacucuacaagaauuugagguccagucuaaaagcuuuaagggacugacugguagcuuagugguuaagagugcuugcugcuuuuacagaggaccgaagcuuguuccucgccaucacacugggcagcucacagccaccaaaccuccagcuccaagggaucuaugccuucuuugagcucagcaggacuaaacaugcauauauaugaauaaaaguaaaucuuaaaaaguacaaauaaaaaauaaaaguuguaugugagcucucacugagaaggcaggaguuuuacccacaagaggccugucuaaaaucuucaaauaagguguguguaaggggggggggcacuaauguuuccuaaauagacuucaaaaaugauccacuaugggucuauauggcuggagguacagcaaacaaucuauugcuugguaccucuaacccacaguagguguucaguacaauuauuaucuaaaaaacagauuuucaguaaugucuaaacuaaguauaaugaagauacauuaacaccacugcucaggauaucagagugacuacuaaaaaaaaaaauggccauuuucucuucagauugacuugcuuaauaauguucuacuuaguccaauaaaauauuugcuauaucguaggggaacaagccagcuagugauacacuuaaaacuauuucauuuauauaguggcauacaagcuuuucaauaacauaccuaauucauaaagaagagcacaaccacauucaaauauuaucuaccaccauaacaagugaucuccugcugucaaccaaccaaaguuaaguauaggaugcaucuuaacauucuaaggaauuuaguuuguuucuagagauaggguuucucuauguagcacccuggcuggccucgaucucaagagaucugccuaccucugccucccuagugcugagauuaaccaagccaacaccauggaauucuuaacauuuacuguagagaugggcaaaauccugucaggaaaagaacuaaagagcaccuuuccuccauuuuuauagagaagauauagguguaaaucauuauuagagaagaaaacuagggaaguuucacugggcagacaaggcuuuuuuuuuuuuuuugcaauaggaaguagaggugggguuuugagaugggauuucucuguggcacuggcugauccuggaacucacucuauugauaggcuggccucuaaacucagagagcugccugacucugccuucagagugcugggacuaaaggcauguaccaccagugcuggcuagccagugacuccugucuccgucucuccagugcugggugacagccaugugugucacacuagcuuuuguuuuaaugugaguucuugggaugagacuaaguccaacacuugcauggcaagcacuguacagacagagcuauaugccuagcuaguaccaccgaauuauuuuuugacuguuuuaacauguucaagauaauauguuguggaacacagauuuacacaguagagugcuaauacucaagucacaggcaaguaguaagaaugagacauauaacugggugcuuuacaaagugggaggcguauguguaacagguaaaacuggaaaacacaaaggugaucuccaguuucucacaacauggacaaugguaugaauuuguagaaacagauacgagcaugcuaccuuccaacauuuagcggcaaagagugaccuaggugugagauugaaaagcgguggcgcacgccuuuaaucccagcacuugggaggcagaggcaggcggauuucugaguucaagaccagccugaucuacaaagugaguuccaggacagccagggcuacacagagaaacccugucucaaaaaaagaauaaagguuccauucccagcagccacagacucaaaagugucuaacucucaaguuccagugggcccaacacccuuuccuggccucuucauacauguaguacauagacauacauauaagcaaaacagccacacauauaaaauagaaacaagucuaauuaagaaguagggcugaggaacuugcucagugauuaccagaacuuguugcucuucuacaggaccuggacuugauucccagcauccacaugguggcccauaaaucuccuguauauccaauuccaggggauccaacuucuucccuccuuaggcccggcucacucuguagacuaggcuggccuugaacucagagaucugccugccugguucccgagugcugggauuaaagguguguaucgcuuccccuugcgagaauauuauuucugaauggggguuugggugacauuuucugacaaagaaaguaaugucuaagcacugggggcaaggacauuuauaaagcuggcaaauaggcuuaacugguuccauucuguccuucucuaacuuuuguccuccuagguuucuguucugcaguuaccuuggauucuaggaauaauaugacagauagaaaaaaaaaauugucuuuaggacagagaaauggaacuaauccuauccaugcuaaaccuagcuggaaaaggucucccagucccaaaugggaacaaaccaccccgagauuagcucuccuaaagcuuaugggaagcagaugugcaugcugacagggcagcugcuguucuagacccacuuccaggaaccagaacaaggacaauggccagccagaccacuggccugaccaaggugaccugcucugucagcugagcaaacuuucagucucugcuuguuucccuuuccuacaaaaucucaaguucuugucagcugauacaagacauaucugagauuacugagccuggcugcccuccccgauguggucaccugauuaaugcugcuuucccacccuucgacaaggcucugcuugguuggcagguugggcgagcugggacuggucuacugggacuucuaaaggaccuuugcccugaaucuuuaguaauagucucuuaccaguagaaaagauaggagagaaaaaguuaauuucuuauacugaguuugcuuuuaaagcaguaugagccacuuaaaauugacaaugaucaggauuugaccaugcugagcugcuuucgaccuucuuucuauucaauaacgaauauaauguaugucgaaguagauguguuuuguguguguguguguguguguguguguguguuuagucuuuuugggaggaagaaacagcaggcuucaucuccuugucauucuuccuugaccuccuuguaguagaaauuaaacgggauaacaaaaggugaaugccuugcaauuuuagagaaagaugauguugagcuaauuuaaaaucaugacugaauaauuaagaugcacugaaaaaucaauuauaccauguuaacaauaucauauacaggggcaaaacaggaagcaauucacucuaaucauuuuaauuugaaaagcuuacuauaaaggauuuguaaacccacuuauugaauauaaaaaguaacagauuaucauguauaauuuccaaaaggcacaccaucauuuaaucauucauuaaaguuugcaaaacaaauaguuuguuaauuuccauuuauauaaggaagagccucacuccuagucaguucuucucaguaacaaacuuccucaagagcauaaaggcaaaucuguaaaacucacucauuacaauuagagugaaauaacugaggaugggucuucuaauugcaccacauuuuauuaagucuaaaaugccagugguuauaagccgaauuauuuuguguaacaccagagaagauggaaagaaagcugucauuuuuguuuguuuugagacagggucuccugacccagcauccagaguccuggaauugaagguguaagcccgaauauaaauauuaucaauuaagcuauaauaugcuuacuuaugccacucaucuucaaaagaauuuaauaaaauuaguuucagggcuagagagaugucucagcaguuaaagagcauugacugcccuuccagaggacccaagaucaaauccuagcauggcagcucaugacugccuguaacuccaguuucaggggacuucacaccuucacacagacauauaugcaggcaaaacauuaaugcacuuaaaauauugucuuaggguuuuacugcugugaacagacaccaugaccaaggcaagucuuauaaaaaacauuuaauuggggcuggcuuacggguucagagguucaguccauuaucaucaaggugggagcauggcaguauccaggcaggcauggcacaggcagagcugagaguucuaugucuucaucuaaaggcugcuaguggaagacugacuuccaggcaacuaggaugagagucuuaaacccacacucacagugacacaccuacuccaaucaggccacaccuccagauggugccacucccugguccgagaauauacaaaccaucacauuccacucccuggcccucauagacuuguucaaaaacaugagucuaaacauagcauaaggcaaaaugcauuuaguccaauuuucgaaguccucauagucuauagcagucucagcaauguuaaaaguccaaaguucaaggucucuucugagauucaucuaauuaauuaacuguaauccccaaagcaaggcaggaaaucagcugggcaaacuccaaacucugcaucuccaaggaugaugucaaagcagucuuuagaacuccacuccuuuuucaucuuuguugacugcaacaaacugcuuucuccugggcugguuccacuccguuagcagcuuuccucagcauguaucccauggcucuggcaucuuuaacaucuuugagucuccaaggcaauuucaauguuacagcuucuuguuucagugucugggauuccacuugaucuuuuggacuccuccuaagggcuggcaucucuucuccagcucugcccucuguagcacucuaagcucagguugauccacuccacuauggcugcuguucuuggugaucaucccaugguacugacaucuccaauacacugggguguucuacuucaacuaggcuucaccaauagccucucauaggcucucuucauggugccaagccucaaauccuuugcaugaccccuucgguccugggccaccaacuacagcugaggcuauaccuucuccaauggccuuccaugaccuuucacaaugccaagcuucagcuguucuucaugauaccuuuaugccuucaaaaccaguaccaccugggugauucuuacacauuaccaaguccagcuguagcacgagguacaaccuuggcuaucucuggaacacagcuucucugugcucccagaaaacacuucccagaagaguucaccucagugaugcuggucucuucucaaucacugcuaauuucuuagcuccagcuaaccagcaucaaauugucccaauaguuccuuccauuuuuaacuguagagccagagccacauggcagaagcugcugaguucugcugcuugcacgaguuagaacacuuguacuauuacauugucacuggcuuuauguuuuccaaaccauucacugccuaagcuuggcuauccuggaucuugcucuauagauugaccuugaaugcagagaucagcaugccugucuccugggauuaaagguguguaccaccaugccuggaucuuaauuuagcuagauagaaucuugccccaaggucccacucccuuaaucuguuaucuccuagaacacaggauuuugcuucauuucacuuccugguauguaugccuuuaauacucgaaccauauaauuuauauuuuuccuuucuaagcuugcuaugcuuguucaaacuucucuucauaagacuuaaccagagaacaaagucuuugcugggcuuuuuugaaacuuccuuugucaaugcaauuaaucugagucucuucaccuuagccucaggcacuuuucagacaagggcaaaaaguagccacauucuucaccaaaauaccacaaaaacugucuuuaugaccacauucugaaauucuucuccuuugaaaucucuugggccaggucaacacaguucaaauuacucccagcaacaaagucuuccauauuccuacuaggaugacccauuaagccccauuuaaagcaguccacuguguuccaaauccaaagucccaaaauccacauucuuucaaauaaaagcauggucagcccuaucacagcaauaccccacuccuguuaccaacuucugucuuaggguuuuacugcugugaacagacaccaugaccaaggcaagucuuauaaaaaacaacauuuaauuggggcuggcuuacagguucagagguucaguccauuaucaucaaggugggagcauggcaguauccaggcaggcauggcgcaggaggagcugagaguucuaugucuucauucaaaagcugcuaguggaagacugacuuccaggcaacuaggaugagagucuuaagcccacacccacagugacacaccuacuccaaccaggccacaccuccagauggugccacucccugguccgaaaauauacaaaccaucauaaauauaaacaaauuacuuuuuuuguuuugguuuuuuugagacaggguuucucuguauagcccuggcuguccuggagcucacucuguagaccaggcuggccucgaacucagaaaucugccugccucugccuccugagugcugggauuaaaggcgugugccaccacgcccagcuaacaaauuacuuuuuaaacuuaaguuuuagaauugaacuacuagaaccauaacguauucaaguaugauaggagaucaaaaggaaaguuaucuacagauaaaauaaacuggaauacuaagauccuaucaucuuuucuauguuacaaucaagucaguacuccaacauaauuccuagucuguuugggccaguaacaaaagcuuuugaaaacauuuccuucaguuguugagaucuuuuggugccacuucuaggacuuuggcauuuuucacugggauccgaccaggaaguaggcucagauaagaauaucagaaacagugaccauggggcuuugcugacugcuuugcuugauuaccaccuugcgugaucucuuugcuuacuacuucgcuuuauuccuuugucuuugaucuaagaacugaccaugugucuggaugagccuagaaugauauaaaagcaggcugggaaaaagauaaagccgcuucagccucgccgacugacugagcuggcuuggucguucagcugccugcaagucugucuaugcaccaugugcauggggaggccagaagaggugugagaucccuugggacuggaguuacaaaugugagcuaccaugugggugcuggcaucaaaagaagaccagguacugcccuuaaccacugagccaucucuccaguugccauaauaaaaacuuuuuagccacaagaacgauaccuaaaaccccaaggcaugcccaggaaacaguaaggagcaggaauucuaagcgucuggucuuuaagcauaggaagucaccuuagacagacaguguggugcugcucgcaccccaucccaccugccacaccgagggagucagcagauagcaucccuguuaauaaagggcaggugcagucagcacacaugcucacaacuaacacaaggaaaacgcauuuacagcuaauuuacauucugagaaaucagcugaguugcaaguuaacauggaagcuguauuuuggguucuuuuuuucccccuuucuuaggaaaacuggaggcugacucaggagucuaucagcacggaggcaccgucugccgcucacucagcacaggauuuuuaauaggauggaacuaauguuaagaacuuuaaauacuaaaaagugcauuuugcuguccaaauaauuuuuuaaaaaauucuaauuaaauuuaauucuaauuggauagucuagaguagucucuucugaacacacugacccuuaaaauuagggaaacaccccuucuuuaaaaugcuuuuccccaaaaucucauuacucaucaauucagcagaauucugcuggaaacacaucuagaauaaaaaacggccagcaccccagcagacaaaaaaaaaguuuuguuuucacccaacuuuuagggaagggggaaaaaaaagcaaaucuuccgaaaacagacuucucacaaaguccuacuuccauuuacuuagcaaaaccccagugcccagaaugagcccucgaucuauugaccuuaccuggcgggucaccaaggcugcagcagaggccagcucugucucuccucuucccaagcucgcugagauuuccagaaggguuaaaguggccuuccuuuagcuugcaagcuuuucucuuaacacucucuuuugcccaucuccuuuccccuacccaguaagccuuuagcuuacugccaaccacgagacuuuucagaaaaugaaagcaaaaaucucuagcaaacuaacgaagugcccgguccacuuuuuaaaaccauauaaaguacacaugucauacaaagacaaaucacgaacgaguaaggcacaguauucccuucaaucucuaaaaaccuaaauguauguaaauucaacucagcaguacaagaacauauuuuggaaauguuuuucuuucaguccuugaaaauugcgaauuuuauuaauuuuaauuaccuagacucagaucacgcuacuaagguaaucaagagucuuugacccaaaaauuuuccuccaaaaauaaaaauaaccaaaaugugguuccuacaguguucgccacgaugcucggacgcagacugaccauaguaaguggcacuuuagaaaaacaaaacaaagcagaaacccuuaaaccgcucccuuauuucuacuguuguuuaugugcuaagcagucgguccuccaggggaagaugggaccgcugucucuuaccaccgcaccccacagcuccucgcacgaagccuggaagaaguggccauucaauaaaugccuacuaaacacuuuugucuaacaaguuggggcauucccaaacgcugacuccaccccugucgucggccgcuggcucccgaauccagacagcuuauggccuugcucugaugaaacgaaaccucaucgcucaggaggacccagggcaggaucaagagagccacucgccuccaucccgcagggcagccgcuccucggcucaucccgcuaggaugcagaucccgagcgcggguucccacagcaucccgagaggcuccauguccagcagcagaucugcagggcacuagucccugcccaccccgcaccgacagccgggcgucgggacacaggggacgccugcgcacaagaacugagcuaccacccuccuggccccaccgaggcgaaggguaacaauaccccucagcaguaagacaggguggacaggcggccccggaacggcugcgcgcuccccgaugccucggcgcgcucccggugcacaaccgccugcacgugagcgcgccccgcgcgcgcgcgcccaggccacucuagcugauagggucgccucaccugagccgggcuccgccccccuucuccucgcaggaggaggcgguggcccuccuccgcucggaccgacccugaggaaggaggcgggaagguccagacuggcuuccccggcugugacuuccgcccgccccgccccucgcucccggcuccuucagcccguucgcgcgguucuuugaggacccggcggaggccu

SEQ ID NO: 1877 - RNA, 3070 nt, Mus musculus
gaccagcguuagcaccugaaagggugccccuacacuugaugccaccuccaaaagauuguacaugauuaugccgggcuagaauuaaggcuaaaagucaaaagucagguccccaguccccguuagaaucccugugaaacuccaggcugcagcgacccugggcucguuucccagggacccuuggaaaucuuuaagugcuacggcaugucggaggacacuggccucaagcuugcuucucacauggagagacugacuacagagguagaugagauuccagguccacccagcagcagagaggcaggcucuguugagcgccagggacaggccccagagcaaagcccacuuguaucgaagccaaggugaggggcagacuugaagcaccacgucccuaagacagaaaggacaacugcuagucuaugccugugacauuggcuccucauccagcagggccgcucugguucuccaugcugacucccacugguccuuaugaaggugauauagacccaccccaucgugucucaacaggacugcugaccaucagccacacaacaucuucucaagugacuccagugccuucaguggucuugcccacagcugcucagcagcaggaguccagccugccauucgggcuugcuucccuggcaaucagcucagaugucaugccuucucagagcauuacaggucaagccacagauucauggucacaccagcuuaagagaagacacaugcucauuuuuguuuuaggauauacagaaauauguggcucucuaaaguuaaugaauuucucugaauuguguacaaugguuugguaucucugaaaaaaguaugaaaaaaauucuuguccaucuuuagcuuacagauaugcaugaaacugugcuauucuccugggugcaugucaggaugcagcagcccuggcagcaugguuaucaggggacagagaacugaaugccaccccgagaaucuuggguguuuuuggugaauucuaugcuguaggcugccugacucuuccagagccugugaagaacugaggagacaugaacacuccuacaguuaagucugauucaacacugaguuagaggagggacaccacugaacacugagguguagcugugagagcguaugcaacaggaagaaaacuacagcagcgcugcugugguuagucuaacuggcuacgccaggagagguguucuauggcgcuugggagugagacgugacaaggucaagggcagcugaucuuggguggccuugggcauccagauggcaugaaaggcaaaugcgccgugagaacccauacacaggacuccguaucaccagaggaaagacggacacuagcuucccacuuacaucaaacaaguacaguaucagaaauacacguugguuaaaacccugcuaacacagcacgaacagaaacaccucacugucacuccuacaaguacacacuccauuacaacuuuaguucuuaaaacaaacagaaaaguuacuaaaaacaccuaugccauagagauguauucgaaagucuauacaccuguuaguccaagggcauauuucccuggacucagugugagcaccaucagagggcagugccugugacugcaacucagauacaaauaaaaacuccacaggacuuucagaggccugggacuagcucaggauacacuuuaagcaucugugccagacaugcuuguccuccagggccuuuuuuuuuuuuuuccagauagcaccaagucaccugguuacacacaguauguucugcauugcuguacagggauggaauacucccaucacaggauacaggacauuuaauuaaaugcuucacagagcuuuaaaauaguguuaaaauguuuucugcacuuucauuuuuaaauuugauauucuuaacaacaaugacaaccuacuuuaggacugcauuccuccacccuaagaaaugugcaggguaagugcuacaccuaacaguucucugcuuacucuuggcugaaauucaugagagccacuggacagugagaccgaguccagugacaagagcugccugccuacagcgguuuuaguuucagugcagacuggccugugcgcuguggcgagaagcgaucagagcagggugcuggggagguugcugcucugccagcgcaggcaggucguuuucgaguguuuauauagguggcuggacugacugaaccguuugccacacuugaggcaggcguacggcuuuucuccuguguggacccggauguguuucuugcaauccgucagagucaggaagguuuuacagcagauuuugcaggcauacuuucgagcucccuccacaaccaagacauugugcuccgauaaggccuucuugcacuuugacaagacaucagcagaugcccuggucaacugaggagggccaggcugggagguguggccauuuucaaaugagguggccccguucaucauuagcugggaacuggcugaauuuucagagaucugcgagcuccugacagaaguuaccacuggcauuuuuggagcuauucgucgguaauauggaaaguuacuggccccuccucguggggaacccaucauggcccuggagaaggaugaguggagacccaagccagaccuggaaaaauccaucccgaauuguucuccuugguagccugaggucugcacacagggcaggcccaucaccuccugcauaggucugacgaagugggagucugcaggcucacugaacggguucucuacaugggaaccaggggcagaggaaggcccaccugcuggcccagccucuggacucaacagauaaggggccucgcccucgagccuacagucacuggugguguuugggagguugucgucagugcucugacuugcacugaaauuacucccccugcucuuguugagaaaauuggaaauacuaaaagaggucuuauguucuagauuauucgugacuuccaagauguggauguccccgacccugucggugcuggacuggggaucggaaaagcuccggucacugcuuucagggcugaggucuaucuucucggcacugaccaccacuccuuccaccuccacagacucacugcccucugcuugggag

SEQ ID NO: 1878 - RNA, 2908 nt, Mus musculus
gcuuucuucaucagaauguuuauuaaaaauauagacugugcuuaaaugucauuguggguguaugcugacuuccaaacagacuucacaaauaacacuuugaacagaagugguaaacagaaaugacuccccuuagagccugacauuauuaaccacuccaucaacacucacagggguggaguucaugggccuaagggcaccaugaacacaagacaucuuuuugcacuucccaaguggcuuuauauuucagcuauggaggucaguucucaaaguccuacuuguucucaacaaguaguuuauauguccguuuaaucagccuuacaccuuucugggccaauucagcugcagacaggaggagaagccgucaccaggucuucaugccaugcauccaccugacugcccguccucagaugcuauccagcuucuuuaagauauauggagcugaaagaaaaacccgggauuagguuuuuuuuuaaagauuuauuuauuauuauacauaaguacacuguagcugucuucagacaccccagaagagggcaucagaucucauuacggaugguugugagccaccaugugguugcugggauuugaacucaggaccuuuggaagagcaguuggugcucuuaaccacugagccaucucuccagccccugaauuagguuuuauucuacaaguccucaggccauacugcacaguuauaauggugguggugguggcgaugguggaugucacugacuuuaugaaauaugauucuagaaacuuccaaauuguuauccaacaauugugucugaccacaagaagggauccgcugcuuugcaaagcugcccacccccaugucacucaauaaccaucgcacacaaagagcaagcaaccucacacuccggcaucuuuccuccagggcuguacguaaccccaacagcccuucacugugggcaucuuugaccuauuuugcacuacaggaaguuaaauccaggucuugcacgggccaggcaaggacuuuacccccaagguauacuugaggggggugggagguggagcagauuccuuuuuaacccaaacaagacgaaaugcaagaggaaucaaaugggcauuaggcuucauuaccaaugcugggagaacaggggcuaggagguguguguguguguguguguguguguguguguguguguguaaggcaagcagaggaacagacaccuacucugguuucucuaugacucugucaccuaugcccuucagaucacaccaguuacugugcugaugugauaaaugaugugcacagagcugucuggaauacccaaguggcguugcugagauagagaugacucagcaguucagagugucugcggucaaucaggaggaccugaguucagaucccagcagcccagccauccagccaucccuggcagcuuacaauuaauggccagcuugacuccaguuccagggauuccaacgcccccuucuggacugcaggcacgugguucacauauagacaagcagaaaaacacauaacaaaagucucuuguuucaagacagauuucucuguguaaccgcccugucuguccuggaacuccauuugcagaccaggcuggucuuuaaaaaaaaaaaaaaaaaaaaaaaucauugagauccaccuaccucugccuucugagugcugggauuaaaagugugugcuaccaugcccgguucuaaauaaaaaucauuaaauagaauaaaucagugcacuaagcuaacauuuccuugagagcucuugccuauaagagaaggaugggaaagcuaaaguuuaaaggguaagcaggauguuuugggugcuuccauuucccccaagauguccuguccuggaggagccagcaauacagagaguacagcaaaagaggcacccaaaugagggaggccuuaacuccagucuucuaaaaauguugguauguucuucaauuauuugaaucgcuccugccucucccugcccagaagacucccacaggcaagcaagcacuggacaauaggaagaagugguacagguguggaggucagaguacaacuucuggaaacugguucucuccugccaccacguguggauccggcucaggcaacucagugagccaccuagccagccccugacuuuuaaauugacaguauggcuuuaaccuugaguauguguccuaugaacucaagcucucacuuggggugagguggcacagaucaagcaacuuuuguuaauguugagaucaaacgcuucagagauucuccaagaaaaaccaauuauuuacuucacccucuguacaaacaaacauaaagaaagcuaaucucuuguacuucaaaggcaagcagagagagaaagcgccugcuaccuuauuaagagcucagccggaauuguauucguucucugaacggccaaaugaccuugggucagccaccuuccggggaccguuucuagguuugcaaaacgaggguauugcuccgaggauaacacgugggagcuucuuaagcacaaacguugggcgagcaaaggugacuuaaccacgcguccuccgccaccacgugcacugggcacauccccaggacccgcagacccccagagugugcgcaguugggcaguccuggacgugcaagcaccccacucuccccaggaugcucagcucaaggccccacgaccgcgugcaggguuggguguggacgcguggccucacggucacagcccagaaggacacucacugacucgcagcagggccacguagaugaggaaguuccgaauggaggagaccacauccucacgcaucuuccgcuucaucuccuccggguccaacuugggcgcgagacccucgauccggaacauugcggcggcucugccuccaaagcuugcgagagcagcagcuugcucuccuccaguggccgcccugcacccggaacuuagcca

SEQ ID NO: 1879 - RNA, 2908 nt, Mus musculus
uggcuaaguuccgggugcagggcggccacuggaggagagcaagcugcugcucucgcaagcuuuggaggcagagccgccgcaauguuccggaucgagggucucgcgcccaaguuggacccggaggagaugaagcggaagaugcgugaggauguggucuccuccauucggaacuuccucaucuacguggcccugcugcgagucagugaguguccuucugggcugugaccgugaggccacgcguccacacccaacccugcacgcggucguggggccuugagcugagcauccuggggagaguggggugcuugcacguccaggacugcccaacugcgcacacucugggggucugcggguccuggggaugugcccagugcacgugguggcggaggacgcgugguuaagucaccuuugcucgcccaacguuugugcuuaagaagcucccacguguuauccucggagcaauacccucguuuugcaaaccuagaaacgguccccggaagguggcugacccaaggucauuuggccguucagagaacgaauacaauuccggcugagcucuuaauaagguagcaggcgcuuucucucucugcuugccuuugaaguacaagagauuagcuuucuuuauguuuguuuguacagagggugaaguaaauaauugguuuuucuuggagaaucucugaagcguuugaucucaacauuaacaaaaguugcuugaucugugccaccucaccccaagugagagcuugaguucauaggacacauacucaagguuaaagccauacugucaauuuaaaagucaggggcuggcuagguggcucacugaguugccugagccggauccacacgugguggcaggagagaaccaguuuccagaaguuguacucugaccuccacaccuguaccacuucuuccuauuguccagugcuugcuugccugugggagucuucugggcagggagaggcaggagcgauucaaauaauugaagaacauaccaacauuuuuagaagacuggaguuaaggccucccucauuugggugccucuuuugcuguacucucuguauugcuggcuccuccaggacaggacaucuugggggaaauggaagcacccaaaacauccugcuuacccuuuaaacuuuagcuuucccauccuucucuuauaggcaagagcucucaaggaaauguuagcuuagugcacugauuuauucuauuuaaugauuuuuauuuagaaccgggcaugguagcacacacuuuuaaucccagcacucagaaggcagagguagguggaucucaaugauuuuuuuuuuuuuuuuuuuuuuuaaagaccagccuggucugcaaauggaguuccaggacagacagggcgguuacacagagaaaucugucuugaaacaagagacuuuuguuauguguuuuucugcuugucuauaugugaaccacgugccugcaguccagaagggggcguuggaaucccuggaacuggagucaagcuggccauuaauuguaagcugccagggauggcuggauggcugggcugcugggaucugaacucagguccuccugauugaccgcagacacucugaacugcugagucaucucuaucucagcaacgccacuuggguauuccagacagcucugugcacaucauuuaucacaucagcacaguaacuggugugaucugaagggcauaggugacagagucauagagaaaccagaguaggugucuguuccucugcuugccuuacacacacacacacacacacacacacacacacacacacaccuccuagccccuguucucccagcauugguaaugaagccuaaugcccauuugauuccucuugcauuucgucuuguuuggguuaaaaaggaaucugcuccaccucccaccccccucaaguauaccuuggggguaaaguccuugccuggcccgugcaagaccuggauuuaacuuccuguagugcaaaauaggucaaagaugcccacagugaagggcuguugggguuacguacagcccuggaggaaagaugccggagugugagguugcuugcucuuugugugcgaugguuauugagugacaugggggugggcagcuuugcaaagcagcggaucccuucuuguggucagacacaauuguuggauaacaauuuggaaguuucuagaaucauauuucauaaagucagugacauccaccaucgccaccaccaccaccauuauaacugugcaguauggccugaggacuuguagaauaaaaccuaauucaggggcuggagagauggcucagugguuaagagcaccaacugcucuuccaaagguccugaguucaaaucccagcaaccacaugguggcucacaaccauccguaaugagaucugaugcccucuucuggggugucugaagacagcuacaguguacuuauguauaauaauaaauaaaucuuuaaaaaaaaaccuaaucccggguuuuucuuucagcuccauauaucuuaaagaagcuggauagcaucugaggacgggcagucagguggaugcauggcaugaagaccuggugacggcuucuccuccugucugcagcugaauuggcccagaaagguguaaggcugauuaaacggacauauaaacuacuuguugagaacaaguaggacuuugagaacugaccuccauagcugaaauauaaagccacuugggaagugcaaaaagaugucuuguguucauggugcccuuaggcccaugaacuccaccccugugaguguugauggagugguuaauaaugucaggcucuaaggggagucauuucuguuuaccacuucuguucaaaguguuauuugugaagucuguuuggaagucagcauacacccacaaugacauuuaagcacagucuauauuuuuaauaaacauucugaugaagaaagc

SEQ ID NO: 1880 - RNA, 19007 nt, Mus musculus
agcugaucaggaaccggaaguggcuuuggggcgggaccaacuguguucucuucugagcaagguguguuagguaagccaagaucugguucugaggguuggcuagagacugcggggucccaccgagacgccuaggcaccccacagcccuggggagucugggucuugccuuuccucggucgcagcacgcgagucagugugacccgcguucccugcagccugggaucuaagcagguguucuggugcugaaggugguugggcucagaaugagaaaaugagagaccuaugcaaacaggaugauuggacacuuagcgacggcguuugugcucaucaggugggacuugggcuagaaaaggucuaaggcggagacggcgguguuaacuccaaguauuuauugagagucugaguaaacggaacauuuaauuuuauuggaacggugugaaaaaaucagacaaaaaauaaguaggugguguuggauagugaaaauaugccugaucugaggacgugugagacuaagggaagagcaugugggcagagauuaacaguuuauguagacauugggauauuuaguauguuugggaaauagguaggucacaguuuaugcagacaucgggauauuuaguauguuuggggaauagguauaccacagagcguaaaagaaaaugauggaggaggggcuaccaggaaagauggcucuugcugaggaugggaguuuaguucucagcacccaugucugggcgacucaugacugccuguaacuuaagcuccagacaccuguacugaacugaugcacacauagccacauacauaauuuuuaaaaauaaaauggcucuggugugguggugcaagccuuuaauucgggaggcagaggcgggcagaucuccgugaguucuaggccacccuggucuccagagggaguuccaggauaaccaggguacagagaaaccuugucucaaaaaacaaacaaacgaaugaaugaaugaauggauggaugaaugguuggauggaugaaugugggaggcagagacagggcagauuugugaguuggaggccugccuggucuccaaccaguauauagcaaguucaaggccagcuagggcuacauagugaaacccugucuauaaauaaacaaacaaacaaauaaauauaaauaaauaaauagaauccucuagaaaaaagaaaguugacagaagggagagagcccuuagugaucugugcagauaguguguagauuuuggauuacggugagugaaauagaaaaugcugcugacucuggccagaagagugguguaauucucaaacauuuagaugcucuuauauaucugcugcuacauacuugugaauauauauauuucacagauuuauuuugagacagggucccagguaguuuagacuaaccucaaagucuuuauguagccaaggaugaacuugaacuugagccgugaacuucugacccuccuguuucuuuuuucguugugcuaguaguaccuaagcugucacagcugguuuauguuauggguuugagacaagggcuuuaugcaugguaggcacacgcucuccugaguuacuucccugguccuaggaugcucuuuacugugugagguucacuauaaguucuugaaggauuuguuuguagaguagggaaaugggaggaccuguuugaguuacacucaaagcaguugaaaguuggaaccucauaaagauggaauggaugucaccaccaaauccccaggauauaccaucacugugucgguucauuaguaaccauugagugacuaaggcucagaaagagugcuuguucauuugagaugggguauaaucacugugucugcuagacuggccuagaacucauaagcccccugccucagccucucaacugcugggguuaaaguuauaccacuaucccugccuuuagaauagauauuuuaauuaagagguaaaauaccaaaucugagcauagauaaugucuuguguagauucaucggaucuguauuuuuuuaaagauuuauuuuaaauuauguguaugugugcauauacauguguguguucacacaugcacacacacauguguguaggugcaagugccauuagagucuagaagaaaguaucugaaccccuagagagaaacuauagguaguucugaacuaccugauguggguacucguaauagaacccugguccucuuuaaaaguagcaaaugcucuuuaaccauugagcagcgccuccagcccccugaucugugcaucuugaugcucagcuacaccuuggcuuuuugaggacccuuagaugauaaccucuguucugcauuuacugaauuugcauuguguggccaggacuuaugcuguccaccagggaugcagagcugaagaaaggugggcucugccauuaggagugugcagucacauauaauacaggcucuuaggguggugguuacuggugccuuuauuugaucuccugguaugagaaacaucuucagggacuauagaauuuagaaaggcacaaggaacaaaaaagaaaguaguuaaguuuaauaaauacuaacuauugcuguuuaagauuuauuuauuuuuauguguauaaguauuuugcuuuccuguaugauugugaacuaucauuccuuuggaggccagaaaagggcuuuggauccccuggaacuggaguuaacagaggauugucaaccacuguaugggugcugggaacuaaauccaggaagaaauuguuuaagaagcccugaacucgcagggcaagauggugaacacuuagucccgaaacucgggugagucucugugaguucucggccagcuugcacacgcaccacuggugucuugaacaccacgauuacagugcuucucacauuuuuucagccucaggccuggaugggacagugcauacccucagugcuuccucuugcaauggcgcucagauauagggcagauuugaggcuuggcaagagguucugaccugucaccagaaccccagaaaucuaccacacuuuuuuuacuggcucagaaccuuguauguaguagauacuuaagaaauauuugcuaaaggacugauuugaaaguaagcugacacacugcuuuccaaagagcacaauaaaagcuuggcuucuguggguccugaugguuuggagguaucugguccguguccucugagaagugugcggcuucuuuccugcugaagugucucucuggaacacucuccagcauguucuccgugguucagucguucugggucaguauggcaccccugcuccucacuaacaccccagcacuaucugucuucugguuguaaggaaucagcuguguaagugacgucagcgcauggacuguaagucggaagagagcgcccagagaacagacucacaggccuuucaggaaccagacggacucccagaggccggaggugaagauggacucucugaaagcuuccagcuucugcagguggauguggaguacgagcgcccagaagagaccagcccugcaaacagugccguguggagcucgguaggugcugcguggagcucaguagguccugugagcuugucgugauggcugucucggagaucucugcucuaaggguugaucuaggagcugaaaaugaaugcuauguauuucauucccuuggauuacaguuuccucuucauuugagucauaagaauguaaauaaaaauuuaaaagagauuuugauauggcucaaaaaggaugaaggacucuaaacucuguuuuuaagauucugucccaaaugaguuuucugcagucuugggaugguggggugagggugguguucucucugauuacaaccuggagagggauauuauucagagagaacuuuugccuugcguacucaaggcccugggucagaucccaagcgaugcacacaguuauaauaauucuguaauguucacggugaauacccaccagugaaaauaaaauagcaaaccaucauagugguaaaauuaaaaauaaacacaagccaguugcaggcuuguuuuaaagacaaaaaccuuuucuucuuuaacuuuauauauaaaugaaaaaagguggcgggcauucauuuuccuuucuggugcucaugaaguucucaaacaauuuuguuuucuggauaauggaagaaaaacaugcaaagaaaacagagacacugggaaaggauagucuccucaaagaagagcaaaaggaagcaggaaagagaacgaaggaaagccaagcgugcagaagaccccgguaacggugagcgugguugccggugaaaggucauggcuuucagcaaacuuguuuuuauguugcugggagaguagggccuauuacucaguuccucugcaagucagcggaccagugucaacuucgagguugcuuuuaaaguagaagcuaagugaccaugugcagcuguaaucucagaaacgggaugacgccggcgguagcgcaugcucacucaugcucugugcuagcuuaaaaucaugcauugaguaccucagggcugcuacguacugagauuauccgcuuuguguagaagagauggguucagauuagauaauaugcucagaauaacucaguuuagcacaaucucuaagccagagccuaugcugccccccaccaaaaguaaaagagagauucgucugcacagagaaccccauggguuguacaaaaagagcuauuaguucuaguaaguccagaaaagacacuggacucaaaauuauuauuuugaaagcuggccuuuggccgggccugguggacaugccuuugaucacaucacucaggauucagagucagacuaaucucugugaguuucaggccagccuagucucagggugaguucuaggacagccaggccuacacagagaaaccaucucagaaaaacaaaaacaaaaacaagaagauagagacagacagacagacagacaggcugauuaccguuccccucccucuuucuccugcccucccaucuaaacccaccucauaucugucucauuagaaaacaaacaggcuucuaagagacacuaauaagaaaauauaguaagauaaaacaaaaacugucacauuggaauggacaggagaaacaaacagaaggagaagagcucaagagaaggcacaagaaucagagacucacacaggaaucccauaaacaugcuggacuggagcgcuaaucugcgccugcugucucagacuccauaggagcauugaucacguugaucacauugauccagaaggccuuguuuucuuggugccauccccuggcucuuacacucuuuccacauccucuuuggaaaggucccuggagcccugaggagagggauuugguggacacaucccauucagggcugaguguuccgaggucucucacucucugcaugucuggcugugggucucuguauguguucccaucucugauggcugagucagacacugagcuaugagucuagcagaauaccauuaggaguaauuuuauugcuauauagcuuuuguuuuuguuuuagaccaguacuauuuuacccuagauccuugggcuaucuagucucuggcucuuggucauccaagcagugucagguauggauuucaucuuguggaggggccuuaagucagauauuggcugguaacucccaugagcuuugugccuccaaugcccuagcauaccuuauaauuaggacaccauuguauauccaguuugugacuggcauggaguuuauguuacucuuuugguagugugcagaguacuuuccugugccaaaggcauuggaauauaaaagacuccguguaggcaccaguucaacuucuucagguuccgugaguuguguagguuuugucuucagcauuggggccucacugucaguuuguggagagcaaccuauagccuuggucacagccuggguuguuuggagauuccuaugugacuccuuuggccaacaacuuagauguaaccuaaucccaguacuggaggcuucauuuggugacaagagaugaacaguugggacucugucuccccauuacuuugguccccuucauaucuguauacauuucaggaagcuuacuguauuagguuuguguacuuaccccuccgauggccuugaugcuagcugucuccccauuucccccuuucauaguucucucuccuccccacuugauccuccugcuccugcaacccccauccauucauaucuguucauuucucuuaccuaacaagaucuaucuguacacccuaguuucuuacucuauacauaacuucugugguucugugcauuguagcuugguuaucauugacuuaacagcuaauauccauaucauaagcagauacauauuuguauuucugggucugagauaccuaacuuaggaugauuuuuuuuucuaauacuaaacauuuaucugaaaauuucaugaugucguuuuuuggguuguuuuuuuuuuuguuuuuguuuuuguuuuguuugguuggauaauacucuauuguguaaauguaucacauuucuuuauccauucuucugauaagguuagguuguuuccaguuucuaggauuaugaauagagcagcaaugugaacaugguugagcaaguuucucuguuauaagaugaagcauccuuucggugucugcccaaaagugguauagcuggaucuugauguagaucguuuccccucuuccugggaaacugccaugcugauuuacauaguagcuguacaaguuugcacucccaccagcaauggaagaguauuccccuugcuccacauccuugccagcuugagcugucccuugugcuauugaucuuagacucugaugaguguaagaugaaaucucauaguguuugcauuucccucguggcuaaggauguugaucauuucuuuguuucucagccauuuaaguuuccucuauugaggauucucaguuuagaucugggccccauuuuuaauuggauuauuugauuucuugauaccuacuuuuuaaauuuuuucauauacuuuggauauuaguuuucuaucugauguguaguugguaaaaaaaucuucucccaugcaguggcugcagcuuuguccccaaaaacgugguguccuuugcugcauagaagccucucggugucaugaagucccauuuacuagcuguugaucucagugccugugcuaucccauucuuaauccucucugguguuucugucgcaggcaccugcccacagcacagcaaacgcuuuuugaaagccuuaaccaaagagaaacuuuuggaagccaaacacucaggaccaagacuauguguugacuugagcaugacccagcacaugucaaagaagguagagcauccagaggccaagggaggcacggaagggugcagucuggccaggcggggaccaucgccagcuucuaugggcuagacgugucugauuuucuagucuccugacuuccacaggugguuggaaaggaacacagguucuuugauuuaguuugcaguuugccuucucuuuugagccuccuacucaggcuaugauguucucagucuagauggaaccuugccgaucuucuagcccaaaguuccaaaguccuuccacaguccucccgaaaacauggucagguuaucacaggaauaccccacuucugguaccaguuugucuuagucaggguuucuauuccugcacaaacaucaugaccaagaagcacuuggggaggaaaggguuuauucagcuuacucuuccacauugcuguucaucaccaaaggaagucaggacuggaacucaagcaggucaggaagcaggagcugaugcagaggccaugcagggauguucuuuauuggcuugcuuccccuggcuugcucagccugcucucuuauagaacccaagacuaccagcccagggauggucucacccacaaggguccuuucccccuugaucacuaauugagaaaaugccuuauagcuggaucuuguggaggcauuuccccaacugaagcuccuuucucugugauaacuccagccugugucaacuugacacaaaacuagccaguacaccuucuaaaaagaugaacaaggaggcaggaggugguggugcaugccuuuaaucccaguacugcugaggcagaggcagaagccauaaaaaaacgaagaguaaacaagggagucucuccuuauauuaagcgagagcagauuaaaucaaauccaaagucuuguaggccuuuucuucaguguagcacaaaucaaacuaaacuaugaaaaaaaacuuucuaggauuagggaggaaaguuagaacuuccaacauuguaauaucucuuaaaguuagggugauggggccaaauguaccgaaugagcacggaagugccacugcucuauugaccucuuuaauaauuuaaauacugagcagcgucguacaggagaacugguguaaaagcaaaggacauccuuccagauaucaugggcagauucaggggaggaggaacucucgguuuuugcucuuaggggcaucuccagacuagugucaucgucuuaugucaaggagcauagcacuuccgcacaugcucgcuccugagugaaaggagccaggcuagcccacgacagucucauggggcaggacccagggagugaccgcugugugaccguccgcagcuagggcugucaugcguccaugccaaaggcucaguuguccuuguugcuuuacaggaauugaguagguuggcgggacagauucgaagguuguaugguucgaacaaaaaagccagcaggcccuuuuggaucugccuuacuggauucucaacugccagcccccucuaugaggagugucugaggaugaacgacggguuuucugcuuacuugguaagaauccucuagcauguuccuuacguuaucuaagugugcucuguccuaauagaaagcuuuuacuuuuucauucuuugacauaaagcuggaucuccaccuaugacauccuuaucgcaucuaucuauucuguuacuuugugugugugugugugugugugugugugcccaugauaugaacacagaggucagaggacagugagagcuaguucucuccaccacauggguccugggagaagacucagcucgggcuucggagcagcugucuuugcccacugagcugucuccacacuggcucaucuguaguuuuuuaaauauuuugaugaacuaaagaguugaguccaagggcuggagagauggcucagcgguuaagagcacugacugcucuuccgaagguccugaguucaauucccagcaaucacaugguggcucacaaccaacucuaaugggaucuggugcccucuucuggccugcagguguacacucagacagaacgcuguauacauaauaaauauccugaaaacaaauuguaccuguagugaacacauagacuuuuuuuuucuugucauuuauucccucugcaauacacuauagcugggugugguagcucaugccuguaaucucagaaauugggagccugaggcagaaggacugucacaaguuugaagcuguccugaacuauauagugaguccuaagccauugugagaucugucuuaaaaacaagaggaaacaaaacuacagcauauaagccgggcgugguggcgcacgccuuuaaucccagcacuugggaggcagaggcagguggauuucugaguucgaggccagccuggucuacagagugaguuccaggacagccagagcuacacagagaaacccugucucgaaaaaaaaaaaaaaaaaaaaaaaaaaacuacagcauaagaacuauuuauguucuauuugcuaggcauuauaauaaucaagaagugauuucuuuagugaucauuuuaagucuucaggaacauauaacuuaaauguaagcauugguauuuuauauaagggacuugaagaugcuaacccugauuuuagugucuauggggcccacuggaaaccagaccccacccaugcugcgggguaacuguaauuaaugucugcauagaaauggugucuucacuguggcaaucuaaaaaguuucagaaucuuucauuaguucuuauaauuacauuuuuucucauucuugcccuucauugccaaacuaauauucccauugucuagaaccauguuucauaaccugucuaguucgugccaaaccauauacucuaguaauauuuuuggaauauagcaguggagaggugggaaacgugauuguuagaggaacagaaaggacacuuucggagcaggguggcuucacagugucuuuugggaagaaguccuccacuuuccacucuuugcuggggaucuuguaaagguaacaguagguauggagaaucaggucuguuuccaagaaacggcacuaaaacugccccucugugcugcucuauagcugggacugaguuaccgcagccuucccuggggaagccacagaggccauaggcaugagggaugugcuguguggcgcugcacauccagcugucuccuguuacugcuucagcagcuucucccgaugugcccuauccgugccguucugaggagaucuccuuuccguuugaccugugucaguguccucucuucuuuccagcucacuagaaagccaccccuccugcugaugcucccucaccuuaguccugguguaugcucccugucccucuggggccucugauguucucugucucacuucugugguuuaagugccugcacuuauguuugucucaacuaagcacuucucaagaagcccucagaccggcagcuucccggcgcagcgggcgcuaugcugccggguagcgggcaacugguacugaauugugcaugaugcaguuuuaaccccauucgcuugugcaauuaucuuuaugucuccagcuggaugugacagaagaagacugcuuuagccuuuuuccucuggaaacccuuguguaccugacuccugacuccgaacacugugagucccugcccuuccccuguggguucaccagagcuuugucccuagucuuguguugcauuauucccugugguacaucuguucucacuccaucuaagagacugugggaggaaacaccggggauaagcugcccucuccugugggcagauagccagugccgcagagauggccuccagcuucggguggauucugcaugcagccuggccgccgguuuccugggcagcuuuggucaggguguugguucuauaguuccuuuucccagcccauccucuguugcucccccuaguguuaggucggccaugcuccucucagauucaucgcacauuucucguacgucuggcuuuguuucccgucuaacucagagcugcuuuggacagcaccugcguuuuuucagaucugccagcaggcuuuaaguuguguuguuguguuuguuguauuacuauuguugauuucuuuccuuuugcuuucucuggauuuagaaauuauaaaacaaaguugaucucgguggcuuucauuuuuccacuagcccuugaagacauugaucagagcacaguuuacguuauugguggacuuguagaugagagcauucagaagguaaguggacaucuuagccucaccucccccuccccccuuuuuaaaaauuuucuagauuggguuucuuuacauagucuuggcuguccucuguagaccaggcaguccuuaaacucacagagauccaccugccucugccuccugccuuggauuaaagggguucaccaggaacuuccagccguuuuauaccauguacaguagaggcauuugcccuguuguuaauuuccccagcaggccuagccacugugugggaacaagaagagcucguccaugagugccccuccugccuggaggucagcaguccugacugacaggagcugagugggaagucaguuaggucaggcccggugauuucggcacaaacuuccuucugcugccucucuucucuucucucugccaugacaacgcuguucuuggcuccgcauuuuaucccagcacugugcucucugagagagauuguuggcuucuuguaggcuaacguucuugcugguguaagucauauuccaagaccucaacuucaguaggguuaaccaggcuucuuuuuuagauuugcuuuauauuuuacauauaggacuguuuugcucacaugcaugucuguguaccaugugcaugccugcucagaagagggcaucagagccccuggaauuagaguuauagaugguuguuagccaccuguggggacugggaguagaacccagguccucuguaaagaacaagugcucuuagcugcugaaccaucuuuucaacuuccucaggauucuuuuauugaaguuucacuggaauaauuaagcugauacuuaaaacuuuguuucucuuauauaaauauuaauuuucuuugcuuacauucacuaauuaacauauauugcauaguuuuuaaguugaauagugauacaguaguuuacauuugcaaaaagaaauguagaagucagaaguaaguguccuucccacccuauacccucaauccucaaagcaucaugguccauuuucucagacauguuuguuggucucugacauguauuuauaauguauuagaaauauuucaugugugagacacacauauaugaagcacauguuuaauaugaauggcagcucaaucuaucauuuaaucguaguuucagaacaacuaaaugauagauugagcucccauugguguuaaacaugugcuuaguuuuaguacaauuaaauguguggaucuaaguguuccauggcgucauagcaguaauccuuugcggcugggggucucccgcagaagccugcuaauagggauuagaaagucacuguuguuguucccagugcacuccugauucaggcagcugauuacaugaagacauaaacagcuaucugcuucuauuauauaaauauuguauauucuauaauaauaauauagauauacauauauauaauauauacauaucuguauauauaauauauaauaauauauauuauacauuauauuauauauauuauuauauauuacauauauaauaauauguauauauaugugauauauauacauauauaucauauauauaaauaauagacuauuccuauuauauaaauaaacacacagagugcucccuggcaggcuaccaaggcaagagcacacccuuacacugaagccaguuuugguucccaucaucuccagacuugaugaggcugagcaucaccaggaaugacacucugggucuccuggugugacaugcuuuccugucaaguauucuugcucaugauuugaaauuuucaaauguaaucacaaggggacaagaaguccaggacuucugcaagacaacagaauuuucaaaaaauucacuguaauggaaacuaaaccaaaccaggggggaggaggguuguuuucaaggagcauaacaaaauaaaacacaguuaaaugaagcaacacgugugugguccugucugccugcgaggcugcgucagaaucauugagccccuuugagcccuuccuacaaacagggaacugucaaguguggcuugauuguauuauggauugggagggaaacuuuacaaaagaccuuaauaaugguuguguauuaaauaauccuucaggauuuuuagaagugaagauggugcagaagggggagagcugguuguccuccagcgagaggccagugugaggugcaguguuagaauggccgaaucucacagaaaugugggugacaggacgagaacucauguaaugauucucucggaucucuuagauuugagauauuuugaaguaaaugguugggagggggaagagagcuuuaucucagagucgggaucucugcuuacccucugacuugccacgccuccugcgacaggaagauggccucuuugaggccauaaaguccagaagguacgugaguagugugcuguuuagaugugaaauuuuauuuauuuauuuauuuuacacucugaccacaguuugcccuccuuccucuaccccaaguuccucccucucccucuccacccaugcuccauuucucuugagaaacaaggaggccucccauggagaucaaccagccaugguguaucuaguugcaguaagucuagguauaccuucuguugagcuuagaugagccaucugguagggggaagggucccaaaagcagggcacagagucagagacagcccuugauccuacuguugggaucaaguagaucaagcuauacaaauguaauguaugugcagagggccuaggucagucccgugcauguuuucugguuggcgguucagucucugugagccccuauggguucauguuaguugauaauguggguuucuuggaguguccuugaccccucuggcuccuacagucauuccuccccucuuccaugggauucuccaagcucugccuaauguugggcugugggucucugcaucuguuuccaucaguggcuggaugaagccucucagaugaccaguguaugaguauaguagaauaucauuaggaaucauuuuauugguuuucuuuuuuauuugccauuuguguuugguucugcuauaggucucugugcuauucagucucuggcuccuggcccucugggcagugucagaggugggcuccccucccauggcaugggucucaagcuggaucaggcauuggcuggccacucccacaauuucugugcugccuuuaccccagcacaucuuguaggcaggacagauuguagguugaaaguuuuguggcuggguuggugucccagucccuccacuggaaaucuugccugguuccaggagauggccaguucaggcucuguuuuucccacuggugggagucuuagcuagggucacccuuguauccugggaguuuccauugcccuagguugcuggcuccucccagagaugguccucccaaauuccaguugucucucccagugcucucucccccaccacaacugaucccuccuauucccauccucacacuucacccuauucagucccuucuccccauccacuggcaaugucuguucccauccucacacuucacccuauucaaucccuucuccccauccacuggcaaugucuguucccauccucacacuucacccuguucaaucccuucuccccauccacuggcaaugucuguucccauccucacacuucaccccguucaaucccuucuccccauccacuggcaaugucuguucccauccucacacuucaccccguucaaucccuucuccccauccacuggcaaugucuguucccauccucacacuucaccccguucaaucccuucuccccauccacuggcaaugucuguucccauccucacacuucaccccguucaaucccuucuccccauccacuggcaaugucuguucccauccucacacuucacccauucaaucccuucuccccauccacuggcaaugucuguucccauccucacacuucaccccauucaaucccuucuccccauccacuggcaaugucuguucccauccucacacuucaccccauucaaucccuucuccccauccacuggcaaugucuguucccauccucacacuucaccccauucaaucccuucuccccauccacuggcaaggucugucccgucuccccuucucagugagauucauucgucugcccuugagcccuccuuguuacuuagcuacuuugggucuguggauuguaguagcaucguuuuccuguacuuuacagcuaauagccacuuauaagugaguacaugccaugucugucuuucuggagcuugguuaccucacccagcaugaucuuuucuaguuccauccacuugccugaaaauuucaugacaucauuguuuuuaauagcugaguaauacuccauuguguagaugugucaccuugucuuuauccauucuucaacugagggacaucuagguuguuuccacuaucgagccaaauaaccacuaugagcuacuaugagcuauuucuaugaacauaauugagcaaguguccuuuuggugcagcagugucuuuggguaugugcccaggaaugguauagcuaggucuugagguagaucaauucucagucuuccaagaaaucaccauauagagcuggagagauggcucagcgguuaagagcacugacugcucuuccaaagguccugaguucaaaucccagcaaccacaugguggcucacaaccauccauaacgagaucugaugcccucuucucuggugucuuaagagagcuacaguguacuuacauauaauaaauaaauaaaucuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugagccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcacuggugucagcauuuggaugcugauuaugggguggaucccuggauauggcagucucuacaugguccauccuuuuaucucagcuccaaacuuugucucuguaacuccuuccauggguguuuuguucccaaaucuaaggaggggcauaguguccacacuucagucuucauucuucuugaguuucauguguuuagcaaccacaugguggcucacaaccauccauaacgagaucugaugcccucuucucuggugucuuaagagagcuacaguguacuuacauauaauaaauaaauaaauaaaucuuuuuuaaaaaagaaagaaaucaccauauugauuuccaaaguggccgcagcuguuugcacucccaccagcgacggaggaccauucuuuccccucgcuccacaucuucaacagcaugagcugucaucuguguccuugaucuuagccguucugacaaguguaagauugagucacgcccucucagguuuucagacuggcagucccuauuacagugaauacaaugaaaauaauacguguaauuuuuauaauaagaaaauuugauuuacagaaggugacauuucaaaaagcccgagaauacucugucaagacagcccgcuugccaauccaggaauacaugaucaagcgccagaaugagaaaaacuaccauucggaaauauuggccaucaaccaagguacuacucagccaaacccaaugugcuucuccuuacaggccuuuuacuguugcucugucuuggaugggcucuguguucucuguuuacucaaagacuauuugauagcucacucugcugguuugcuuuaaguguaguacccuugacucaguuuccuuugacgccuggacucuccugcaugcacuugcuggcagccauucugccuggccauugagaguucccuccuuuuguuuucuuuccuggauaaaagugucccuuugccuagaacaccuugucaccuaccuucauuggccaguaucuuuguucucuaggcgucagcucaggagcaucuuagcugccucuccucccacugcaggcugucaggccccuuguugguauucccauggugcuguguuccucgguugcaguuguccauucacaaguguucaguguaagcugaggccuuguaaguagggcuguguccuugccccacuguucccaugaucuaccaucacaugugacucaggacagcugggcagugaagacauuccacagcaccccuuuuccacauuaguccuuuacuagucuucucccuaacggucaaccaacaucuguuuaccuucugacaguguucgauauccugucuacuuacuuugaaacucguaacuggccugaagcacugaagaaaggaguuucuccaggaaaaggcuacguucuucagaauucagcagaaggaugagcagccuaagauuccagcugcagggggugaagugccagaggugucuugaccaaaggaccaggcaaaguguggcaauggcacacacuugccucuacaugcuaucucggaucuuugaaagccauuaguggcaaggaccacauuuuauguugucacccacaaugccuaacucacugaaaaugcccugauaaaacauauuaugguuuaaaaaaaaagcuuguguuaaguaauugccaaaauacaugucauucuggguguuaauucaugcuuuguacauucaucuguuugugaaaggucuacuuuuaaaguuguuuaaaugauugucugaacuuuucauuuaacuuacauaaaauuauuuuugucaccugaaaugugccgauuuccaccagcucagacauaugcugcaacaagcucugcuguccuagccccgccuggcccgcacuacuuuacguuuagaguacuugguucuuuccuguggcucucacccuguucuuguucugacuauagucauggagggcuccucuccucuagucuuuguaaauagcuuuguguagccuugagcuuagacaagccaagugcucuggacaaauauauaccccaaguuaauaaaaacaaaaguaauuauugauaaauccaacauaaagcagccaaaaaagguugcugcauucugacagagaagcauacugauccaccuucuguguuacucuuauugcaggauaggcaaggccucagggaagcccuuuaagggacugggccacauaggcuucagggguccauaacucauucucagaggucugacugaacugagaaccccucagcucuuaccaccugccagccuacacuuuucccuguggagguuuuaccauaacguagauagcacagaaucuuccuccaacucuaaacacuccucuuuauccaaaaccugagcucguagguuuuuaagauugugggaauucuguuaaaugauguuuagccagccuuggauuaaaaaucuucaucauacuauuacaucua

SEQ ID NO: 1881 - RNA, 4318 nt, Mus musculus
cggaagcugcgauggugacgccugccauggcugaaguacuguccgcgggaccggagucgguggcgggcugccgagcacgggccgugcacaaggugcugaaucaggugguucuccccggggaggagcuggugcugccggaccacgaggacguagacggccuuggcggcgccggggagcagccguuacgccugaaugcgggugcgcgcccgaggcugcgcguaguguguggcccagguuugcgacgcugcggggaccgucugcuggucaccaaguguggccgccugcgucacaaggagcccagcggaggcggcggcggcguuuacuggguggacucgcagcagaagcgggugagcggaugucggagaggcggcgcugccgcgaaagugggcccccugcaagcgaucauagguuaaggcgaaucuagagccgcgguggcuucuagcccccucucugcaucuucuuuagaggaaccacaauaggaacacauccugagaagggugacaggagagaaagguuccgugagaucuugucuugaaaaacccaaagccucgggguugccauuuggugucccaguugcaaugaguccaaauaaaucacagggaauuaaaauucccauagaauaauuaagagcuuucacuuaggaauaaugucaaauggaguggguuuccuugaauguaaagauucuugugccaccagacuuguaaaggaugcugagaaaacuugaaacuugaucaagugugaauuagacguucauaaaguuggacuggugcgggccgguuuuguaguugcagcuacauggggaguaugaguuggcuggauagguugagacccacccugaucaaccuagaugaaaguuucagaagauauuuuguaaugauauuuguauuauuuaugacuguucuuucauucugcuuuuaguauguaccugugaaaggggaccacgugauuggcauagugaucgcuaaaucuggagauauauucaaaguugauguuggagggagugagccagcgucuuugucuuaccuggcauuugaaggggcaacuaaaagaaacagaccaaaugugcagguaauaaugggagucuuugguuucaacaagaaaaaauauccacucccgagaaaguuaacuauccagagggcuacuugaauugucuucaaagcauaaaccaguucuccaagacaguuuauaagaguuucucaggcgcugcggcuccagaaguauugcuguaugucauguuugcagccuugguucuuuucuaccggguugaagaguuacaucugcuaucccccuccuuaccugucaugucugaauccaccccaugaggaaaauggcccuagucuaagggccaugggcacuauuggcuaucuguucaucauggcucuaaauccuuggagcuggagcugacagaagaguaaucuuguuucuguagguuuucagguugggcuuucuggguaguuuagccauguucuuccugaacaccugagccagaaaugugcuggccucucugcugcuuuuucuucaacucucaagggucuuuagucacucaaucuuauuuguuccuucucuuaucuuuuguaugccaaccccuuugucucacuuuugacaggagcgggcaacaaucuuaugaacucauuaaaaaaaaaaaucucauuaaaaaaaggauuguucaaaucacacagagagcauuguacucaggggucuuuccucgugguuucuguuacuucauggaaccauauuuaagcuucacaguguaacugggcuuuguuuccuucccuugggucuuuauuaaugguguuccuguuuggagcuguguccucagcccuaggagacaucaccuuugagguccaggcugacugaguugaugacugucucaucgucacuuguccugcauauucaccacacacuggguucauucucauugcccugugcaggaccacaugcccaggaagccggaaaagguguaaugauucccgcuagguuuuguaaucacccacaacaguggggacuuacaaggcauuuuuaaaguaugcacaggaaagugugccuacauguauguuuuugcacgcugugugacagcuucuuguggaggucagacaggaaggucagguccccugaaacuugaguuaugacagguugugagcagcuacacgggugcuagaaaccaaagcuggguccccuacaagagcaguaaguacucuuagcccacgagccaucuccagcucaacaguggguauuuuuaauguugaagagaacaaauuuauuguuuccuuagcuucauuuuaaaguucaguuuuguaacauuuuaaagcaaauuuuccaugaaguaguaucugaauuaccauuguccuguuuucuuuugaauauggauaucaugaguuuuuuuccucuagacaaacauguaauuuguuaguacugauagaacauucuccggugaugcuguuuguuuuuauauccacacugacgugugcaguuaccacuaguuacguguggcugcugagcagcugaacuguugaagaguggaauuuuauauauguuaaguagauacaaggcuaaauuaaacuacauguaaguugggcaguacagucuugaagauuguucuuaggccuuggaauggcuccugguuggaggguuucaugguguguggugggagggcugaauucugaggaccaucagucccuuagugugacagcugugggucccuggcauucuugcccauggaucagaaccagcagcagcagcuguagguugucuggaugaagggaacugaacuuugguuuuaaucuuacagguuggagaucucaucuauggccaguguguggucgcuaauaaagacauggaaccagagauggucugcauugacagcuguggccgcgccaaugggaugggugugauugggcaggauggccugcucuucaaagugacguugggcuuaauuagaaaguagguuaugcugcuuauuaacugcccugccuucuuuaaugaccuguuuacucugagaauuucguaaugguguuuuguuggucauacuugcuccccauucucuguaacuccuuccagguuccuuccccacuuuccuccccucuccacccugucuccuaaguuugcccuuuuuaaagacaagccacugagucaaaucugugcugcauguauauuuguaaaaaauggggccuacuaccaaagugugaccagccuaccgugaaaggggcacugagcugggcacugugucccagcuacucgggaaggcaggagcguucucacaccuacaaaucugagacuuaguuuacaugaccuagguagacuuccucuccaaauacagaggcauugugugugugugugugugugugugugugugugugugugugugcgugugugugugugcgcgcgcgcgcgcacacacgugcaugugcucaagaccgggcagagacaucaaagcagcagagacaucaagucuuguuuugggacgaugcugagcggacuuugcguagucacagagagccacucagaaagaaauuccagaaaaggaaccuuguuuaggagacccagaacauacacuuuauuaaauuucauuuucuuucaucuuuccuaacaggcuauuagcuccagauugugaaauugugcaagagcugggaaaacucuauccauuggagauuguguuuggaaugaauggaagaauaugggucaaagcuaagaccauucagcagacguuaauuuuagcaaaugucuuagaagcuugugaacacaugacaacagagcaaagaaaacagaucuuugccagacuggcagagaguugacauauaaauuuucuuaauggauauuuuagucaagacugaguuuccuggggaaauuuuuuuuuccaggugaauuucuuccuggcagaucuuuagaagaagcauauuauuuuacuagaauugaauaaaauauuuuuguaagagauacugguugucaaucauguauagaugagaaaauuauaaaaacuuuuauauaauaaacuuuguugguagugucuauauuuguaguucuacaguacagcuucuaaagugagcuggaaugcaacacuaaaccuguuuucugguuauaaucguaagccuuccuugccagagggaauguugaacacauuaaugaaagcaaagaauaaacccgucuguaaucccagaagccaguggaagaguacacaguagcucauacuuaagcacucacugugugagaaguauugucccaaguguuucacacaguuaccaggaauucucauugcugguaacugcagagaacacucaaagauacugaggcacagacuguaacauggccugaaguuuaacca

SEQ ID NO: 1882 - RNA, 5771 nt, Mus musculus
caggcggagcuuagcuggugacggaaccacauuggcuggcuagcggcugagcgaggcggguccgcacggcugcugaacugaccggagaacgcugauacuagaauuugagccugagcgcgauucggagccugagccccagaccaccgcagguagcuaccgccgcccucccuccgcacuggggcacgcuacgguccccgaauggcaggucucuuccgggugcacugcuggguucuuuccacgccgcuuccuaucggggagacacuggaugggcugggagaacacagaaccacccaaaccuucucaucuugguucccaucuggggcuagagccacuggccauaguggacaggcuaggucuaaguguguguuccgggguucugacuucaggccuuucacucgguggacaugaguaucugauauugggaggaaccacaaagcuaggccuuugggaauccaaauccaaagaugagagaguagugucccugaacaucugugguucccucuagaguagccaucaaaaucuguucuacucaaccugacggggacagggagggaggcugcugaauuuacagugagaagaugaaccgcaaacuguaaagcuggauaaccugugaccagagcuuugucuuuucuuuucuuuucuuuucuuuucuuucuuuucuuuuccucucucucucucccucucucccuuccuucuuuucuuccuuucuuccuuccuuucuuucuuucaagauuuauucauuucauuuaugugaguucacuguagcugacuucagacacaccagaagagggcgucagaucucauuacaggugguuuugagccaccaugugguugcugggaauugaacuucgaaccucuggaagagcagucagugcucuuaacugcuuagccagcucuccagccggaccagagacuuuucuaugugcaaaaugaaagcaaccacuuggacccugugaagauucugagcagcagagccuuggugugaccuaagagcaauuucacacacacacacacacacacacacacacacacacacacacacagagagagagagagagagagagagagagagagagagagagauccuggucuuuugguuacaaggacaaagcagauguccuugaugggccugcuggcucagguuccccugggagggcuuuuuucuggucagcauugauuucuguauggcuaaggaccuggugggauccuugcuuucguggauuagguuuuuuuuuucuuucucugcacuugggacagaggguugaaagggccugggaugggaguggggguggggguggggguggaggucaaggaucugggcuggugcaauuacauuuuacugcuggguggagcaagccuccgagugagacagaaaagacacaagguuucuauuccuagccagagauuaacuguguaacuaaucuaggaaguagaaacacagucuaacagucguuuaugcaauuuuagauacauuuacauuucaucauguuaucaugcuguuuuaguaaagaaagucacugcuguuuuaggugacaauaagcagaccuaccucagcugguguuugacuuguaccccagaaaacuaagccccgucccacuguucugggguuggggggcucugccagguugguuucugagaccuugaguguucugaugucugccagaguggagugucucugguuuuagacauggaagaccccauucaacaccaccccagggaacucuacauuugagggaacuggggucccaagucucuaggguccuugcucagaucucagggcaguuccucaguggcccuugugggaaucuuaguguguuuuccuagugugucacucagucagcaauaggucuacccuaggaccggacauggucauagaggugacucugacgaaagagcagaauuaauaauuauuugcguuguuugcguuguugaggcagggucucccgcuguaggccagguugaccuuggacucccaagggcuuguuugguuaucucuguggcuuagagcauccagcuugcggagcgugagaagggcuuugugugugguuuaggccagaacuagggaaagaaagguucuugguuucucuuggcuuugccuguagccacacuaaaaucuuauuaaaaagauaaaauucaagccaggaggcguuacagugcaaauuuuagcugugacacaaauuaucggauuggugaguaucuccugacgcugcaggguauugucauucucagaaggggggcuuccuggagaaauucugaucccucagagucccuucccucaaggucugccacgcuagcggggcauagaaugacagcaacaaaaaucccugccucagaggagcucauccuacuaacgugcuuagggacaacgaugcacaggcauguaagaucguacaaggcgaaugagacugagaaacauacuuuggagguucggaggucagcuccagaggugucccaggguugcuuugcugcugcuguuguuuguugagacagaguguguuauguaucagaguuugucuucaaacucacuguggagccagugauggccuugaacucccgacccuccucccuccaccuccuaaguacuagggucauggggaugagccccauacaugguuuaugucauggggugauugaaccuagggcuuugaaugugcuaaucaagcacuuuuaucaccugggcuacaucgccaguuaucgaagcucccugauucugguauucugguguuagauagggaacuaaggagaaacagguauuuguugcaaacacagaggcagguuauuaaaggucaggucauuuccaauggggagggagcagggcuggagaggaguuuagcugcucaaacauuaaaaauucacagaggggcuggugagauggcucaguggguaggagcacccgacugcucuuccgaaggucuggaguucaaaucccagcaaccacaugguggcucacagccauccguaacaagaucuggcgcccucuucuggagugucugaagacagcuacaguguacuuagauauaauaaauaaauaaaucuuuaaaaaaaaaaaaaaauucacagaggaccaggcuucuguuauacaacugggcuuuccaccucgguuucacggugugggcuuuuccucaaaugcacaacuucaugccuggugugucucauuagcaccuuaaauuuucauccagaaauguggacuuuagcguugugaugagccauugguuccuuucaaacacugcaacaggaggaccaagaagggcuacacagagccgguaauauuugauagagacccaaaagaggugaaagagcaggccggaauugaaggggacaugauggguggauuuuguaccccacaaccuaugcuuuuggaggccucuggguaacccuguucacucccaccugcucagcuugcuuuuuuuuuuuuuuuuccuaucugcuccaagguccucaggaugcugacugcccgacucuugcugccccggcuccucugccuccagggcaggacuaccucuuacucuacagcagcugcucucccgaacccaaucccaaacccagagauuugcuacaacaagcuguucaucaacaacgaguggcaugaugcggucagcaaaaagaccuuccccacagugaaccccacuacaggugaggucauugggcauguggccgaaggugaccgggcagauguggaucuggcuguaaaagcagcccgagaagccuuccgccugggguccccauggcgcaggauggaugccucagagcggggccggcugcugaaccgccuagcugaucuuguggaacgagaucgaguguacuuggccucacuggagacgcuagauaacgggaaaccuuuccaggagucuuaugucuuggaucuggaugaagucaucaagguguaccguuacuucgcuggcugggcugacaaguggcaugguaagaccaucccuauggauggugagcauuucugcuucacccgacaugagccagugggugucuguggccagauaaucccuuggaacuucccacuggucaugcagggcuggaagcuggccccggcacucgccacgggcaacacuguggucaugaagguggcagagcagaccccacucucugcucuguacuuggccucccucaucaaagaggcgggguuucccccaggaguggugaacaucaucacuggcuacggccccacggcgggagcugccaucgcucagcacauggauguggauaaagucgccuucacgggcuccacugagguaggccaccugauucagaaggcagcuggcgagucuaaccucaagagagucacccuggagcugggugggaagagccccagcauugugcuggcagacgcugacauggagcaugccguagaucagugucacgaagcccuuuucuucaacaugggccagugcugcugugcaggcucccggacauucguggaagaguccaucuaccgugaguuucucgagagaacuguggagaaggccaagcagaggaaaguggggaaccccuuugaguuggacacccagcagggaccucagguggacaaggagcaguuugaacgaauccugggcuacauccggcugggacagaaggaaggggcaaagcuucucuguggcggggagcguuugggggagcgcggcuucuucaucaaacccacagucuucggggacguucaggauggcaugaggaucgccaaggaggagaucuuugggcccgugcagccucuguucaaguucaagaagaucgaggaaguaauccagagagccaacaacaccagguauggccuggcugcggcuguguucacccgagaccuggacaaggccaucuacuucacgcaggcccugcaagcugggacggugugggugaacaccuauaacauugucaccugccacacgccauucggaggcuuuaaggaaucuggcaauggcagggagcugggggaggacgggcucagagccuacacggaggugaagacugucaccaucaagguucccgagaagaauuccugagauuggccaucuuggaggcccagcccuguccugcagcuccgugacaucuagccaguggagggcaaaaucugauuucagccugaguucccagugaaguguuacaagaagugucaaccaauaaaguaguccagccagagcuuuucuacuuaaagcagagacgguggcugggcccagagugcagcccauuucaucccucggucccaccucucugaugaguuauagccaagaagccuuaggagucuccauaaggcauauucaaaaccacugacuggccauaaaaaggagugaugggcugaucccggggccacagggauccucaaaaacagaacgaucagugaaggacgccggccccacaucgaucaguguuuggcugggacccgggggaggggaauggggaaggaccacucguggauguggggcuccucuugggggagguuuugaaaauguuguggaauugggcaauggacacaguuggacaacuuugcagucauacugauuuacuaucaaauuaugcacuuaauuaagguaugggaauuaauuucacuugaaaauuaaaauaagcucaguguccuauuugcaaaucuguaucacuguuuuccuuuacgcugaacacuuuacugucucuggcccagacaggacccaucgaguaauugcuaccuccuccccacccccgcccccaacucccucccauguuuccagguuucuuuuugauuucucuuggcugaugacuaaguacaaagacucaugggaaaugcuauacuuccugcc

SEQ ID NO: 1883 - RNA, 34445 nt, Mus musculus
uaagucgucggcgcaggggccgccgggaaaaucccgccgggccuguauaaagccgaggcgggaucgcugcggcccggauaauuuagcucgcuguccagaagggcccgggguggaaagccggaggaggcggccgcaauuggacuugcagacgccggccuuccacugcggagcccauccggugccccucugcacgcgcuuccggcaggcgucguaagcgagugcgccugcgcgccgcucaguccgcgcgccucgccgcugaccgcgcaccggccggccggcagcccgacgguucugggguugcaggcggcuagcaacucagaucggcugcgcaccagcaagcagcaugucgcggaggcggcacagcuacgagaacgaugguaagugcucucggccuggccacugcguccgggugagaaccgaggccgggcucgccuucagucucccgggaacggauaggaauccuuucuccccgggagggcucggggagccccaaagggaggcugcuggcucgguuguggauaguggcuucgggaaagcgacggccucccugcuaccccaucuccuucagucaugggaaaggaaggccuggugaaucccgugagcaaauccgaccuggggucccgcgacacugaggacuuaaucccucacuacugaucauggaaaccgcacgugugucugucugcugcugccucuuaggaucacuuaguggaggagauauaucuaguggaccaguguuuuccuuuuagcccuccaggguguacuuggaaaggacccugggaagacaggaaaagaacaaagcuaugacagaggucggauguauugcaaucugagcccuucuccuccaccugccacccgcugauuccccucuuuuaggcuucaaaaaaagaauaccaacaccccagaggucacuaauaaacaggcacgggguguuuuguuggauuggcuuuaagcauauuucccuuauaagaaagugcaggaaaacccgagcagauuauuaauucucaugucaguuuugauggucgccggcaaggacgucguuguguugccauaaauuuuguuuuguugcaccauuauugccuuucaagaacacacuuggagcuguuaguguuagguccaaaggguuaaggcaagaaaaaacuuuagaaccgaaggguuuagguucgaagcucgacaucucgauuauuuacuaugugaucuugucagggucauaugacuucuuaaaccuaagcguggacuguggauaauacuaagccauuugguuucuacggggggcuaaaugagauauugugcucaccaguaguucaugaugauguuuauuuugucaacugcuaaugucucagaggugauacacacagauaaaugcugacaucguugagaaaaaaagcccucccucccccaaguuuaauuggguuagcuuccucccuuggaauguuaagacaaccaagcgaaucccauauaguggagccccagguuucugccaguaguaccugagagaauguccuaauacaucaggagugccgacuugcuaaacaguuuccuagcuucugugcuugcaguggaguaggaggcaguagaacaguggaggcucccuccccuggguuaagacaaaccccacagcgguauagugcaauucguuauaaggucacgggguuguggagaauaaugugagguaaaggguguagagaccaaagugagagagaagcugguuagguaaggccuccuugcagauggccuauggcuucagugaugugaggaugagccguguggaugcuuggaggaagcagagguccaaaggaaaccgugaguuaagguuagaacauuucugucguguuagagaacagacagcaaggaggucauuguugguagaagagagaaagugaggguagaaguugugagaccggggaguuuagaugagccucuuaccucacugggccacuugaacauuucuguuaggacuauaugauuggggauucacagagauacuacaagguugcuaaucaauaaaguucccguaguuuauuuagagucacagaaagggcuaugguaaauggaaaguaucaaaucuaacucagucuuagacucuuuuguuuguuuguuuuugagacagggucuuuauguggcugucuauguauguaguccuggcugucuagaacuaugcaauucaggcuggaacgccuguuccuauguccuggcuagauagaucccacugacugcccugccuuaccccaaggggaauaccauacuuggcaggcuuagauuccuuaacaguaucucugaacuucuucaguaauguuggauauacauuuuaucagugugaaguauauugucuuauuguuaagaaggaauuuaggcccggcgugguggcgcacgccuuuaaucccagcacuugggaggcagaggcaggcggauuucugaauuugaggccagccuggucuacaaaaugaguuccaggacagccaggacuacacagagaagcccugucucgaaaacccaaaaaaaaaaaaaaaaaaaagaaggaauuuagauugaaucuuagucaaaaguccagauagccuauucuacuuccacuuaggucuuuauauuuuauuguggcugauguuuuuacacuuaacuguaugaaaaguuuguuauacauagggacaauauacuuuguuucagaagugauauucuucuaccauuuuaaauucuaguuuuaaguuuguagagucaaaguuacuuuuuucuuuuauggugguguuuuuugucuacuuuguugaucugaauuacagucugauucuaacaagggcauaggaaacaguacaauguaucuuuguaacauucgguuccuauugcagggagaaaagaucuggugucuuguuuguuuguuuguucuguucuguucuguucuguucuauugucuguuuuccacccacccaccaccucugguuucucuguguagcccuggcuguguagaccaggcuggcuucaaacucaaaagauuugccugccucugcuggcauuaaaggccugcaccaccaugccuggugucuuaagagccuuuagagugguuauuaacauaaaggccacuuacucugcacuaccaguguuuguagcaauauguaacuuuuacauauauuauaaaacuuacauagcaaguaagccuuuucuggauuauggugucaacauaaaccugucucucuuuuauuguucaggguaugaaaacauacagcuaguucuccaagaggugucuaaaauauccaacaaagugcuuuucagccuuccuggugcugugacccuuuaauaacucaugguguggugacccuaaucauaaaauuaucucauugccacuucauaacuguaaucuugcuguuguugugaaucauaauguaaauaucugauaugcaggccaucugggggucauuugacucccaaagggguugcaacccauagguugaggacuccaucuauaaagauaucuuuuucuuacuccagcugauuuuuuuuuuuuuuuuuuuggaaaaaggucuaaaaaacaaacaacaauaaaaacccccuauacgugaugaauuuaggccaguugaccaaggagcuccagggaucugccuguuuccauguucucuagguuacaggcagguguuacuaaggcagauucucaugguuguucaggaaggacuuuagugagccacccccacucccuaaaguguauggauuuugucugugucuaugcacauggugugugugggccaggcagaggcauugggugucuuucugucacucucugccauauuagacugaacauauuaaccagcaagccccaacaguccucaugucuuaccucccauaguaaugggguuggggguaccuuguaugguuguccuggcuuucuuuuuuuuuaagacaggguguccuaguuaagguuauuauugcugugauaaaaugccaugaccaaagcaacuuggggagaaaagaguuuauuucagcuucaacuucuagguccgucauugagggaaguuagggcaggagccuggaggcaggaacugaugcagaggccauggaagaguacugcuuacuggcuugcucccugaguugcccaacuugcuuucuuucuagaacccaggagcgcucacccaaggauggcaccacccacaaugggcugggcccucucccaucaaucaugaauuuacaggcuugccuacauacagcccuaucuuacuuaggcucaaucgguguucccuucuuucaaaugacuaacaugucaaguugacauaagauuagccaguccagcgucuuauuauuuugcccuggcuguccuggaacucuauaugugaucuaacucacagugacucaucuuccugugugucccugguaccaagcaguguuagcuuuuuggugugggugcuagggauugaaccuaggucuucaugcuugggcagcaaguauucuuaaugaagaugcuguagucugccucugcccucacccaggcucugcucaguucagggucugggacuguccggguguuccgauuguaaucgguagcacugauauguauacuucaucuucucucaaguaccaaguacuuucugcaacuauauuucucuaaguaaaccuuugcuggauggccacagugacacggagguuuacaguucagagaugugacugugugucugcauuuugucauguucuuuagacagccugcuugucucccugaaacaguguuuuccaugugucaggcuuacaagagaaccuggagggauugaucguuuugaagacagggacgguuguaaacugggacagguuaaccauauaauuuggagaugggaugaaggguuaguauaguagaugaaccagaaggaagggaagaauuugguaaaauuuggaaaaacuacugcucucauugccaaaugaggauuuucacuccgucgucucugaccuucaccuaaaucugguucugaauaauaauaaugaacaugguugaugcauuaugcauucuggagcaguuucucagcaucaguacuguugauguuuagggucauauuuuaaauaaagaguuuccgaaggguucaacuuguuuuugcaucccuauuucaccgguuuacaugggaguucaguuacaucaucagauuagcaagugccuuugauacccucagguuuaggaagcagcaacugaggcucagugacaggcugcaggugcaguaguggcagcauucagaucacggccguuucguauguuggugccauugcaguguguucacagaaauggucauagcucccuggacacuguuuaaacaaaauuuaacugagaucuuuuucccagcauuguuguuuauagugaucuuaaugauagagacaggggugaggaguugggaagguggcuuagcaguuaagagcacuggcugggggcugguaagauggcuguucuuccgaaggucgugaguucaaaucccagcaaccacaugguggcucacaaccauccauagugagaucugacuccuucuucuggagugucugaagacaacuacaguguacuuacauauaauaaauaaauaaaucuuaaaaauaaaauaaaaaaaaaagcacuagcuguucucuagaacccagguuuaauucccagcucucagacugugucucacagauguccauaacuuuaguuacagggcaucugguguccucuucuggccuccaugugcuccaggcauacaagugguaaacagucauacauguagacaaaacauccauacacauaaauaaaaaauuguauauauguuuguguuuuuacauauauagaggcagggagagagacugggucuggagagauggcucaacaguuaaaagcauuugaaaacuggaauugggccucagcauguucagaagcuggguaugcaguacaugccuguaaccccagcuacaaggcaggguggagacaggaauuaucacuaggacuugguggcuuccaaccuagcuaagaagaguuaagccccagguucagggagagaccuugccuugaaggaauagugugguggaagaggauacucagcgcccccugcuggcuuuagugugagugaacaggcacagggacccgcacacacgugugcauucacucacaugugcacaaacagaucuuuaaaggaugugagauagaaguucuccagguaccuagcuuaguuaaaacaggauugguuaagaacuacucuaaaaaauacaaccuaauaaaaaagauuaaaggcuaaaaaggugacaaaaauguagauaguagauucaucauauaauguugcuuuuuuuuuaauguuguaaaauagguggacaaccucacaaaaggaggaagacgucugaugcaaaugaaacugaagaucauuuggaaucuuuaauaugcaaaguaggggaaaagguacgcaccaagcccagggguuaggguuguaauugucacuuugauuaauuucugaaguuguccuggguaauguagguuuuagacaaagcuuguuauuacuguacaucuguaucuuaaagugaaaguguuuuggaacuccugggauuccuuccaaucauuaaguuuuuucaguaaguaauuuucauuagcuaagucuuaaacagaccuggggaauagucuuuccuccagcugaccugaagcagacugacaccuuuagugagagacagagugcagcccacgcugucuuccagcuuggaagauuucguugacuuuuuguagaacaguaacuaaugggauugauugaugcagagggaauuguccacgaaauugucaucgguucuuguuucuucccugaggaauuacagugccuuaugggagaccuuacugucuuuauggucacccaagaguuuuaauucacugauugcuugagcgcuaaccgaugaugaugaugucuucugcagagugccuguucuuuagagagcaaucucgaaggccuggcugguguuuuagaagcugaucuuccuaacuacaagagcaagaucuuaaggcuccuuuguacaguguauguauguaaacgauuuguggauccaggugaugauguauuaucuacucuugugugcuuggggaauguucgguggacuuccucauguuaauuaguccugaaacucgugcucaggaauguucaucuuugcccuuuguugaacuuaguuuuuaaagggauaaauaggacuaaaaugaaguguuuuccuuauguuuuguuucuuagaauuuuaaaauaauugaaguuaauuuuuuaacucagaaaauagaugagaaaguggauaucuuauuuagagauccuuuuucccccaccaaggagugcaucacauuuagauguuuaaaguagaguuuagcucguguguguguguggguguggguguggguguggguguguauggauguggguggguggguguguauggauguguguguguggggguguguauggauguguguguguggggguguguauggauguguguguguggguguguggguguggguguguauggauguguguguguguguguguguguguguguguguggguggccucucuugagggcugacgaugcucuagaagcuuuuaaugacauaauuguccuugaugcuguaguuaccauuucaggaauuuuaaaauaauggcuaauuuuaaagcuuuauuuuuuguauaugggcauuuuacuccucugccuguagaagucagaagagggcauuggaugcccugaaacuggaguuaugggcaguuaugagccaccaugugggugaugggaacccaacuugaguccucagcaagaacaggugcucuuaacagucgggcucucuagacccauagauaaauucugucugcauagaauccagucaguucagagaaauguauaucuagacuaagaaacugugaaaacagucauuuauacuuauccauacgauacccucuguuuugauaguauuacagaauuguuacgcugggugaaguuguuagaagccaugcuuacuuguguacggcugagcuugguauugauuggcagugcccuuuaaaaucuuuguacuuggagaaagcuuuagggaccaugguguacuuucaguacaagcaguuuuugagcuccugcauccuucccugugcccagcaagauaccuuagaaaacaaugugagaggauucuccgcagauuuaucauuaggacugacuugcuuucccuuugugcugugacucaaggcuucauuuaguguguguguacacgcgcgugugcgugcgugugugugugugugcgugugugugugugugcauguguggguacacugugcugcagcauguguggaggucagagaaagacuuggaagaauccguucucucaaacucagguuggccaggaagaguuguaacccucucagccaucagccaucuacccguccuccgcauguucucaacuugauuagcaggcccugcuuuaagcauuucuuauacgaacuuaauuuaaacucauuuuaguucuuuauuuuguauaagcaauccaauaauguuucuccaagaggaagucuagucccaugguguuuggccagcuaaguguagaagcucugaaugcucuguucccuacugauucugcauuaaagaaucucaucucauggaacacuucagagauuaccauagaaaccaucugcugugggguuguuacucacuuccacuccacacacuugaaggaaaacugcucuagcaugaauugcaguaauuuuggugugauaacuucacaaguaacuguguguuaacucuugcauuaacuauaaugaaaaacaguggcaucuguaucugcacacugcccagugaugcugugucuuuucagaagucauuuucaaagcauaguuuaaaaaauuuuguuccagaguuauuuaaccuuuguuuugggguuguuuuguacggguucucaaaucagugcacgucuguuaccugagaagcuaacaauuuacacaacauuaguuggacugcugaaugccaggaauuacaacuuuggaggagaauuuguagaagcuaugauucgucaacuuaaagaaucacuaaaagcaaauaacuauaaugaagcuguauauuugguaaguuuaauauguauguaugaauguguguauaauauauauaaauuauauguguauaauuuauaauauauuauaaauuaguauugaaaugaaggaaaaaacuacugcaaguccugaaauuccugcuauuuacaccccucuccuguaagcucauuccgggcuacugucuacuggguaagccauccagagaucugaaauuaauuuucagcuuuucuuugcuuccuuuuuucugucucuauuuucucuaaauccuaucuccuaaauccucuuuguucccauggcuucuagcacaguuuguaacucuuuuuguguucuuagcugccucuguacuugccgguuugcaucuacucugccuuugagucugucuucaauaauagcagcaguauagccuuuguaugacuaggcucagcucauguuggcuacugguuaaaagcuucauuuccuucccguguuuuauagugcgugguuuuaaaauucugauacacgaaaugauucauugggccacacagaguaaauauuagaacauuuagaacguuuuuuaaaacaguuucauguuuguauauaagauauucuggucacauuguccccguuaucucuuccccacuccucuugcugugcccauucuagccgcucugauguccuuuuugcacaugggugacuuacugaguuuaauuaggguugcuugcauacaguugugggaagucauuuacuggaacaugggcaccuuaguagugacuacacaacugaaggagaucccuucuuccccagaaacuguuaacuguugugguaaauauuuaauauuaaucggggguuucuacgcugccuuaagucauucaguuccagauaaaagacacauuuguaauaagccuuaacagcacuagagcugggcagauaccaauccuguauaacuauuuugucuacuucccugucaguaaccaugaguuauaauuugcccuguucugccugggccauucuuauucuaauuggccagcucuguggcccccugacaccuucucccuucucuucaccccucucucucccuguggucucugccuccaaccccgagccccaccuacuucucuucugcccagcuauaggcaucuuuauugagcgaccagucagggauaacuuguggggcaagguuacauagcaucacuugguuaagugaagaucuccuuguuccugaggcaaccaggccugguauguagcauuacaguauguaacuacagaccaaaccucacugguuaacugccaguagcuccucaagaaagggugaggccuagugagcuccauccuuaucugugaaggaaaggugaccugcccagucuuguguagguuuuguguaacuacuguaagguuauaaguguuguggccauguccugucuagaagacagcaugucacagccuccucccaaccucuggcucuuagauuauucuugcacuauagaacuuuuaugugucuuuuauggaaggaaguggaauuaagccuuacuaaaaccuaauacauagaguguuaagaauccaguguuuaccauuguaaauacauaccagcuggagaucaugugaucaaguuaggacccauauuaggauauaggauuaaagccuuggucuuuugugauugccacaguaggcuugcauucucuuguccccugcaacccuguagcuauauaaauuuauuugcacagccaucugccaagauugccuuuccugucccuccugagagcuuuccucacccuuuauaucuuugcccuuuuuuuccuuauuguucuuuuuuauugucccuggugucccccaagggcacuuuguaauuuaccuuuuagugcaggaguuaguugucccuuucuguuuagaguauguuugucccaaguaggcugaguucccuaaaacaguaccugaauacuguuuacuuagccuagcacacacuggacacccaacaaaucuuuuacuuaaagcuugcauuucuacauuucagcaaaaauuauucuagccaaauagaaagaccaaucuacuugaguagcauggaguuacuagaguauuuggaugucugggugcuuacuguagcguggccagguauacuaaugggcaugagcuguccuccacugcaagugugauuaugggcacugaaaucugaauucaugccauuuuguguaacuauugucuuaagccuuaaauuuaaagacuccuuagcugacagguuacacaaacaacaagauaguaagcuaaauaccugucuggguuguaguuuuguaggcugauaaaggcuguuuauuuucuaacuguuauuaaagacucuuggguguaaugcaaauauccuuuacccucacagguccguuuucugucugaucuugugaauugucaugugaucgcugccccgucuaugguugcuauguuugagaauuuuguaaguguaacucaggaagaagaugugccucaaguaagcaccuuuguauugacucuuuucucugcagcgcugcugcuagccuuuuuguuuuuguuuuccccacugauaacagcaguaaaugaaaugcaauaacaucaucacacuguaaugcuuaauaucuuaagggcaaggcagcuggcuuaguugauaucuuuguguuaauucaaaugauuuuaauaagauuagaaauauauauuuggccaaccaaagaauacacguggagggacccauggcuccagccguauauguggcagaggauggccuuguuggacaucagugggaggagaggcccuugggccugaggguguucgaugccccaguguaggggaaugccagggagggaagggugggugaguggggaacacccucauagaggcaggggagaggaugggacggggguuccgaaggggagaccuggaaagaggaaaacauuugaaauauaaagaaaaucauauauauauauaauucuuguuagccagauauuuuauuuaagcccuauuaaaaagucuccccaguauugcauuuaugaauaaaaaagauggggggagcuguguggcucaguuauagaaugcuugccuaccaucuaaccauggaaagaauaguuaauaaauaaaauugacuagcauguauuuuuuuuuuaauugcccuuuuaaacuuguucaggugcgacgggauugguauguguaugcguuucugucauccuugcccuggguuggaaaggaguuguaugaaaaaaaagaugcagaaauggaccgaaucuucuccaccacugaaagcuaucucaaguaaggccucgcucgcccgugcuuccuuguuugcaugaagauguccuguugaugcaauaaaugccuuaaguucucuguuggcaauaacaccacuucauuuccacuuuuaaaaaacaaaacagaaccaucagguuauagaaaauguucauuuaauuucauucuccugcugccauaacucacuaagaccucaguacuuuguuagagcgacaaguugguaacgagucuuuuaagcuguuuucauauggucaugauagaacacugcaguauaacagcuccucuagcuagaguucuaguguucguaagcucagagucaccuguggcucaaaguuaccccucugcuaggcuacugaguugacuggcagaaguucagacauguuacugauguguucugaauaggagcacugcccuggcacaguuuuauuucauacauguuaauucuaagccaagcccuuccccaggccagugugaaaaacaagcuuuauuuuauuagguccaaucaaacaaugggccuuauuagugagcgucccuaguuaguucacaccaauuaugucauuagacagugaauggcccugagcuccuucggcuuccauagaccgacuucugucauacuucuuugaauaccguuaacauugcuuuguuuggugcaaaugaacaugacaucuaaagacuuuuuuuacauaucugugugcauguaaaugugacuguggagacacaugcugaucuuacacagaugucaguaacacagugugugaacacuuacuugcaugcauaugcacuuauuuccaugcuuuuuucuuugcaguuauauaaaagcacaugguuccaucugauuggguuuauuaacaguauuauuauuauuuuuuugaaauaggacauaauuucucuuuauuaguccacacuauguggauauuuauucugugcagguuccugguacgauaaacaagaugggaauauucuuguguauaugugugcacauauauuugcagcuguauuuauggggauaugaauucauggaaaugacauuguuggguaaacauucagaacaguugagauuuugacagacaucgucagauuugccaucaguguuugagauacagaaauaccuauauccugaugaucuguaagccauuaucaaaaauguuaaucugcugaucugauggacagaaauguuuuucauuguuuuagucaaucacgagaaccauugaauggcuuuuacguuuuaaauccuaaguguagacuuuccuuuuaucuuuagaagacgccagaagacucacgugcccauguuacaagucuggacugccgacaaaccacauccacaggaagaggugaacugauuuccaucuuguaauguaaaccuaguucuugaguagauucuuaccucuguaacgugcuuaaacugagucagugacauggcucggugggucaaggugcugccgccaaccuggcccggcacuggguucccaggacccacacuguggaagaaggaaccugauuccuaaagguuuuccucugagcucguaugugcucuguggauugugugcugcacaaaugaguaaaacuacaaccucagacaauguucagccuguuguacuuguacgucuuagcuggguuucuaaauacuugagcaaggaguucauuuccucagagucugaagcauagaggggcuaguuaguagauguuagaauguaauugaaacagccccuugcuuuuuagaauaccaauuuccaaagacuugacaaguuuuauaucgaaauacucaaguaacaacuccaggugugcuucugaaaacaaacugcuucaguagaaaggacagugggccugcucaguaguugaggacggcccgagagagagcugggggcuacaggagagugagucugcucaguagguugaggguggccugagauagagcuggggacuacaaagggagagcaacaccugacaggagcuguccucugaccuacaugugacucuguagcaagugugugcacauuaauguaauuuaagauuuuaaauaaaaacagaaacuuaauaccauuccuuacuacuguaugaaauacuaaacuaguucacuuugcugugcauuagaugguaggcuuuucuguauuguuuagccaaaauguaucuauuaaacauuaaaaucucuuuuuaguauuuagauugccugugggcccagauucagaaauugaaaaaagaccgguggcaggagaggcacauccuaagacccuaccuugccuuugacagcauccucugugaagcucugcagcacaaccugccuccuuucacaccgccgccccacacagaggacuccguguacccgaugcccagggucaucuucaggauguuugacuacacagacgacccagaaguacgugagugccggacaccuccagggaaagccuggccugaagcugcacuugugacuucguuuccuuugacuaauauuuugagacaggguucuuucucuggaauccagauuggcuuugaguuuacaaauucucggaucucagccuuucaggagcugggauuacagacuuguaccacuuugcccagcucugaaauuaccuuugaaacuucagguuuuuguuuuuguuuuuguaacauaagaagauuggaaaucaauuuaguguuuuaauucagcaaacuuauaucucauuguuuuaacagucuagaggguuaaguugagagucaaguuagcuagcauuuucaugcaaauacuaccugggcccacaugggaguaauuuccuucuuuugccuuguccuuguaucucuaggcagguuaaauuauuaucacauguaagauaccuugaacaaugacucuucuagugagggcucaguuuuagcuguaggguagggguguguugugugcuugggguagccagagguuggcuccagcugccagucauugcucuucgccuuugcgggauggguuggcaaggucuuucaaagaaccuggagcccaccauuguagcuacacugaauggcuccuaagcccuacaaaucucccuaucuugagguucccacaaugcuggggauagagguacaugccaccuggucugggggugcuuccacugagccaucucccgggcaccauguuuagucaacguuuaguguaugucucucugcagcccaguccgucuucauugugacuauccuccugccuuggccucuugaauucugagacaguacucgugaaccauugugcugccuguuucagcuuuuccccugagaaagggucccucauagcauuguguuugcuauugcacuugaggauggucuuuaacuugugaccuugccucugccucugccucucugccucugccucugccgauuacaaacauuccccaccacacccagucuuacuuguugcuaagaauugaacccagggcuucgugcaugcuaagcaagcuacugaccaagcuacaucucaguccuauuuagcuauuguuaauauuaaaaaaagaaaaaagcuuccuuuucuaaauugucaauauuuuuaaacaacucaguuuacacuauucguauuguacaauuuuuaaaaguauuuucaucagccuccaaguuaacauucuaguuuuacaauacuuuuuauguuuuuuauuaugacgcuaaauuguuggcaacucuuuaauagaaaaacaagauuuuuugugauauuugauuuaaaaauuaauauuuacgcacauacucauuauuuguaucucaguguguaugucugccuugggagcaggcagcaagcaggugacuacuagauuguuucuggagagaagcuuaagguagcagaccugcugcgugcuccgcccugcucgcauguggcagaucagccucagccccagcccaguaggcuugucagggugcggguuugugaacgagcagccuguguaccauaaggugcugggccuggcucugcuucucuggugaccugugucacaugaguuucaugcaccaaauucuuggagaacaaagguauuccaagaggggcacuuucaagucuguguuguuggcacaagugaaauaucaaguauauguaaucaaaaccagcugucuuuguaagacgugccacuacacaggaccuuugguuugguuugguuuugauuuuguuguuguuuauuuuucuuaauuuuuuuuuaaagaaaagaauacaaacaaauauagagccgagauuccaaaugccuccuuccgaagcucacagccaacuucucccuggaucagccugaagcaguagcgggaagggcugggucaggaucauuuaaccucacacagaucaguuuaaugccuccccugaaugcugggggacuugauugccaagucugcuauauuaaauaauaagaaagcacuuugauucaaaauuauaugaugaccuaauuagguuuaucaacugaaaaaucuaguuuauauucaugccauuuagucuuugugaucaguuaauuacuaguugaggugaaggaaacaagaauuugaccucaguauguauuucuccugugcuaauuacauuuccuucuguugcuguacacugccuguccuuccucugucacaguauaaauacuccaaaacaguuaccucaaaauaacauacucuuguuacuuugauagugucuuuuacaaguguuuauuaaauuuagagagugggugaugcuuccguggauaaaagcaugggccaugaaaccugaccccagagcuccaucauuguugccagacccccauaggaaagagagccaguuacccacaaguguucucugcucuccaccagagcaccauggcacacacccauacacaaugcauggauagaugauagauggacgacauacagacagugauggagcuuuuuaaauaaaauuguaaaaugguucuggugucauuacagauaucucaggagcacuauacacucgaucugugguaguuauuuagcacaacagucgcaaguguuuauugaauaaaugaaagaaaucuguuuugugguugugcgugugaguacacuugaucuuuuuuccagggcccuguuaugccagggagccauucgguggagagguuugucaucgaggagaaucuucacugcaucaucaaguccuacuggaaggaaaggaagacuugguaaggucccucugcaguacucuaaaggggguaggaaggcaccgugguucuuucauaagaauagacuauguguugagauagccuagcaagcaugaggcccagcguugagguacccacguaacagucaggugugggcacucagcguuagcucaguucuggaaacacugaugcaggaguguccccagaggcugcugucccaccagucaggccagccugcgcaccccagguauuuuguuugaaauauuuuucuauguguauggguauuuuccaugcauguauagcuguauaccagaugugcauccggugcucucaaaggccauaagagagcuuugaaucaucuggaaaugggguuacagaccguugugagcugccaagugggugcuggaguggagccuggguccucuggaagagcagccaguccucuuaacugcugagccaucucuccagucccugaagcccagauguagugagaagcacuugcagaagacaggacucuugaccucugaacaguccuacacacacacccacacacaccaaauaagcuacaauugaagaguaggcugguuuuauuuggauguguggaaauuaaagcauacuauaucuguuuuuguuuuuguuuuucuguuuucuagcauuuagaaaccuaaguguuaauaaauuuucauagggcuggaaaguuuuggcuuagacuuugaggagaaauguauuuaggaguggagcaccuaggucaguagauuggaaggugcugguauuauuacuuuguuuccauuuuguguguaagacaauucacgccauguuaauaaauaacuagaacauuacagcggagaauuuuuucaucucaguucacuauauuuaggccuguuggguuucauguaccuuuguagacuuacuaacuuacaucacuuuuuacagcgcugcccagcuggugagcuauccagggaagaacaagauccccuugaacuaccacauaguggagguacgcaugccauggggugcugagccucacuuucccgguauucaucgggcucugagaaugaacagaggggguaaggaaguggccagcagcuuugguucucagucagccuugcuaggaaaggaagaaagaaaggagagugggacucagagccauuaccuguugggucaucuugcuagccucagcugccucuuuaucuuucucucucucucucucucucucucucucucucucucucucucucucucucucucucucucuuugaagugccacacgccuuuacuccaagcacuugggaggcagaggcagggggaucucuugauuuuuuuuuuuuuuuuuuuuuugaccagccuggucuacaaaggaaguacaggacagcaaggguacacagaaaaaacccugucucaaaauacaaaagacugggugucaccauaucacccaaccugauccgggacucauggcccuccugccuuauucuccugaguugcugggacucaggcaugugccaccacacuauuuuuaaaucugaaaaugcguagaauucaucauccacuaaguggaaagagugcagacuaggguguuaggaagaagggguaggaaauaaccuccccaaaagaucugaggucuggugugaguagccgcauagacacucagcugucuccaucucugguccaccaagaguuugcauugcccacagguaugcagcuccacugauugagccccucgauguagcgccucccucagucaacucugagacuucaaggauagacucuugugcauuugugucagcacuguaggucacagcagccugccucuagcagacucuugguguagaaagggggauguucauguuauucaguuguaggucucgaauuaaagguaguuccuuuucccuuguaggugacguggaguuugugguuggauuguaauguguaggucuuucuaauguagaaaugcaaagauaacugagguguagguuucugacucuggguuguuucccaggugaucuuugcagagcuguuucagcuuccagcgccuccucacauugacgugauguacacuacacugcuaaucgaacugugcaaacuucagccgggcucgcugccccaagugguauccuuuuaugguuuuaaguguaccugcuuuggcugugcuuuuaaaagauugcaguaggagcuauuuuuuucucaggcucucagguucaccuucauguuccugugcuuuggguuuuagggguaaugguuucauuugcuuuguuuuuaaguaaauaacacguugaacaaaaugaauguuugugacguuaacauacaacaucucucucugcuuaacacagaaugugguguugggacuuaaaagcugcuuucuucuccucaguaggauccuguuacucucacgacacacuaauaaugcugguguuaccuuuugcuugucuucugagacaggcagggccuuacucuagcccaggacggccucagacuccaggcgcugggauuaggguuugaggccauguccagcuauucauuugccuuuuaaaagaauaguuucaugaagagaguguauauucuguacuuucaggaccucgggccuucuauaagcuccuuagauaaguugcaugauuugaauaaguaguuccgugucuguaacagugugugucugugugugugugugucugugugugugugucugugugugugugucugugugugugugugucugugugucccuuacagucuccuccuccgcucccacgugcauccgugaugcuguugaccuucagugguaagcaucaagagcuuccuugugcuuagggucguuuuccuuacagcuuucucgugugccucguaaaccauuguucuuaccuccacucauuucacagcacccuguuggccauaccccuuuuaauuuuuuuuuuuuuuacugucucucuuagguuaugaaaaaguuuuuucacuacauuuuuuuuugucuuauaacuucauucuaccugccucucagucuuaauuucugaccuuccuuucagauaauaaaaagaucagaaaauacuccaauuucaaguuuuuuuuuuuuuaaaucuuuuuggcauuugaaagaaaaauauucuguacaugagaccauuuagaugcauauauaccuaccaccccaggugucuguuucuuuuuguacaucaugaacguccaucuccaguuauuucauguggaauuuuuguuuucagagagaguuugcugcuagugaucacuacagauuuuagaagaauuuuuguuuguuuuuguugugauagugguuuucauucuuaaggaugggaugaauuuuuagagauagaauugggcaugguacuuauagaaauuguauuugugauauuuccaaaucagaaauaacuugaguguccaacaauacaugaauggauaaacaaguuuuguuuccucgcaaugguaauauuccguucagcaacaaaaaagacuuguuuuuaacguagugaacaguguagguuaaaggaaagaacggauuuacagaacaugguacuauuuuuguaaaauuuuggaaaaauauaagauuuguucaugacaaaagauggguguaugcuuggggagggaucucaaauggcugagggaugcauacaaaggaacagucagggguccuguccaucaucaacagcugaagucagggaugcuguccaucaucgacagcugaaaccugaaaacugaaaugaguuauguggaagggugaaagacacuuacuguccuuaggagagacccagaggcuggguuucauuucucaucucucccaucacauuuucuuaaaggagagugggaagucguuuuccuuaccucccuaucacagcuugcgcaggcgacugagaugcuguacaugcgucuggacacgaugaguaccacguguguugacagguauggacggcuauguuagcgccuguaggaaucuucggaagacugccaaggauuuccaaguuguuccuucccugcuuucugagaccccguguguaguagcagcucuuguuagggcaccacagucggcuccgugucaggcugguggcgccaugcuugcuucucuuucauaauugcauuaacuuuuucugcuuaauugcauaugcaaguccuuaagaugagcuuacuuugaaugauaaaucuuacaaugcauuuauuguagauaaacauuuauuuauagauagucuguuuugaaaguacagagaaguaucuucaagccugagacuguaaaaucucauuuuaaauuaaaucaaugaauaaaaccugucuugggauuguuagagcgaggucguuccaugaucauuauuuccuuuuggggaaagucucugugacugccuuuacugguuuuuucuucuguccauuucccaaguccggucagaacaaaaacuaaacauuuaucuaauaucuguaucucuuaucaaauauuuuaucuuaaaaauuaucagugagaaccgucuccauccaugaccuugaaacauuucaaaugacuugagaucagaguuuugagggaagugcuuuaagaaagugucuuccagugucucuacuuugaauaccaauucuguaaauuugaguacuuagauggucuucauagcacuauuuaacacacuaagauguuuccugucuugagagcugaguguauuuuuaagugaggagcuucaggcauauaagcuguugugaaaagguuggagugggcucugagaggcucagcaauuaaggugcuugcugcucuuccagaggaccugaauuugguucccagcacccacaucccaaagcuuuacaaccccuguagaagcuccagaagaucccauacccaucuggccgcuggcacugcaugcacaccauacauacauacauacauacauacauacauacauacaucuguccacacacagacacacacacacacaauguaaacacagaaaugaagaaguaguuauacuucuauaaggucgugguuuaaguaugagagacuaagagcuggugaaacuaagagcucagcgguuaagagcacuggcugcucacccagggacccaggcucaagucccagcaaaacaugagacgcuuacucugauucugccauuuggaaauuauuuguaaacauuuaacuacaauuuauuuuuuuaacuacuuccauuucaucaacaguuacaugggaaacauaauauucuccuucauagcuuugaaaauuauguauuuugcacaaaacaugaccuuaaaucauagcuguucucuaacaagaauaaaagggagccccauugugagagaugagauaucugggacacaggacagggagucagaggcuuugcugagaaaacaguuaaagaagcuauggguaaugggguaugcaccuagacaauugagcuguauaauggauuuuauaaacuauggucuaaauugcacucuucauuuucucuucucccugcuccacuccccauuguagguuuauuaauugguuuucucaucaucuaaguaauuuucaauuccguuggagcugggaagauugguaaguguaauguuuuauccuuccuuauucaaaacaacuggagauugcucagucaguaaagugcuugcuacucaaacauaaagacccaacuuuugaucuccagagcccauguuaaaaaacccugugugguugcacacaccuuuaauuccugcacucaggaagcagaggcacgcccaucucuccaccuccaugaguuggaggcuggccaacuacauaguaaguuccagacuaccagaacuacccagugagacgcggguucuaaucccagauauacugacaggucccugaagcucacuggccagccacccuaaccuaaaggguaaguucugggccuagugggugcccaggggagcagcacccaaggcuguccucugcucucucugccugugcaugucacggucaugugugcagcuuauggaccuuaguauuugaaauucugugagugcucugucugcaugaacaccugcacaccagaagagagcaucagaucccuuuauagauggucauuggccaccauuguggguucugggaauugaacucaggaccucuggaagacauccaguacuaaucacugagccaucucaccagccuguaaaacucacuuuuaaguaaaauagucuguugucucaaguauuuauuucauugauauuuaguuaugauguuuugaugagauaaaagguagaaagacccuaguguaagccaggaaaugaagauaugucuacagaagauuaugcauauuaacuuaauaaauccagauuuccucccuaggucagauugucuuacucaggaucuugaaagucccaaaccaaaguuuguaagggaaguucuagagaagugcaugagguaagcucuuggcgcuuuucuucuugguuuagcucucagccuaauuucucucuccucuguuuugcacuuguuuguggugcauguccacauauuuuuucuuaaguccugguguuuguccaucucccaccucacuuuugaaucaagauuuaggguacaguuagucagcuguaccaucuggauuuuaugugaauuaggccaaugagauucuugucuaugucccccaacauugaugagcauuuuacuuuuuaaacuugaguuuuuaucuaauuuguguuuuccuagccuucuccuaaagccaccuauuuacagagcccuuaguuuguaauuaauagaguguuuuggggaacugugaucuaagcucucaauguguauuuuuuaagggguaguuggguugaggccuuugggaagacacuguguguauacuugugugguauaucccucuuuucacauccaacccaacauaggaaauucuguguaaugcuccgucaggcagggcaaucucccauuuaugcuuugcugugucacauccaaccucccagccaugccaucugaccugcacccaacccgcucucacuucugucucucaccggucccagaacccauacugcagagccagugucugaacaggccugagcucaccuaugcuaacuuacucaaaggcgugaaggacuguucccauuugccucuuaguuguucacugaguuugggaucuuggauucuggcuuucugggcaaguugaguauuaccaaagacugaaacaugagacuuuucugaggcucuuauuuguguuguagguugucuuaccaucaacauauauuagauauuguuccucccaccuucucagcucuguguccugcaaacccaaccugcauuuacaaguauggagaugaaaguagcaguaaguaaugaaucgacaagucucucuccuuaaaaaguacugaccugugcgugcucuggagcuggcuguuuguaggaggagaaacagauuuauuucuguauuugaaaaaaugacccauauuagccacuagauuaaagauuuuguuguuauuguuagcuuuuagguuucuucuauuuuguauuguucacaguguuuuuacaugacauuuuuaauacagcacaaagaguaguaagaggacuucuuuccuggaauguacuaaaacugaaaguguccauuuguuaugauggagacuucuugaacugguucucauucuuguccugguuagcacugauguugcuguguuggagcgccguggccacagcacgcugagggaaggguuuauuugguuuauacuccauguguucaucaccaaaggaaaugagaacucaggcaggccagaggccauggagggccgcugcuuacuggcuuccuccccuggcuugcugacccuguuuccauguagaauucaggaccaccaucccagggguggggccacccacagugggcugggcucucccacaucaaucacuaauuuaaaaaauccccuacggccgagucuuuuuuuauuuuuuuuaguagagaauagaguuuauuuagggcauggggaggggaguuaagagaguagcagaggcagagaaaggcagagagaaagagagagaguagauaagugaggucggccauggccauguggagggguggguggggagagagggggagcaaggggacaagagggaagagagauggaagagagcaagagcuacaguugagccuuaaggaaccuguucucaauggguguucccuccuuucagauaaguagcuugugucaaguugacacgagacccccuccagcacaccuuaugcugggaccccugggcacuuggcagucugcuucuagaaguaaauuugucaucauggcuuucagcguuuagccccauggguugagggauugcaccaugaaucaggcgugcuggaauugcuguggucuuuuuguguugggccauuuaagcuuccugguggcaggugugcaguggugacggguacagagguagagggcagguuuccacccugcucuugugguugcacugaauguugucaccauucaugagccucacauucugugcugcaaggaaggucugugucugagaaguguucuuccuuccacacuacagaaagcucuuuuuaucucuaguuccucuuuuccuccuuggucuggcccaaguuaguuauuuguuaaccuuuaacaaaccauaaaaaugcuuucugucuacuucugaaguaaauuuccugguucuuagcuaguguguaaauuccuugacaguggguucuuauuuucuuaugcgcaugcgcaugcguguguguguguauguauguauguaugugugcgugcgugugugcgugugugugugugugugugugagugagagagagagagauuuuuaaaaauuuuuguuugguuuucauagaauuuccuucuacuuuaagagacaggcucacaguauuagcuauaugauuauccuuguguggccuauugugacagacguuaguuaugacaggucuuaugaucuuaugucaaaauugcccuucuuguuaccauugucugaauuucauugaaaguacauuucuuuucccuuugauaccuuuauauuaauuuaacauaaauucuauaccauaagcacuuacucacaaaguccuaaccagcaguaagcaugcaggguuuaaacacagagcccucaucuuggcgauguucaccuuguuugaacucauuugcccuaaaagaaaguguuguuggcaaaagugagcaagacgcuuuuggauuuaaaaugucugggagaccugaggacuggugcgcucaugaguacugacacugaguguaacuaaccucucucagucuagaugaaaaagcauuaaaguaggugaagcuuuugucugucuuaacauacgugguuuaaauacugaucuugggcugaaguaugcuguuuuaaaaggaaauaacaaacuugguuuagcugcuccuagaagagucucugagcuuacucugccuucccuucuguucugugcuuagauucucuuccuggacauuccguggcacucuguuuaucuguugcuuuuaaaaguaaggcaaccaacgaugagaucuucagcauucugaaggacguaccaaacccuaaccagguugaugaugauggugagagaaugacuucuucagcugagccucaggccaaguuaaagcauagacacagcucuggugacacgagcucuguggugaccuauugguggucacacagucugccagcuauucugagcaccugcauauuucaccccucaccuaagaggcccuaaaauuccuggggagagcuuauauuaauaaaacccaugcugaguaugauaugcacuccuuuaauuuagacuuggaaggcagagguaggugggucucugaguuagaagccagcuuagauuacauaauagauuucaggucaggcagaacuacacagugagaccuugucucaaaagcaacacaguuaccaaaaaaaggacauaaacccuacaaauaaauucacacauucuucauucagggguuccagauauuucucccuuauaccugucuauauuaagagggcuuccugaaugggggggcuuaguggguuggauauuugggguauggcugacauuuucuccaaguccguaagcuauuaugauaccacugccuagucuuuacuuaguauguauuguguaauuucagccaacaucuuagcuuuguuuuauuuuccugguaugaauaggaaaauugacagaaugaaauaaaggcuuaccggaaucgugauuggauagagaaguacugagagaguugcaucaguacuugagaaggcauacugugaaauauuaguugaguaaaucuguguugcacaaaaagagcagaugacuggucugcagagacagcccuuugcuugggagugcacugaagacguguuagucagcugugguaacaggagguuuagacuuggcagaaguuguaagcuguagguuuaaagguuuugcugguuuugcuuuaacauuuugacaucucguaaucagaauauggaagagggaugugugaugguuuuaagcaaacgggucauaagccaggagugguagugcaagccuguuaauccaaccaaguuugagguuccuggccaacaacagugcauagugagagccugccauaaaaacaacccugagcuauauagaagaacucucccaugagagagaguuaagggucugcuuuuucacgagggauugacaugaggucuugcuauguagccuuggcuggcccaacuuaguuuuauguugucaaugugugaaaucaggagugugguguugcuuuuacuagaacauuauuauauguucauauguuauuagcaguacaagguguagcaccaaagaauuacuauaguuaacuugggagggggggggcguuuuuucgagacaggguuucucuguguagcccuggcuguccuggaacucacucuguagaccaggcuggccucgaacucagaaaucugcuugucucugccucccaagugcugggauuauagacaugcaccaccacugcccgacaguuaacuuuuuuuaaaucuuacuauaaaauauuuuucagaugaaggguucagauuuaacccuuugaaaauagaggucuuuguccagacucugcugcacuuagcugccaaguccuucagucacuccuucagugcucuugcaaaguaaguauauacauuugagcaccagugcuguacuaacuugccuaaaguuguuaaauaugaagaucuucuuacauaguuugcuagagugggguuugguuugugguggcuuccuugagugugugcaguguagcugugcaugugguggguaaagcagugccagccuaggucccggggacagucgucuacacaggcugaggguccggccuaucuugacgccuuucccaggagaggaagcagcaacgagagccugcccgaggguuggcauguaacgauagcaaaucugguaagaguccaugaggaaagagcacucuccuaagcugaugaagcuuccucgggcgcaguuccaacacaugugugggcuuagggaugacucuuugucuuuuauuaugugcuauauuuuaaauucagugacacuaaaggggcuucugaguaacucugguacuuugcaccuuugucuaaagguuucaugaagucuucaaaacucuggcggagagugauaaggggaagcugcacgugcugagagucauguuugaaguguggaggaaccauccacagguaacgccugcucacugggacgugggccuggcuauggagauacacacguaugacauuagguagauuggagucugccaguaguagaauguuuuuuaagucuguacacuggguguuauggaaauacuuaacugauacauucuucuugguagauuuuuaaauuacacugagcuguugcuuaggggugcaugggagggucacggggccuaugcgaagucagaggacaaauuucaggucuguucucuccuucaaccauggugaguccuggguauugaaccuggcuuguccaacuugccaucgagugucuuagccauugagucaucucgccggaccuugguaacauucuucagguggcauugggauugguuuugugcuaaagcaauuccacacauauuagaugcugaggaagaaaauuguuugaccacaauauuugguaggaaauaguugucaugauuauccauuucuacaaacaagacccauaacauuuuuaaguagggccagacauauauauauacuuuuuuuucuuuuguuuuuguuuuuguuuuucgagacaggguuucucuguguagcccuggcuguccuggagcucacucuguagaccaggcuggccucgaauucagaaauccgccugcaucugccucccgagugcugggauuaaaggcgugcaccaccacgcccggcuuauauauuuuuauagagguauuaucaaugaaaguuuucuuaaagaguaugugcuaccauucaagaguugucuuuucaugcaaucuuuauuauuaauauaguuuucuuauaauauuagagcauagcagaaggcagaauaaaucuaaaggcugacuagucuaaucaagacuaauggcagcacuugggaaguaauggcaggaaaaucaggaguucaaggccagcccuagcuauaugaaaccgugucuagaagaaaaaaaagacgagcuauggcuuaaacuggucaauucucuugccauugaaaucacauuucauagccgcacuauuucauuuccuagcauuguuuaccaccgugccugcuugucucuuccuugucguagaugauugcugugcugguugauaagaugauucguacgcagauugucgacugugcagcaguagcaaacuggaucuucucaucggagcugucucgggacuuuacgaggucugaaccagaacuguaucaccaguaacagugugauguuacacaggcuuuauagugaucaggaccaaagagcaagggcuaacauauugugaaaacaaaugaaauaaaaucugugacagucuuaacuuuuccacuacacccacuauuugcagagcacacuugucagaaauauaccgaggccugaagugucauaugaucaaaaguuuuuacagggccaacaagauggcucagagggucagggggcuugcugucaagccuaauggucugagaucccuggguuugauccucagagcucacaugguaggagaaccaacucuaauguugguguuuuauuaagggguggacaaguacagguuaugguccugcccccugggagccgccugccugacuaauguguggagacggaugcuucauaauucaccgcagggcugaacuaguguugcuggaaaagacugcuucauucuucccaggggacagaaggccccaucagccccuaagaaugauaggcugaaacuguagauauuuccucugcaguagcauaacauacauuaaccaaaugcuguauuacuuuaagguuguuugugugggaaauuuugcacucuacaauucguaagaugaacaaacauguucugaagauccagaaagagcuagaagaagcuaaagagaaacuggcgaggcagcacaaacgaguaagucaccugccgaccugagggcucacagguugggacagaaucugcaggguaguccgagccauugccgugacacuaggcuuuuuccaaguuacauaaaacugccacaugcuauggcacugauguugaccacaaacuguucccuaguuuaccaccucuaaguggcuuccuagaagaaacuuguauaucucuaagucuggcacagaggagaagagacacaguuggagaggcugaggagaggugggacaaguuagucuccgucccgaccugacagauuauucccaugguaauagacuguguaggggaaagccgagagcuggcugauccccacacguacaguagugaguguucuugguuauggguggaacauauccacccagggaaaagguaaguuuaaugccugagcuggccaugguagugacaccugguaggccucacccacuauagcauuuacaccaccacguuuccccagagcucucacuccgggaauaaaagcccuuuaguacaaaauccuccccaggccuaggucauggcucagugauaaagucccucccuagugcaccacccauccaucccccccaaaaccagcucgagggagcuggaggcaggccagccugggccacggagcagaaccuggggcugaugguuuuaaccauuccccuucugugguagaugacacauacuggcuuguuguuuugcagcgcagugaugacgacgacaggagcagugacaggaaggacggugcccuggaggagcaaauagaaaggcugcaggagaagguggaggcugcucagagugagcagaagaaccucuuccucgucaucuuccaggugaggugcacagggcgcccggcuguuaguuugcaacgcugcuauucgacaacgugucacagccuggggccacugagucugagcuguuugcucuccaucucagcaucugucuccuguaggccuuaugguggugacucaggcggcugcuuucuucccugugcacagucccuacggagacugacacuaacagaggccggggcacauuucuacaagaggcuacaggacuuaacguuaaaucucucccuugcuaaguugacaguuuuggggcaguccugaaagucaggagugcacaccacaguccaguggggcagcaagaccuuugagaacucuugguuuggcuuuguugagaaguuagcauucccccccuaauucuucuucaacuuguacauccuguccagcguuucaucaugaucuugaccgagcacuugguacgaugugaaacggaugggaccaguauauugaccccgugguauaagaacugcauagagaggcugcagcagaucuuccuacagguuugugaggggccuggaacagauagucggcaccacuucucugucacacaggcuuuccaguuuaaaaagucagugguaaaacacuagucugucgugcucgagaccagauugugacucuuaccacugguuuuuuguuuguuuauuuguuucuuugguugguuuuugguuuuuugagacaggguuucucuguguaacccuggcuguccuggaacucacucuguagaccaggcuggccucaaacuuagaaauccgccugccucugccucccaagugcugggauuaaaggcgugugccuccacugccuggcuucuuaccacuguuguuuuaaaaaaaaaaaaaaauuugguccugggcuggagagauggcucaguaguuaagaguacugacugcuuuucuagagguccugaguucaacucccagcaaccacacgguggcucacaaccaucuguaauggaaucuggugugcucuucuggugugucugaagacagcuacaguguacuaauacaaauauuugggaaaaaacagugcugauaaaguuauggagguuaugaagcucuuguaggccucuuuccuuaguuccuguguauuugcugccacuacugcucuucagaauacuuaccacagugcuuuguggcacucacacccugggcugaguauauaggaauacuaguguagugagggaacaaaagcccgcuaacuuaacaguaauuagauuuagcaaguuauuuuaaaaucuacguucccaugguaaagugugccacaggaacaagguaaacaaacugcuuucugcuagauuuacugaugagugaaguucauuuuuccucuuuagcuccuuaaguucaccuuuguuucagaaaagugauuaauacagaaguaauuauccuuaaaguucaauucuuuaagccucugaaucucccagauuuauuagcucauuuaagagguaacugagagccccuagucguauagaaauuucuaaguguguuuuagucugcagagaaaagguucccacuuucugacgcauuggcucccuagacaagcuggucuugaaaaugucuuguguccugacuuugcagacacgcuuugcagcugucaguaguguagcuguggccaauggcuggccccugcaucaaggcuuuaagagcugggcuuggguuuacauuauugugugucucuccacucuuuccccugcaguguuagaaugcugagccuucucaggaaaugugugggcauggguggucugugagggacacguucugcaagguugcuuguguuugcuuucugacugaggccucuucuguguccgcagcaucaccagaccauccagcaguacauggugacccuggagaaccugcucuucacggccgaguuagacccucacauccuggcuguguuccagcaauucugugcucugcaggccuaacacucgcguuucuucccuuuuuauuaucuugaaauaacuugucuuauuuuugaugguuugaauguuugcuuucuuguaguagccuuucacuuccugauggaaaugggggaggagagugaggaauaugacgugacccuuaguugcccugcagggcaaguguggcuugcuaacagcgauguuauguugaccguagaguuguacauaugugagcacaacuuuccugugauaaauuugauacuuuuucuccuuagggcacaaaacaacagauuugaggugugugaaaugcaaggucgggcuugcaaaauaguagauacaaccgagggacuauccccagggagccaacuuuucucugcuccugggaacauggcuggaauaaacugcaguuaugguuuuuaaacucugggagucaugguuuaucaucuuagucucuuuucuuacugaagcugucuuuugcaaauacuuuucuuaagugguaucuuaugauuacuuguucggcuaaaggauuauuaauacuaauccccaaauuugucuaaauauaaauccacccagaaaucuugaaaguuacuuuaaacugcgaucucaaaguauaaagauggcagcaguuuuucgacuucucagaugacuacaggugugucagccauugcugaaagcauuggucaggcccugcaccucuaagaaggauuuguccaagauccuguagugucaccgaccgagcugacguggacuuggaguucaguguggcuuggggcuugucuccuagguccuggagucuguugaggcugaagcacaacgccuguuguguaaauaaugcagaagcaguuaucuggcaucccggauugcuaggauuuuuaaacuucucauuaaaccucaaaaacauccacuaauaaugauacaauuacugguaguaauuguaugcauuugcuaucuuuuuguacauguuauacucua

SEQ ID NO: 1884 - RNA, 40969 nt, Mus musculus
ucuucuccuugccuggugauggaguagggccggguacuuguggcuccgcuguucaccaacaauacgcguucccuuccuacggaguguguaggcgauggcgacggccgaggaaaagcagacgucaccugagcccguggccgcggacgagcccgcgcagcugccggccgccguacgcgcgagcguggagcggaagcgacagcgggcacugaugcugcgccaggcucggcuggcugcgcggcccuaccccgcggcggcggccaccggaggugggguccccuccacgggcgcgcguagggccucccucccgcggguuugugaccgcaucccgggccuucccgcugcgccuuggccgcccgcucuggcucggugugcgggaacagccgagcacgcccgcgucucuguggucccuggccuucccugucgugcccuuugcccggcacgucuauggugcagagcuuucagccugcgccgucucccaggccagcacccagcagaacugacccugacccagucuuuuacaugggccgcgccuuccagggcucaaaguagaauaacacucgcagagccuagcacuugggaguuacucuauuguauucuuauggacaccuuggaaaauggaaagggcagggcuugguaacccuguuuuacugaguggcauguugcccuggguucauuuuggcuauacuuggcauuuuaggguagccccugucuugcuguuuuccgguuuuaauguccguugugcuuuaggcugcugguauugcucuuuggaguaauucacccgaguuauuucuacaaaaguaauuuacuucuuuucaaucccucuuucacaacuccacuauauauauauauauguguguguguguguguguguguguguguguguguguauguauauacauauauacauauacacacauauguauguauauauuuauauauauauacacacacauauguguguguguguuaaguacuuguuuuggcagcagguauaaauaauaaugcguauauuuuauggcuguuuguaccuuuagacuugccauugaauuugauuuguugcucuugaccagcagagcuggcuuguaacuaacuagcuuagauuugaaucuuucaaaauaaaucgaaagcccuuacuuaccauuuuguaaaguaaaaaguacuuuucauuaucuuuguugguuauagugcagaucuuguaaguccgaaauugcacccucaguuucucauuauuuguaggcggauggacacuguuggauaaauggcuuaccaauguccaucuaccugcuggcaacgucuagagucaugagaguuucuacaacgucagacagccuggcaagugcagagacaguauaguucaguuccacacgagaaguccagagcacuaggaaagcuagaaguagccgaaguaguagccugauugcugggccugugaccagagcugcuggggaggcugagacaggaggaucuugaguucaagaacugccagggcuagaguuccaggucggccugagcaaguuagggaggccuggacucugaaaacuaggagagccauggauguuucucaguagucaagugcuugccuggugugcucaagacccuggguuggaaaaagaaaaauagccgaaguuaggcagggucggucagucuaccugguaaguguuguugcccuuggaagcaagugaguuccguaucucguuugaacgcccugccccucauuucacucaccagccuggggagaaagggcuuucuccuucagagguuuauacccuggugugaguuuuaacccuugggcuuuggcaguuuucccuuccguuugccguuuucuguuugucacagggaaucacuucugcuccuugcuucugcggcuagguccucagggcgcuucuuaaagacacuucccagcuaggcuuauccuguuugcucacuuucaggucuaguuauucuaauccucuuaaaguguuuuuuuuuuuuuuuuuuuuuuuuuuuugacaagugucuaguauagaauccucggaguaaauacuaguuaucaccacaauccuuucugcuagaggcuguugucccccuguccucccaagccuuguguagaaaggaauugccaaagcaggguuggaaccggcuuaagguucuccuuuggcugcuaucuagaaacuugggauuugguguguuuccacucuuccgaccuggcgguuuacuguagcuauauaguagguagaaugugaugugugcuguacaccuggguagcucuccggaagucgggcauuuggggcuggaggauggggaaggaagcucccauauuggaacuccuuuaggucugcacuugccugguguguccuuugacuugacuuuucauuuguauuuaaaauccuucacaaaugauuagcgaaugucagugaguuagguucccaaguuguguguauugcuguagaagguuaauuacagccagggaagcaguuuuggaaaccugauuuauagccagucgauagccaggcuaacugcagccuggucugcaguuagcaucugaaguugggcagucgggaacugaacccucaaccugugggcuccgacucccgguagauggauggcaucacauuggaaguagagggcaccuggccagaaucacuggagaaaugcuagggguguggugucuguugaguaguguugagugguuuguccuggagcuaaaccucugaugugcugggagcguuggggauugguguaggucuguuauagccauaggagugaucuuugaaggccccauuucuuuauauacagccaagugcguucccccaggugcaucccagcguucugcguugucuuugguuuuuguugugugcuguagucagugugacagccucaggaggcuguucuuuacuguaugguagguucuuguggcuguuuguauacaugcucacaccgccugugagaggaaguggcauuuuacuucuuucuaagguguaggcuaguugguuuuguuuuguuuuuguuuguuuguuuuugcuguuguuaguuuugcuuuugugcccugcugcaccagcugggaccuuaaggacagucugaaugaagcggugacauugucacccuuuccuguuuccccgcaggagagucuaugggcuugccagguucagugggugacuccuuucucugcuuucuguaggcguggccaguguaaaagcagcucccaaaaugauugacaccaaagguggcuucauuuuagaagaggaagaagagaaacacgagauuggaaacauuguucaugaaccagguaaagcauuuaaguguuuccacaaaagaaguauggacauugguaauuuggagugacaugaagaauucuuugcucuuugauccaugagaagaugcagggaugaggggaggggcuggaaggaguagagggaggggaagcuaaucaggacguauuauaugagaaaagccucucuccaauaaaagggggaaaacacaacuauguguguguguguguguguguguguguguauguguauauauguauaugaauauauguguguguauacauauauacauacauauuuauuuguuuaucaguuuacagugauaacuuuuauuuauguucccuuuucaugguagaacaaauaugcuuacucauguaacuucuuggacauaggauaauaugaagauuaauauuaggaagcacuacaaaacauuuucaggcagauucccaguuucaaacucucaucaguaauauaggagaggguugccgucuccacaacuggcaacaguuuucuuagcagucuuucuguagcugcugcucuuauccugaugugagucguagcgugcuccggaguugaacggcaccuaugagauacuaaugauguugaacauucuuuugaguauuugcugcccauuuuaaauuuuggauuaauauuuccauauaauuuuaaauuaaacuauguaauggugauacaaagcuguauaaauuuuagguacagguuuucugucuuccuuucuuucuuucuuucuuucuuucuuucuuucuuucuuaaagauuuauuuauuuauuauauguaaguacacuguagcuguuuucagacucaccagaagagggcaucagaucccauuacagauggcugugagccaccauguagaugaauugaacucaaguccucuggaagagcagucaaugcuuuuaacugcugagcuaucucuccagcccccacauguaguuuuauuuuuuauuuuuauuuauuuauuuuauuuuauuuauuauuuauuuuuuuuuuuugagacaggguuucucuguauugcccuggcuguccuggaacucacucuguacaccaggcuggccucagaaauccaccugccucugccucccaagugcugggauuaaaggcgugugccaccaccgcccggcucacauguaguuuuaaaugaugcgcuucuuguugagauuccuaagggcuuuauuuucucggguaugucuguauuugucauuggcauggcauugcauuuauuaaguauacucauuaaggacaacaggaagucaacucaagugugaacaggaggauagagauggggaucucuagugugagcaggaggauggagaagggaaaucucauuucagggcuuuuugaauaacaaugugauauagccaucuaauggcacuucugaucaguuucucuucauccuaguacauauuuugaggauaucaacagccuuguucuaaaauauuuuguucucucuuuuauagcucugcccuguuuuaugaagaaccauuucuuuuaagagcuuggagauuaguggcguuaaggggcggcaggaucuugacagaccaugcuuuugaguuagcuaaggaaggcagugcccgaaguguguuuccuacuguggcaguccugagccaggcugggcaguaacagucauacagucauccuaaggacuuccugggggguaggggggcuuacacuugccuggggaccauuagaggauuaaagguucuuaguauugaagucuuuaagagaagccagcuucaccuugccagggguaguucuguguggggugcugggggguacagggcucagugauugucccuuaagaagucuguaauccaggaggugacacagcaagcagaggcucuugcucuggugacauguuggaaugaaagaagaguaauguccccaucugagugaguuucguguugacucuccuaacauugccuuguucucuguauugcuuuaacugcuuaauguguugacggccucucucuguaaauagaccccuccgccacaguccggggccagucuucuuuguacuuucaacaguaccauaauuggcugaacaaaaguccucaaagauguccacguucuaauugucuuggagccugcguauauauuacuuuacuuagaggagacuuugcagacaggauuaaaguuaaagaccucgacauggggagaucgccaucaucccggggaccccagugugaucagggcuucccagggagcugggcuugcagaggaagccagggaaggcauguagaaaacuguuccugguccugaaggugggaguugagggaggaguguggguggccucugggaauuggaaaaguccccuggaaugaacacagcccugcagacugcuuggauucgacauacugggucucacuggcgagacgacagauguaaggccagcaucaccuuaccugauaugcccacugagaaaagaaucuuaaaccagacuaggauagagggggucucagcaagacagaggcucagacaaccuuacuccaaacaaucagacuuuuuauaccuuuaucagaaauauagcgguaguugccaggaucaauaugacgguaguuuccaggauacagugauguuuguaagcgauacaggauugugauggcuauucccaguugucagcuugacuauauccggaaugaauuauaauccggaaaugguggacacaccugugauccagaucuugaggcuggaagacacaggcuuuugaucuggauuuuuaaaaaaacauuuuauuaugucuguuacuagcauugguguugugccugcauguaugucugugugagagugucagaucuuggacaguugugaguugccaugucggugcugagaauuggacucugguccucugaaagagcagucacuucucuuagccccugagccaucucuucagcaccugaucuggauauugaggcacaguggccaugaaaagcuuaggcccaagcaaggugguacacaccuuuaaucccagcagacagggaggggcaagcagauuucuggguuccaggucagccagagacagagcaaguuccaaguaaagaacaguuagguccaggugaggaggucacaccuuuaaucugggccacaccuucagcuggaugcccacuuaagacaauggaagaaggaagacuucuuucuucuucgccugcuugcauuuacuuuccagcacaucuguuggauccuacuucuucaggauuccagcuuauaaagaaagccaggcgaaacacccagccucguggacugagcagaggcuagauugucggacuugccauucacagcccauugcuagguuaguugaacuguaagucauuccaagaauauauagagacauuccauaaauucuguggcucuagagaauccugacuaagacaaggacacacaagauuaaugucuaaggccacuuguccuaucaaccuucccuguucgguugacuuccggggaacacagagaaucaaaacauguugugaauguuucacggccugagggagugccucuguuucucaggaacugaaaggcacacagugacccaugagccauggauucuaaccuaaaaaaccagggcaacuccaugauugccugcagacagacucaugcuguaggccaguacacaggaauuccuuaugucaguguguaagugaagcaguguuguucaugucugggguucagaaggacuuggugaauuacuaacucucuccugcuuaauuacucuggugguuugaaugggcuugacucccauagacucauguguuugaauguguggccuacagggaguggcacuauuuggaggugugaccuuauuggaggaaguaaaccacuguggggacagacuuugagguuuccuaugguccaguucugcccacuguggaaacccagucucucccuggcuuccugcagaauucaauccccuucugcugccuugggaucaaaauguagaaccccccagcuccuucuccagcaccuugucugccuggaugcugccauccuucccaccaugaugauaaaagacugaaccucugaaacuauaagccagccucaaguacauguccuccuuuguaagaguugccuuggauauggugucucuucacagcaaugaaacuugguuccggggacugggguguugcugugacaggccugaccaugcuuuuguuuggaggagugugggcuuugagacuuuggauuaggaaagcaauggauugcuuuaaguggaguuuaaugguccaugcuaauagaagcacggaagaacuuggugcugagggugauugcacuguggggcccuggcucuagagguuucagaggagaagaaucuaguauguugccuagagaucauucuugagauauuuugauaagaauguggcugcuuuuuacccuuguacgaaguaucugccuaaggcuaaagcgaagagauuuagauuaaucaaauugacaacaaaaucucaaaauagccuagcauaggcucugcccugugggucacucguauaaagagcauuuugaucuaacguaagcugagaaaggaaaaauacaaaauauauguuucaaggaguaaggggcaccaggaaguggaauggagcuaaauccuggauccaaggaguuaaaacauuaaagauauuaaauagaauugagggaguagugaccuuucaucuugugagaaggauguuccccaagaaacacugucaccuauucuaaauuuacaauguguuugcaguuguaugagggagaguuauaucauguuagccaucauuaugaccugguuauugucuucauuuggacauaaagagauaugguuguguguccaguugacaagggguggauuugugauggcuguucuccauugucagcuugucuauauguggaaugagcuacacuccagaaauggagggcacaccggauucaggucuugaggcagguaaacaguaugccuuugaucuggaucuugaggcgggaugacacaugccuuuaauccauccacagcuugaggcauaguggcagugcuuauaaagaucuugugguaaggaauaaagagaagcuuagguccaggcguggugguacguaccagccuuuaaucccagcacucaggagacagagguucaagaucagucuacagagcaaauuccaggucagccaagcuaaggcagugaaggaaaccauggaaaacaaagcuggugaagaugcagcgagggggccauguuccagcccccaacaagaagcagaacucggcagcuucagccacuugguucuggcuuuagaauaaggauggaacuuaccucugagacuaagcaaagucacugagggcagguguguggcaaggggugucucugcaggaaggcucagaaacgccauuguauaagguggccaaggucguaccuugcgcugccagggagauuuagucaugaauaagagucaccaggugguacugguuuugaagacaugaaggggucauggagagcagcugaggcuuggcucugugagaggccuggggaggccaucggugaaagugcagugcaguugccgcagaagacagcagcguuuuggaguaccacagaaugaccaccacgaacagcagcuauagaagcuguguuccacaagcugugaagguaaaggcuggacggccuuggagaccccaggagguuagagaugccaaaauuauggaagagcugccgaggaaagcugcugacagggaguggaaccagcccaagagagagagagagagagagagagagagagagagagagagagagagagagagagagauguguuuggucagguguuucucacuaugcucccuuuccucccuuuuggaaugauaauguguguguauauauguguguguauguguguguauguguguguguguauauauauauauauauauauauauauauauauauguguguguguguguguauguauauauauguguguguauauauauguguguauauauauguguguauauauauauguguguguguguguauauauguguguguguguauauauauguguguguguguguauauauauguguguguguguauauauauauauauauaugccauuguauguaggaaguaugugaccugguuuuuaauuuugauuuuauaggggguuacaacugagagauugccaugagucucagaagagacuuugaacuuggacuuuuaaauguuguugagacugugauagaccauggggacuuuugaauggacuuuugaaguugaacuaaaugcauuuugcguugguuuuggcuacaagccuugggggcugggcagggaaugaaaugugguuuaaauagguuuggcucucauagacuccuguguuugaaugcuugaccgacaggaguggcacauuuaggagguguggccuaguaggaggaagugugucacuauggggcugggcuuugagguuuccuaugcucaagcuccacccaauguggaaauucagucucuuucuggcugucugcagaauccagucuccugcugacuuuggaucaagauguagaacucucagcuccuuuuccagcagcaugucugccugcaugcugccauguuccugccgugaugauaauagaguaaacuuuauugcugaacugccucgaccuuccagcaauuucuuuauguuuuuguuguuguuuuuuugguuuuugguuuuuguuuuuguuuuuuuuuuuuuuuuggguuuucgagacaggguuucucuguguagcccuggcuguccuggaacucacucuauagaucaggcuggccuugaacucagaaaacugccugccucugccucccaagugcugggauuaaaggcgugcgccaccaaauuauuuauggauguuuaggccuucuagcuuaggcuucuucccagcuagcucauagagccuaauuaacuuguuuauucuagucaguguccugccacgugugccugcggccggcccguuuucuuucuuaagccggucagaagguuuuuaagcagcgcugagacagguauugcuucauaaaaauaacaauaccacaguccagguauucagagcccugcugguaaagaaaucaacauuugaauaaacaaagacaaccuuuacacagugugcaagaagauuaucccagcaaccucugaagcugcaagccagccccaguuagauguuuuccuuuguaagaguugccuuggucguggugucuguucacaguaguaaaaccccaaggucuuuuuuccucuuagaaaauuguuuuccauaaaccuaagguuaaucaguuucucccccaguaagcauuugugucaggcauaagaucuaugacaauaagcuaauaagguagagaaaaguccguuguguuaguccucugacagaauaaagacuucccuuucucuugcagggcccgucauggaguuugauuacaccaucugugaagaaugcgggaaagaguucauggacucguaccuuaugaaccacuuugaucugccaacgugugacagcugcaggugcuugccuuaaacuacuguuugguuuuguggugcuggagacugaggcggucuagguaacccagcuacugagcuacggccucagcccacacugggcugccucacugccucccaaguggagauuucugggucugcccugcgccuucccaagcuugcaccucuggcucuucucucuagggaauuuugguuaaaacguuaaagugguuuuuaguuccuuuucaaauaugccuuuaccacggcugcaggucuccaguagccccugauuaccuccucaacgcuugcccccacuuacugcuggcgugugugccguccccugucugccugcccgcagcuccuguacgccuccuucucugcuuagcagguuucuuccuggcuugcucugggcucuguucaccaguguccucagcagaggcuucuucuggugacuguccugucaggaauccuugucccuucagugugccauaugaucguagagcgucuuuccugucauuaugugggccgucuucugacugggacagagcuucauuaaacaaggcccuauuuuauccacuaaaucaugauggcugucuucuuaucaccuugaacagugccugacaucggggugacaaacgaaggaaaagaauuaaccaguucacggccuucuguaaacuuugguguugcuucaaguucucacggucucuguuuuuacuuugguuuugagccaccagaacccagcuguguuuaggaaaugggaccuugggauauuuauuuuuugcccaucuuucuggaucagggucuguguaccccgggcugggcuugaacuugcggucgguucucucucuuuagccucucaaguccugggacgauggcaugggccgcuacuucuggugaccuuguaacugauuuguauuuucuuucuccaugagcccuuuuuucauugugucuucccuacucuuauuucaaguucuuucugaaauaagagggacuuuaagaagauucuuaauugugauaugacuugagucugaauuuaugacuuuaaacaugagaaccaaaggcagagacgucugugugcaggccuugugggugcugggcugucugaaaacucagcuuaacuggacauuauauaacauguauauaauguucuuaaucucuuuccagagaugcugaugauaaacacaagcuuauaaccaagacagaagcgaagcaagaguaccuucugaaggacugugaucuagagaagagagagccagcgcucagguuccuugugaagaagaacccacgccauucacaguggggcgauaugaagcucuaccuaaagcuacaggugucuaguaagccggaggcugggauguccgacuggaggugaacuuccagcguagucggcugguugucacucacacauuaaagagggcccuuguccugucuacgugucuaucccugcacagcugaugacugcucagagcaucaucuggcuuuugcuguggcaacuccggcauaagugcacugcucguggaugcugcagagagcauaacugcacucugaaagguuuagaaaagcucagcccuccccuggcucucggucgucuuuuaccaaacagcaagaagagcgggcaugggcauuuccgcuccuucacagaugccugggcucugacucuuggggauauaaguuggaugcuggagugucccaguaacuggugcagcgcagggcagaucucggccccugcugugaucagguuacacugugcuccggcaccugggccuacugcuuagagacacguguccucccguaucuacuccagaacggcuugacuaugacaguguuugcaccauuauaugaaaauguguagagacacugcuuuagagcuguuuguacaggaaugugcuagaaguuuccucaacuacacauaaaaucaagccacauugagaaacauacacuggauuucauuaaauaugauuauugauucagaaguucaccauucaucuuaagugccauucaaaauaaauaaaacacgauccuaaugaaagcagcccaggguuucuucucccuuagugcuuuguuucagccucccguacccggcucagguggcacaggcagggaaaugccagggcacagacucugcuagcauugccugccucucuugaccucaugauuggauuuuacauguucuuucuuguugaaucuuuucuucauuuauauuuucugaacuuguauuucaacuccuucuggaaaaagugggaccuaaaggggauccuucaacuguuacauuccaugguuuugcuccuggugugacuuaaugacaucugugagcucgacaguuaggacuuccuacuguaccucucugaaccccagcugacugggcucuuuccuguguuauaggugguaaagcgggcucuugaagugugggguagccaggaagcucuggaagaugcaaaggaagugaggcaggaaaaccgagaaaaaaugaagcagaagaaguuugauaaaaaaguaaaagguaaguggccggauuuccugucacggagaucacagagcacagucucuguagguaaggagaggggcgugaacgcuggccugcgugcuuugguguaugaggcuugggucaacccucacgguaccucauuaauaaaggccaucguuuucauguaagucauuuuugcacagcaguggugucuggugggguagggacagugggauuaggcaucacucagauccugaguggcugcaguguuuaagauaacaguaacauaaaauaacaagacucccaauaaccaccucucauugcuugaaacaaaccaugaacuacguagucauuggauuuaauagcuagaaggaacaauggguaucaguccgaaugucuuuauuuuaauaugacuaauaaacccagaaagaugagugguguuccauuguugggacaguuguccgguucucuuccugagucuucauauguauaugugcauauacauauguauauguauuauacauaugcagagccguucuucugucugugaaucugucuccaugcagcccuccacucccugcugguucugccucugcauccguuguccacguguguaucuauguguggauauuuccauaagucuguccauccaugcacacaccuaguuuuaccauaugccaagcacugugcuggguugagugucaggaaggaaacuugagacacuaacccagugugcugggaauggagccacaccagggaugagcagaguguggcaggagcacucggggcuguaaacaaaauccccaaagaggagucggcaggaaguaaccagcaugccuuucauguggcggcugugugagucccuguguggcgcagugugacuaagguaauaugcgcccugaauguagcuuggguuauacuuuacaugauccauuucaaacuaguauucuagccauauuaauuuuucuuaugauuuuaaaauuuagaagagauuuugugggugaauggugcagcccacaugcuuaaacacaaagaaagggggggaggugcuguacaugucuguaguccuaguacccaggaagcugaggcaggaggauugugaguugaaggccagcaugggcuguagaaugaguccuuggcucaaaacauaaaaccaaaaaaccccacaacaaaaccugccucccaaaccuaacuaaacaguuauagcucuggcuguccuggagcucacgcuguagaccaggcuggccucgaacucagaaauccaccugccucugccuccugagugcugggauuaaaggcgugugccaaaacauuuauagcaaaaauccaggcacucaacuaagcaaccaaguccuuuucccugugcagacucuugcacauucuaaacccaaaaugguagcgauguuggacacagacaaucucagugagaccccuuugcacaagcgacuuaguuccugagcaggucggaagcccacguggaaggcuuagcugaggugucccucaggagacuucuauagaagaguaugucguuaacguuguccaagccagccacagcugugucccagcauucagaugccagcaaagacccacugacaagaguucuccccucuucuguuuagcacgagccccucccucugacagcagagcuucuauuacaggauagagccguaaaaaagcagauuaaggaagggcugugaaagguggucuccagacuaguagucugcucugggugcaggugcacacaucuguguugcacauguggaagccagaggccguaaggcuaagguuaaugccuuuguaaucggaucuuuucacugaaccuaaagcuggccguuggguggcuggccugugagcuaccagcauccaggauuccuguguccugugucccccucccaucuccuggugcugagguugcagccagcugagcagcauacuguuuuguuuggcguucccccugcccccucuuuuuugguugggggagggauucaaacuugguuccucauccuggcacuucugcccucugagcugguuuucucaggucaugguagugcaagccaucucuggagcucagguccaggguuuuaacuacuacuagaaaucaacuggacccuucccucagauaauacgcuggugaagaugaugaaauguggacaaaagaguaagcauuaacuagaaauuaguauuguaaaguggggaggaacacuaucuguaacuuucccuuagauaccaauucuguggucuggucaacaggucauauaaacauuuugauacacuuuucuugccuuuuuaauacaacucuauuaggauuuguacaaauuuucuacaauuuucaaaauacgaacugaguuggcauuuacuuuuugaucacuguauuagacaagcuuuauggauuuuccuuauuccugagucccagugacacggaggccuuuuugaagauugaugucuuuugaguucauuucuuguuugagugaaacaugcuuuucaagaauauguuugagcugggcagugguggcgcacgccuuuagucccagcacuugggaggcagaggcaggcggauuucugaguuucaggacagccagagcuacgcagagaaacccugucucgagaaaaaaaaaaaaagaaaauguuagagguggcuucgagagugagugccugccauuaccugcuucugcugaugagcccgugaguucugggugcucggugugcagugugccgccaacuuuaacugugguucuuguugauucguucacucuagcacuugguggauauguuccuguccugacuaggccacagagggcugaguggaguagacuguagaguagaaacgaggagcucagaacagagaggagacaaagcaagucuaaaggcuuuuaguuggaaagaauugggacaugguuccucuugaugcacagcgaagcugacgcaaagcuuucuucuuuaugggaagguaagcaauuauauucaccugcucucaacaguuuuguauauuuuuuuauuuuuaugguagucauuguaauguggagguugcuacagagaaaggugugaauacuguaaagcacauccagacaagguuccacaucuccgagcuggaggguaacuguguucccaagggugcaccacccagcagcagacaagagccccgaccuggugcccuacacaggaguuuuggucugcaggcuuuuuugccucaaauaaggugggaauguggguguuucuugcauguuacaugcgcucaguacuagagguuuuccuccuagaagcuagucagugggcuucguuaguaugacuguccccaccucugcaaggggcaggaaggacaucaucccguuuugaggucccuugugaauuuguggacacugaccugucccauggauaugcaugugacacugaggaccuucucugagcaaccugugacguguaaguccagccuguuaguuuauggagcaugagcugagaucaaaacuucguguugucuuucuuuguaaucuauuuccuccagggaacgggccccaccugcuuuuccaucccgcacauagagguguugggucuccuuaccuagcucuguaguaggucucccucagaagcagcagcagcagcagcagcagcagcagcagcagcagcagcagcacuggguuccuuugacugcagacugucucuugcaauguguagucuaaaaacaaacucugaaguggauugaguuuucacugcaacaagcauuuuggggaaaucuuucugggugaacauuguaagcagucccugaggcucucuuuccaggagguguagucuacugccaacaagacuaggaggcagcaagagggcgagccacucaccacuuuguuguccagccucccuuaggcuccaguuuugugcagcacacgcaccccaguuccuugccccaggucugcuagaccuggcccacuuuugcacacucacuaacaguuuuacucacacuccacagaagacaguugauugcuacucucccgaguguuguggaaccaacaaaccuuugaaagauuggggggggggggcagugaaauggcucaguggguaaaugugcuugcugccaauccuaauucccugaguuugguccccagaagaacccacugguggaaggagagagcuuacuccugcuaagauguccugauuucaauacaugugcaccauugugauccgcaugcacacacauguauaccccccacauguauguguguguguguauauacacacuccccgcccaaguguuggcauuuggccaucucuaaccuuucacacuugcaugcacuuuauuaagcccugaguuauuugcaaacacugugauuccuucaaaucuuugugugccugagaacuuuucucuguaacuaaaagcugaucauaauugagacucuuaaaaggugacuaugaaagccgggcgugguggcacacaccuuuaaucccugcacucgggaggcagaggcaggcggauuucugaguucaagaccagccuggucuacaaagugaguuccaggacagccagggcuacacagagaaacccugucuugaaaaacaaaaaaaaaaagugauuaugaaaauguuucucauguguuguuccugugucuccccucauucccaucugcuggggugucgccuuuaauguugccccucagcucuucucuuuugcucuuggacuguucagcaucuuguuucugcuccgugagacucaggcugauugcuugugggaaaaauacuucuuaggagauaaaggacacacaugagagcugcugcccauccuugagggagcugauagucuccacugaaguccuuccuuucuguaccuaacacacacaacaucggguguuuuacucagugcuucuaguauacgcagacgucuuagcugagagcuguuuguggcauauaaauaggggauguuuguguugaaacagcuuuucuuugggcucuacucuuguuuucucaggacaagguucauguagucucggacuuguaacagucuucuugcuccugcccccuaagugcuagaauuauagauguccaucucuaugccuguuuuauuuuuaaauuggaauuauauagcuggaacauguuauguagaccaggcugaccuccaauccacagggaucuaccugccugucaggugcugagacuaaagccaugggcucucaugccuggccuuugcuuugguuuugcagagcacagguuggacugaccuguggauuccagucaggccauggagugcaagcuccuucuggagcucuucauuggaugcucacacucccaggucuggccacugggcgguggagucuccuuuaagcugguucaugucuuuuccuaaagccccuuuuauuuggaaagaauuucagaguugugagaaguugcugaaaugaaagcagcacacacauugccuuccccagacugagcuccugcaaccaucugcaguguaggcgcucacugaagccgcaaccacugcucuuuacggccuguuucccaaguguucaccagugugacaucagcagauguaguagucaggagauuuuaaucuaagcugcugucuguguucugcuucugcguccugaaccuacguuaguguucccuucuagaauggacguggugugagcucccuccuguuguaggcauuaagucuuccuuccuaaaugguuucuucucaucacccugccuuucaugcuguggacacuggugaaguucuuccacaguggguuuggaaguaaagcuuugcacccagggcuucuguggcuuuucuguugaugggaugcaggcuaagcaucucaggcagguggccccugguccagggucucacaacuggaggugcagagcgcccaucugcuuucaccggcaguaggcaguaauuugguuuuuauccaguaagccaaagaaaacagacuacaaauaaccaccccucccagccuggcucagcagcugugcacgggcggcuuugcuggaccagcauuccugugauaggauggagcagcuuucagccccaggacucacuccaucagcagccaguguucuacaucauuguuaguggcauggacucccagaguuguguguucaugugucuuuauuuuggagcucagaucgucucagauucugucuagugggaucuugucauaggcugcuguuuaugccauugacaaacugaacauuucuagaacaagcaugucugucugucuucaugcguaaaacgucugagcacauacugauacaucuaguuuuaacccucgacauuucagggcugacacuauagggagggaccugcagaccuugcugcucaguaggaagugaacccccuauuccuguccuuaggcuuuggauugcuuguuuaggagacaagggcaaggaaaacccaaaccaaucauagcagguuaaacaucucuaaucuaaaauuccagagugcuccaaaaucugaaauauugccaacauaaugccauaaggaaacuaugcaauaagcuguagcccagacacuagacauauauaagguacaucaagccauguucuguguguacacauacuucaacaucuauaaacauccauaaaaucuggcagagaugguagcuuaguaugauuugcugcagcccaauuuugagaggguuucacaguagggaagucaaggagacccgugcugcccccugcagucaggaggcacacugacucccucagguaacacagaacucuguauacacuucagaaaucugggcucuuucugagcugaaacaaccaagacgagagcuuggauggcagaccuuucuaguagauggcacagacacugagccauguaaaccuaagaguggugaagaaugccgcucagggucggacugauuccuggggaccuaagcuagacuagaccuuuuccuauuggcugacuggccuugggucgcccaucugcaucugaagugcuuagcccacuguccagucuauugacuguccugaccuccuccuacccaugauauguuauaucuggaaacagauucaagacacgccuugacauuaguuauagcaaggaaaaugaggaacccugaacuggaguuaucgguuguggggcagcugacgugagugcuaggaaccaaucccauguccucaggaagagcuucuaaccacugagccgucugucucuccagcuccugcaauuuuuacuuuuuaaaaacaguuguuagaaugagaauguagcucaggugaugagugcuugccugccauguucaaagccagggcuucauccccagcaccccacaaaacagaugcgguacucagaguugggaguggagguaagaacauaggcucaguguccagcacgggccugcgugagacuguuucaacacaacaagcuaaaccgaugcuguccucucacuaaguagauguaagaucacugcaaucagcaugaugcaaaggguucuuggcuuccuggauuccucauaggcagaacucgucugacaugcuccugacugaaaaccuugggauaugggccacucccauuccuugcuucccuccgcuggcuuugcugcucuggcauccugcuuucugucagaugcuccaaacacaccccguucuguuguucuguuacuacacuucgaauccauauagcagcuucauacuugauaaugugauaggcaggcuggccaagugugcguaaccagugguuggaacgaaaggaaaccauuauauacacagauaccaauggacgccucauuggacuuacucuguauaaggcugaaaagcucucuucuccccuuagaauugcggcgagcaauaagaagcaguguauggaaaagagagacaaccacucaccaacauaaauauggaccagaggaaaacuuagaagaugacauguaccgcaagacuuguaccuuguguggccacgaacugacauaugaaaaaaugugacuuuuuaaaaaauuuauauucaaauaaagacccuguucaaaguuccacgaugcagucuucacagaaacaacacuuacauagcaaugcuuuggaauggcuguguuucaggucugcccgagggcacaguguugggucugugggagcccagugguacagcaagacugaaaacuaaguaaaagaaaaaaaccuaaggugguagauaugccuuaaaaagguacacacgcacaacugcacauacauguacacagggaaguaacagugacaggaacaguuacuccacgggaacaggggaugugggggaauccuggguuggcacagaaggaaagcuugcaggguaagguugauggagugagcaggucugauguguacugcugugaagucuucaggcaauggcaagagcaagaugcuacuacacgaacaagcacccagucacagcgggagccaagaauggacucgagucugugcccaaggccccguucuucagggccuucacacagcaauuuggaaaugcuguauuaaaagggaaaaaugacuacuuucaaaagcacucauuuaucauuuaaguggucuaucugcuuuacaaguucucaucaaaugcagggaggguaacagcuugcuuccuugcuuacuuaacaccucugagguagguaggaaguuacagucgccagucuuacuucgcuauaggcauuugccuccgcuuucuuuacucuuuucaaaaguauuacugaagcguccaugaguaacagcuguuugaagcaacuauuacacaugaacaaaggaucaagagcugggcacucaggaggcagaggcaggccgaucuccugaguucgaggccagccugguuuacagaguuccaggagagccagggccacacaaagaaaccgugguggguaggggugggaaucaagagaaagaaaagaguuaucuacaaguuuuuguagacugcagcucaaguagaacuaacuagcugaggucaaaaagcagagcaaugcccuaaagaguguugcucuagcacgaggacaggagccauuccuaacuaguccauacuguguuuagcaaggaggcagccgugacucugacaaacacgcagcuugagaugcaguggucauuuucagcccucagaugcacuaacugggaagugugugaggcucacuuuuccuaucagcugcuguacacugcaccuggagaaaggccaaacucacaagucaaucccggauaacaugggccuucacgacuaacuguucuuuagaaacacucggcagagauggucuguguuuuacaugugccgugcuagcucgaagagcucaguaaagggugauccuggaugggcagccagaccuccuaauagagagggguuucaggccgcugcugaguacugcugugugcugcacaguucauuccugagguucauggcucuaaccuccucccuguagacuucagcuagguuuugcuguggccugcuucugucugugaagugagcgcacucaccugucagaagaacucugucagaaagauuucauaagguccgacaguguaacagccagcuguuagugagcacuuccuaucaaggccaacacaggagauguguuuugcuguaugcuucuguucucuagcugacuuuagguuaauccugguaucuagcuaucaggcuagcaaggcacauaccaccuuuuacuuuuagguaugauacaguccucacggaagcaaugcaugucuacuuugacaaaagccugcuaaggagcauuagcaugacuucauagaccuugugaggcacacagcgugccaccccgucuaagggagccccaccagaagggagcagcugcuuccugauucugcaucuugucuucuguaggauacaauccucucuucagcuuucccagauggcugaccaggauagagcaggcgcacauuaaugaacaguuucuggaagucuccacuacacaagaggagcaaaagaaagggagaaaaguacaaacuccuagcaugcagaucaaggauaaccaaccucuacugugccucagcaaaggauacaguuaccagugccuucaguuagagcaugaacuauguuaaaugggaaggagacacaggguaaagaaauaggauauuuaccuaagaaucagauuuugucuuuuugaaguaucucccauccaacccugagcuauugaauuuaaaugauuaaaugauacuccuacuuuaaauguuuuuaaaaagucuaggaauucucauuauuaagaaauuauauucuauggucauugaaauauaugguaacuaaauacccacauacacaaacagauaaucacaauguauacuucuagaguauaacauguacaaaaagauagcaaaugcauacaauuacuaccaguaauuguaucauuauuaguggauguuuuugagguuuaaugagaaguuuaaaaauccuagcaauccgggaugccagauaacugcuucugcauuauuuacacaacaggcguugugcuucagccucaacagacuccaggaccuaggagacaagccccaagccacacugaacuccaaguccacgucagcucggucggugacacuacaggaucuuggacaaauccuucuuagaggugcagggccugaccaaugcuuucagcaauggcugacacaccuguagucaucugagaagucgaaaaacugcugccaucuuuauacuuugagaucgcaguuuaaaguaacuuucaagauuucuggguggauuuauauuuagacaaauuuggggauuaguauuaauaauccuuuagccgaacaaguaaucauaagauaccacuuaagaaaaguauuugcaaaagacagcuucaguaagaaaagagacuaagaugauaaaccaugacucccagaguuuaaaaaccauaacugcaguuuauuccagccauguucccaggagcagagaaaaguuggcucccuggggauagucccucgguuguaucuacuauuuugcaagcccgaccuugcauuucacacaccucaaaucuguuguuuugugcccuaaggagaaaaaguaucaaauuuaucacaggaaaguugugcucacauauguacaacucuacggucaacauaacaucgcuguuagcaagccacacuugcccugcagggcaacuaagggucacgucauauuccucacucuccucccccauuuccaucaggaagugaaaggcuacuacaagaaagcaaacauucaaaccaucaaaaauaagacaaguuauuucaagauaauaaaaagggaagaaacgcgaguguuaggccugcagagcacagaauugcuggaacacagccaggaugugagggucuaacucggccgugaagagcagguucuccagggucaccauguacugcuggauggucuggugaugcugcggacacagaagaggccucagucagaaagcaaacacaagcaaccuugcagaacgugucccucacagaccacccaugcccacacauuuccugagaaggcucagcauucuaacacugcaggggaaagaguggagagacacacaauaauguaaacccaagcccagcucuuaaagccuugaugcaggggccagccauuggccacagcuacacuacugacagcugcaaagcgugucugcaaagucaggacacaagacauuuucaagaccagcuugucuagggagccaaugcgucagaaagugggaaccuuuucucugcagacuaaaacacacuuagaaauuucuauacgacuaggggcucucaguuaccucuuaaaugagcuaauaaaucugggagauucagaggcuuaaagaauugaacuuuaaggauaauuacuucuguauuaaucacuuuucugaaacaaaggugaacuuaaggagcuaaagaggaaaaaugaacuucacucaucaguaaaucuagcagaaagcaguuuguuuaccuuguuccuguggcacacuuuaccaugggaacguagauuuuaaaauaacuugcuaaaucuaauuacuguuaaguuagcgggcuuuuguucccucacuacacuaguauuccuauauacucagcccagggugugagugccacaaagcacugugguaaguauucugaagagcaguaguggcagcaaauacacaggaacuaaggaaagaggccuacaagagcuucauaaccuccauaacuuuaucagcacuguuuuuucccaaauauuuguauuaguacacuguagcugucuucagacacaccagaagagcacaccagauuccauuacagaugguugugagccaccgugugguugcugggaguugaacucaggaccucuagaaaagcagucaguacucuuaacuacugagccaucucuccagcccaggaccaaauuuuuuuuuuuuuuuaaaacaacagugguaagaagccaggcaguggaggcacacgccuuuaaucccagcacuugggaggcagaggcaggcggauuucuaaguuugaggccagccuggucuacagagugaguuccaggacagccaggguuacacagagaaacccugucucaaaaaaccaaaaaccaaccaaagaaacaaauaaacaaacaaaaaaccagugguaagagucacaaucuggucucgagcacgacagacuaguguuuuaccacugacuuuuuaaacuggaaagccugugugacagagaaguggugccgacuaucuguuccaggccccucacaaaccuguaggaagaucugcugcagccucucuaugcaguucuuauaccacggggucaauauacuggucccauccguuucacaucguaccaagugcucggucaagaucaugaugaaacgcuggacaggauguacaaguugaagaagaauuagggggggaaugcuaacuucucaacaaagccaaaccaagaguucucaaaggucuugcugccccacuggacuguggugugcacuccugacuuucaggacugccccaaaacugucaacuuagcaagggagagauuuaacguuaaguccuguagccucuuguagaaaugugccccggccucuguuagugucagucuccguagggacugugcacagggaagaaagcagccgccugagucaccaccauaaggccuacaggagacagaugcugagauggagagcaaacagcucagacucaguggccccaggcugugacacguugucgaauagcagcguugcaaacuaacagccgggcgcccugugcaccucaccuggaagaugacgaggaagagguucuucugcucacucugagcagccuccaccuucuccugcagccuuucuauuugcuccuccagggcaccguccuuccugucacugcuccugucgucgucaucacugcgcugcaaaacaacaagccaguaugugucaucuaccacagaaggggaaugguuaaaaccaucagccccagguucugcuccguggcccaggcuggccugccuccagcucccucgagcugguuuugggggggauggauggguggugcacuagggagggacuuuaucacugagccaugaccuaggccuggggaggauuuuguacuaaagggcuuuuauucccggagugagagcucuggggaaacguggugguguaaaugcuauagugggugaggccuaccaggugucacuaccauggccagcucaggcauuaaacuuaccuuuucccuggguggauauguuccacccauaaccaagaacacucacuacuguacguguggggaucagccagcucucggcuuuccccuacacagucuauuaccaugggaauaaucugucaggucgggacggagacuaacuugucccaccucuccucagccucuccaacugugucucuucuccucugugccagacuuagagauauacaaguuucuucuaggaagccacuuagaggugguaaacuagggaacaguuuguggucaacaucagugccauagcauguggcaguuuuauguaacuuggaaaaagccuagugucacggcaauggcucggacuacccugcagauucugucccaaccugugagcccucaggucggcaggugacuuacucguuugugcugccucgccaguuucucuuuagcuucuucuagcucuuucuggaucuucagaacauguuuguucaucuuacgaauuguagagugcaaaauuucccacacaaacaaccuuaaaguaauacagcauuugguuaauguauguuaugcuacugcagaggaaauaucuacaguuucagccuaucauucuuaggggcugauggggccuucuguccccugggaagaaugaagcagucuuuuccagcaacacuaguucagcccugcggugaauuaugaagcauccgucuccacacauuagucaggcaggcggcucccagggggcaggaccauaaccuguacuuguccaccccuuaauaaaacaccaacauuagaguugguucuccuaccaugugagcucugaggaucaaacccagggaucucagaccauuaggcuugacagcaagcccccugacccucugagccaucuuguuggcccuguaaaaacuuuugaucauaugacacuucaggccucgguauauuucugacaagugugcucugcaaauaguggguguaguggaaaaguuaagacugucacagauuuuauuucauuuguuuucacaauauguuagcccuugcucuuugguccugaucacuauaaagccuguguaacaucacacuguuacuggugauacaguucugguucagaccucguaaagucccgagacagcuccgaugagaagauccaguuugcuacugcugcacagucgacaaucugcguacgaaucaucuuaucaaccagcacagcaaucaucuacgacaaggaagagacaagcaggcacggugguaaacaaugcuaggaaaugaaauagugcggcuaugaaaugugauuucaauggcaagagaauugaccaguuuaagccauagcucgucuuuuuuuucuucuagacacgguuucauauagcuagggcuggccuugaacuccugauuuuccugccauuacuucccaagugcugccauuagucuugauuagacuagucagccuuuagauuuauucugccuucugcuaugcucuaauauuauaagaaaacuauauuaauaauaaagauugcaugaaaagacaacucuugaaugguagcacauacucuuuaagaaaacuuucauugauaauaccucuauaaaaauauauaagccgggcgugguggugcacgccuuuaaucccagcacucgggaggcagaugcaggcggauuucugaauucgaggccagccuggucuacagagugagcuccaggacagccagggcuacacagagaaacccugucucgaaaaacaaaaacaaaaacaaaagaaaaaaaaguauauauauaugucuggcccuacuuaaaaauguuaugggucuuguuuguagaaauggauaaucaugacaacuauuuccuaccaaauauuguggucaaacaauuuucuuccucagcaucuaauauguguggaauugcuuuagcacaaaaccaaucccaaugccaccugaagaauguuaccaagguccggcgagaugacucaauggcuaagacacucgauggcaaguuggacaagccagguucaauacccaggacucaccaugguugaaggagagaacagaccugaaauuuguccucugacuucgcauaggccccgugacccucccaugcaccccuaagcaacagcucaguguaauuuaaaaaucuaccaagaagaauguaucaguuaaguauuuccauaacacccaguguacagacuuaaaaaacauucuacuacuggcagacuccaaucuaccuaaugucauacguguguaucuccauagccaggcccacgucccagugagcaggcguuaccuguggaugguuccuccacacuucaaacaugacucucagcacgugcagcuuccccuuaucacucuccgccagaguuuugaagacuucaugaaaccuuuagacaaaggugcaaaguaccagaguuacucagaagccccuuuagugucacugaauuuaaaauauagcacauaauaaaagacaaagagucaucccuaagcccacacauguguuggaacugcgcccgaggaagcuucaucagcuuaggagagugcucuuuccucauggacucuuaccagauuugcuaucguuacaugccaacccucgggcaggcucucguugcugcuuccucuccugggaaaggcgucaagauaggccggacccucagccuguguagacgacuguccccgggaccuaggcuggcacugcuuuacccaccacaugcacagcuacacugcacacacucaaggaagccaccacaaaccaaaccccacucuagcaaacuauguaagaagaucuucauauuuaacaacuuuaggcaaguuaguacagcacuggugcucaaauguauauacuuacuuugcaagagcacugaaggagugacugaaggacuuggcagcuaagugcagcagagucuggacaaagaccucuauuuucaaaggguuaaaucugaacccuucaucugaaaaauauuuuauaguaagauuuaaaaaaaguuaacugucgggcagugguggugcaugucuauaaucccagcacuugggaggcagagacaagcagauuucugaguucgaggccagccuggucuacagagugaguuccaggacagccagggcuacacagagaaacccugucucgaaaaaacgcccccccccucccaaguuaacuauaguaauucuuuggugcuacaccuuguacugcuaauaacauaugaacauauaauaauguucuaguaaaagcaacaccacacuccugauuucacacauugacaacauaaaacuaaguugggccagccaaggcuacauagcaagaccucaugucaaucccucgugaaaaagcagacccuuaacucucucucaugggagaguucuucuauauagcucaggguuguuuuuauggcaggcucucacuaugcacuguuguuggccaggaaccucaaacuugguuggauuaacaggcuugcacuaccacuccuggcuuaugacccguuugcuuaaaaccaucacacaucccucuuccauauucugauuacgagaugucaaaauguuaaagcaaaaccagcaaaaccuuuaaaccuacagcuuacaacuucugccaagucuaaaccuccuguuaccacagcugacuaacacgucuucagugcacucccaagcaaagggcugucucugcagaccagucaucugcucuuuuugugcaacacagauuuacucaacuaauauuucacaguaugccuucucaaguacugaugcaacucucucaguacuucucuauccaaucacgauuccgguaagccuuuauuucauucugucaauuuuccuauucauaccaggaaaauaaaacaaagcuaagauguuggcugaaauuacacaauacauacuaaguaaagacuaggcagugguaucauaauagcuuacggacuuggagaaaaugucagccauaccccaaauauccaacccacuaagcccccccauucaggaagcccucuuaauauagacagguauaagggagaaauaucuggaaccccugaaugaagaaugugugaauuuauuuguaggguuuauguccuuuuuuugguaacuguguugcuuuugagacaaggucucacuguguaguucugccugaccugaaaucuauuauguaaucuaagcuggcuucuaacucagagacccaccuaccucugccuuccaagucuaaauuaaaggagugcauaucauacucagcauggguuuuauuaauauaagcucuccccaggaauuuuagggccucuuaggugaggggugaaauaugcaggugcucagaauagcuggcagacugugugaccaccaauaggucaccacagagcucgugucaccagagcugugucuaugcuuuaacuuggccugaggcucagcugaagaagucauucucucaccaucaucaucaaccugguuaggguuugguacguccuucagaaugcugaagaucucaucguugguugccuuacuuuuaaaagcaacagauaaacagagugccacggaauguccaggaagagaaucuaagcacagaacagaagggaaggcagaguaagcucagagacucuucuaggagcagcuaaaccaaguuuguuauuuccuuuuaaaacagcauacuucagcccaagaucaguauuuaaaccacguauguuaagacagacaaaagcuucaccuacuuuaaugcuuuuucaucuagacugagagagguuaguuacacucagugucaguacucaugagcgcaccaguccucaggucucccagacauuuuaaauccaaaagcgucuugcucacuuuugccaacaacacuuucuuuuagggcaaaugaguucaaacaaggugaacaucgccaagaugagggcucuguguuuaaacccugcaugcuuacugcugguuaggacuuugugaguaagugcuuaugguauagaauuuauguuaaauuaauauaaagguaucaaagggaaaagaaauguacuuucaaugaaauucagacaaugguaacaagaagggcaauuuugacauaagaucauaagaccugucauaacuaacgucugucacaauaggccacacaaggauaaucauauagcuaauacugugagccugucucuuaaaguagaaggaaauucuaugaaaaccaaacaaaaauuuuuaaaaaucucucucucucucacucacacacacacacacacacacgcacacacgcacgcacacauacauacauacauacacacacacacgcaugcgcaugcgcauaagaaaauaagaacccacugucaaggaauuuacacacuagcuaagaaccaggaaauuuacuucagaaguagacagaaagcauuuuuaugguuuguuaaagguuaacaaauaacuaacuugggccagaccaaggaggaaaagaggaacuagagauaaaaagagcuuucuguaguguggaaggaagaacacuucucagacacagaccuuccuugcagcacagaaugugaggcucaugaauggugacaacauucagugcaaccacaagagcaggguggaaaccugcccucuaccucuguacccgucaccacugcacaccugccaccaggaagcuuaaauggcccaacacaaaaagaccacagcaauuccagcacgccugauucauggugcaaucccucaacccauggggcuaaacgcugaaagccaugaugacaaauuuacuucuagaagcagacugccaagugcccaggggucccagcauaaggugugcuggagggggucucgugucaacuugacacaagcuacuuaucugaaaggagggaacacccauugagaacagguuccuuaaggcucaacuguagcucuugcucucuuccaucucucuucccucuuguccccuugcucccccucucuccccacccaccccuccacauggccauggccgaccucacuuaucuacucucucucuuucucucugccuuucucugccucugcuacucucuuaacuccccuccccaugcccuaaauaaacucuauucucuacuaaaaaaaauaaaaaaagacucggccguaggggauuuuuuaaauuagugauugaugugggagagcccagcccacuguggguggccccaccccugggauggugguccugaauucuacauggaaacagggucagcaagccaggggaggaagccaguaagcagcggcccuccauggccucuggccugccugaguucucauuuccuuuggugaugaacacauggaguauaaaccaaauaaacccuucccucagcgugcuguggccacggcgcuccaacacagcaacaucagugcuaaccaggacaagaaugagaaccaguucaagaagucuccaucauaacaaauggacacuuucaguuuuaguacauuccaggaaagaaguccucuuacuacucuuugugcuguauuaaaaaugucauguaaaaacacugugaacaauacaaaauagaagaaaccuaaaagcuaacaauaacaacaaaaucuuuaaucuaguggcuaauaugggucauuuuuucaaauacagaaauaaaucuguuucuccuccuacaaacagccagcuccagagcacgcacaggucaguacuuuuuaaggagagagacuugucgauucauuacuuacugcuacuuucaucuccauacuuguaaaugcagguuggguuugcaggacacagagcugagaaggugggaggaacaauaucuaauauauguugaugguaagacaaccuacaacacaaauaagagccucagaaaagucucauguuucagucuuugguaauacucaacuugcccagaaagccagaauccaagaucccaaacucagugaacaacuaagaggcaaaugggaacaguccuucacgccuuugaguaaguuagcauaggugagcucaggccuguucagacacuggcucugcaguauggguucugggaccggugagagacagaagugagagcggguugggugcaggucagauggcauggcugggagguuggaugugacacagcaaagcauaaaugggagauugcccugccugacggagcauuacacagaauuuccuauguuggguuggaugugaaaagagggauauaccacacaaguauacacacagugucuucccaaaggccucaacccaacuaccccuuaaaaaauacacauugagagcuuagaucacaguuccccaaaacacucuauuaauuacaaacuaagggcucuguaaauagguggcuuuaggagaaggcuaggaaaacacaaauuagauaaaaacucaaguuuaaaaaguaaaaugcucaucaauguugggggacauagacaagaaucucauuggccuaauucacauaaaauccagaugguacagcugacuaacuguacccuaaaucuugauucaaaagugaggugggagauggacaaacaccaggacuuaagaaaaaauauguggacaugcaccacaaacaagugcaaaacagaggagagagaaauuaggcugagagcuaaaccaagaagaaaagcgccaagagcuuaccucaugcacuucucuagaacuucccuuacaaacuuugguuugggacuuucaagauccugaguaagacaaucugaccuagggaggaaaucuggauuuauuaaguuaauaugcauaaucuucuguagacauaucuucauuuccuggcuuacacuagggucuuucuaccuuuuaucucaucaaaacaucauaacuaaauaucaaugaaauaaauacuugagacaacagacuauuuuacuuaaaagugaguuuuacaggcuggugagauggcucagugauuaguacuggaugucuuccagagguccugaguucaauucccagaacccacaaugguggccaaugaccaucuauaaagggaucugaugcucucuucuggugugcagguguucaugcagacagagcacucacagaauuucaaauacuaagguccauaagcugcacacaugaccgugacaugcacaggcagagagagcagaggacagccuugggugcugcuccccugggcacccacuaggcccagaacuuacccuuuagguuaggguggcuggccagugagcuucagggaccugucaguauaucugggauuagaacccgcgucucacuggguaguucugguagucuggaacuuacuauguaguuggccagccuccaacucauggagguggagagaugggcgugccucugcuuccugagugcaggaauuaaaggugugugcaaccacacaggguuuuuuaacaugggcucuggagaucaaaaguugggucuuuauguuugaguagcaagcacuuuacugacugagcaaucuccaguuguuuugaauaaggaaggauaaaacauuacacuuaccaaucuucccagcuccaacggaauugaaaauuacuuagaugaugagaaaaccaauuaauaaaccuacaauggggaguggagcagggagaagagaaaaugaagagugcaauuuagaccauaguuuauaaaauccauuauacagcucaauugucuaggugcauaccccauuacccauagcuucuuuaacuguuuucucagcaaagccucugacucccuguccugugucccagauaucucaucucucacaauggggcucccuuuuauucuuguuagagaacagcuaugauuuaaggucauguuuugugcaaaauacauaauuuucaaagcuaugaaggagaauauuauguuucccauguaacuguugaugaaauggaaguaguuaaaaaaauaaauuguaguuaaauguuuacaaauaauuuccaaauggcagaaucagaguaagcgucucauguuuugcugggacuugagccugggucccugggugagcagccagugcucuuaaccgcugagcucuuaguuucaccagcucuuagucucucauacuuaaaccacgaccuuauagaaguauaacuacuucuucauuucuguguuuacauugugugugugugugucuguguguggacagauguauguauguauguauguauguauguauguauguauggugugcaugcagugccagcggccagauggguaugggaucuucuggagcuucuacagggguuguaaagcuuugggaugugggugcugggaaccaaauucagguccucuggaagagcagcaagcaccuuaauugcugagccucucagagcccacuccaaccuuuucacaacagcuuauaugccugaagcuccucacuuaaaaauacacucagcucucaagacaggaaacaucuuaguguguuaaauagugcuaugaagaccaucuaaguacucaaauuuacagaauugguauucaaaguagagacacuggaagacacuuucuuaaagcacuucccucaaaacucugaucucaagucauuugaaauguuucaaggucauggauggagacgguucucacugauaauuuuuaagauaaaauauuugauaagagauacagauauuagauaaauguuuaguuuuuguucugaccggacuugggaaauggacagaagaaaaaaccaguaaaggcagucacagagacuuuccccaaaaggaaauaaugaucauggaacgaccucgcucuaacaaucccaagacagguuuuauucauugauuuaauuuaaaaugagauuuuacagucucaggcuugaagauacuucucuguacuuucaaaacagacuaucuauaaauaaauguuuaucuacaauaaaugcauuguaagauuuaucauucaaaguaagcucaucuuaaggacuugcauaugcaauuaagcagaaaaaguuaaugcaauuaugaaagagaagcaagcauggcgccaccagccugacacggagccgacuguggugcccuaacaagagcugcuacuacacacggggucucagaaagcagggaaggaacaacuuggaaauccuuggcagucuuccgaagauuccuacaggcgcuaacauagccguccauaccugucaacacacgugguacucaucguguccagacgcauguacagcaucucagucgccugcgcaagcugugauagggagguaaggaaaacgacuucccacucuccuuuaagaaaaugugaugggagagaugagaaaugaaacccagccucugggucucuccuaaggacaguaagugucuuucacccuuccacauaacucauuucaguuuucagguuucagcugucgaugauggacagcaucccugacuucagcuguugaugauggacaggaccccugacuguuccuuuguaugcaucccucagccauuugagaucccuccccaagcauacacccaucuuuugucaugaacaaaucuuauauuuuuccaaaauuuuacaaaaauaguaccauguucuguaaauccguucuuuccuuuaaccuacacuguucacuacguuaaaaacaagucuuuuuuguugcugaacggaauauuaccauugcgaggaaacaaaacuuguuuauccauucauguauuguuggacacucaaguuauuucugauuuggaaauaucacaaauacaauuucuauaaguaccaugcccaauucuaucucuaaaaauucaucccauccuuaagaaugaaaaccacuaucacaacaaaaacaaacaaaaauucuucuaaaaucuguagugaucacuagcagcaaacucucucugaaaacaaaaauuccacaugaaauaacuggagauggacguucaugauguacaaaaagaaacagacaccuggggugguagguauauaugcaucuaaauggucucauguacagaauauuuuucuuucaaaugccaaaaagauuuaaaaaaaaaaaaacuugaaauuggaguauuuucugaucuuuuuauuaucugaaaggaaggucagaaauuaagacugagaggcagguagaaugaaguuauaagacaaaaaaaaauguagugaaaaaacuuuuucauaaccuaagagagacaguaaaaaaaaaaaaaauuaaaagggguauggccaacagggugcugugaaaugaguggagguaagaacaaugguuuacgaggcacacgagaaagcuguaaggaaaacgacccuaagcacaaggaagcucuugaugcuuaccacugaaggucaacagcaucacggaugcacgugggagcggaggaggagacuguaagggacacacagacacacacacacacagacacacacacacagacacacacacacagacacacacacacacagacacacacuguuacagacacggaacuacuuauucaaaucaugcaacuuaucuaaggagcuuauagaaggcccgagguccugaaaguacagaauauacacucucuucaugaaacuauucuuuuaaaaggcaaaugaauagcuggacauggccucaaacccuaaucccagcgccuggagucugaggccguccugggcuagaguaaggcccugccugucucagaagacaagcaaaagguaacaccagcauuauuagugugucgugagaguaacaggauccuacugaggagaagaaagcagcuuuuaagucccaacaccacauucuguguuaagcagagagagauguuguauguuaacgucacaaacauucauuuuguucaacguguuauuuacuuaaaaacaaagcaaaugaaaccauuaccccuaaaacccaaagcacaggaacaugaaggugaaccugagagccugagaaaaaaauagcuccuacugcaaucuuuuaaaagcacagccaaagcagguacacuuaaaaccauaaaaggauaccacuuggggcagcgagcccggcugaaguuugcacaguucgauuagcaguguaguguacaucacgucaaugugaggaggcgcuggaagcugaaacagcucugcaaagaucaccugggaaacaacccagagucagaaaccuacaccucaguuaucuuugcauuucuacauuagaaagaccuacacauuacaauccaaccacaaacuccacgucaccuacaagggaaaaggaacuaccuuuaauucgagaccuacaacugaauaacaugaacaucccccuuucuacaccaagagucugcuagaggcaggcugcugugaccuacagugcugacacaaaugcacaagagucuauccuugaagucucagaguugacugagggaggcgcuacaucgaggggcucaaucaguggagcugcauaccugugggcaaugcaaacucuugguggaccagagauggagacagcugagugucuaugcggcuacucacaccagaccucagaucuuuuggggagguuauuuccuaccccuucuuccuaacacccuagucugcacucuuuccacuuaguggaugaugaauucuacgcauuuucagauuuaaaaauagugugguggcacaugccugagucccagcaacucaggagaauaaggcaggagggccaugagucccggaucagguugggugauauggugacacccagucuuuuguauuuugagacaggguuuuuucuguguacccuugcuguccuguacuuccuuuguagaccaggcuggucaaaaaaaaaaaaaaaaaaaaaaucaagagaucccccugccucugccucccaagugcuuggaguaaaggcguguggcacuucaaagagagagagagagagagagagagagagagagagagagagagagagagagagagagagagaaagauaaagaggcagcugaggcuagcaagaugacccaacagguaauggcucugagucccacucuccuuucuuucuuccuuuccuagcaaggcugacugagaaccaaagcugcuggccacuuccuuacccccucuguucauucucagagcccgaugaauaccgggaaagugaggcucagcaccccauggcaugcguaccuccacuaugugguaguucaaggggaucuuguucuucccuggauagcucaccagcugggcagcgcuguaaaaagugauguaaguuaguaagucuacaaagguacaugaaacccaacaggccuaaauauagugaacugagaugaaaaaauucuccgcuguaauguucuaguuauuuauuaacauggcgugaauugucuuacacacaaaauggaaacaaaguaauaauaccagcaccuuccaaucuacugaccuaggugcuccacuccuaaauacauuucuccucaaagucuaagccaaaacuuuccagcccuaugaaaauuuauuaacacuuagguuucuaaaugcuagaaaacagaaaaacaaaaacaaaaacagauauaguaugcuuuaauuuccacacauccaaauaaaaccagccuacucuucaauuguagcuuauuugguguguguggguguguguguaggacuguucagaggucaagaguccugucuucugcaagugcuucucacuacaucugggcuucagggacuggagagauggcucagcaguuaagaggacuggcugcucuuccagaggacccaggcuccacuccagcacccacuuggcagcucacaacggucuguaaccccauuuccagaugauucaaagcucucuuauggccuuugagagcaccggaugcacaucugguauacagcuauacaugcauggaaaauacccauacacauagaaaaauauuucaaacaaaauaccuggggugcgcaggcuggccugacuggugggacagcagccucuggggacacuccugcaucaguguuuccagaacugagcuaacgcugagugcccacaccugacuguuacguggguaccucaacgcugggccucaugcuugcuaggcuaucucaacacauagucuauucuuaugaaagaaccacggugccuuccuacccccuuuagaguacugcagagggaccuuaccaagucuuccuuuccuuccaguaggacuugaugaugcagugaagauucuccucgaugacaaaccucuccaccgaauggcucccuggcauaacagggcccuggaaaaaagaucaaguguacucacacgcacaaccacaaaacagauuucuuucauuuauucaauaaacacuugcgacuguugugcuaaauaacuaccacagaucgaguguauagugcuccugagauaucuguaaugacaccagaaccauuuuacaauuuuauuuaaaaagcuccaucacugucuguaugucguccaucuaucaucuauccaugcauuguguaugggugugugccauggugcucugguggagagcagagaacacuuguggguaacuggcucucuuuccuaugggggucuggcaacaaugauggagcucuggggucagguuucauggcccaugcuuuuauccacggaagcaucacccacucucuaaauuuaauaaacacuuguaaaagacacuau

SEQ ID NO: 1885 - RNA, 2879 nt, Mus musculus
uacuuuuugaucacuguauuagacaagcuuuauggauuuuccuuauuccugagucccagugacacggaggccuuuuugaagauugaugucuuuugaguucauuucuuguuugagugaaacaugcuuuucaagaauauguuugagcugggcagugguggcgcacgccuuuagucccagcacuugggaggcagaggcaggcggauuucugaguuucaggacagccagagcuacgcagagaaacccugucucgagaaaaaaaaaaaaagaaaauguuagagguggcuucgagagugagugccugccauuaccugcuucugcugaugagcccgugaguucugggugcucggugugcagugugccgccaacuuuaacugugguucuuguugauucguucacucuagcacuugguggauauguuccuguccugacuaggccacagagggcugaguggaguagacuguagaguagaaacgaggagcucagaacagagaggagacaaagcaagucuaaaggcuuuuaguuggaaagaauugggacaugguuccucuugaugcacagcgaagcugacgcaaagcuuucuucuuuaugggaagguaagcaauuauauucaccugcucucaacaguuuuguauauuuuuuuauuuuuaugguagucauuguaauguggagguugcuacagagaaaggugugaauacuguaaagcacauccagacaagguuccacaucuccgagcuggaggguaacuguguucccaagggugcaccacccagcagcagacaagagccccgaccuggugcccuacacaggaguuuuggucugcaggcuuuuuugccucaaauaaggugggaauguggguguuucuugcauguuacaugcgcucaguacuagagguuuuccuccuagaagcuagucagugggcuucguuaguaugacuguccccaccucugcaaggggcaggaaggacaucaucccguuuugaggucccuugugaauuuguggacacugaccugucccauggauaugcaugugacacugaggaccuucucugagcaaccugugacguguaaguccagccuguuaguuuauggagcaugagcugagaucaaaacuucguguugucuuucuuuguaaucuauuuccuccagggaacgggccccaccugcuuuuccaucccgcacauagagguguugggucuccuuaccuagcucuguaguaggucucccucagaagcagcagcagcagcagcagcagcagcagcagcagcagcagcagcacuggguuccuuugacugcagacugucucuugcaauguguagucuaaaaacaaacucugaaguggauugaguuuucacugcaacaagcauuuuggggaaaucuuucugggugaacauuguaagcagucccugaggcucucuuuccaggagguguagucuacugccaacaagacuaggaggcagcaagagggcgagccacucaccacuuuguuguccagccucccuuaggcuccaguuuugugcagcacacgcaccccaguuccuugccccaggucugcuagaccuggcccacuuuugcacacucacuaacaguuuuacucacacuccacagaagacaguugauugcuacucucccgaguguuguggaaccaacaaaccuuugaaagauuggggggggggggcagugaaauggcucaguggguaaaugugcuugcugccaauccuaauucccugaguuugguccccagaagaacccacugguggaaggagagagcuuacuccugcuaagauguccugauuucaauacaugugcaccauugugauccgcaugcacacacauguauaccccccacauguauguguguguguguauauacacacuccccgcccaaguguuggcauuuggccaucucuaaccuuucacacuugcaugcacuuuauuaagcccugaguuauuugcaaacacugugauuccuucaaaucuuugugugccugagaacuuuucucuguaacuaaaagcugaucauaauugagacucuuaaaaggugacuaugaaagccgggcgugguggcacacaccuuuaaucccugcacucgggaggcagaggcaggcggauuucugaguucaagaccagccuggucuacaaagugaguuccaggacagccagggcuacacagagaaacccugucuugaaaaacaaaaaaaaaaagugauuaugaaaauguuucucauguguuguuccugugucuccccucauucccaucugcuggggugucgccuuuaauguugccccucagcucuucucuuuugcucuuggacuguucagcaucuuguuucugcuccgugagacucaggcugauugcuugugggaaaaauacuucuuaggagauaaaggacacacaugagagcugcugcccauccuugagggagcugauagucuccacugaaguccuuccuuucuguaccuaacacacacaacaucggguguuuuacucagugcuucuaguauacgcagacgucuuagcugagagcuguuuguggcauauaaauaggggauguuuguguugaaacagcuuuucuuugggcucuacucuuguuuucucaggacaagguucauguagucucggacuuguaacagucuucuugcuccugcccccuaagugcuagaauuauagauguccaucucuaugccuguuuuauuuuuaaauuggaauuauauagcuggaacauguuauguagaccaggcugaccuccaauccacagggaucuaccugccugucaggugcugagacuaaagccaugggcucucaugccuggccuuugcuuugguuuugcagagcacagguuggacugaccuguggauuccagucaggccauggagugcaag

SEQ ID NO: 1886 - RNA, 3108 nt, Mus musculus
aggaggugcggaucuccuucagcucgagugccgggccgccuggucgucauggacgaggucguggcugaagagcucgaugaugaggagcagcuggugagaaggcaucagaaggagaagaaggagcugcaagcuaaaauucagggaaugaagaacgcuguucccaaaaacgacaaaaagaggaggaagcagcucacagaagauguugcuaaauuggaaagagaaauggagcaaaaacacagggaagaacuggagcaauugaagcaauugacuuucaaggacaguaagacagauucuguugcuguuaacauuucaaauuugguacuugagaaucaaccaccucggauuucaaaagcacaaaagagaugggaaaagaaggcugcauuggaaaaggagcgggaagaaaggauagcagaggcugaaauugagaacuuaucuggagccagacaucuugagagugaaaaacuugcucaaauauuggcagccagagaauuggaaauuaaacagauuccaucugauggucauuguauguauggagcacuugaggaucagcugagagaacaagacugugcacugacuguggcuucccugaggaggcagacugcugaguacaugcaaagccauucagaugacuuccugccguuucuaacaaaccccagcacaguacacaccagaagaguuugggaaguacugugacaauauugugaacacaguggcauggggcggucagcucgagcuaagagcuuugucucacaucuuacaaacaccaaucaagauacuacaggcagaugcuccuccuauuauagucggugaagaauauccgaggaauccauuaguacuaguauacaugaggcaugcguauggcuuaggagaacauuauaauucuguuacacgguuggugaacucagcuacugaaaauugcagcuaguuuacaaaauguuacgcuguuuuuauagagugugucaaucuaccaagugcuagauuguuguaaaugcuacugaagaacacagcuaccuuacacgaguuuuaugaauaagcuuccuaacagcuuuaagaaacacguuggauuaacuuuaaccagugcucucucaguggcaguuuuagaacuuaaagucuauuguggaggacgucgucaucacacaccaagguguuacucuuccugcuaauuauuuuuuagguguccugcucauucugguuuggaauaaauuuuguuuuagauuuuggccccccagcuuuauguuccaaaaaugaagauuucaauuuaauuuuucuuaaaaguguggagacucggucucugucaucauaagaacauauugucgugacagcagcuuuaucagccuuauaaagugcuggugaucccagugaccuugguguuacuaggaucaggagugcgccgcuuuuuaucagcacaucucugcugcuaagaggaaacuacuucaguaguuaagaauuuuugaauacuuauaugagaaucaguauaaagaaaugaaugaaaucagcgguaaacagguguuaauuguaucaguuuugaaucuuucuaacaaauuggagauuucccuuuuauguauguguagcuuccuaaguuuguaacuccugcauugcugguuuuucagccagagacuggagucaggguugaaccuuguuucucuucaacugagaauuuguauccuugccccaacacuacucagcugcuuugcuuucucuggagccuuuccuacugagaggcauccaguggccucucacugcucaccugugcaaggugaugcugaaguaaugcagaaagggagggccauggccacacucgcuuguuaagucuucccccuuccagcuguccuaacaagaccucugcuugugcucacuuucuaggauucaaugaaaacccuggcuacacauuauuuuguuacauaauguaucacuuguuuucacucaaguguuugauuauuauauuuuauguauagcaagaguugaaggucgcagaagcagagagcugugugguaaaaucaguacagaaggauuuuauguggaaugacucguguuacucagauuuucaaucacuucgagaaguauucuuuguaacagagcugugcccacacacaagucuguuugcuguucuuauguaacaaagugccaugggauggggacacagcucuagcagagcacuugccugccaugugugaggcucaagguucaguuucuagcaccaacaaaacacaacaauuuaugaaaaugaaacguuuuguugcaaucuguuuuuuuccaacuuagaacuacaacuaaguagagcaucauguguauaauaucugggcuuuugacccguguauacugucuaugaguaaacacugggcuuaugauguuaaaagcagguaauaguguggcaggcuggcagagacugcucagcagagcacggacuuucugagaucauuccagcugacuaaaacauacucugccugcuauacaguauauucugaagggugucugcuuuguaacuuuugauucuuuuuuauucugaaauuuauaaaaacauaaaguuguaaaauaaaugcuuugaaccuauuuugaaguaauguuaucuucaucuuauaguaucagucuuaaggaguaauaaaacaaaacauuaugaaacaguuauugaaaauuccauuuucaacaaagauacucuaaaguaacucauuaauguuuuguuguuuugacaaggacucaaauguacuuaauuauguauuucuaauuuuuguuuauguuuuauuuuaaaauggccaguauauuuaugaauaaaauguauggcccacuucuaccauuuuagugauaaauugaaaagucuuuuaaaaacgguagguguuaauuuaagaaccauguaugcaaauuaaauuugcugcugguggucugauggaacuuccacaagcuuucuuuagucuugauuaaaaacauuuauaucaaaauucuagaaugugucuucagccaagaauuuuaucuacuuacauauauuuauagccuguaaaaaguaaaacaaagaauguguaacuguugugagcaagauagcuuugcucauaauaucugauguuuaccaagagaauaaaugauaaaggaguugaaucaaaaaaaaaaaaagaauau

SEQ ID NO: 1887 - RNA, 12955 nt, Mus musculus
cggaaaucagcguugggcgcgcggacgacucagcggccuguaaccaugcgcggcuuggagaagcagggcucgugugcuacggcggccccaugugggugcguucagccggcccuggaggcagguaacguuauggaaaaagguggcgccgcacccuaagcuaggcggcccgcuucccuggccagaagaacgcgagccaccugacguacauucuuguccuugccgccaaaguaagggucacgugucucgacgaccacgugacaugcuaaggcuaacgggagugacguauuaggaucuugguacacgggguguggucugggcuuaguuucaguacaguagcugcgucggccacguguguaguguggucuuuuuccguaggggguuacaggaaggugggaugugugugacugaugcccucauuugguccaaguuucuucgccuuuaaucuuuucccaccaguacauggaugaggauuuaaaaacaaaacccccaaacaaacaaaaacuauacaguaguaauuguaaauauucuuggagaaaacgucaaaguugucagaagcgcacacaauauagauggagagagaaaggcaguuuauauagauaauuuacaggguggugucagcuuuuauagaauucaaaauguauuguuuaggcucgaaaguacauaugauaagaucucuuucugaaaggaaguaaacgaugauaaagaucagauugcagcuccuggaagcagucgacagagaugcaagaaguggcacugaggucuuuggaguggcuggcagguguauuaugcuuuaacuuacauacauacuauauguguauguauguauauauauauauauauauauauauauauauauauauauauauauauucuuuuccccccucuguauaagaguauuuuugucuccacacuccuacccuggagacaggauuuuucugugaagccccggcuggccugugcucacucuguagaccaggcuguccucuuguugguuuagagcuuugagguaaugaauuagaaccucuaagaaucuccacuuugugcugcccucuucuuguggcaggaaggguucuggguauaccugagcuacaccuaaagacuuuaaaaaaaaaaaaauuguguguucguagcucuggcuuaccuccaacucagggaucugccugccucugucucccaaggauuuaaaauaggucuaauacaucacaacaguaaaaagaguuuguauaagcaaaaagcaaggaaacauauugugagaguuagugcuagaucuuacugguugugcuaauaagauauaauaggauagauagguuugaugcaaauuaaauaaaauggagaucuggagugucccuauaaagaacauaaaaagaaauaauuauaaauuauaguuuauacugcauaauauacaaucaacacauguauuaauauaauuuaugaauuuuuaugacuauaaguaaaaauugagguggguaugcuggugcacaguugugaucccagcaguuaggggauggggcuaaugcuggagguguauacguuugaggcuggcaugaguuacauagcaggacuuuauuuaaacaugauuuuaauaguuguguuguaccuagauuuuagaacuaugaagucaauacugagaggaaaacauguuuucuuaccucuuggacccuuugaguaaugauucucauccaguuuucuuccauagggaaucuuuuaacugagccaauaggguacuuggaaucauguuucccagccaagauuggcacuccaaggcagccauccaucuguagccacuccagagccuguuugaagaucagaaagaacaucuuuaauaacccugagcauuccuugaugggccuagaagaguuuucucauguuugguaagucguuuucugguuagaaguggcagcucgggcccugagagagugugacaaaugaaggcagcuuugagguuugucagcuauaccacccucgucuauauauauggauuauguauggauucccauauucaauuugugcauuugauuguuugcauacuuggacaccauuaggaauuugugauucacugacggaacauguuuuaauacugcuuguuuuaauuaugacgucucucuucuguuuagcuuuaacuaaacaccuccuugauucugccugugggucauuaugcuggucucuagaacaagacucagcagacuguggucuguggacgacacauggucuauugcuuacauuauacauuuaugggaucacagcugugccgacuguagcagcauucuguguauuuucuguggcauaccuauugguuuacguauuguguguggcuaccaguguaaaacucugcuccauuugcagaauaguugaaacagugacuggcuggccacaaauccuaaaauauuaaucauucgaccuuuuacagaagaaguucaugggccuuguuguaggcccuugaagaauucuguguacucuuccuaaaagacaaaaaaaaaagccuuagaaauuuggauacuucuugcugucaucaggaauucuguuucuguccauguuuaccuugucacagggaaguacagugcuguuuuuaguuuaucuucuuaauuacuauuggcucaugcuagcuguuugauggcuccuguguaaguugcauguucuuguucuuugcugugaguccuuugaguugaguucuuggugacuuaugugaggaugacuuauauaucgucaauauuggcugacucacuguguauagugaacauuuccuagaccugaauuuaaugguuuaaugaauucagcacuguuacuguuuucccucaugcuucuggcuuucauauucuguuuagaaaggccucuguuaaguugaacuuuucugaacuucaauuucuuuacccuuagagugagggcuaaguuguacuuccuauugcuaagguacaaaauggguaugaaaaugucuaguauacuacauggaaacagcagccacuuagaagcagugugucaagucuguuaaguuccuacuguaugccggucauuguguuggguacaaagaauguggaggugaaggggggagggccuauuuucuuuugacugauaaccuuaauaagaacuguucuuccuguucauuagugggagaucacagucccuucucaaaucauuauacaaaaauaauuugucccuuuguuaaauaaguguuuugguuuguuuucaauaggauuuuguuuguuuuucacaaaaauggccauuugaacuacaaggcaaaagugcagccgcccaggcugaauggggcaaagacuggaguguucuccacacggagcccucaucgcccuaaugccauagggcugacgcuggccaagcuggagaagguggaagguaacucucucucuuugucuuugucuuacuccgggaaaagucggcuggcauucucugcuagcugcugcucaugccuacacuguccaugucgccuuugagugcccccagcccuuaggaacgugugaugauugagggcgucagccagcauuggagacacuuaggaaacacugcagacaggccugugaaagaugcucagggccuaguuuaucauuccacucuaaaaaccagugcuguuuuuaagaacucauagguuuuauaagcauuagauuaguaaaaagauugcuuaagacuugggauguaggaaauacaagaugauuaaauuauacuggcuauuuucagguaugaugcauagugccuaguuguuggugcauuucuggaaagcagaacaaagguguccuuacuucuugcaagcugaaaggagagacauuugagcuacagugcaggccaucagcugugcugugugcuggugaccugggauagaauuacauuguaggccuuagcaaugucaggauuacacuguaggccuuagcaaugucaggauguagaagugccacagcagaauacuggauugguuuuaacuauguucuuguauaaccuagucagauguuuucagagagcuucuauuuguuuguuguugguuugguuugguuuuuuuauuguuuuugguccagggucuuuuguauucagguuggccuugaaauccauauagaaccgaagaugaccuuaaacuucugaccuccuuccucuaccuuccgagugcuguuauuacaagagcaggucacaacagucaguuuauguggcgcuguggguugaacggagggcuuugugcauaguaggaaagcacucugccaacugaguuccacccaaagaacuucucacuacauuuuuguuagagaggcagaaggugagagcauggggguaggaguggagagccuauuccaggcugcaucuccauugcuugcuugugagcagaagcaugaauugccucuuggucucuaaagggauuuugcugagggucuuacaugacagguucucaauguuccucagggcuguuuuguucuguuugggcccuguacacugcuaaauugugcucaguuguuaggugaguuguccagcaaauuuaguugcucauccaccugcuuuugucaagguggcuuaucaaauugaacaauagcauuuaggacauuuucugaucauucaugcaaauggcauuuuuuuauuggauauuuucuuuauuuacauuucaaauguuaucccguuuccugguuucccucccuucugaaacccccuaucccauucucccucccacugcuucuaugaggguguuccuccacccauccacacacuccuaccucccugcccuugauuccccuacacuggggcaucuaucaagccuucauaggacuaaggaccacuccucccauugaugcaugacaaggccagcaaacagcauguuuugauuacuuuuuuauugcugugauaagacacuaugacuaagucaauuuauaaaagucaauguuuacucagggauuacaguuuccaaagauuaauuacaguccauaauuaucaugguggagagcauuucugugggcaggcuugggguaguagcugagugcuuacuucuugauccaaaugcaugaaguggagagagauaacuuugagauuucaaagcccaacccaaugacauaccuucuccagcaagaccugucuccuaauccuuucuaaacagucccaccagcuagggacuaaguauuuggauccacaaaccuuuggagccuguuugaacucagaccaccacacugcacuuuuuuuuuuuuuaaaucauugacuuugugccaggucuuguaaaugguagagauacauuggugauuaacucaaauaaaaauuccugcuuauacagaacuuagccuucuguugagggagaugagaucaggaaagugaaugggcgaacaguaaucaauaaugaauaauguagggguggaaauagagugcuucuuuuuauaccuaucauaaaaggucaugagccugucaguccuguguuagaaggucauaauaaauguuguucaugcacagggacaaauaauagcaugagccaugaacacuguaggaguuucucaugaacucucagguucuccuuuguauucagucauuuaaauagcgcagggucaucuuuccaaaguucuagguuugcacacagcaugucuaauaucuggguauucaugcaaucauguuuuucuuaaguagagucagagucagugugagcacacgauguguuuugguuuuuguucagccaguguucccagagucaggauaguccuguaccaguagcaggaugugcacaacaccuauccaagugggacagcaggagaccuuaauauuuagucauagggccuugugcccugaugacuuuuugaaccuuuuuuuuuuuaagauuuauuuauuuauuauauguaaguacacuguagcugucuucagacacaccagaagagggcaucuucagacacaccagaucucauuacagaugguugugagccaccauguaguugcugggauuuaacucaggaccccuggaagagcagucagugcucuuaacugcugagccaucucuccagccugacuuuuugggucuuuauggacauuucuuggucuguauuaacagaaaugauucaaagcguauccguuuauagacagaacacauugaugauguguuuaaaaccuugcuauuuuuccaggggccaacugaaugggcucaucuuugccgcuccucuucugugagguuguuugucagaguucaguuccucauagauguaggguugaggaucucagcuuucugcugguauuggcuggaaacacccucagguccuaaagcugcccauauuucuaggacaucuuauggcugcuugccaccugggcuuccccacugcgccugugcaguucaucagucugcagggagaguucauuggguugagucuguggucagcgaggaguccuauauggaacucaucauagagcucuuugccauguucgguggcuuagauguaaguugaacucagagaaggggucgcacggggaaugagcagcaaauuggggaaugucggaccuucugaagucugcuugccacuguggaaaugcacguuggucuuggugacacacugaggacugacgugugcgguguccucugugagacccagaagaaaaagagccaggaagauuuguaaaugacguguucuaugagagccuugaagaguaguaguuugguagauggagauguggguuugcagucaguaagggggggcucauugaggucaagguagguguuugagagagacuuaggggauaauccugcccuccauuugccuuucucaucauccacuguagacccauaagaggaucucugucucccuuuagguggagcugucuaccugucuggaguugacaugauagacggcacaccugugcuagacauaaagcccuacauugcugacuacgacucaccacagaaccucaguguacacaaugaccaccauaagcugagggcugaggcccagguugauggcacggccaacaguugugaccagcugcugcucucagggcgugggaaaguacagccucgccagagcaccaaggagagaccgaaaugccuugaagacaggaccucaggagaaaacucucagaaguccagagacaugucagaaauccagcacacuuugccagaagacagagagagagcguuggaucuggcacuggaaccaagccgaggugagagcauggauaugcccgaaaaucagcuuggcccaccggaacugaagagcuuucuggaagaaggcacagauagaccaaggaaaguagaaggugccuugguccugccggggagcagugcagaaacacagugggaugcuuccuaccgugccaggacagcugacagagugcccuacaguguuguccccagcugggugacagaggcuccuguagccccuuuacaaguccgguuuacuccucacgcagagauggaucugaggaagcucaauucaggaggugaguguggguacccuggguguguguguguuagcuacagacccaguuaaaugaugggcuugucuuuauaacgaaucucgucacgguugacacuggugaaagcguuuauauauguggaguacuugucauggcugggcuuugaggagcaggugaugaacucugggugcacuggcacuggugcuuucccuugaggacgguuuagguggugaugaguccgggugcucgcucagaaggcgucuguggagaguggcugcugccugaggacgugucccuugacuuggcccuucucuuucauuuaauauuuauuugauuauuuaaaucauguguaugcauguguaucugucuagggauauguagaggucagaggaggcuuuguaucucuuagagcuggaguuacaggcauaugagcugcccaacauggguacuaaaaaccuaauucagguccuuuguaugagcagccaguguucuuaaccguugggccacaucuccagcucugcuugccaucucuguucuuuuuuugaauagcaguggcuugugcuuggucuauacuuggacgcacucaauuucuuacuugcuucccuaucuagccaaagagguaucuguuuuauucugucagggcccccuaggaucucacagcacagaagacccuccugccauagugcuuuccccaccggcaggcacuuccugccaaagaagggucacaggaccuguuguggagcguauuuaacacacgguucuuagcauguguuuccccaguccacagcagauggagaaugaaggaagcugcuggcuguugagaggugggaaugaggaugcuagcaaguagcugguuuccaaggagaugacagauauccaaaggguugagagccguucuuguguuacuugucaguaaacagccagcaugaccauagcaagagggacaugcgcuguuuacugugcaguucuuccccagcuucuccagcacuguucuggccuuagggagaaacagcagugagaaaaggggaucagaaaaccccugcccuggucuacggagcuugcuuucuaauaggugaagagacgaaagcucagguauaggaagucagcacacugcugugcaaaguacacagaaacacugucaggaggugaugguggcacaggacauagcaaagaaaagggcaaugucagcaaguuacauuuagaaauagaugcggucuuaguuaggguuugcugcugugaacagacaccaugaccaaggcaagucuuaauaaggacaacguuuaauuggggcuggcuuacagguucagaggcucaguucauuaucaaggugggaguauggcagcguccaggcagauauagggcuguaagagcugagaguucuacaucuucaucugaaggcugcuaggagaagacuggcuucuaggcagcuaggaagaggaacuuaaagcccacacccacagugacacaccuacuccaaggcuacaccuccauauagugccacucucugggccaaacgaauucggacaacuccagcuugucuugccuguuuuggaggccuauguaaaauacacagcguuuguuauuuuggagguguacauauuaacucuaaugacaguaaauacuugaugaaggugaucgucucugaaaugaguagguuuccagacccucuucuuuuaugugaggugcagaccgaacacuuuacaugcugaagcucauugauccgaguuugaccugcgugguuguaauggcaggcuucuucuuucuccucgcagaugcuagucagccgucauuuaaguacuuccacuccgcagaggaagccaagcgugccauugaggcugugcugucagcagauccucggucuguguaccgccggaagcucugcgaggaccgccuuuucuucuucacuguggacacagcacaugucaccugcugguuuggugauggcuucgcagagguugugaggauuaaacuggcuucugagucuguucagguggcugacccugaggaauccuuggcggcccuggggucuugagcccacuguguuuucagaagcuccauuggcaucugaugugccugcucuugucaucuuacugcuuugguuggugcugguuuuuguuuuucuuuuuuucuuuuauaaagacauuauuuauuuuauuauauuacuuauauucuuuuuuaauccuauggauuaaaucccugcauuugagggucucucucucucucugucugagcuuugaauauucuugcguuagaaagcccuucccccacccucaggaaagucauugcuggugugguuuugccuuacucuguggcugaagaagcugcugugacucagcuuuagaugguuaagaugaaacggaugaggugugggacagaguucgaggcagacccuuguguagcccaggcuagccugaaacucugauucuccucucagucuccuggguaugggauuacagccuucaccaccacaccuggcucaagauucauuuugugccgcaagucaugguuuguggaggagguagacauaaacaagacagcguauuacagguugauaaacuaauuaacaccacacaguuccaugccauguaggaagugauuguaagaauguguggccuguaggagauuuuaaugagaugggcugagauaacugaagauuuacaaucggaguaaccaaauuagacaccugucaacaugacgcucuuuccuaaucaggcugcagaucucagagcugauugaucacgguuuggaaacgaccccacggccuguggaaacuuguccagccauggcggcugauggcauuucucuccuaagccagauugcuguguagcuguuuacuuccuuugacauuugggacaaggucuuaaauucaguuguucuaaagcuuuuuuuuuuuuuuuuuuuuuuuuuuuuuuuaaacaaaacaaaacgaaaugguuguuagaaguuguaaaauagcacagaggucucuuuuagccuuuaucuggcuucuuccauaaggaagaucuagacauaucguauagaguucuagcucagaaguuggcauucugaugcggcuuuguugauguguucuguucauguagguguguuuuguguggauagucugcguguguggguguggguguagaggccagaaguggcauucacacuuauuuuuuuaauaauauuuuauguaugauguacacugucggccaucuucagacucaccagaagagggcaucagauccuauuacagaugguugugagccaccaugugggugcugggauuugaacucaggaccucuagaagagcagucagugcucuuaacuguugagccauuucuccagcuccuacauuuuaaaaacaauuuaaaaaaaacccuuggaguuuugcauggugguacauaccuuuaaucccagcagaguuugaggccagccuggucuagagaaugaguuucaggacagucagggcuaugcagagaaucucugucucauuuuuugacaaauauaacaaacaaacaaacaaacaaacauccuugcaaauaaauaagaucacccaaauuuaccagauccaaagacucuacaacuuacugaaugucuagaguuagaauuagcauuugggauggaagcuguagagcgucacaugaacuuuacggacugaauauauuuuauacuauuuuuauuuuacuuuuuugagacagagucucaugauauaccucuggcugucuggaauucacucuguagaugaguuuggccuugucucacagagguccaccugccucugccucccaagugcugcacagugcccagcuaaaugaguuuucuguuuugaauaaauuuuauacucuuaaccaccaccaaaacacaagaucuguggcagaguucgaacuaggaaaacaaaccauuagcuucauauccucuuauaaaauguguguuuaucaccucuuagaaauccuuauugucaugacuuuuagguguguguacauuuguaugcggguuuuccagacguaaacaggaacccgggaacugcugggcacgggcgcuagaacugaacucaguacucggaggcuuuaauuauguguaggaggguuucacccagguguacacguguucaccaccugcaugccgggcacugaggaggucagaacacuagauucccuagaacuggaucucagaugguugugagcugcugugugggugcugggaaucaaaccucagccucuguaagaacaagugcucuuaaccacugagccuucuucccagccccucucucucuucaaaacaaaacaaagcaaccuuuuuauucuuggagacguuuucaucauauucaccccuccuccaccucuucccaggccuauccccuaacuuuguguccuuuuuaaaacaaagcaucuucaggagcugccccugauauuggguguggccuuucccuggggcugacugacuuaccagggccugcaggcuuacacaaaacucuucuucucccagcagcuaagggcugccaacagcuccauggccuagugggggaauuuggugucuaacuuccaucuccaugcaggauuuggcugcugagcuugugcagguccagugcgugcugucaaagcacugugaguucacaugugcaguugcucugcuguguccagaagacgcuuguauagugguccgucaucuccggcuuccacuucucacauuccuucuuaguaaugauccaugcaccuugggaggguuaggugugguucagguguuccacuuagggcugagcauucugaaaucucuuacucuuugcauauagaauagaagguugagagcagcaagaucugugggcgcaaacauaaguagguauuauuuuuccacuuagacuguacucccucccucucccucucccaacggaagagaagaacaaucaucaguggaagaggaggugcagcagagagccggacccagcaggagagcagcaccuagagccgcuucaaugcuccugacgccccaguccucuagccuggccacaagugcccuuacccacugggccaucucacugcccccucucccccaaggccuggucuuuuccugacugaagcuaagacugcucuucacaucgucaggggaagaauauaauugaaaacuacccaaccaagaaaacaaaacccaagaaagugcacauggcacagaugggcucacaaagcugcaaauacuuguugaaguccuuuucagaaagaaagacugcuggcuauugauccugaacagugauucucugaaguggugcuucgagaucuagaaauguuucuugugaauggaguuuuuuuucuuuuuaaagauuuauuuauuuauuguauguauguauguaaguacacuguagcugucuucacacacucuagaagagagcgccagaucucauuuacagaugguugugaaccaccaugugguugcugggauuugaacucaggaccuucggaagagcagucagugcucuuaaccgcugagccaucucuccagcuccgugaauggaguuuuuauguuaucgcauacuucuaagauacucauugugguuugaaagggauuauauguaauuguuagaaaauuuguagaguaaaagguaaaucauauuuuuauauuuuccaucaca

SEQ ID NO: 1888 - RNA, 3904 nt, Mus musculus
caacuuaaaggaaguuuauuuggguucacaguuccagggcacagcccagcauggugaaggaaggcagcagcaggagcuuagggcagcggguuacaugguauccacaagcuggaggcggacagagauagaugcuggcacucagcuuucagcccaggaucucaucccauuuguuaaugcuacccacaguuaggauggaucaaucuagaaacuccauaggugauucuagauccugcugcauuguuaaaauugaauagaguccugugauggggaagaaaaaaaaaaguuuucaggcuuccgguccaaagagccuuugcucuaccccucagggaucugggaaggacaaauagaauacaaacaagcuaccggaacuucacuguuggguaaagcaagcaaggcuuucgucacggcucagaagugacugucccuugcuaauaauuuaacggcugucaccaagucagaagugugugccucagccucugugcuguggccuaucccggccacccagaugaccucucccucuucacugugcuucacagcugcugcagauguucuaccggcaacaggaggagauccggaggcuccgggagcuguuaauccagagagaaguccagaccaagcagcuggaacuagagaucaaaaaccugcggauggccuuaggacagcucugagcagugcucuccuccacccuugcccucagggacaccgauaggcucuguggagagagagagagagagagagagagagagagagagagagagagagagagagagagagguccagcaccgagccgaaauucacugagaacaaccacuauuucuauauuuuauaccaggaaaacaaaacucucaguugcugaaagagaucccagugggacguggugccgcuuuccugucgccuucuccaaucugcaguuccugcccuggcugguuuagauuauacccuaccuucugcuggauucugguuuuaaggguuggugaggagcuaugaccucccagagugaagauuuggcccaauucuaaaccacaggcaggcagccaaacccauccuuccaaccagaaucagccacauguggguagaucgucccauagguggggacacagaccucagagcugaguccaugucuguugacuacaagagggcaggaacggacuuccacccaggguaucuaaaguccucugggagguaggggggcccagcacuggauguggcaaagccccauggccagccaccaguaagggcucugguucacugcacugggugagaaaauggcaccuggucugaaagccugcgacccucccuugugugucuugugccugguucugaggcucuuuucuuucuuggugcaaaacaagccuagcuggugccugagaacuugagacaaggcuuaccacaggagguacccacucccccauaccuccuggacaagcagacagaguuccccccuccccccuuccccucuggacagauaguuucccccaucacucagggucaugcuggagcucaagcgagaauuucaggggcuauccaggcuaacagguucugacccacaucguccauuagcaccccacuggaugcacauacugaugaccagaccugcccacuaaagcugacccuacaguggaggguacggcccucugaacaagcugccugaguggcuucuguucaugggaauggagacgcuuuuagcuagcauccuacugcuguguuggcaauggaagcaguacaaagcugacucgcacacgaccacgucacucaccgucgcugguaucugcacacaccaggguccugugcuccuugguuuauucuccaucccuacacuacacugggacucuaugcccggcgaugagcuagcuaugcucgccuuccuugugcucccgaguauggcagggaucuggagcuccugggauggcgcgcucucucuccuuucauuugugaccagcaugucagucuguaaagcuccaaccccaugcucagaaggcaggagggccacauagugaagacaccagcccaaaaccacuggcugccucuuauguguggcuaggggugggguccagugagcuucccaucaaaucucuguacaacaccauccccucaaaaaaaagcuauccccacuguaagggacccagacccagaccucacauucaggaacaggucacagguggcuaugaacaaaauuauauguuguuucuuguucuguuggguuuuuuuuuacaucuagaauaaauuauuuaaauuauuucauagcaagggagagggauauuugucaucuuuuuuuucuuuugaagauuuugucauauuuuuuuaagauuauguuuuuauguucuugggcuaauggagcaacacugcccccugacacagugaccacccaagcagcaaagccgcccucggcuccuuccuucuugccuugggagcuuucuuucugaugacucaggaacuuugugugaaugagggagaacgcuuggagaugagcuuguacccaccuuagcucuacaauaauucugcuuccuagaacaaaacuugagguuguaucccagagggaaacgggaaucaagauacggaccuaugcuuuucauaugaaaccgugccugaagccguuugagugauuguuugaauguuucuuaaauuccuuguaccuuuguaaaaaaguaaauaaaaaaauaauuaagaaauaaaaguuaaaauagacacagaaucgugcaauguaagaauaugacaaucuacugugggugguaauuccugccuguaaucccaguucauggaaggcugaggcaggaagauugaaaauuccagaccagcuugggcaaaggagucuaagacucugccucaaccaaaauaauaauaaauaauaacaccagacucgauauugcaaugcuuggcgauuuccuuuuuguuaauucguucuacaaguaccaauuuagcacuaggugucuggaccagaugauaccggaccagguuggcaaacuggucaguaagguccgaauacccuugaagugcuuccacuuguguuugagagaauucgugaggggcaggauggggcaggguggucaggcggcuguggguggagaauggacgcuuccugaagaaggagauaagccacaccuccaugugauugggggacagugagcagcagcuauaccuuaagcaagaacugcaaaaugccccggcuagaaacagggugggucauucacccaucaaggcaagagaaaucagaacaucuucagggccuggggcuuugaaguuuuagccugaagauaauuggggcuucuuggaaguauguuccaacuucacccccaccugcccccacauggcugaccauagggaggaagcacuacaggaaaagaacaaaaugagguguagaaaauguaggcccucugggcaggccacaccaccuacuacgcaccuccgcaguuugccagaagcccaacaucaucaacaagcgggaagccaaccuuccagugagcccaucagugcaagcacccgcguuccuaucuauagugaccuccuccuccucaaggugagaaagaguggaaggaugcugugccgcggauccagcacuaggugggaccaagcaucaacucuccagcaggucaucgccccuccaguuugccacugggagcugggucgcccgccccgccccgccccgccccuccccgagcaagguuucgauuucugcaccaacccaacccgaccacacugcacagagaacagcgguugccacugagaauggcgagcgagacuaccgaggcgcgggcgcccuuucagcccgacggggcguauggcuggcgcuguccggagcacagcgaacgcccggcugagcucuucugucgccgcugcggccgcugugugugcgcgcucugcccgguucugggugcgcaccgcggccacccggugggccuggccgagg

SEQ ID NO: 1889 - RNA, 1248 nt, Mus musculus
uaaauuuguuauagagccuaccaagaacucagcuaaagucucaacuucuugucuaugaaaugggaguauuaugacuacauugaaggcguugguagaucaaauguaauaaauuguguucuuaguuaacaauauauacaauaccuacuuugugccagguacagugcuagucucccuccucccccccgccccccaccaaacacaucacuacaagacacgaagaacacuuuccaagacaggugguguggcgugguuauuaugaaagauaugacguccuaucuuccauauucagugagcacccggcugaaagagggagcggcuuggacgcagcgcccccuaauggcagcagugggaaggaucucccggaugcgcagccgcccuccgcucuccaguucucccgccgccugcagagcugcggucccggcgcucgcugcgggauccagcuucgagccaucugggaggcaggcgcgaugacagucuccaucucagcaaggggaaacugagguucgggacccgagucccacccaaagccugcggcgagagcgugucggaggcgagagugugugcacgcgggacgggaaccgagcugcgggcgacgggcggcgcacaggcggggccucuccgucccgccccgccccgaccccgcccggcccggucccgcccgccgggcugcgcggggaggcggcggcacugggcgcggggacucggcgggcggcgcgaagcgcggagcgggagccggagccgccgccgccgccaccugcgcggcagccaacaagguagggugggaccgggccgggcgggacgcucgcugcgcccgggcugcggcucuguggcgggagggaugcuguccccggcgucgcggagaccuauccuccagacccccgcacgaucucacacaaagcucugccccgcuccaguccucaguuuccccaucgggauacuggugcggccgcucccucagugggugacuaggagcagcgacccccagguucgcgcuccagagguuaggggccaguccuuaccgcccgcgccucuugcggcggugagcggcccgcccugggcgcggcagccagucucgacaggccccgguguggcccaggugccccguggacccgagucgugauuguuccuguccuggcuggguuacccgcgggggccucagcuuccagucccgggaaacgguggaggaggaagcaucccugagucccugccgaggcgaccugggcgcgcggguggggcgagcagucugcu

SEQ ID NO: 1890 - RNA, 9303 nt, Mus musculus
caguagccagagggggccaggggcggagcuugcaggagcuugcagaagcucgcgcggagagcgcaagcgcggcucaucuaccauggccgaaaaccuguaccgagcccguucccggguuuacagcccaucugugcuguuucugcacccagacauggguauaggcggagccgagcgccuagugcuggacgcggcgcuggcgcugcaggaguacggcugugaugugaagauauggaccgcgcacuacgacccgaaccacugcuucaucgagacccgcgagcucucggugcaaugcgcaggggacuggcugccucgcagccugggcuggggcggccgcggcgccgccaucugcuccuacgugcgcauggucuuucuggcgcucuacgugcuguuucucuccggcgaggaguucgacgugguggugugcgaccaggugaggccgccaccaauucuuggcuggggggggggggggggggcggcgccgagagggggggagggaccgcuguucuagguuuuuaggaacuguccagcaggaguccccagggagagaacggccaccaauuuuaguauggauagacccuuuaaaauggcagaucucagggacaucucucccccgcccccuuccuuucguugaagauccuugagguagggcuuaugugucugcauuuuaaauguuuagccuugggacuaaaaugauuggauccaggugguugcuggcauuaaaagacgacuuccggccacaccuuguaugugacucaauuuacucuucuuucuucuccguuauuccuuugucucugcuuucaggucccauccaucccacccuuccagucuuucuaauacugccauuccaguacuuagcagugccacggauuaaagucaagcuaaacauaucguuuccccauuaggguccccauuggucuuuggagaaaaauccaguuauuuugucuauacaagugucugagcuugcauaucaaaaccagaggucagcuaauauucaccugaacauuggagucaggcucucucacugaaccuggaacugaaagauugagcuagacuuuuggacaggugugcacugccauacccaacauuccuggagccaacccucaguccucaguguuuuuuuuuuuuuaauuaagaaguaacauuuacucaggaguaaaaguucaaauaggaaguauaauguaaaaauucccuguccccauccuugagagggcgagccauugucaacagugucuucugcauccuuccagaagugauguguggcccugguaguauaugugucuguuuccugcuacaucuuauauguacacagcugggauccaguuuaccugcuguuggacuuuuugcuuuuguucugcaaaaauuugaaacaucuugcuuauugauauucaagauccacaucagucucuucagugacuggaaaguccccuguccuguaaauauuucagucuucccuaaaagacacuaacauugcugugugugugugugugugugugugugugugugauccuaggugugacacuagauaugacauccuaauacugcauuuauuucacuucuuacaguccucugaggaaucuccugauagucauggucauuguaaaugucaguaacaguuuccagccuuuacuuacaaugaugucaccuuauucuuccaaggucuauacuuggcuacccagugcucuuaucuaagcugacauguggaaauagccacaguugcuccagggaaucuuuaauuaugauccugaguugcacugaaccacccugaggaagccguauguucaugguuaaugcagacauuuacccagguccuauggauucaguaauaccaggcagcuagucaaccaggaaaaggcuuauggccaaggagguuaaggcgaccagucacuuaucuacuguuuuaccuugguuaggugucugccuguaucccgguguucaaacuggccagacggcguaagaggguccuauuuuacugucacuucccagaucugcugcuuacucagagaaauucagcucugaagaaguucuacagggcccccaucgacuggaucgaggaauacaccacaggcauggcagaccgcaucuuggucaacagccaguacacugcuuccgucuuuaaagaaaccuucaagacccugucucacagaaauccugaugugcucuacccaucucugaauaucggcagcuuugacuuggcuauuccugaaaagauagaugaccucguccccaaggggaagcaauuccuguuccucucuaucaaccgauacgaaaggaagaaaaaucugcccuuggcacugagauccuuggugcagcuucggaaucgguuaccaucucaagagugggauaagguucaucucuucauggccggugguuaugacgauaggaucccggagaacguggagcacuauaaggaguugaagaaaaugguccaagagucagaccuugagcgucaugugaccuuccugcgguccuucucggacagacagaagaucucacuccuccacggcugcuugugugugcucuacacuccgagcaacgagcacuuuggcaucgucccucuggaggccauguacaugcagugcccagucaucgcuguuaauaacggugggccccuggaguccauuguccacaaggucacgggguuccugugugagccagacccagugcacuucucagaagccauggagaaguucauccacaaaccauccuuaaaagccacgaugggccucgcuggaaaagccaggguggcggagaaguuuucagcugaugcauuugcagaccagcuguaccaguaugucacgaagcugguguagucaggagaguacaguguagagucuguaugcuacaugcacugcgaucccucuuauggguuguagaaacgccuuugaaaccaaaagaaagggggaaacaaaggagcuagaaucuagugcuagugagauuuucuuuuuuaaguagacuugagucuugaaugugagccaccuguccaccacaccuaccugucauuucugaaauauucuuaaugcuguaaucauuccguaucucgugaguguuguugaaaguaugguaggaaucugcugcuagcagacuauuuuaacucuauuuuccuggauuauuguuccuuuauauauaaagguuugaucauccagugccuuaauuggcuuuaguaguguaggucuuaccauugucacagucaauugauuugacuucagagcguaaugggaacgaggcugcugcagcucccaagcucgguuuacuuaaaguguucucuaguagcugcuagaaaauuuuuguuagaauuuuggcuggaucuauaacaagaguacucaguauuauuuauuguuuugguuuuuguuuuguuuuguuuuuuacugcaacuugacaauaaaauauguuuggcaucagaagagaauagaacauuagaucugagcccgaugcucugacuucaucuuguuaaauacauaaaccugaagucagaagacuaggauaaaugagauaguuuacaugaaggaacaccaucacacauguuuuggccuaccgugucacgcuuggccuuauuccuuugagccugugccagaacaguguauugaggcagggagcaaagacaaaaagggucccauaucccuuucuagaaaauaucccuugaugaccugauucucuuccacuagcccucacuacuaaaaguccugucaccuccuaguguggcucucagugugggccggggaccaggccucagggcacaggccuuugggaacuguauuagaguucucuaaaauagcaaacagcacuuaacagaaugaauucccagaagaagaagaacaaauggcguacaggcuucuguccagcuaauccaacaaugaacagaaaguccagaaauccaguaguuguucaguccaggaggcugaaugucucagcugaucuucaguauacacuggaaucccaaaguaggcucugacgccggugaagggauggacuugccagcaagguaaggacaagcaagccaagagcaaacgcucccuacuuccauguccuuguauaggcugccagcagaaggcauggcgcagacuagagguacguuuucccacuugaagaucagaauuaaaggaagaccugccaacuucaaguuaagcaaaaaucccucccaggugugcccuccauuguuagauuuuaguucaauccagauggagucaaguugacaaccaagaauggccaccaccggggacacuccgcaucugaacuauauacuaagcuucauauuucagacguguuucuuaauguuguuggugucuccagcccucguaguguuuguaucguauucucugcaguuuagcaugccaguguuuccuguccuucacguaaaugccuuugugugaagcuugcuugacaccccgcccccaccccaccucucaacuccccuaucccugugacacugcccaguaauaacuguucguuguuguuuaccuguugcuuguaagugcaaguauuaaagcaauuuuaaagcuaaauucaccuguaagaauauaauaaauaucuguaaucagaugguccaguuuaugguugcgagcacagagccgaacagccugccggacuuagagggcaguaaucucugcuuaacaccucacuucuucaucugcgaagugggguaauugcccugucacgcuucccuggaagggugauugugacagauuucaucaguagacacagugcagaagaaauacaugguauaaauguuagccacuaccuuuagagguuaaaacgaacuagaaguuccaugugaacucaggccacagggagagaccacuuuguugaggcuccauagagcuguaguuuuaguuuaaaucuguaucucaagagcauuuuuccaggcacgauaccaaaaggaagcuucacaaguaaggaugggacgccuggcucuggaauuuaguuucucuaguguuuuggaagauccaguaaaguaggucuucccaagucugugguuugguucauacauuggagaauuagagccuuucgggcaaaaccugacccuuuuucaaaaaagcucugacccuuugauucaagaccgguagaauuggucacauaucugugguaagggcuuacucacugcaagcacaaaaucuauugcugcuuaugagcguuuaucauucuaaaaugaacucuggguuccuggcacuugucuuccuuguccugagcccgugggauuacaaaaaacuucccaggcguagacagacugcagagucccaccugcucugaaugacuugacucuaggcuccuagauaaacagcuaacgguggagcuuuccccacaggguguccagaauuugcaaaauugcauucaguagagaaauagcauggaccacagaaacugacuuguggccucaucaguaguaauucuagcauuagggaaccacuucucagcgugcugcccgagaugcauaguagacauucauuuaauccucauaugaaauccaaugcccccuuguggaucagugaggguaaacuauuugcuuuaucacagccuggaaccccacccuaccugcuucagucaucaaguuccaugauugucugccucgaaccucccuccacagcacugcugccaugcuugcuugggccccuuguuacuuaccucuugaucuuuggguggucugagcuuggucuaauccuccaucaucuucaaaggcccagacaaaugaaagccacaaccaagugugcacaguuggaaaguaucagaggcaggcuucaacccaucuagccucuaaaccucaagacuggccaggauuucucaguuagcuugagacaugaauaccacgccccucauacaugcacacccaguuagggugaggauggccuuacacacagaagguaugaacuugcucaguggcaggcugcauuauuacuguucuuccucccucauaauguucccauggccucugaaccuuucccugugguauagagcucacccucaguggccauaacauccuucaaaggcaauuacaaguaccucgggugggaaaucagauguguaucugggaaguaguuaugcuguaaucgaagccuggugucuuacucuaaguuuggguuuuauugcugcaaagagacgaccaugacucuaaaaaggaaaacauuuaguuggggcuggcuuacaguuuggagaucuaguccauuauaaucauggugggaaacaugguggcacacaggcagacacagaacaguaaugggagcugagaguugaucugaagacagcaaaggagauuauuaaccacacugggcauagcuugaacauaggagaucucagagccugccccuacagugacacacuuccuucaacaaagccacaccuacuccaacaaggccacacauccuaaaaugccacucccuaugggccaugcauucaaacacaugaaucuagagagccauaccuauuccaaccaccacaacuggguuuccagacagccuaggacaagaguuucucagucguggcaaugccucuucugcagaacuucaccgccuucuaagcugcugcaggaaccuguuucacucugcuugcucugcaucaaacucaguugccaaccuucaguuacccagucuguuguccugagucucaacugcuggcagcaagucuucaugccugccacuaacugcccugagacuuccuuucugugcagugcagcucccugaaucugacagauuccagaggucacccaaccuaauuuguucuuaugcaggugagagggaucagcccaaagccaccugucugaagggacagccucagcccuccuuggucucuguggagccccucuuucagcaucuccaccauaccuauacucacucaccucuugccacucugaauuuacuccuucauuccuuaccccagcucaacccccugcagcucugugccccuuggaggaccaccaucuggacaccaacaccccuacaucucguagguggaagguaaggagcucucccaauggcaggugacuaaacaaacugguuacacagccaguguugaaagggaauaauagaggcugggggagugggguuggggcgcauuccaagcuaccuggagccaaaguuguucaagccagcagcuccccagaagaccagggucaagaaggaaagaaguaaggggggccaggccaggauguuuuguuuuacagguuuguuuggguuuuguuuuuguuuuuauuuuguuuuguuguuguuuuuguucguuaguugguugaguuuuuuuguuguuuuggggauugguugguuuuuugguuugugaauuguuuguuuugcuuauuuagucuuaguggaaaagcuaagagcccuuauuuauuucacaguguaugcauguacugaaaucgugcugugucauaaaugugugcaacuaacaugggacaacuaaaaaccuuuucagcuagauauaauggcaugcaccuugaauaccagcauuuagagaggggggagggggaaagggggagggggagagggagagagaauagggcccuugagaaaugucaguggauaaaaaugcuugccacgaagccuggcauccuaaauucaauccguccccgugguagaaagagaacugacucccacaagcugucgucugacuuuuacacccauacacaaauaaauguuaaaaaggaaaaaaaauaugaaacaauuuuuuuaacuguauauagugguguaugacuuuaaccccagcacuuugggagaaacagagcuggguggaguucugaguuccagaccagccuggucuacauagcaaguuccaggucagccaguauuccacagugagacccugccuagauaucuaaauauuuuuaaaggaucuugccuuuuaaaaaaaaaagaaagaaagaaacuguaaaaaacaauccuacugaucauuucuuuuuacagcauaguauuggacagcaauguguccaacgaaugcccugaaauguacacuacuauuuauaauaauuucuuauuguuauauauuugagauugcuucaacuuuuugcuaccauaagcaucucaguggaaugacaacagaauuaaauucuaaaagaaaauauuuaaaauucugagcagcaaaauugaaaggcaaagauaagaaagaaaaaaaaaagagacaugaaaagaagauugcagcaacugccgggcaucacacgcagguacaaggaugcaggucucaaaaacugaaaaugccuugcccuccacaaugguuuuagaaccaaguuaccacguuaaccagcucagauccagccgaauuguggguucacuuuguauuauggaauacagaaaucuaaggauaucucgguguaauugaguaaaccagagucacgugugguccugggagccacccucuggaacacugagcagcaugguccuaacgcuugcaaguggcucuaagcaaaagagaagauuucaggaagcuacugggauagaucauauaauccaaggaaaacuaggcauaugaagggaugcuacuaaacuugaaauuuuuaagugauccacuuaauggaucaccagagcacacuuucuguaauauccuguaaccuucaugauagacaaccuucaaagcagggaacaugguccccaacagcagauaauccugcugguucaccaaaagggagccagcccucucucagaaaagaugucagagaaggacugcugucagaaagaaaacuccccaaaggcaaguaagagauguucucugagcucagcucauguaaugagcuaccucaaguccauggcuaaggccagaacccaaggccaccuagaaguacaacuauccagcccagaagaguacaaggaggaagcagagaagaccaagcaagcuguccccaggagcuaggcagacagagcaagcagguggcuccccagugcucagugugacaccccacaggccucugacaaccauccagcaagccccacuuacacuguacccuuuguugcccugacccaucuuaccaauguguacguaggaccugucaugcaggagacuggaggaaaagaaacgauguuuccagccucagacucuucuuggacuucuguaauucugcagccuucaguuuuacugagaccugacuguuuguuugcucacaguuggaaucauauuuuacccguaucuuaauuucuguaaguuuucacacauuuauuuuguguguggcagugugugcacacaugccaugucacacuugugggauucagaggacaacuugaaaaagugaguucucuccuuccaccauguggauuccaggccuugacgucagucugucaggcuugguugaggcaucucuccagcucccauacuuuaguuuugauauuuuucacauuu

SEQ ID NO: 1891 - RNA, 8609 nt, Mus musculus
ccagccggccggggggcggugccagagccuguaucuacgagaguucugagugcucggcaacuucacgacuucccucuuccugccuccugugcccaccguucuuaggcaucagcauggugcgcgguccccgcuuccauggggugcacuagccccuaucuuggucuuccuuucugggaccucauugcucuucccagcuucucggguggguguggggucgggggugugaagaggauuugacccgcgauguucacuguuugucugcuucccucugcagccggguccaacgcccaguggcaccaacgugggcuccucuggccgcucucccagcaaagcgguggccgcacgggcugcgggauccacuguucggcagagguaaguggcugggggcuugcgggggacgcccgguuauggcuggaggaggcuagguacccaggguugcauugcauugcuggaaggaggaguuccaggauggaaagauuaauaggggccgagugagcccgagcugacguggccaucuaguuaguuaaaggcccuuuaggagggaggcaugguuuuccucuccuugaucagcugcacgcaccacuuuaguuaaagguaaauuagacuaggaucaggaauaacuuuaggaaaagcguuggcauaaagcuggugugucugaggcuuuaccuuucagucuuccauauggaggucccauacacacucaguuuaacaaaaugugucuuacacagucugucacccugguuccccaucccagcugugugugugucuuucuuuuuaagucuauuuuguguauguguguguauugcacgcaccuguguguguguguguguguguguauguaugugugugugugcgcgcgcgcaucucuuucuugccugguguccuuggaggucaccugaaacugcaguuaugaaugauugugagcuaccauaugaguacuggggaccgauuugggguucucugcaggagcaacagguauucuuaaccucucagccacuuuuccagcuucagggucuccuuauuuuuaaaugucacugcuuauuuauagaaaucuagaaacuccaguuauuuaucuuuuuuaauuuggugugucuucucuguacagucauaugccauauuucauaggaagaccucacuacuuuuuuuccuccauuucuguccccccaguuuagcccucaacuucuucugcuuugaauuuacaccacuauucacccuccaguugcucuuccacuuagguucucuguaaguuucugguggugccuguuaaaaaaggcuuucagagggauuccacgccucuccuuucucccuccugugagccagcaauucugagcuuacuaccauuucuuuccuuuucuuuucuuuuuuuuuuuuuuuuaguuaguuaguuucuuuuuagacauucccacacaaccuaggguugaacucagaucauccuuccuucaccuccuaugugcuaggauuguaguuguaauaggauacuacuauuuacaucugcauguucaucuccucugcuuugacagaacaccugcccaagcccucuuccuuagcucuugccuuaaaucaugccacaagaaaauguugacugaaggaaucagucagccguauuguuguguuuguugaacuacuaguaaagguuuuuguagagaggaguagacuuugaaaacgcaaaggagcgcuuuaaaaccacccuuaacaaugugaagaggaaggcuugaggauauagcggggagauagcucgggaauagagagcuugcuuagcacguguaaggccgcaggcuugaucacuagcacaaccaacaaaacacaacacaucagcagaagaggacgugaaggacuuguugacugcaguaugaaaaucuaaaucugcagucugaacgagguggcuugaacaugugugcaucagauugcagcuuggaggaggaacuuguaauagaacuguuaggacugguaagaugaccccgagggaccgugaacguccuguuacuaagaugugcaaggaaaggauauugugcuaugguuuacauuguaugggccugcggugcuucuuguugcuagcugggauuucagagccuuuugggcuacucuuguagcuguguguaguucuuuggggauugguuuuuguucaagaagaguuauuagggaaauuuggccaucugagaguucuuagggaaccggaagguaccuaauuaugagauuaucaaaagagaauaaauaaaaaugaggcaaccagugcacaagugaggugacagaugcaacuuugaagguuauggauaaggaugacaucuuuuagguucugguacuggagggcccguaauacuagacagccaguggcuaucuguaugguguguacaaaauucauuugcacaugcuagugaguguguggcuauaugcauggaguguacaaaauucauuccagaaacguauugaugguuagguaauugugacugcuguuggcuaucuaagaauauguccauucuuugagaagaaguugaagcuauggcuagcgauacuugggcucuggagugugcaauuuuuauuucucccugaaugaagugauagaguaauaaggccucagagaagaagugugugggauuuaagguuaagcugggauuggagcccuugcucugcacaguacagugggaaaggaagcugccacaggacgagaaggagugaugauauuucagagaccacaaauuaugaagugccagcccaugguguuccuacagaagugauggaaacuacaaguuuaagauggugggauaguuagggauacuaagacagcuauaaauaauaacuaaaggucugucaugcugagccuugcuuuaccuuggagaauguaguugaaagaaagauagcuagggcuuguauucaugcugugagcuucuuuccaguguggaggccaugaguagccagggcaaaugaauaggucauggaauuuuaagugaugaaggcaauaaguuggggaagcugggugaggaaagagugaggguggaugguuuggauagaguacgcagggugagugacucguagagacccaugaggugcaagggagugaaugacacgcuggcccagggaggacaggcauccuaggcuaaaggaacaguaaguggaugggcaggucagagagcugggguugcucuagcacgugccagcagccauagcaguaggccaaagcacgcacgugguuagggugaacagcauuugguuaaaggugcaggaagaaggugcagacuugguugaagguuaagaaguuaaagugggcucuguuaggcaccucagcuagcuucccagauaagguaaugaggaauauugugagcccaguuugauguuucuauggacccugcuuuucagggacucugcucugucccacugccgguggcagaaguaacaacaacaaauccuauuggcuucuguagggaucuugaaauucuagcuuugaagagagcuaaacucagggauugugcuuuggagaguggcaaucguguggaggugguaguuguggcucaggugauaacgucccacguggacacuggcuugucuuugguuguagcuguaacuccuguuuuaugaacaaagaagauuucagguacccaccuuccagauuagagacauggcugcccagggaggcuuucugcacaccccguacaucuucuuuugcuauuuacagucagccuucccagagaagcagucaugcacaggguuguauguuuccaggcuacuguagcccauagcuaauguaucugaaaugucauucgcuagcagaguagacacaaaucaugggcacugacugccgucagaguugucaugaguacaacuggagucagacuggaccaaggcucuaaucuuccacucaugugguaggaugagcuuccuuggcuauagacaggauuucugucagcagcccccacacaggaaugggauuucaauagagagaguauugggauuugguaguguugcaagaaauauuaguucccaugcuccuuccagcuacucucugccugccacucucuggugagccagagcucccgaguucccaaguucccuucgcugccaugccagcaccacgcaaugaacguccaccccagggucagccccccacaauacccagcuaccugguagaaacaaaacucuagaagcuuauaauaaacaagucagauuuauauaucaauaacuucucuuuuucucuuuucuuuuuucuucguuuuucgagacagggcuucucuguguagcccuggcuauccuggaauucacucuguagaccaggcuggucuugaacucagaaaucugccugccucugccucccaagugcuaggauuaaagaugugugccaccacugccuagcuucaauaaauucucaauucacaagauacccacacaauaauuucagggccaauugaucaugguacaagcugcccaccuagaucagacaaguuaucccaguuaguguauccuuugugauaaaucuaccuguggcuauuuaaaacagaugcugguucaggaucuucuuccugucugucugucugucuccaucucgccuucaucccccucccuccugucagucgcucucugucccugcaacucuuggcuccgcccccuuuucccuguccagucacaggccuccugcuguacuaauauuucaauguaacuggacagggaaaauucugccacaagguaggacaggacauucuuuuugaacaccuaacacuuguggcauaauuauacgacugaugauuucuuuuagauuucuuccugucacccagugcuuggguccucgcuuugccacuccagcaugggguagggcaaugccccauuccauaggaggauaggagagucugugucucguccugguccuaaguguccaugucucuggugugcucugucugacgagauggcuccgugcaucagccguuauccuuuugcagagagcaaguuuggguugucaguuguuugcuuuuuaccuccugcuccucuccaagacugacggucagaauauuaaaauagcucagcuguguuacagaauucucauucaucaugugucgucuccauuuuggggaccuugcuauaauuacaguucagugucuugucuuaauuuugcagcaagugcaguuauuuuaaaccaucucuuugaauagucuuuuaaaaaugaaguuauaauuuaagggcauuucuggauggguuuauuucacagaaguucccaugaagacaaacugagggacacuguccacugagaaggcuagauaugguaaaggcaguuccuguacacaucggcaccugacagguagacucaguccauagaaccuaagaucagccagacaaaggaagaguuuaaaucuaguaagaaggucuucuuacagcuugccuuuuuuuuuuuuuuuuuuuuuuuuuuuuuuuuuuuuuuuagagaaagccuguaugcuagaagcauauaguaucuuauuaaacggauuucuuagaaaaacuacuaauuuuucuuuucuuuuuaaucuguuacagaaaaaaugccagcugugggacccggagcgcaggccgcaccaccucugcagggacuggggggauguggcgauucuacacggaagauuccccagggcucaaaguguaagucguggaguggacucgugaccgagguguaggagccgugucugacauagccugcagcugcauuugugccuggugggcugggucuggcucgccugcucaucaccugauggacagauuaggguggugaaggauaccuuucugggagugauuaagagauggagccuccugucgcaguaucaggguaaacggcaggcacagggaacaggagggaagcugcuuaauuagaggaaaucgcucuucauuugguuccccugccccacauagagacacggggagggggcguuugaaugggaauugggugauuuuucaaagcugcccugagguggaagcugauauuauuacagccuaauggaaaaauuuccauuauguuguguuacccaaaguuccuuggcuuccuugcugugggagcguggggguggacccaggagggugaaugcaucaccuuucaagcuuagccuugagaggacugaggggcggugaccaaggagaggugaccguccgucaggcaacuuguguccugcgccucgcuuaccucuuaggccaggcugucuggcaccacagcauccuuugcugcuacuucccguccacaccggaucagggaugaugauaacaacagcagaucucccgccuuuguguagcccuugcuguuuuucagaaaacuuaguaucuuuucugcuuugauauggccagccuuccugagguaggaccugagccauuuugcagaugaggaguuccagagguagugaggcacucagacacaaaugguaggaggcagagcagaccugacuguuggagcccagccuuccucuacuguccgucugguagaaaagagacagaaauucaguuaguuuaauugauuuggcuuacauuacagauuuagaugacuucccuauaacuugugggauuugguuuaauucauuuauugacuuuuuuuuuccucuuacauuuuuuuuucucuuuugggggcagggucuuauaguguagccagacuaaucuggaauguuccuucucucuaccucagacuccuagcugagcaccggugcaugugaccaggccuggcuagugucugucccacccccacucccccacugucagcuugcaagaauaucuuuaugaaucaguucuucagcugggagggugguggugugagcuggugguguucugaccgccuuuggugauuuuccuagugucucuucccaguggcccugcaacucacuuuaaauuccucagaaaggugggaaacccuuguauggacaagucuggcucaugccugcccuucaaguccuucaguuguagcguucugguccucauaggaacugguagaaacugucucuugaagugucauaagcaguauccuaacccugucagagaaaugugcuucugugaaaggacacaguugagaauuccuaccuacaaaucuguccaccagcaucuuggagcuuauuuuuggcuccuccuggggauuuuguaaaauuuccagguugauaguacuguuuccugagaaccugcuguaagccugccuugugugcauguagcucuaaggugggugcuguuguaaccgcuuuacagauggggagacagacuugaggguaaggaaugggcacaggcaagcuugugaaugucaggcauccucaguccgugccccccgagagcuggauccucagcuccgugcccuggcugaugauagcagugugccuggcaggaagggaggaagauaaguuaguguggcggucucgcuccauuucaaccuucuuacucucuaauuguacaaacuuuagaaugauguagcagagaccuugguccccgcaguauuuauuauccagucugauccagucuggaccacugcuaccucaccuggcccugccugguaaugcuuugaugaguaaaggauuccuuucuggaaucucuaccucucgguuguaucugggagggcagugcuuacaauaaaugcucacagcucggguacgcucagaggcaguucuuuauagcagcguuugauucaaagaaaggcagacgggggggaaaucuauuccuugucugcaauuaagcccaugacuacaagucaguuuaguuuagcgcacagugccuggaauguggugccaagauauguugagugugguguguacaccuuuaaucugaguacuaggccagcagaggcagcuggaccucugaguucaaggccagccugguuucagugugaguacugggaccaucaguucuacacagagagaccuugucuuaacaaaacaaaagaaacagaaaaaacuuguagaagguaaaugagcuuaaugggugggguccgagauguucagacuucuguauuccgcgagucuauaggcaggaaucccucugagccuugucugucuccuuguguauaaaggaucaauacuugucucacucaugagaugcgugagcuucugcagguugaauucgaucauagauucacaagcauuuugugcuaguucaccuguaugucucauacuguagugagacggaaaagguugucucaauacauguuaauuugagaagguuugcaaauagauuuuuuugcgcauaagaguuugggaaauuuuucuuuuuauuguagaacauauuaaguacacaaaauuagcauaucugagggauuaucucuaggacauccgaugucgucguuuguguauaaugugcugcccucggcagucgugaguauuaagccuaccuugagacugaaguaagcaugacuucucuucucauucccaggggcccugucccagugcuggugaugagucuucuguucaucgcugcuguauuuaugcugcacauuuggggcaaguacacgcgaucauagauugggcuacauccaucugucaucugaagaagaagaagaaggaaaaaaacccaacauaucuuggaccaaaaguguagugauuuucuguucacguguauuauuuuacagagaauaagaauugacuuugagaaaucaguuuuuucuauggcuaauaaacuuuggaauugcuuuauauggagacugg

SEQ ID NO: 1892 - RNA, 88929 nt, Mus musculus
gacgugcuucgagaugggcaggacccggaagugagggcgugagaggccucucuggaaguugucccggguguucgccgcuggagcuccgggucgagaggacgaggugccgcugccgccggccccggagcccagcccuuuucuagcccgguccagucccagccgccaccuccugaccccgccgucgaccccgucguuaccaugaauccugcggucuuccugucuuuagcagaccucagaugcuccuugcugcuccuggugaguguaugucggggugacaaacccuccgacugugucccugaacgccucccgcccuccgcgagggggaacggugcagcccccugcuugccucgacucuccuccgcuggcgaggcgugcacccccgggcacuaccuucacuuuggccguucuuuuggcuccuuaagccugcgguccacaaggccugcgaaagcacagucagggcuuggaaccugcaaauaggagaauucgccuuggggggagugagugauccgugggagggaggucaccgcugaggccccuggaguucguuucaguuuuguggacguugaggaccugcuuggggcaccagaauccuaagggaccuaggguacaccuaauguuuucucccacauggaggggcguuagaagccgacagguguuggggucgugugaaucucucucuggauccuugaaaccggcuggcaaagcccucuguuguggcuuaaugugauugguuggaaacccggaacuggagucugguuuggugucgacugggagaauaggaauuugaaaagguggaggaugugauuaucugacaggcucugcuagagccuccugcuagccuuguugcaaccucugcacccuagaagcauacauaaaucuuggucagugcucugaacuggagaauaaccagcucuccugcauaccuaggugcuugguacuucccugccugcccaacaccaucccaucuuagaaaagaaucuucccccaguucuucuucugaagucuaucuugaguaugcaacuuacuuggccucuucuuaaggucaaauugagacaaaaacugaaggucuaacuccauaugugaacaugagaggaauuuaauuggaccguaaugacagcauuugagaauacuugaauugugguagauucuuagaaagcuaagauuagcaucauugaauauaaauuacuuucuucacagcuuaagaauaauaauuaacuugcaagaagcuguguaguugguuacaggcgaaacugagucuagaaauagauuucuuaauuuguaguguguauucccccguaucacauaaaaaguuuaaugucugcacuuaaaauacuuuucauucucauuauggcuugaaagccauuuuuuaaaaagcuauauauaauacucugcuuuuuucaaaauaaaguaguguaaacuaaaugaaaugaaaauaguucugaaggcuacaguuguguauaaacgaggccacauaugucuucuuagcacuuguaaguauauagcaguaaauuacuucuauauagaggaucucucucucucucuucucucucucugucugucucugucacucucugucucucugucucucccucccuccucucucucucucucucucucucucucucucucuguguguguguguguguauguguguuauuauguacuguggcaccuucuagaacuguugcauuaauaagaggccauauacuucuuaaggauacuaauuacuaaucuuuuccucagccuuaaaaagaguugucuguuagaaauuauuuuuaggugacugagaaguucaaagaucaacauucuuaagaaauugaaacauugaaacauuucuguaggaaaaugucacuagagcuaaguuuaagaagagugagguccagggcagccaaggcuauacagagaaacccugucucaaaaaccaacaaacaaaaccaaacagaaugaggacauuuauuucuaaguaacacagacuuuuucuagagaauuuaucaacccuguuaaauaccuaagugaagauuucuucuccaauaaagccuacauuuuccuaaagucuaguuaaaaacacauuguguguuugucuuuccaagcaaagauagaugauaggaccagaagaagcccagaagccauuucagagaacuccugugaagaugaauggucugaaagcaaagccucagaaguucucauaaaccagaagcacaagucaaguuagcgcccaugugagcauaguauuugcuuacuuaguucuaaucauuuuaaacucgucuuaaacuagcuuagcaaauauucauagagcauugguuuaaucucaacaguguguagccugucugacugcuaauucagucacagugacggaaccugcuuacucaguaucccaccugucuaaugaauaauccucugaguucccuucaggcuucaacuugaugccuuucacaggcagacauagaaaacuccagcucccguuuagcuuaggucaucauuuuuucccuuaagugguuggcucucaacauccauauauccucuuaccauaguaagaagcacucuaccucaguuuuaaagaccuacuaagaccuucuuaaauauguagggaucauaaaauaauagcugaaguuauaacacuaaauuucaggaaucaaaugacaauuuuuuuccccuuaucucaaaaguauucuagggggaaaaaaaguauucuagacuacaucacuguaugccuugaaagccuuccugcaugggcaucaaaccacagacucugugaugacucuuucauugagugcuauuggcccucucuccuuugugucagagacagguugcuugagaacugaagcgguuucuuuucugcuuaccuucccuagcuugugcucucugcgcuggucguguguaaguuuugaaaaugugagguaagagagggauggauaaaucugaauggaguugugucagauauucucuguuaacuuuagagauuuuaacccuuuauuccaguuguuuuauugacgaugucaucucacuaaucucuugauucuaagacucuagguuguuacuagcucugguaguccugggcuucuauaagcuaauaccuucauuacuguugcuuuuguuuuuuuauuuuucuauauguauaggaagccaagaaaauaguaccugguuuaggaagcuaaguaauuagagagcuaaguaaacacugguagagucugcugaguuuaauuuuuaagauuuuuguaggugucaguuuuagucauuaaugucaacaauaaaaguguucaaucuucaaaaaaauacuauuggaagcccuuaauuagauucauagcagguggguuauuuauccuuuuuauauaacuuuuuaaauguaaccuauggguuacacuaugggcugcucuuuaaaauuaguugagacaguuuuaauaaaacacaguucauggguauccuggauucuguucucaucucagaacagacaaauaaacagcaacacaaaguugcuugggcuguaccccaguuauaugucauagaguccaggcacugguuuaauuuccccccgaaacacuauugugacacuuacaaauguauucagauacuacuugauguuaaauauuccuaauugugucuuauuuuaaaaacuggucacucaaauuggaaccacaugagcuccaugcaugcgaguugguuucugugucuccuguaaaacguuaggcugccuggaauugagcccagggccuugagcauccugagcacacacugugccacugaucagcuaccagccuaagcuaaagucuguagcuuccuuucccaucucauuuuucccuugguaacuuagauauagauacagagcaucucacauucuugguauuacuauuuguagccucuuaauguuguuuugauguuucucuguuguuuuauuaauagaaaucuguaauucaguuuuugugauuuuuuuuuuuaaccacuagcucaguauguauugcuaaauuugcuuauuuaucuuucaagucaggauucuaaaaacuuauuauuuacuuuauaaucauauaaaacguaugaucuucagaaccagacaaauuguguuaagauaauucuaauuuuugucucuuaugcugauauaagaagacuuaguauuuuuuuuuuuuuacuucuauggccauuucuuuuaaaaaacuaauguaagucauuugcuuugaugucuauauauguauuuuucuaguuugauuagacuauauauauuauucauacuuuucacuuuaaaauuauaaaaauagcuuuccagcuucaaguuuuaucuuaaagguguugagauggaacuguucuacauguguacacaugugagugugugcguguguuuauguguuggagguugcauguguaugugcauucaggaggccagaagagacuuuggguguugucugccuugauuuuugagagggcaucucucacuuguuugguucauugaacugacuaguuaggcuaggcuaacugaccacagaauccuaaccuucccaugucugacuuuuaaacuuuaguuuaaagaauuuuuuuuuuuuacauuuuauuuguuuacauuucaaaugauaucccccuuccugguuaccccuccacaaccuccccauccuaucgucccucucccuccucccauuugccuccaugagggugcuccuccacccacucaccaacucccaccucacugcuccagcaucccccuacgcuggggcaucaaaccuccacaggaccaauaguuuaaagaauuuuaacuuaauuacuuuauucuuugacaguuucauauauguguauguauaauaugcuccagucauuuccacccauauuaucugcucuucucuucugucucuuuucuucuuuccaagaaguuuccuuucaaauaaaaugccuuuuaaaagugugugugugugugugugcgugcgugcgugcaugugugcaugugugcaugugucuguguuuuucugugugacuguaugacucacugaguuuaguuaagguugguugaaugagcaugggcaacuuuuugauggguacaccacugaugaaaaugccacccccucccccagcagucauuagcugccaauaccuccccuaacccugagggagugcugauagacucugccuugugcagguuaccuuaacagcagugaguucaugaguacaauagucuuuuuuuguguccauuugacaucuuuuuguggcauaccaccuuauuguucagcuccaacaaucuuuccaucccuuucuccccaguguuuccugagcuuuggaggggacaauaagaugccaucuuuagacaggacugacuacugcuccgcuaucauuaugauaggcacuuugaccaguuaugagccucugcauuaacugcugucuucagcuuuaagaaacuuuucugaggaggcuaggagcagcacaaagcuguggguauaaaccagaguaucagaagacagucuggcauguccauuuaguaaaacguuacuuuuugggacuuacucaccagacuaagcugacuggcucgggagccucggaccuucccagccgcuggcuggcucuugaccagguuacaaugccaacacuggacuuuuuauggagguuuuggagauugaacuuaggucucucacuuuuguguaguguucucagauuacuauuguuucuauuuuuuucuguugugucaaauaguucugcaaacauuagcuuauguguauacaauuuugauaguguaucuuagagauagauuccuguaagugaagugaaguugccaguggucaaaagguaauggacaagcugggcgugguggcgcaccccuuugaucccagcacacgggaggcagaggcaggcggauuucugaguucgaggccagccuggucuacagagugaguuccaggacagccagggcuauacagagaaacccugucuugaaaaaaaaaaaaaaaaaaaaaaaagaaagaaagaaagaaagaaagaaaagguaauggacaguacuuggaacuuuaugcaugcugccaccggaugucgugaaacgccaccacauugggguuuugccauuaugucaucuugccaacaauguaaaaaaaguuuucuauagucuucucagaauaggagugggcauuucucacugguauuucauguaacuuguuucuuuuaauagguguacagaugauuugcauauucuuucugugugaaaucuuccugacuauaguuauugcucuuccauuucucuacugaaugcacacacacaaauaugcacacacaagugcacacguguacuugaguacacagacauugacucuuacaucuguguuagauugugugguggaccuaaggauaagaggugccaaaauacacuucugaaaaaaaaaucaaucugaauuuaguaauaauuaacauuuguaaaaagccuuagagaagauguucauugccacaguuacauaaggcuucgaaacugcaugccaugguguuaagucucuuucugguaccucagucuuuugauguccugugauuuauuuacuucaccuuuugucaagauacucagguuauugguuauuuuguuuuauggaguuuuaaauugugcaaaagguauacauugaaagacauucauuacacaucucaaaauagagccuguaacuguuuuucaugggucaugcaaaugugucaauuuaguaagagaaaucuaauuugaauuuacaauucuuugguuaugagcaaaguugagccuuucacacucucucucucucucucucucucucucucucucucucucucucucucucucucucucucucucucuauguguguaugugggggccauaaccuuaguuguuauuucucagccaucuacuucucuguuuuugagauagagucuucucccuggccugaauauuggcaaggaggcuaggcuggccaaccagugagcccaggguuucuuuuaucuucaccuuggcagugcugggauugcuaucaugugccauaucuuuguggauccugggguucaucuagggucucacuucacuuucugaguugucuuccuagcucugaaucuuuucuguccauaguauauauccuuuuaaaaaaccugauaacacuuccagugauugagaauaaauguucuaacaagcuguaaggaacaauugaagguguuuauucaugugaaaaauggaugucagggcaucuacaugcaaguuucagcucucccauuuacugaacacuauaaucuuggauaaauaauauaaacaaaaauauuaagucuauaagauaaacagauugggcaucauaauucuguaauuuucuuauuuguugaaucuugcuuucagaaaggauagucuucuaacuuccccuaacguagacauuugcucuguacuuuccuaaaaaaacucugcaaacauuuuauuuagcagguugugggacuacacucuucaccucauuuucuguguugggaaaagcaugcguaagcacagcuuuccagugcggacagcacgcugcugucucaucugagcgaggagggguuaaaggcaguugcacuuuccccagcacccgcccuuguuagucugccuuugauucugaaacucuucaucccaggcacuugaagcuuugucaguccauagcauuagcauuugagugacuguuuuccauuugcuagagauaaaggugcuugggauagaugccccuuuugucaagaaaccugugcuucacuuagagaaaggggcuguguauacauaauuauaauaccaaaagcaaagagagauucccaaggcaauugguacagacuggccacagaccuugcuucccugaagagugggugaguguugaguggccucacauuaggacugcugaaucagagccugcagaguaagggugagugcacuugaacggcuuaaauguauguuaaaguuagauacagcuauagacaucuguaagaaacaaauuauuuuucagugguaaaucuccagcucacugugaaagaagaauuugagcauuaucuugaagagagaaauugcaugggguacuuuuuagucuucaguggagugaagaaaggggauuuugucuuuuaaaagcauaauuaaucuuuuauaugaauugaguacuuguguauuuuguuguuguuuuuuaagaauucuugcugucuuuuuugcugacauggccaaacaucagaauugauccuaaagaagcuagcaaaccauuaacaguugcuuacaguucaucauuaguuuagaaaagaaauggaaacaaacauggucuucaguggauuugaaugugcauugggauggcuucauuggagaggaauaggaaagcaugccaccucggaggucuuauguaagguccuguaucugagucucagucuuccuggugaggacggagaaaagucccaagugcucugugagucccugcuuauagugugguucuucaguuucuccaaccagugauuuuuaucaucauguagaauugauuacacauuauacuugcucuuaauuuuaaauguuuaagacaagacuauacuagagaaaaacauugaaaaagacccaggaaacuuccuaagaagaacauuguaguguuuuguguuuuuaaaaacuuaaguaaacuagguaggccucauaguagaaugccaaugauuguuccauuucuuaagaugaucaucauacucuggaaggagaccuuugauaauugaacuuaagagauguuuggaaaaaugucuuuagaaaucauaagaacuuuuggcauguggcucuagcauuagugucuuauuucaccugauaggaaguaacucauaauggcugaaguuauaguuaucaaguugugcugaacauaaacauucaccaaaguuaaauaaaacuuguacuccccagucaugguagcuacauuuaaggcaaauggcuacuguauugaacacuguacauuauggagacccauguacuugagccagacugggaggagguaaagaaugaagaaaaugacucaaacaguaucucuaauggguguggaaauuguuagggcuuuucuguucaaagggcagugaaaaaauggaagauaauaaaagucuuaucauuggagauuuggauuuuguuuguuagggaguuagggaagugcuagaaauaaaagcaagaauugagucuuaguauuaguucuucucaucguuuauaaaaucauuuugucacuguccuugaggcauuaauugucuuauauauuaacuaagauugaauagaccaugaaccucacccuaccccaguucaagagcagugaaacuaacuuugggguuugacugucugcaguuuauuucugugguaaaaaucucauaugaggucuacauuguuaagugauacaguagaagagauuuaaaauuuuauuuuaucaugugacaguuucauacugauaaugaauuuugguuauuuucacaccuauuucucuuucuuaucacuuucccuauucuacuagaacucuucucaacaguuucuccucuccuaugauuguguguguguguguguguguguccuauuguguguguguguguguguggccuauugaguguccuuggaguuacuugcuugaguguuggugggagaguauggagcaagggcaacuuaccugugguuccagcacugaagaaaaugacacucccugucucaacaaccaauaauuaccagaguccugcauggagagauggaaucucacuuuauccaugauggacuguugauggccucaauguugugcaggauuuuugaagauaacuacagcuauagugaguugagugcguggguaugccgugucuagaagacaucuuuuuguugaaaccacucuuggcuccuacauucuuuuuuuccucuuccucagugauaguccuugagccuuaaagggggucauaaucacugugccuuuuuuuuguuagauauuuucuuuauuuacauuucaaaugcuaucccaaaaguucccuauacccuccuccugcccugcuccccuacccaugcacucccacuucuuggcccugguguuccccuguacuggggcauauaaaguuuguaagaccaaggggccucucuucccaaugauggccgucuaggccaucuucugcuacauaugcagcugagacacgagcaaugaguccucuacuaucauuuguucuugacacuuugaccaguuauggguuucugcguuaauccugcccucugcagugagaagcuucccugaggaagaugggacacagcaguaaucuauuaauauaaaaaggaguauuaggcuggagcaauggcucagcaguuaagagcacuugcugcuccauuccuagccacccauaugauggcucaccuauaugauggucuguuucaugggaucugaugccuucuuuugcccuccauggacacugcaugcauguggugcacguacaugccugcaaacacauacaauuuuuucaugaucuuaaaagaaauaguauuuagaaagcaauuuugauagugugaccauagcaaaacaauaguaauauguuuccucuugggaccuaugguacccaucaccuacccaccaucaugggcccuugaccagcuuuacagagugagguaugaguuuuucagagaaauauuacuaagaauguacuuccauuauaugguauuuaauaaaauuauauauaaaaacuggccuuuuuauaucuuuaaaaaaacuguuuacuucagauauuagaacaauaucucugucaggaguuaaguguuucauuuauuauuauuauuauuauuuuuuuuuuuugagacacaguuucucuguguaacccuggcuauccuuauccuagaauuuacuuuguagaccaggcuggccucaaacucagggagaucgaucugccucugcuuuacaacugcugggaccacagucaugugccaccuugccugacuaggaguuaaucuuuugauuugaucaaucuaggugaauguacaucuuuucuuuucuacuugaaaaugguuggaaauuauaugaagucauaaagguagacuaguaugucuuaaaagcagcuuucugauuaaagcaaacugcugcaaauggugaauaaaauaugaaguagugauguaguauagcucacaaauaugucugauuuuauauuucuuacuuguuggcuguuuagcuacuacuuuauuguaguuuaaguuuuagagaaaaugccacuuuaaaaaacgucacugcuacagcauugaaaucuugucacugcuuaaggaacagauuaaaguguaacauaauggguuagaguugcccuugagucaagagauuggacauuuucaguuccucugauuuuauuucuggaguuuuggucugaguauagugcaauguaaggugacaaguuggugccucuguaaugacucucaggcauucucagagcugagaauaaaggugugcugauuauuguuaaaguaguuucaccuggcacugggcccauaucuugacucacaauuuacacuucuauuuccugucacuaccucuauuuuucuguuaaccuuugaggaguaauauagauacucuuucugacccaaagaaggugguuuguauguucaauuaugauuuuaugaaacaaagugguuaagaauucaccucuuguuuauucaucuuuauuucuaguguaauaucuuauuacagauuggcuuauuuauuuuuucuauugcugugauaaagcaccaugaccaaggcacuuacagaaggaagaguuuauuggggaccucauaguuucagaggguuaauguacaugaccuuaacacaggaagcauggcagcaggcaggcauggcucuagagcaguggcugagcgcugacauccucacccacaaggcaugaaguacuggaaaugauacagacuuuugagacuucaaaaccuacgcacauugacacaccuccaccagugcauccacaucuccuaguccuuuacaacauuucuaccgacugggaccaagcauucaaauauaugagucuggaggugggaggcaucucauucagaucauacaaauaacauauucucuaauagaaaacucuaagaaugccaggaauaggaaagguagaccucucagguaggggucaaguauauauuagaggcucauaagugugaaauaaaugugacaguaggccuuaaaggaaauaaggaaaucacacauuuggauuucuuugugggagccucuuuauaaccaguuuuuguagaagugccccagcacugaggcagcaguaucgucaaugauucuaagguaucggguguuggaagauuauaucauagcuaaaaagcauguggcaaaugugugcuugcucuguguguguguguguguguguguguguguguguguguguuguuugccaguguucucuuucugcauucuguguugaucugacucagguagaacuuacuaauugcguuguugguaauauuuauuuccucagccuuggcccaguugcuucugcuggacauaggauucucaaucaaauaguaguguccuaguagucucaauuaaaaauauuuucuggguaugacaggaacacugucagcaugaaaugugaaaaacauaguguuaguaauuuaaaguauuaaaagauuuccugacauguuauuuugacuccugauagcaguauacuuuaugguacagagaagcauaaugaagaaaaaaaaaaugugccuucacuaaccacugaacacacuuuagccuacaccuuuccaguuauuuuguucuuauuugaauguugcuuuaaauuauuuuccuguuuuggaaacucaaaagcugacucccguuuaagccugguuugaagagauagguacucauagaaauauagaaacaaaguguuguguggcacuguucccgaggagaugugacaaaugucuacuuuccccagaagacuugcagaagacaugccugggaguaucucuuccauucaggcagcguagcuggucugagcgucuucuaggcagcucagcuugucuuagagugucacccucaaguagugcuuacagcuuauauaaacuggggagggagagcggguuucaggacugccugaagcuuugagcuaguuguuugcugacugaguuuuaaggauguucuuuguaagauaggaugucauguuauuuuaaaacauccugagucauaagaagcuucccaccaagaugaaauguuuuaucucugggcaaauugcucuuggacaaaaagguagccaugugcaugaaggugaucauccccuagcauuuggaagugacggcugcuuuaccucccuaguuaaguuauuuacugguuuugagccuccaggcucagcuguuagaugggaacaggaacucaccugcaaaguccuagagaacaagggagauuuugaaugcgccuauaacauugugggaaacucuucuagcuucugccucauagugagcauuccguaaguacugucaggaugagggagucaggaaguaacugucuguugcauuaaaauuguguguacugaauuaauaagcucccaugacuaguuaacagugccugggggcuucugauccuagucauuacuccccaacuaaaggcagcuuaaaaacgugauauuaagugaguaacuucucucccuagcucuguuguuauacaauccauugucauuauguuaacaaaugguaacuuagaaaugugguacuguguguaaguuaucugccacacugucuuuuaacuuuaucuaauuaguauuguacuuguauucguuguauaauuauaaaaauaguauauaauaaagauaguugugguuuauuuuugaagaauuuacugguuuuagaauuauuagaagccuagguuuuuuuaaucccuguuuugucauaaacuuagacaacucauagcuuguuugagucuuauucguucagcaauguuuuuauuuuuuaaagagaauuuaaaaauacauuucuuuuuguuuuauguucaucgguguuuuucccugcaugcaugucugugugaggguguuggguuccccuggaacuuacagccaguugugauuugcuaugugguugcugggaguugaaccccuguccuuuguaagagcagccagugcucuuuaaccacagagccaucucuucagccccaauguuuuuauuuuuuuaguauauguuacacacuacuaaacuuuacuuucucauuuauaaaacagucauagcaugaucccugcuucagcuucagugauuguuauaauguuguaaagagauacuaugcaugaaaaauaaaaauaaauugcuggggccugugagauagcagguaaaagcccuuaccauauaaaccuggcuacaagaguuugaucccagaaaccuagcuaaguuagaaagaaagacacuuuucuuuaucucucucucucucuuacacacucuugcuaucucucucuaauaauaacaaaugacuuuuaagaguuacuauuagaguaaaacauuuagacaugccuuagauauccucauucuaggauucuuuaccugaaugcuuacuuuguuaagaacgucuuuuugagggagaauaaaugaauuaugauaguucuagagucugguugcccacaauaacuggcaauggaggagguauagugaccuuggaagcugaaagaccuacuugucuucugacuccuuagcucucagauacuaugccagcucccuucuccucagccuuguuuuucuaguuuaaaauugggcauaauuauuuugcaaagcugugagaucauacauauguauagaaagugccuuguguccuagcugcauaugagagggauuuguuuuguuagguaaggguugguuagggagggaaagccugucagauccauagagcguugugaaaccaggaaagcaucuugggggagcugagucuugugcucaucuacccucugugagucugccauccuuuaacccacucagaggaaugaaugcauggguuuuuuuaauuuuaaaagucugagucuaaacaguagugguuuccuaaagcacuuaucagcuugucucuuuccucugguaacagggcauagucuuaccaaaauagugaaaguguaauuauaauugauagaaaggaaaaucuaacuugauacgcaguucgucuuucaguacaaaagcagauaaauuucuguaaguagggcagaugaaaguguggaaacacacuuuacgcucuuccgaaugaaagguaucauuaguugcacauagaacaacuuaauguuacuuaagcauuuggaaucauucagaagucuaucggccgugauugacaugggauacaugggaaaugaugacucuuuagaaaugugucgucucuaguugaauuugguaaaggaagagaagguuauuacuucacacaugucacugaaaagaugaaaaaacuauuugcuuaaauguggaagauuuuaaauagcugucuuauaguuucauuugcacuuggaagucugauguacuugcauaccaguuacccuuaauauugcauccagugggauaucaacauguuucuacagaaguguguacaugcauaaucuuuacuacucuuaguaaaauuugaccauuaggcuaaauuuguuuauggguccagugaguacugguauaaagcugacugugcuaauaaucccaucagucaaggaggcagaaagauggaguguucaaggcuagacuggguacaaacaaacaacaaagaaaauccuguuauguagugagucuucuuagauguuaaaacucccucuggggagggaaaagaaagaggccacauuuaggagacaaaaggcaggcuggaaaguguaugcugccagggagcuucuugguguccuauggcaucuuuucacuagccauuccugagcuuguaaucauugcuucgccacagauuggaguaacugauucuuuucuuuguugguucuuugcauuuuggggguguuguuuuuuaucauguuuaugaaagacaaucaaacauaauuuccagacuuuucauguuagcugauagaaagcauuucaccuucagucagcaguagacggaaccuuaccuucugucagcuguuuucccauugacuagcaaggcacauacuagugaaacuaaaguaggcuugcgacugcacagugaucuccugcccuaagguucucguguuccccuuuccacucuggucacuuagauuggaaacguuauuuuucugacuuguuguaggagagggacaucucuaucagacuuuucuguguugguuuauuacacucagucucuuguguuuuucuccccuuaaccaaguauuguagugauuuuucagaguuacauagagaacuaaguuagucauguuuuucuugagaugccagcaguaguuuucagccuguggguuucuacucuuuagguggagcacacaaccuuuucucaggagcugcagaucugauauccugaauauuagauauuuacaauuuauaacagcagaauuacaguuaugaaguagaaaagaaaucauuuuauggugggggucaccacaacaugaggaacuguguuggcucacuaucucccagguuguccuagaacugaccguuuggcccaggcaauccuaucgcaggugugagccuucacacacagcauuauuuuuauugaaauaauccacagcauacauacuuuguagucugcccauaugucagugaguacauauguuuucuagucaugaugaggguguagugcaucuuuuuaccacucuaguaucuguucacauucuuuggcacugcuaaaauuguauuguuguuguuugcuuuuguuuuucacauuucuuaacauugguugaacuuguuagauauuucuccccuuuuuugucaucauuccacguagcuguuuguuuugaaagguaaagaaagguuaggguuggaaaguuugucaaauccauggagccauugugaaacccagaaaucagcuugcgguucuugugcagaucaacccucugauucugccaucugaaaccagugaauggagcaggccuuuuauuuuuaagagucugagucuaaauuguauuuucauuaauacagcuuuuccuauguucuuuauauacuaaauuuguacucuaaaaccuuauaauucucuaauuguuuguauuccuucuuuuuuuaaaaaaaauauauuuuuaaaauuuuuuauuagguaucuuccucauuuacauuuccaaugcuaucccaaaagucccccauacccaccccccacuccccuacccacccacucccccuaaaaaaauuauuuauuuauuauaucuaaguacacugaagcugucuaccccagaagagagcaucugauuucauuacagaugguugugaaccauggauuugaacucaggaccuucugaagaacaauaagugcuccuaacugcugagccaucucuccaacccuuguauuccuucuugaauuucugauuauaaguuaugucauuugcaaagaguggcacauuuauuucauuuuccacauugaaaccuauaauguuucccuuuguuacauugucuacugauuucaugguuguuaaguaauggugggggaaagaggaaaauaaaccagggaaccacaauaaaaucacuaggaugaaggagagcgcaguuaacuuaaacauucgcaaggcacaaaacaaaaccuuaucucuuuaaugucaucuuuucucuaguaguuguucuagcuaaucaaacuuagaggcaagagggagugucuuucaagucccucacucauucauggauuuaacuagaaacuugaauucuucugauuucuaucucuugugcugaccuaagggaguauuuauuuaagggaguacaccaaguccuuuaauaauguuuaaacuucauucugauaucucagaacugcccagugaauaccuauccuguuuggagcuucccacauagcaguucauaagcauccccagugucaaguggugaucuagaucugguaacaguucaguuucaaccaagagacagugaacugaauaaaucucguguaacaaaaccaaaacuuugcaaagagaacaugugcuuaaauuacacaaauuagaaauuuuguauucagaaaccagaugauuuuuaaaguaauucaugcuuaaauuacaaaaauagacacugaauuauuguuuguuucugagaguuuuaugaacucucauaaaaaccuuuaauugcacuuauaagugucgcauacaauuaguuaagguuaugauuaaaccacaauuucauggucuggucauuggaugcagucuaugaauugagguccaggaggcaaaacuuuuugcugcccucucugacccucaucauguaaccuucaacuugugcuuuuuugccuucucuuaauccacagguaucuguugcuguuuugcaccuuaauaaucugaaauuuauuggccucugagauaccuaucucaauggaauuuguuuuccaagaaacauuaaggucauccuuagacuaaacugugccucacagagacuuauucuugcauacuggaaaaauaugcagcaucagcagcuguauccuggccaaggcaagggaaaauuuggaaauuaugggaaauuugccugugaaaacugagaauuacgguucaugccaccauuccacaacagagguuuucagaguuuuuguuuuuacgguguuucagaauaaauaaaacagaacagguuacagggcuggagagauagaugguuuagcuguuaaaaacacuggcuacucucacagagaacccagguucaauucccugcaccuauauagugucucacauuguaacuccuauuccuggggauuuguaaccacuucugacuucuacaggggccaggcacagacagacaugcaggcaaaacauucacacaguaaaaauaaacauucacaaauagaaagcuuaaaaagagaaaaacacuuuacacugcaaucugagauauaucacugaagcagugauuaguggcuugcuccccauagcuugcucagcuugcuuucuuauagaacucaaaacuaugggaucuuauggcacaauucacguuaguugggcccuuccacaucaaucaucaaagaagaaaauauaucacaggccaaucgaguggggacacuuucucuguguuggcuggaaauuggcaguucaguucacagguuagcaggcagcgacagcucaauccacucacaaauaccucgcggaugcaccaguaguccuguucaauagaguuggauuagcaaacagugguaacaugaccuaguaaagacagucaggccuccacugcagacaggaggagggaccaacaagaauaccaggagaaguucucuguuaugucucucucagggaagugaagaucagugaagaugagagacccacaagcguuauccagcuagcuguaccagcaagccaagcugucucugucacuccuguaguccuauuuauacccuccaaacaucaccuguccucuauaugccucuauaugcaugugcauccagucagccuaaguccaaguccguggaguccugagaaauggagcucaacuacacaguguaagguggaccaauacauucauguugauagcaaagaauccuucauuauguguccuuucaugugcuugcuuuagcagaaauucucuccuauguaugcuucagugaaauguuucuucguaagucugccuuagucuuucacuuguauccaugucagaaaaguacucuuucaugcgcuugccccagcaaaacaccaucuaacacaacuuacacuccaaagaacccucacguuuccauuucagggcuccuuguguagucucaacaggaggagaugagucuaguccuacagcaacgugacaugccaaggugggcugauauccaugggaggccuccccuucucuaaggaggaagggagugggaaaugggggccaggaggugagaggaaaggacuaggaggaaacgaaggaagggaagcuucaaucgggauauaaauuaauuaauuaauuaauuaauuaaugaaauaaaaaagcuguccuccaucauuuuaaaaacaaaaauacugaggcuuuuguggauuaauguuucuaaaaagguuugucauucguguuucagguguucugggucagguguuucaagguuuuuggccuccuauucagagaauuggaauaaaggcucacacagauuacagauuagcaggacaacuuuauuuauuaaagcaaggcuauaaaaaaaaggucaaauuuacugaaagggggcaauaaaccacaugagugaguauacuucagugcccaagguuccacccuucaaucucuuuuuguggggucuaaaggaaggaguguuucuuggcuaguuuuaugucaacuugauacaagcuagaguaacuagaguagucugaugggagaggaccucaauugagaaaaaugccuccauaaaauccagccuuaaggcauuuucuuaaugagugauugauguggaaugaccuugccaauuguugcuggugcuguccuugggguugugguccuggguucucuaaaaaaacaggcuuaccaaagccaugggagcaauccaguaagcagcacucgucaugacuucugcaucagcuccugccucuggguccugcccugcuuaaguuccuguccuggcuuccucugaugaugaacugugauucggaauccuaaacagacuaaacucuuuccuccccaagugucuuuggguauccagguguuucaucacagcgacaggaacccuaagauagaggggcuggcuacuagggugucguuugggugguucucuauuuugauaaucauauguucauuuuccuguugugcauaacucauuuccauaaugcaucugauuuuagugauaucuuuguucaucauaugcuauacauagacaucaggcaguaccuaggggauuuuuuauuugaagggcacuguuugccuuacugugccaucaaccaguucaguccuauuuuucuaacuggauucauuaggaaugcacuuaaauagaaccugucuauuugaucguugcuagagguggaaaaauauguauuauuacucagagaugggaguacauguggccugaugugcauagguguuguggagguucagagauugcuaaguuuauuguuuggagagggguauguguauauauuaugugcagcugaaggaacuaggcuagcgaguacuuuauaagaagugcaugcaugugugcguccaucugugcagggucucagccuaaacugucuccuaugccugucucauuagacugacaagguggauuaucaugcugacuaauaggacuuugguuaacauuuucuacuuaguuaugaauuacugaugaucuguugauuacugcucauaucauauuuagucacuuauaauucuacauucagaacuauuugaagaaguucuagaccaucuguaaaaucucuaagaucaucuugagauagagaugaaaauagugaaaguagcuuuaaaaauaguuuuuagagaacauaagagggcuggagacauggcucagugcuaaagagcauguacuccucuuucagaacccauauuaggcagcucccagccaccuguagcuccagcugcaggggcgugugacacaucuguccuccaugggcaucugcacuuacgugugcacacagacacauaugugcacgcacauguacauaguuaaaaauaaaugucauaaaagcuuuuguuuuauaagggaacauaagaaaauucauuaauaauacagauaguuacauucuuaaacacuucuaacaaaaguaguaauuucacucauuuuguaaucuaagggauaaaaaauuugaggugaacacacacaaguacaaguagcuucuuucaauggaucuguguaaacauagauuaggaaugcacuuaaagaggacauggaucagaaagcuguaguguguuggaaaagaguuccuucagccuggagugugaugauuuuuuuuuuugaaggaaagucuuucuauauguucuuaguuaaggcucuugagauggauucauacuagaucuagggaugguccuagcucuagggcuugauguucuuaugagaaaagugcacagaaaaaaauggugagaagauggagguucaguuauacugauggaucucuguaaauuaaggaauuucaguagccacuggcagacaaaacugagaauucaucuuaaagagcuuucagagaucaguggccuugccagacacuugguuucagcauucuggcuucuacuugguccugugaaggcucaguuccccaguguaggggaaugccaggaugugagguaggaguggguagguggagagagagcauccucauagaagcagugggaguggggacgagagaggacgguucuggaggggaaaccaggaaaggggauaacauuugaaauguaaauacauaaaauauucaauuaaaaaaaaggaaaaaagaaaagaaguguguauauguacuuauauaugcuuguguguguguguguauauauauauauauauauauauauauauauauauauauauauauauguauaauucacauucacccuguaaaagucugucacauaaauauuaaauguuucuggaaaaaaagaauucuggcuucuagaauuauaacauaauaaauuuauuuuaagucucuauguuuuguuaauuugucuuggcaguccuagaaaacuaguucauguuuagaaucccugcaaauggaccauuuauguauuuauuugguacaacuccuauacuacuuaacaagaaguccugaaucauuacagucuuuucaugugauaaugaccucacaccugaaaacccuaagacuucuucuaucaaauaauaaaagcucuucccacccugggagugcuauucuuuuuugcuccccuuuucuccuuugguaggugguuuaaauuuuaucccauuuuaguauuugcuucuuuugucccaaucauggcacaugguaugcaguagagacaucacaauaguugugaaaagaguaauuggauugagcuacacugacuuuuuucauuucuaggcauuuuacaauucuaggagauuuuaaaaucagucuuacuuaaaguagaaaaggccaucaguaauacugugucuagaaaagaaggcacugucugauuauuguuuggacaccagaacucaaaugaaaagaggacagggcuggagaucacuuccaaaacuauguaagaaaaaugcuuaguuucguuguagagacuagcaaguaaaaaguacuaacucaguuuacagcuacauuaagagacuaaauuuuaaaaaugcuguaccuaccaauaaauuuuaguuuuacaaggagaagaaaggcaagucucacuaugguagaaauaaguaguauucuccuauuuaucagagaaugagauuacuacagcaguuucaauaaacauucuguuuuuaaauacugaaauauuuuuagauagucuuuguaggcuagacaguuucuaauuggcgcuuccucagagauuaagugaucaauauaaaaaucaaaaagaugaauuuuguuguuuauuguucucuguaucaugagauguaaagacugcacugacguagagucaugggcuccaaagauuacucagugauaaauuaucuugcuucuccuuacauaucucuuaacaguucuuuaguccccaccagucucuauaugucaaaaguauuaauuauucaaaauugcaaguuuuaagggauagcaauuuugggagcguucucuuccacugcucuuuacuuuuugguugcugugucagagaccuuauaaggaaauucaguccauugugguuuugacuuacaaaacugaauaaacucaccuuucuacucuauauguuaauuacaagccuaucauggacagcuuaccaaaaauguaucuacccacccuuuauucaaguucauggcugucuuaguuagggauuuacugcugugaccagacaccaugaccaaggcaacauuuaauuggggcuggcuuacagguucagagguucaguucauuaucaucaaggcaggaacauagcaccauccagguaagcugagaguucuacaucuugaucugaagguuacuagaagacauacuuccaggcggcuagaaugagggucucaaagcccuuccccggccacaccuccuaauagugcuaccccuugggccaagcauauucaaaaccaccaugaaagagaaccaauaggcauggaagcauugagacagucaaagcuugcuguaugccugucuacauucugcuucucuuuuaaaaagaguugcuaccuaccuaaggagauuuccaucagcacaggcggggaacacuguguagguuagguucuguggcuaguuucugugauuaguucuguggcugaagugaguagcaaagcugagccaggucguucaaguagcgcauuauugaaaaagaaagaaagaaguuuaauugaggccauaguaugaugaguuguggacuucacccuccauccaguaaacauccuuggaaaguauguggauacuaaugcauaugaaagcaugugcagagggacauacauguauggaggaguagaagaucucauuaucaugaucacuguucuaagagaacuaacgcuuccugggugucaaacuaccuuucaaaacaaaaaccuaguuugcuuuggaaagucauuuuuaaaacaauaaaauuaaagaaaaauggcagaaauaaaacuaaacgugccuaucgugucagugaccauaacaaauuuaacugaucuaguguaacuuuuuauguuaaagcauaaaguaaaauuuaacuugucuuuucugaaaacauacauaucuauaaaaggaaugugauaaaaaaaacgaaauaugagcaguaaaaaaccugggacucauuuacuuaacaagauagaaugcagggcaggaagaaaaggacuucuuagaaagcuaagggcacaguuuuacaguguaauauuuauugauauguuaugaaaacccaaguuugauaagaaguggauuaauacuuagguccaugugauaauagagucauaggguuuguaguacacguuguacgucuuauugaauugugucaaacagauuucuuuuggcucccuguuucagauguuuuagucucuaauugguuggcuuucuugccuucagcagcaguguauauuguugagcucaucaugguggcugaguaacaaaagauaugggaggggccaauacucucagacuccuugaccuaacuucuuuccaucacauccuugugugaaguucuucuaccucccaguggagcuacaggcuguccaacaaaccuuuauggccuuuggggaucauauaagauccaaacugaaacacuuuuaugggaacuuuuuuuuuuuuuuaaaucaggcauguugaguggaaaauacagugugacucaaagaacagucauaauuuucuuuuggcauauaugugcaaauauuuuucaagacuauaacucgaaggaacagugcuguauaguaauugggaggccaccauacauugaacauuaucuccuaucaccacugcuaucuccagguuccaggguguguauaggaaaagaaugaaguuguggucuugacuuuucuccaaauuccuagucuuuguuaguugcucaaaguuuggguucuagaagagcaaaugugauuuuucagaaaguaauccuuuccacacauuaaggaucuuauuuccagccaugaaaauccuuuuauacuaagaacauucccuguaauuuaguucauuccauauuuagacauacugaagacaaauaacagaacaucaguuuuuauuggaaauccauguaugaucaaacaauagcaaaaaguauaaaguauagcaacuuuuauuucuuuguauuugcccaugucuguuuuacugucauaguuugagauuagagaucauuuuacugaucucucaguuuggguauguuggaaggggaaagggaauuaaagaaccuaccuuuccuaaugucugcauguguuuucaguugaugaaaaaugcuucuauuguucugaugcuuguucauaaaugcauauugcuucugaugguaccaaaguagguuucuuccauacuacaagaaaacaacugagcaaguuuagaguucaaaauagcuucucaggcuuagacacuuuguccuguuuuccuuucucuuugaacuucuacuaguucauuauauugcucuugagaauacaaacugugagaugugccuugauugguauccaacuucaaggcacuaaguuuucaucagcuccagcuucuuuucuccaggggccuuucaacaucuagcuccuuacagccaacugcacaccuauuaugcuuuuguuguccaccagcuuaaugcaaaacugaaaguaagagugugcugacauuacaggcagagaaguggccuccagggauaagaagcagcuuugggacuugaggugguaggcugucugucagaauggauuacaaauggagaagagcaauugcuugauacaucacuuauuuuuuccuauaggagaaucucauacaaaaagacaagcaacugaaagcuaagaaaaauacucuaagcuauuacuacagaaugcuuugauggacagaaugcccacuaacagcagcaaugccacagggaagaaaacauuuuccuuucaagcuguuuaugcuagugauuuuauauagaaauucuuugcacauuuuuuaaggaaaaggcuacuuuacaaaaauaaaauguacauuucaaacaaaauuacaguuuccauuuuuuaaagucaagcaaucuacaugucacuguaaaauuaucacaaacuugauuaucuucauauuugaggaccauaaauuuuguaguuuuaagugacuuuauaugcuugucacuagaguaaauccucucuaaagcagugcauuguaagcuucagugugcauaggaaucaucuauuauuauuaaaucaucauauuaaauaugaagguuuguauuccuuaggccugggcugaaagcucacagagucucaggugauagcaacgcuucaagggcaagggccacacugaacaguaagguucuaacauguugggcuuuaaacaaauacaugcaucagaaaugcuucuuguuuucuuaacccacugguuauaagauguucuagugagccacuuaaagccuaaaaaaacgcauccaugaaugugauucucucuaacagaaaggauauuugauaacuacuucugaauaauauuuuauuagcucuggaccccaaaacuaccauaccauuuucucuuaccuuacagauggcuaauguagcuguuggguuucuuuuuuuuuaacugacuagugugaaguagcuguugugguuuuggaaauaauuuacugaugauccuguuuauucuccuucagcuucauuaagguauagagaugauauguguuuacaguuuacacugcaauguuuugauauauaucuauauaauaaaauuauuaaaucaagcuaauauccaucaccuuauagaccauauuuuugugaugugaauauuuguaaucuaauuacuuauuaguuuucaaguauauuauuauuaacuggagucaucauacucugcgguauauuuuauugggucgucugugugcuggaacaucuggaaaccaugccaaagcaugugaagggaacugaaagauauuucugggggaucagggcagcuguugggcugagaugcagaggagcuaaugggauuaugggcagggcagauuuaagucuccagauuuccacuaaguguaguguuucucugucaaauaaguaguuuuaaccauuuucuccucaaacuugcuaaaauauuuguagacuguucuccuuuaccucuuuaaucccaugucucaucuccaacacucacuguaauuuucaguauuaauagaaauaggcaauaccucuccugggcauauauccagaagaugucccaaccgguaagaaggacacaugcuccacuauguucauagcagccuuauuuauaauagccagaagcuggaaagaacccagaugccccucaaaagaggaauggauacagaaaaugugguacauuuacacaauggaguacuacucaucuauuaaaaaaaaugaauuuaugaaauuccuaggcaaauggauggaccuggagggcaucauccugagugagguaacccaaucacaaaggaacuugcacaauauguacucacugauaaguggauauuagcccagaaacuuaggauacccaagauauaagauacaauuugcuaaacgcaugaaauucaagaagaacgaagaccaaaguguggacacuuugccccuucuuagaaaugggaacaaaacacccauggaaggaguuacagagacaaaauuuggagcugugacgaaaggauggaccaucuagugauugccauaugcagggauccaucccauaaucagcuuccaaaagcugacaccauugcauacacuagcaagauuuugcugaaaggacccagaauagcugucucuugugagacuaugccggggccuagcaaacacagaaguggaugaucacagucagcuauuggaugggucacacggcccccaauggaggagcuagagaaauuacucaaggagcuaaagggaacugcaacccuauagguggaacaacauuaugaacuaaccaguaccugggagcucuugacucuagcugcauauguaucaaaagauggccuagucggccauuacuggaaagagaggcccauuggacacgcaaacuuuauaugccccaguacaggggaaccccagggccaaaaagggggaguggguggguaggggauugcggggguggguauaggggacuuuugggauagcauugaauguaaacgaggaaaauaccuaauuaaaaaaaaaaaagaguaaaaaaaaaagaguaaaaaaaaaaagaaaaaaaagaaauaggcucauucaccuauguagccauuuaguacuuauucgagugcuuuuuguguacaaauagaauaugguaguagaugggucaacuuucaaacauugguagaggaauuaaauaaccaguuuaaggauggaaguaagauguguucuuuauuaugaaagaauauguugauguucuguagaaaguccucuaguucacaugagagaugugaaucacuguugucuggggccauuuagaaagucuuuguacaaaaggagucuuugacuguucauggcuguuacaacagugaucaugcauggcacaagcaaagcaggcaggagaacauugaacuauauuuuaggaauugcaaguauuguaaacuuauuagacuuuuuaauuuauaaauuauuggaucuggacuauuugugagugaccuuuauaaaggccauacagcaguucugagcugcugauuuuauucucuugcacagccuagugaggcuagugauuggcuuagcagucacauccuugcuucucuuuucauucuuacucuguucucauuuucgcauguuauaugaagggguaaugcucacaaucuaggauuaugaagagcuauucuacaguugcucucaguuacuaagggucugcuacaguaacugucuauaacuuuuugccaaaaaaucugccuauagaggaaaaaguuuuauugaguauauaaaaugacaggacaacaggcaugauuaacagaggucucuuaagaaagauagaguuuuaugugugauggggaaaggagagaaugaauauaaaugaauaugaauucauuucuugagacaggaucucacugucuagccuaagcugucuuaaagcuugugauccuccugcuugggucucugagguguagagauuauaagcuugcauuacugacugcauccuguuaacagugugguuacuguaacuguaguucauuuugguuggagcuuagggcacugaggaaaagccauaggauguaauucaggaaguaaggugcagcuaguuucugaguggcccuaaaugacuaguagaccaguuagaguuuugugcagugacagaaaacccuugaagguuugcugucagaggaauugcuguacaugaagcucuauucagaaagauuagucuggccuccaugggaaauauucaauuuagagaguauacuacuacuacuacuacuacuacuacuacuacuacuacuacuacuacuucuucuucuucuucuucuucuucuucuucuucuacuacuacuacuacuucuucuacuacuacuacuucuacuacuacuucuuuuuuuuauuuuuauuuuuauuuuauuuuuaauuuuuuuauuagguauuuagcucauuuacauuuccaaugcuauaccaaaagucccccauacccacccacucccacuccccuacccgcccacucccccuuuuuggcccuggcguuccccuguucuggggcauauaaaguuugcguguccaaugguccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuuccauaaaaucuugcuaggguaugcaauggugucagcguuuggaugcugauuaugggguggaucccuggauauggcagucucuacaugguccauccuuucaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguaaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaacugccagacugauuuccagagugguuguacaagccugcaaucccaccaacaauggaggaguguuccucuuucuucacauccacgccagcaucugcugucaccugaauuuuugaucuuugccauucugacuggugugagguagaaucucaggguuguuuugauuugcauuucccugcugauuaaggaugcugagcauuuuuucaggugcuucucagacauucgguauuccugaggugagaauucuuuguuuagcucugagccccauuuuuaaaugggguuauuugauuuucuggagucuaccuucuugaguucuuuauauauauguuggauauuaguccccuaucugauuuaggauagguaaagauccuuucccaaucuguugguggucuuuuugucuuauugacagugucuuuugccuugcagaaacuuuggaguuucauuaggucccauuugucaauucucgaucuuacagcacaagccauugcuguucuguucaggaauuuuuccccugugcccauaucuuuaaggcuuuuccccacuuucuccucuauaaguuugaguguuucugguuuuaugugaaguucuuugauccauuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuugccacaauugcucuguaguaaagcuuuaggucaggcauggugauuccaccagagguucuuuuauccuugagaagaguuuuugcuauccuagguuuuuguuauuccagaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugauuuccuccuuuccaauuuguauccccuugaucuccuuuuguagucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaaauccugaucuuuccagaacuuuuaucaugaauggguguuggaucuugucaaaugcuuuuucugcaucuaacaagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcaagaauuuuauugaggauuuuugcaucaauauucauaagagaaauuggucugaaguucucuaucuuuguuggaucuuucuaugguuuagguaucagaguaauaguggcuucauaaaaugaguuggguagaguaccuucuacuucuauuuugugaaauaguuugugcagaacuggaauuagaucuucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuuuguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuuacuacuacuacuucuacuacugguucccauuaagaauauauuuggauagaaacuucugguaauaaugaacuaagaaguuauauuuauuuuuuaaauuauguacaauucauauaaaacuauuuaaaauaauuuaucuucagcauuauugcuaaguucuucuugauucuaaagaagguccucaugaguuuggugcaucuuucaaaaagaguagcugcacugaggcuuagcacugggugacagagcacucacauguuaaaauagugaggacagauaugggucauaaguguaacaguuaaaaugaccuaauauugagugguuaauaaaacauuugccaaaauugauuuccuaaauauuucacuuuagcauguaaucagcauucaauaugauagguaaucuaccuaauaguuuaauuucuuaguaacuccuauugacuuugacuacuuuuucagauauuuuucuauucccacacuaaucagcccacugggcuauugggaaaggaaagacauuuucuaccaagaaaaacaaagcuuaauagaagugggcuuggucaaaggaugauuguguaguagcucaaaagagggcaccuagguagaguaggcuguguguacagagagaagcaagaaaugauggggcauaguugagacaggaucuagguggcuuuuaaguacuggcuuugcuagccagacagguugccuuggaggaagauagggaggguaacuaaggaaagauuuugugcuucccauaaguaccccaguuuuaaaaacccuuuagguaaugcugaagaaguuccuacuauuggaagcuuuuaaaaaauacuguucccccucccucucauuuuuuuccccucaugaauuccacuugguguggagguagaggacaccuugugagaguucugucuuucuacuauauggguuccagagauugaauuuaggccauuaagcuuaguggcaaguucauuuuaaccacugagccaucucacuagcucuauuuaaagauuuuuaaauacugaguuuugugcaacagccaagagaaugcccuuuuauacaaauaugucacuguacaucucagauggaauugcuuaauagcugauaaaccuaauguguguugaagagauuaucuaauaagucguggaauaugguuagagaaaguucuccauuguugcauuaauaacaaagugauauaaugaacugaagggaauaacuuguacaauacuuuugagucugugucuauacuuauauauguugucuguuacauuuauaauauuucacuauuagacacuguguucuccaugacuauuaagaucugcuauuuaaaauuguccccucucaucugucugccugugugcauguguguguuucuaguuuauuuuucaaaaguugaaauguuuacuucaacuauagugauuccucacuucgcuuugcccggggcccacuugucuuuauuucuugugaacucugcauuugaagcauaaaauuguuugcccccgagagucuuuauuuagcccagggcugguagaaagagaaguaaucugccagucugguggaguugaugaaaauucaagcagacuuuucauacugcacauuaauagaaauguuaaugcucauaggaaacccccucacuccccagagggaagagagccuuggguuggaggcauuuucuugcuuuggguucuuguaacaaacccagcuggaugccagucucaucuguugcguauguccuaguacaguguuuuuaaacagguauuccauagcaucagcaugccugcugccugccugucugucugucuaucaaucugucuaaaguugaguuauuggugaguuacuaaacuuugaaaugucauguuauaagaaauaaguguucauguaguagcguccaauggaguaucuggcaguauuuaguauuugacuaaacucugacguuaguguucacuuacuguaaagcagugauucaguggauggguuuucauguguaaauucugcuuugaacaaaagauccccugggcaguagauacauuaagguaaagauggaacuuaagaauaaauauuacuuacuaaacugaguaaaacuuugcuacuuugguuuaaaauuugaucuuaucucugcauugcaguuguuagguuagauucucuuugacaagcuagaacuuggauuuccacauuaaagagaaagugaaaacauuauuuuucuugggguagcugacacauaacacaucauuaucacagacagugaaagcaguacgagggcuguccaggcagguccuccaggcucugucugagaugaaugcugguuagagucacugagcuuaguuuuauaucagcacuuucagaauggcugaauaaauucauaauuuuccuaguuauuuacaaacuauuuggaaguauaagaauucucugaccaauuuuuaggcuggggaaguuaauauuucuauuuuauuguucuaauaaauaaugaaggucagaauagcuaauaaugauuaaaucaauugauagaugauuuucuaaaaacagguagagccaacuuuauuacuguuuuagacugcuuuauuuuuuuauggaauuguuaauuuuacauuuuuaaauuuucagguaacuucaauuuuuacaccuauaacagcugaaauagcaagucuugauucagagaauauagaugaaauuuuaaguaaguaucuugauuuuuuuuuaaaguauguuuucuucucuauaaauaaauuauaaauaaaauuucaauuaucuauaguagauaacaagcugagauucuggcucauuucacugauuguauaaaaguacuuuagguuuugauuauuaguaaaauuucuuaaaguguguccuucuuuccuguuuuguaagacaucuaacuuguuugucuuguuguagauagcauuucugacagugcaugaggugucucauaaggccugcaguugucacuuuacacucugaauauuaagagccauagagaagagccaagaauuucuuucuuucauuuuaauuaaaugacuuauucacccaucuuuuuaauaacauccaguuaaguucaguaauuguuauacugacuauauuauuuacugauacuguaauuauagauagaauuaacuugggggauauucugauuuuuacagauacuaaagaaaaggucaaggcaugguugauauggugggugauuacaauauaggagauuuuaaaaugucugcaguguccauaaaucguccuucuuuaaaaaaaaaacaaaaaccaaaaaacuaaaaccaaaaaugccaugucacugguuugcauaugaccaaacccaaaaguauuugagaugaagaggaaauaaaauuaccuacauugguuuauguuuguggagcuuuaacugucaaaagacgcuauugccaccucaugagcucucuagagcagcaucuauauaccaggucuuauuacucuccgugcugcuugggcagcuccaguuccuggcagaagcugcuggaccgcaccuaauuuacauuucugugaguuccugugugaugguggaacuucugguccagaaaccaguuugugagucacagcuugagugaacaugcaagugaaccaaaaaugugagaggaaaaggggaaggagccuggaguaugcacuuuucucaucccugucaccguccagauucugaaacaucuuuguguauuguuuucaugaguucugaaagagguuguuguuguuguuguuauuaaauuuauuuaucauuuuacaacccaguaucaguccuuccucuccuaguacccccucaugcaaguccccuuagaaggagaagucccucucugggugucaaccccccccccccccccggccuccucuccccauauauacacacaucaagucacagaaggacuaggcacauccucucccacugaugucagaaaagguuguucuuuuagaggugugggauccacaggcaggcaacagguucagggacagccccugcuccacuuguuugggggaccugaaugacaacuaagcugcucaucugcuacauauguucaggggaccucgguccagcccgugcccacucuuugguuggugauucagugucggggagucccuguucucuucaggucccucaguuuuucucccaagcucuaucaacuguuugggugugucucugcaucucuuuccauuguggagccucucagaggacaguuaugcuagguuccugucugcaagcauaacaaacagaauuucuauuauuaauaguuucagggauugguucuugcccauggaaugggucucaauuucaggcagucacugguuggccauuuaaguuuuucugaguuggguuuaaucaaaagaagcaauagugugucuuucucgaguccuuacguccaaagauucaaauaauggugagauuuugugugacagaguauuauuaaguagguaggaacuaggaaaaguggauuuuauaaugcagcaagguagaugucugagaaugagacauagguaauugaucagaucucuucagugaagaauucaccuugcagaacugguucccaguuacuauguguaugaaauauuuaaaaauggauuauuaaguaagcuccaggcgauccuccuuuacgaggauggauugcugaguuuacauugcgacccaggacgggguagagaaaggguuaaguuauauauaagccaaccuuucuguauggcuuucuggaugagugguagcuauuaucucaaagcuuuaacugacuguuuauaaauggaaaauaucaugauaaaaauuguauuuuuaaguaugucaauauagacacaaauaacuuuguuuuuguuuuuaaauuucagauaaugcugauguugcuuuaguaaauuuuuaugcugacugguaaguaaucuuguuuuaguuugggggugguuucccuuuccaccucucuuuucuucuuuccuucuuuucuuugcuauuuucucuguauaugagaauagggcacagaguagaagucaggauauaggcaugucaaguuuauaagaauaauguugauauuuuucaacuuacacacuuuuuuccaggaggccuguaguucuugcucuaaaucagaucuugucuuuugacuuuauaugguaccggggaccauuuacuucuuuuuacuugagguugguugucccuuaucugaagugcuuuggcucagaauaguuucaauguuuuggaacauguacauagacuuuuagcacucgagugucuuuaauucaaaaauccaaagccuaaacaauuccaauaucugaaacuuuaucguuugcaauuucagacuuucaaauuagaaauguucaauuuagguauugguuuuuaaucugaggugcccuaccgaacggacuuugagggcagaaacagugucuuacuaguauucccagaaucuagaacuuaagguugaagucugcuaaagaauaacugaauuugaauuugaagcgugggcaucguugcuuucaucuacucccuacaaggguuauuaucugccagcugcuaccuuucugucugggcuguggcccuguauuaccuuaguuuccugugacagucuccuccacuggcuuucugugccucuagucuuacauguuuccacaauguucucugcaguauaaggcagaguuuauauacuauggauuuauauguucucauauuaugugguuuuuacaauauucucugcaauauuaggcagauuucuucccuauaggacagauuaauuacguucacaguguaccuuaaaucuccuuaauuuuuagguuaaaauguaagccccuugucuugaccuagaaggccccucauguugcaucuuuuguuucugcuuucaugcucugcuugcuacuccaagcuuuccucaguuucugugaaaauguguucucucacacugaucuccugcugucuucccaaccuggggaucacuucuuauucucacucacuucuuuucuuguuaaccaccuuucaaaucuuagguuaagagccacuuuuuuccagucaucuuuauauaucaguguuccuaacuucuucuuaagucagauuaggaaaccuuguauauguccaguuugcaauauaauaauaauuuagcauuugaguuuuuaauuuuacuauuguauaaagauucuacccauucaauagaaacuggacuuuaaauugugacucugucugagcuagugacaugcaguguguauucugccuguggcagacugcgaugacaaggucuagcucccaagcagaaggggucaugagggugagaaacaaauauucugcacugugcuguuucugagcugugcugucuggaggauaggcauaguuagugcauuuucaccuuaagauaucuucaguucacauuagacuccuuggauuuaguucuuuugucagucaggaagcaucuguauuuuccguagcccaggcuuacccggcugaggcccuauucccaaauaccaucuuugcuuuguggagacaguuaucaucauaacuguacuuuaaaaugccauucuuaggcacuuccauaccucauaagcacauaccggugacuucugauugaaugcugauguuugauacuaguguuuaaagaacuugaaugaaaaguugaagauacacagaaaaauacuguuuauaaaguguauaauggagcuauaauuuuuuaaggcaaauuaggauuaaugguagucauaccauuugguagaagauuaucuaggccaaacuuuacagguaaggaugaccugaucagauuguagcacagggcaaauuagaaugcagcguucuugcccgaggaauucucaguacaugugcuaacuuuguugcaaaauaugaguuggaaaaguggacuguggcaguuacuuaagaaagcauacuaccuaaagaauguccuucacucuuaauggugaaugaguguuccuuuuuuuaauggagacaacucgaguaguuugcugacaggcuugcuguguuugcuuucagaggcuagacuucauucucuuaguuggcucucuuauguaacugccuagaacuacugcagugccucggaguaguaaacugcaguggguguuuaguaaagcugggaguguggcaaacucuacauacauuguuuuaagcucuggauugcccugcagguaggcauuguaauuccuauuuuagauuuagaaaguugagguucagaaagaccaucugcuuaauaagugguggaucugagauuuaaagucagguaugucucaaucuaaagguuauuuccuucccacuaaaucauaauuguaaugaccccaaaguccuuguugguugcuuuguuaaggauuguuuaagcccuagacuggagacuauguucagaagaccaugagacucuuuaguuggucuguugguuuuauuguguuaccuguguaaacguggcguuuacaugcacaugaagcugcacugauacuagaauugaccuguuauuucacuuucccauuuaaauuuuuaguagauaaaaugauacuauuuuaaacacgaaucugcuuuaaaacuuaacuggacagcauaacuaaacaguccagagaacucuugaugugagucuuccuuugcuccuaagccagacgccuuccaucaguucuuuacuagaccacaucuaaaguuuucagaaccacagucaaaccuugucuuugccuucuucugcccucuaccuagucuacuuucagaagauuuuuaguacucacagaccugggcuuccaguugcucuagcuuuugaauuuaucagcuugcucauuuaacagacaucuauugaaugcuuauuagaauauguagucaaauaagacacgguccaugauguccacagacccuuccuaccuaucccagacgggagauuuaagaugcuaaagaggaaagaaccacuugaaagcaggagucugaagauacagauugugucuccuugauauauucuaggacaucuccuuaggaagucaggugaguaggcuagagagaaauagaagaagaaauagggaggagguauaauucugcauccuugcauauauucuuuauggauuguugccaauauauguaagaucacagauggauuagaauuuaugggcuucuucaagacacugucuugguacauaagggcaauuauagucuuaccauauccucgauaccuuuucccaugaaguguccauuuuccccagcuaguuauguguguacacuuuguuuucuuucccccucagguccauuuaaucacccacacuaaguauuucugaaaugguuggccuaaugaggagcaauuaggauuagaaguaacaguuuccuggaguaauuguagcuauuuugccugacuuuuaaauaguuaugggggggggggggcggaacauggucaagaagucuuuaggaauuuuauuuuauuuuuuaauuuuuauuuauuuauuugguuuuucgagacaggguuucucuguguagccuuggcuauccuggaacucacucuguagaccaggcuggccuugagcucagaaaucugccugccucugcuucccaagugcugggauuauaggcgugcgccaccaugccuggccaaggaauuuuaauauuuacuucuggauguaguauguuuauauguuuacagauacaaaggccuauuuuaaugugaggauauacauugaagagaaaacacuaauuauaugccauauauucuuuuguaagaacuguuuuauuuaguauguuaacuugugucugagauugaugaaguagcacaugucuguaaugaacuaaguauauaauaaacuaaugaaguacccagcauuugcaauaaacucacaguuccaguaacauggaaauguguucaauguccagagaaacugauuuguguuuuuuuguaaacacucaaaucuuagcaguguggguuagaggcaugcugcaggccucggucauggccucugugagggauccauagcucuaugcgccauaacacuggcaguuaguuaaucauaaggcggaacaacacaccaacuggauacuuuacacagcauugaguuacagagaacacucuuugaauucaaguuguuuuccucucauucacugacagacuuccgaaccaugaugaaauugaaggugugauugucucacacauugucuauugaacggauacuaaacaucaaugagugauaacugacauaagauccugugucuucuggguuucccugcuaauuggugugcuugucuguguguaggugucguuucagccagauguugcauccaauuuuugaggaagcaucugaugucauuaaggaagaauauccagauaaaaaucaaguaguguuugccagaguugauugugaucagcacuguaaguaaccgaguaggaagucuggaaggacuuguccuggcccuccucugcacaugcacaaacuuuauuuuuuauuuuuuucaaaugcccugguuucagagaagaugaaaucuaaaagggauuggaaccuaguauaaauuucuaauaucucaucuuuuaugucuuuuuaacuccauguugccuauguaacauuugugggauuuugcuuuguuuuaauuaaaauacagcaguucaaauauauagguagcaaauuauaacuaacuacauuuucuaccaaagcaaacgcuaaaaucaauaaauacaauugaacuauaguuuuggaaggcaaguggggauuuuuguuacucugagaaacaugcaaaaauauaauauucgauuuaaauaagacuacaauaugguacuuguuuaaaauaagacagugucagauuuuuuguguuucuauuuguuauuuuaaagauuauucgaagucuggcuuuguauuugaaguguaaagagccgcaagcaguauuaaauuauuaaaaaaagacuuugguuagucucucuaaaaaucuguuuucuugaauuuugcuugucuguguggaacgcacuguguaaacucugcuuuuuaauauaaauagcaguauuuucuaaguugaacuaaugagcuagcaguucgugcuccucccaagugcuccguacccagccuucucuucucagagcaccaaaugaguugaccuagguagaucucguguugaauggagucuuagcucaucucagcaucagcugcacugugaguuccucaagucagcacuuucucucuuacuagugcucccaguuguagagacuuaacaacuuacuaaucuuuauaugucauacauuugacaguuucuagaagacaucaacucauuacaagccugguuguauugaguucuuggaaaguuacuauauacaaagccaucuccuauucugcaaauuuucugcccuuuauacuugaccuacugauuguuguuauucugcucuugaacauaugguuggucugucugucugucugacuccaguuuuccaagcaaagaaacagaaauaaagugccuuaaccaguguugcacagcuuaguauacauuaagucagaauuagaauccuggucugaccacaugcuucuacagagcaguuuuccucuuuucugucccauucagagaacauuuugaggauuugcuggcacuguucaaugcuguauacaaaagcauuuucuaacagcuuaucauuucaaacauaccguuuucuaucuguuaggauucacggcuggauuaaguaaagagggcaauaagacuaagauguagguagaagcauagacggugucuccgugcugcuguccuccugcccugcccucccugacagcaagccaugcguggaguggacucagcauucagaucuuccuguucuuuuuguauuuaauuagagguuacaaugcaaaugagucucggagucccuaccagcagugauuuugaaucauugugcuuucaaacucgcaguugugggggagagaauuaguuauuucugugauugaacuauguccaucauuuauguuauauuuuagacagauagcuucuuuaaaaaaaaaaaaaaccaaaacugcagcuuucugucgccuacugguuuuuuuugagauuuauuauuauuuuuuauuuauuucauguauaugaguacacuguagcuguuuucagacauaccagaagagggcaucagaucucauuauagaugguugugagccaucagugguugcuaggaauugaacucaggaccucuggaagagcggucagugcucuuaacuguugagccaucucaccagccccagauaacuucuaauauaaauuacauuauuacaaguuucuuguuauugacgaacuuucccaauacagccauaguauagauguuucuaacccauuauuguuuacucuugaaaguuauaucugccaacaauaccucuccuggggauauacccauaagaugauccaacugguaauaaggacacaugcucuacuauauucauagcagccuuauuuauaauagccagaagcuggaaagaacccagauguuccccaacagaggaauggauacagaaaaugugguacauuuacacaauggaguacuacucagcuauuaaaaacaaugaauuuaugaaauucuugggcaaauggauguaucuggaggauauuauccuuagugagguaacccaaucacaaaagaagucacuugauaugcacucacugauaaguggauauuagcccagaaaccuagaauacccacgauacaacuuccaaaacacaagaaaaucaagaagaaagaccaacgcauggauacuucauuugucccuagaguagggaauaaaauauccauggaaggaguuacagagacaaaguuuggagcuaagacgaaaggauggaccauccagagucugccccaccugggggccuaucccauaaucagccaccaaacgcaggcacuauugcauacgccagcaagauuuugcugaaaggacccugauauagcgucuccuuugaggcuaugccggggccuggcaaauacagaaguggaugcucacagucaucuauuggauggaacacagggcccccaguguaggagcuagagaaaguacccaagagcugaaggggucugcaacccuauagguggaacaacaauaugaacuaaccaguacccccagagcucaugucccuagcugcauauguaucagaagauggccuagucggccaucauugggaagagaggcaggccccuuggucuagcaaacuuuauaugccucaguacaggggaacgccagggccaagaagugggaguggguggguaggggagcagggcagggagaggguauaggcuacuuuuaggauagcacuugaaauguaaaugaagaaaauaucuaauaaaaaaaaagaaaaagaaagaaaagaaaaaaacgaaaguuauaucugugguguuaaguccuucccaaauagguuccuuguuuggauaacuucucuuuuaaaaaguaggacuuauuggcaauuuauuugcauuuugugauguuuucaccuuuuugguguuuaauuuuguaagaugugcucuacucuuucuaguuuguacugggaaaguucugagcugggacaguguuaggaauuccguggucuggggagaagagccuguuggugagaacacuguuaggcuugcuuucuacaacaagauacuaaaauaccauuggcuugcgagccccaaguuuaaaguggagcagcugaggcuuugauauaugcuuaccccaugguuuaucuccacagcuaagauucuuaccaucucuaaauucucauugugccuuuuauguacuuuccaccccagcuacucaaccuuuagcagaccccucuuuuggucacuuucuaaaauuuuauguaaguagagucauauagcauguaugcuucucuuuuugcuuagcuuuguuauuuugagauuauuccauguuguauaauguuauuaauuacuugaaggguuuuuguuuuugagacagagucucaccguauagcccuagcugcccucaaacacauggauaucaccaccucugacuuuggaguucugggauuaaagacaugagccacuaugccugguuccuuuguuuuuaauauucagugacauuuuauuguagggugauaguauugagccugagaauguuuucaugcauucauauaacgguuguauauuuuuaauaaaguaccuauuaaaauuguacacauuuuuguuggauuauuuuccuacugugugugugguuuuauaugagucuaaauucuguuuuaaauguacuguuugcagaauuuucucccauucugcuugguaccuguuguuuuaauuggauagaaugccuguaacauacaguuggcacccaaacucugcugcuuuguagcuccaguaguguuaacauauauugacauuguuuuuacccagucuccagaucuucuuaucuugugaaacgcuguagaucugaaacagcaaugucucauuucuccuaacccucagccguugccagcggccauucugcuuucuacuuguaggacaugaacauuccagauaaccuguuuacguggaauugaacaguaucuuugucauugauuuugcuuggcaugauaaagauccucccuguggagaucuuuaauaaagcagcucucugagauguuccuuguucauauugcuuuauuugguggaggaugucagccacauacacuuuauucagugugaaccagggacuguauaccucuugggggauggaauacucagaaagggaaggucauuauuggcugaaggcuuaggguaccaaaaugccucauuagcauggagaaacauugcagguauaucugcaaugugacuuagugcccagggguccucagugggagucaugguuacauguuccagagcaaguacagagacagguaggaauaggcuccugcuguugucaaaucucugagauuccucggcucugagcuuacucagacuuaccaguucuuaugccugucugguagcaugcucccacaugcccuacagucaagacuaguucaauuuuucuuuuaaaguggaauauuccaguguuuauuauaaguguauaacauauguaauaaugaaaguuaaugaaucuaguuuugcaaaauauuuuauuguacuaaaacuuaaaggaaauacuuucuuuuuguuuggauuuauucaaguugccaaaaucauuacuuaguauguagucauuacuaaguuaaaaaagaacuugaauauaagcacuguagugcuauaauugaucagauagccaagacaacuacugaguugucuugggcagugacuaaugggcaggcaauaaguauaugcaguguggauauacagcguaugcaauguggauauucaagauaaaggaagaccuaguacacuaguaggaggaauuaagacaugacauuuaucaugccauucacaaugguguucaguuucauaguuuaauuuauuucuugaauuuuuaugugguauucuuggcugcaguugacaauaaauauuaaacuuauauagcacauuuuguugcuccaucaucuuacauuucuguuaguauugcaggaguguuucaguuuucuuauauuuuugcuaacaguaugugaacuguuaugauaucuauacuaaguuuuugagaguaccuauuaugcaauggauaugagguuacaugguugguuugcauucccuaaagcuuacugauauugaauaucuuuauauaugcuuguugauuauuaaagucauguucauuuacauccuuuacucauuuuuuacaucaguuuuuauuuucuuuguuauugaauagucaaagcucuuuauauauucuguauauuaaauaucacauaugugacuuucagauauuuuugucaucuuguagguugucuuuuuaguuuguugguuaugucuucaugcauaguuuuguucccucaaucuuguuguagucuaauuuaucuguuuguacuuuuuuuuuuuuuuuuggccauguuuuagguaucguagcuaagaaaucccagcaaauucaaugucaauaagcucuccuauacuuuaauaguuuuccaaucuuaggccuuacuuuaggucuuugguacuauuugacuuaauuuuuauauguggaguaagguaaagucuagguuuauuucugagcauauaagauauccaggcugucuggaaccauuuguugaagagcuauccuccugcucugauuagaugguacugacuugcuuguaaggcaguggccgaugguguauguggugcuuuauuuccagguucucucuucaauaccaugauuucugucagacaguuuuauuguagcucuguaaaauaaugcuugaaauauggaaauaugugauacuucagcuuuguucaggauugcuuuuuguuguuuucaguuuuuuuauucuacuuauuuguuuucuuuuuauguauugugcauaccauaacaugcauauugaguucagaggacaacuuggagcaaucuguucucuccuaccaccaugugagucuuggggauuaaacucaaggugucagguuugguuauaaucaucuuucuccccucuccccacuuugacacauuuauaaacauaaaauauucuuagcuuauuuuccccuucgcucucuacccucugucccucuaauuccuccagaccccauucauggccucuuuuucuuuaauuauuguuaccuauauaugugcaaaaauauauaagugcaaugugcugagucuguugaguuuaggguugaccaucugaugcuggguaaccaauuagggaacucaucucugaggaagacuaauuuuccuucuuugaacugucauuaguugccuguaacucuuugucuaaggaguggagucccaugaguauccccuuucuaugauaguauguccauuugguguuuucaauguuuaggucuuauuuagcagccauauugcucuagcuaucagguauagcuagcuuccuuguuguuucuaggagaccaucuuacagcaggcuuccuaguccuuugguuuuuacgacuuuucuguuugcucuucuacagugucacguggacuuuggguacaagagcuguguuguagcuguagccauugcccuuugguuuuuuguuuguuuguuuguuuguuuguuuguuugagagggucccucuaaguagcccaggcuacccuggggcuuaauauguagcucagcauccgauggucaacccuaaaaucacucauacaagaaauucucaacagacucagcacauugcauuuauauauuuuuguacauguauagcccagccuugaauuuguaaucauccuacuuaaauuuucaaagugcugggguuguagaccuguggcaccauaccgagcuuaaauggcuuugcaagggcauguccugaauuuuaaaauaucuuuuuuagauuuuuuuuuauguguaugaauguuuaucuucauguagguagguagguagguagguagguagguagguagguagguagguaggcaggcaggcaggcaggcaggcaggcaggcaggcaggcagacagacagaccauguguguguauaguuucuguagaguucagaaaagggagacagaucucuuagaacuguuguuagggcugucuguagaccaccauguaaguguggggaacugaggucaaguccucugcaagaggaauaaguacucuuaaucacugaaccauccuucugaucccauguuaucacugaauuuugaucaaauccuacuuacuaauuuuuaauggaucauacuuuauauuuuguaucuuaaguugucuguucucccccaauauugcaauuuuuucugccauguuuucuucaguacauuucacaguaugaacauuuccacuuaugcccauuguucauuuggaguuagcuuuuauauguggaacaauauaugaguuaaaguggguaggugaucuguuguuguauuuaguugccagacagauccgucauuacuuguuggcaaaaaaccucugccucuuugucacuaacugccuuagcagcuuuguugaagugaacuggcccuguccuuaugacucuauuucugguccuuuuuguacuguugaucuagugucugcucauccugcauguugugaguuguuacagcuuauggaaggucuugaaaacaagcgguauaaaucuuccaacuuugugcuuguuuuuucagaguggcuuugacuguuuuagugggauugaauuuccaugaauccuagaaacagcuuguuaguuucuaacaacaaagggggauccuggguuucuaauuagaguuaacugcauugagagcaguuuggaaaguuacuauuguaguaaucuuaagucuuuugauccacaaacauucuuaaucuuucaauguauuuaaauauuuucagcuucagcaauuuuuuucucauuuuccagucuacauauaguacuuugauacucauacaaccuacauuagacuauuuuacuuuuagauugauugcaugugcgcacauauguguauguuuucuuacuuacuuggcucuaccgcugccaucuuaugugaggacucugucagugcccucaguaugcucugacagauguggccagugcccucaguaugcucugacagauguggccagugcccucaguaugcucugacagauguggccagcucuccacugaguccaggcuacgguagugacuugucagaucuuggcucuuuauggccauuuaaaaaaaucuuuauuuuucagaaccuagacaauuccaagaaguauugguuauauaauuuguagaauauuuuucaguuuggguuugucuagguuccucccacaccgaggcuuugcacaucuuuuuugagacuuguuuuuauuuuucaagacaggguuucucuguauagcccugguuguccuggaacuugcucuguagacuaggcuagccucaaacucacagagaucugcaugcuucugccuucugaguacugagauuaaaggcaugcgccaccacugccugauguaagauuuauuuuuaacuaugucucaguuuuugauacucuuauaaauggcuuuggcuuuuaaauuuuaaaauuuugcauuuuuuguuaauauguagggauuaaaauuaacacuuuuguauugcuuuguguugaaauuuaauuccagcaguuuuuauuuagaauuugcauagcuuucuagugaaaauaauugugcucuauacaaauaaagucaguuuuccuuccuguggucagugucuccuuaccauauccugcacagacaaguucaugugcucgugcuuugggauuaacucuguggagucagaggacccguuuccuagcaagguguuugcagaaucaagaugucauccugacucugcacgacucacucuauuagucuccuguuagguauucugggagucugcucuggccugucacugugcuucacgcugucugucuuguucugacucaacugcuucacucagacgucucauccagagucauagugguguguauuggagaggcuccugugaaaaguuucuagcuaaaugaacuggugagccugcucauugagugcucauguggaguucagcuuguucuuacauacauugccucagcuauggucaccacagucuuuugaauuagcuagugguauuuacucaaccagagcauaagugccaauucucuguaaugacaugugacugguccuagagauauagcaaaauacacuuguaugcuguuuuaacuucucugaaggggcaguguuaauuaugugaugcauuauauugauaagcauagcuuacucugaugggguagggaaggaagccucucaggauaugauauaaacuugaaggaaaaguaguacuuccgcuguaagcucaagcuguguggugacagguaagcgugugaggaagaucucacuaugguguggcagguaugcguaaaggugacaucucucugagcugaaucuugcacaguccauuuggggaaauauuuguaaaugcuaucuucacuuuucuaaucagcccacuuuaagauugaugaugaggugagauuauaaaguugagaaacaacagaauuacaagccaagccaguauagaaauaaaaugccauuuaaaaaaaaugaagcaucacacggguauuuuaaagacguucuugggaaggcagugcaccuacucaucucuaaaaacagguggggaagucuucucuagaagacuguuuguugguuuaucuugaaaauucauuucagugcauauuccaggagccacucacuugguuugcugcuugcuuuuccguggagcuccucuccuacccacuggcaacucaggcagccuucuguucugccuuuaaccucacuuccuuauguacccuucuuaguaaggacauugugugaaagguucaguuccgugcugaggacuugggagguggaguaguuccacccagucggcacuuguguuucaggaaugaccugcacacacccuuguuuaucucugucugcucuccucugugcagcugaaaggguuauuagcacaugagcuggacuuccaucaggaagcccaccuacuguuucauuuuauugcaaccccaauguagaacuuauauuucacuuuuaagcuccuaaaauuuuucauuugcuauacucauuguaggaaaugaaugaacuauaaggaaaauagggagagaaaaaggaaaaugaaggcaugacuacuagaaaagaaacagaaauugaacucagucccaacugucucuguccccgagccgacaggaacagguagucuuacugguccuacggaagagcaggaugucaggucuuguuuuugccauuauucugacaguuuuccuccucuucucugucuaaaggacuugggaaacuacaucucuaaucaggauauaugcuguuguguauuccuuagaugggguggcaagaaucacagcuucuuauacuauaccaaggaacuccacacugaaacaugguuuugguguauaugcuauuuguuggggguuuuaaggcuuuucuaagaguuuguccuguguagacagggguaauauuggaaguaguuacauuaguuacagugguagcaauaaaauagaaggccaggugugguggcacuuaugcucagccucagcauuucggaggcaaaagcagaugaaucucuggguucaaggccagccauauaguuuauuagccuacacuggggaguccaggcuaugcauccaggcuaggauacauaguaaaauacugucucgauaaauaaaucaguaaaaugugagccuuguaagacuaugggccucaccucuguagugaucuuuaccaacuuugguaucuagcagguagacuuguucacuugugguaauugaauagaugaauggauuauugaaugcccaccaauaacuggagcaugacagguacacugguacuuuaaauugguuaucucaggucucuaacaguacaugugaggaguuucuucuguacuuuuccacaucuaacuucauugauuauaaggaacuauuuuaucuccacaugcagaaaguauugugugucuuacaaggaagggaaaugcacucaggaucucgugugacucaugccagcugagucagcguuuacaugucuccaugcagugauugacugcacacuugccuguuugacuggcuggagaauuugcuuuauucucaauuaaaacgucauugcuaguuaaguagguuuuauucaaggucagcaagauaaaaacuaaaauauuaauagugguuuuucuguagagacuaggaauaguuaauaaugguggcuggauuacaagugauuaguuuucuuuauaguuuuuuucuaaaagcauuugucaaauaugcauauuuuguaucuccacguauauguguguaugcacaugcuucaaacauacuuuugccuguacugcagaacaugaauccaugccaucugcagucuccucauuugagagugugggaauagaauucaccauucugauguuagugcugccuuucccuauggaagguccuguccgucugccccuggugggaccagguucucuacugaccuccaguggcuacagucuguauggcauuaagcagggacacucaguguuuguuggucagugcagaaucaucuacccucccaugagcauuuuuuggaaugcucucuguccuugaauuagacaauaugcuaccauaugcucaaguuacucuuaccugucugucuuccagugcuacuugaaccuuccuuauuuaaaauuaagcuuuuaugagaccuguacauaaauccugcauaaagaacgcaaaaaauauaauuagcucauguguguaagacagaauucuguuggucccgguaaaaauaguuggaaaauaaacaacuauauagaaaaccacccagcacugcauuacucggggaaaguaagccucaaggucacuuaauguuucugucuggaguuuuauuugaugguguuucuuggggaggaugcuuguuuuagggcacuaugguuugagaauaggaagagauacggaaacagcaguuguccuucuccuggguucugcagugagaaccuucugaugaaaccauaugccuccuuggacugaccuggauaauaguagugggccauagcugggacaagagaugacauacuugcccuauuuggaacccuccuggguauugugagacagguaggaggaauucaucaaggaaaacuuagugaccauugaagcaaaguacaugcuaauuuucuagucaugaaguuauuaaccuccugaaauuucuaauuccuuugacauccauuuuaacauuugaucuaucuaguuaauuuuuuaaaaagcauuuauuauaccccugaagucauucuuuguuacauuguuaaaauguuaagcuguaauuauuuuaaaaucacguuuggccaaagcuuaugaaaagucaccuuuaugucuggacuuacugaucaauguaauuuuaaggguuuuucuucuuaauaauuaaaaguuaccucauugugcagcacaccugcuaccgugauguuugagaauuaacucacugacuaguccccuaauagucuucaaauauuagguaacuuuuuucuucauaaccagauuuuuaaggcagccugaugguuauaaugacagaguauggaaacaggcucuggcagccuauaucaggagucgggcagcaguucuuuacaguacuucuguuccugcugggugaauauuuucaaaguccaaccccauagcuaucuggccaagcuaucacagacaggauagcauucaaaugcuguuaauagaacugcaggcccucagggucucucugaucuuaguauccucugcuguauaaaaccuuuuucuuuuaguguauuaaguuuucauuacacucauugauuuaucagguuuagaaaguuaaaaggggaaaacaagagagaccaaaacugugaaugcaguuugguuagguagguagggcuuggggagaaucuaggagaaguuaugggagaggggugaaaaugaucaaaauacauuguaugaaauucucaaagaacuaauuaagauguuauuuuacaaaaagaaaauugaaaacauuauauugucucuaguagaaucuuuuacuguucauuuucaaacugguucuuagauugcaaauuuaaaauaaaacgguuacuccuauuagacuagucauuuuugugcuagucugucacaaauccuuucugccagacccuugguaggaguaaaauaaagaccagauauguucaccccuugcuggaaacuuagacacucaccucauuuauauuaacucugacuauacacuuaaguuguacaggacagggucuuuguagggcuugauauuuucaguauagauuuugaggauuuaguuuugguuuugccaaugugguggacaaaaaccuucaucugguaguuuaaucaauagcuuccugaugacagcugagcauguuuuuauguuuauuggccaucugugauucauaaauugaacaauuucuuuaguucacuuauuuuuuuugaugguccuuuuaaaaugcaguucucuuucuuucuuuuuauccauaugaucauuuguuucuuguguauguuacaaguaccucucuccuaguuugucauaaaaacccaugaucuugccagguaugauggugcauacaaguugguggaucaugaguucaaggcuaaucuggcuacauagcaaaucugagggcagccuggguugcauggugagacccuguuaaaaaacaacccaaaauguauuuaaccucaaagugcuuucuugucuauaugggacuccaaaaucugucaagccugguggcagugugugauccugacucaggguuacagguuccuugccugaguaaacauuguccccuaagcaccccaggcuagagcagcccuccucuguuuucugccugcuucuccuccacacccacccucagucuccuggguugcccuagcacucaguaagugcccguugagacuaugcuuugugucuuaggcccucgcaggcuccucugcugggccaggaguguugucugggaaaggcuucauggcuucugucucuuuugcuuuugcaggaguaacaccgaguccuaaacugcaacugccgauuuaauuucuaaaaggaaaccucuagggaagaauguggcugugaucuuggcuaucuagaaagggucuuuucuuugggggacauuucaguuucuuuagucauuguggcuuuugugauuuuugauaucuuuaaaaauauacuuuuaaaaaauguucaauuuuugcuaguuauuauagugaagcaguagauguguggcagugaagcaccugcuguagauuggcgugcuuguucuuuaaaauguaaauaugccccugccagcauauuacacuaaaagucuaagcagacaucaguggcaaaagcuuuuaguguuucaucaaguuauuugguauuuauuuaaauaucuucuucucagauaaaggaagccauucacuucuauuucugaagugugaauggauguugaauuuuauugaaugguuuucugcuccuuuugagguaauacaauauuucuuucuuuagggucuuagucucuccuugugguuuuaaguuacaguucccccaugguugguggugguggcauuucccccauauaccuacauagaccuacuuuugugaacuaucuauuaagaucuuuuacccacuuuucaauugaguuacuuguauuuucacaguauacuuuuuugaauucuuuauacauuuugaguguugacucuguucaguguuaacuuacauauauuuuccagucaauagauugccucuguaacucuuaaaaacuguucuguuugcuuggugagagcuugugugugugugguguguguguguguuguuuuauauauguguggguuuuuuauugguuauuuuauuuauuuacauuucaaauguuaucucccuucccaguuuucccuccacaaacccccaucuuuccccccccccucaccucuaugagggugcuuccccaccugccuacccacucuggcuucagugcccuaguguucuccuccauuggggcauccagccuccacaggaccaagggccuccccacucccuuugaugccugacaaggccaucgucugcuacacaugagucuggagccaugggucccuccauguauauucuuugguuggugguuugaucccuaggagcucagggggcagggggggucugguugguugauauuguuguucuucccaugagguugcaaaccccuucagcuccuucaguccuuguccuaacuucuccauuuggguccuugcacucagucugauguuuggcugcaugcaucugcauaucuauugaucaggcucuagcagagccucucagggggcugcucuaccaggcuccugucagcaagggcuucuuggcaucaguguguguguguauguguguguguguguguguguguguguguguguguguguguguguauguguguguguguguguuuuauuuguuauuuauuuauauuucaaaugucauaguguauggguuuggugucugcagaugggauggaucccuaaguggggcugucucuggauggcuuuuccuuccgucucuucuccauucuuuaucccugcaguuccuuuugacagaaguucuggauuaauauuuuugaaguagguggguggccccaucccucaaccggggaucgugccuauccacugcauauggucucuacauguucugucuccccuuuguuggauauuucagcuaguuugagauaaucccguuugucuguuugcuccuguugccuguacuucagaagucuuauccaaacauucuuugcccaggcugauagcaugaaguguuucucaguuuuguauuuuacucccguaggcugagacucuuaauucuuacugacauuacugauaucaaauacuuuaucuaccaaauaucuguuaaauuucaaagcagcaauacugguauuaauguuuuaaauauuuuauacucaugguaaauauuuacaugguuucaagcucagaauuauaaaaccaaauguuagaaugaaaucuaaauuucuuccauagcauucacauuuuucuccuacuuucuuuucuuucaguuuuccucuuuuuuauuuacuuuuuuauuuuuuagaaaagauuuauuuauuguauguaugugaguacacugucucugccuucagacacaucagaagagggcaucagaucccauuacagaugguuaugagccaccaugugggugcugagaauugaacucaggaccucuggaagagcagucagugcucuuagcugcugagccaucaucucuccagcccaguuuuaaagcauuuuaauuaaacgucauugucucuauguuuugcugcagaugcuuauuugucagagagcauguguagugugcuggagagucaagguauaugugacugauccacauuguugugaucuuugcacuguuaggaagaccucuguguauuuaaagacucccauacgugugcucccauugucaugccauguuuucucguucaucccuugcccagcagggcucaaaccauauuguagcgugucucuuguaauggaugcacuuacugguucgcucugaaguaaucagcuccuaaaccagacaggcuauggcuuuguuaaauguguaacauuggguuaauaauucagauuuaagaaacuuugcuaaugaauugugcuuuccuccucauaaauccuguauggauuuuacgagacuauuaugugaucuaaauugcacguagacuuuuauccaucucuuuugagaacuccaaccuuaacuucuaauauuccuuuaguauucucuaaaugcuuguccuggagagaaacagugcagcuuugacuuagcaaauguuguaaguacuucugccucuuucugagcacugcaaaggccgugggauauagaauguaauuuaccuccugcuuaucacccuccuccuagcuuauaugcugcaauugccauguaguuuuaauuuauacccuaccucacaaggcauaguuauuguauugcuguuuuuauauucugauaucuaugugccaugcuaugcuauguauuugcauugucucauuugauucaugaaacaaccuuguuauaauagaagucacccuuccuguaacagaugaaaagugagggcauugcaauuuaugcacauuaaagguucauggagccuguaagcaguagauucagaauuuaaauccaggcagugagugaguccagagucuggucugauaccagugauaaaguauuuucuuuucucuuucacugggaaaaaaagagaugucauaaguaauuguaauguuucugacuguuaaacuauuggguucacccuggcugagugcuaaagcuaauuuccuuucauauauucuuuuagcugauauagcccagagguacaggauaagcaaauacccaacccugaaauuauuucguaauggaaugaugaugaagagagaauacaggggccagcgaucagugaaagcgcuugcagacuacaucaggcaacagaaaaguaacccaguccacgagauucagagucuagaugaagucaccaaucuugauguaaguuacuuaugguggaugaaguguguacugccuguguaauuaaugcaaacaaccagaaugcaauauagaaucuacauguucucuuauaguuacugcaguauacuugacauauacaaacuggaaagacuuugucugggauucauucucaagggaauugcuaauguugaacaaacuucagauaaaauguguugcauacaagaaagcugcacuaauugauuaauauaggcaaagggaaccagaauuauaaauagaaguuuaagucaaacacauaacaccaaaauuuucccauuucccuugguugauaccuucagugucuacuuuaaucacuauuucagcucuuucuacaauuuaguguagaaauaaaauaaccucucuugauaaacuuagcaaaucccuuucuuuguaaaauaagugauuuaaaaaaaauaacacagaaacaccaaaagcauaaacuauaguguuuagucuuuauuccagucucugucaaguggcaaguuaauaaauuagccacuucccauuuuaugguugcuguuggaggaacacagcuucugagccagacaugaaggauguuuauggcucacaucacagcaaaccuugugugcugaugagccuaucuuguuauugcuguccuccagccccuaaguccuguuaguggcaaagggccacuguggaugcucauacaggccauagguugugguacacacgaagggauggcuagucuugccauuucagagcaagcaguagacuuuccuuuuuuuuuguccugaauaagacaauaugccauaccuuaauguuuugccugcaggcacagcccuaagaacuugucuacacagagaguggacaguaaauauauacagugcuauguggaggcaggugaaggacccauggaggagucugagcucaaugcguuuuuauuaaaguuacagcuaucuauauuuuauuguagcauauugcuuuaacucagcacaauuguucauaguuuuggacuaggcauuagaugcuaucauugcauccauaauuauucuucaguugaacuaacugaacuuuaaccgagcuacaugaguuacagaauaaagaauaaauuaagcagcaugcucuuacaauuuuauauguugcaaaauaauuggaugcuuuauuuuacagcgcaguaagagaaauaucauuggauacuuugagcagaaggauucagaaaauuacagaguuuuugaaagaguagcaaguauuuugcaugaugacugugccuuccuuucugcuuuuggguaaguauauuaaucaucagccugcuaggaggugagcauggcgaucauguucaguucuuguuauauuuggucauguucuaaagaugaccucugaacuuuucaagucaccaacuaguauuuauacaugugacuaauccuuuaagggccuuacuguuuguuuuucuguuguguuauguuucagaauguagguaaaaacauaagaaugguucaguuaaccaugagcucuuacuugguugauucagugacccuuauaccagguaaacuguuaacccaugacagcucaggugacugagcaugcucucuuucuaguuaggaaguguacgugugguaucuucuuucauccccaugucuuuaucaccuuccuucauaucuuucuuucauguucaguucuuguugucuuuguucauaucaaaauaacaccccacccuccacacacauacagguacacguacauguacugcacuuacuucccucagcuggggauccauaccagggccuuacacaugcuaagcuguuccguccugaucuguaguccuagccucaaguuugccuuucuaagauugaucucuucucucuuguagguuguccuuguagaucucucugggacuuugauccaucaggucucccuacuuucucaugguuucacccugacccauacagaaacugcuuucuuuucccaaaaucauguuccucucuuuucuaacucaccacuuucaucuugagcuuuaaugccaucuuuuucuuuucauuucuacuuuuuuaaaggcuauuuuaugcuugguuaccuugauuuucucaaauucuuccaaauaaaaacccuuaguuucuuggaaccugacuuucuucuaaugaagcuugucucugacuaguugcaaaaugacuucuugauuguccaacaguuuaauccccucaaauucucugagacaucaccuccuuucuuuuuucuccucuugagaacauuugacauugaaucucucuuguuugccccucacaauuccuuuuucuucuuguuguuccuuuuaucucagaauguaguuauucaagguuccguccuugacccucucuucucggaggcuuucuuagcuaccuuuggcuguuguguaguguaaguucuuuuauuuggggcucuuuaccucguguuagccugauugagauagguguugugaucccuucucuagaugaugaccuccuccuagcuuucauacuuuuguggauuuuauugguguuucacugugagcacuaucaguguacaacaugggcagggacaccuccagccugggcucucaccucacugcugucugugugugaugugugugccauagaacccaccucagacacuuugagcuagcuagccuuugccuuagagccucugcaguuccuuaucuguaucugggaguaguuuugguuuuuuaggauuccagaguggcuccgcuaauuugcauccaacaguaaacgagguucuucuuuuuuuacaaccucaccaacacuugugccguuuuguguacaaugagaugaacucucaaagauguuuuaauuugcauuucucuuauugcuaaggaugauaaacacuuuuugagguauuucuaagccauuuuuauuucuucaauugagaacucuauaaaaaaaccuaacccauauuuuaauuugggacauuuguuuccuuggcuuuuuuguuguuguuuguaggguuuuuuugaguuauuuguauacgcugguuauuaauuuucuuuaagauguguuagcuggccaagcuucucauucugugagaccagacugauuguccuuagccguacagaagcuuccaguuacccauuguuagccuucaaucccauggagccuuccuguucaguguccuuccuucacccauaccuugcagggcacugccauguuuucuucuagcagucuuagugcuucagguuuuaaacugaggucuuuaauacuuuuguauuuaacuacuaugcagguuuauagguaugagucuaauugaauucuucugagugucgacauguuuucucagaagcauuuguugaagauguugucuuuucuguaauguggggaugcguuugccuuugucaguaucagauggucguggguacaagugcucguguguuugcugguucuucuguuuuguccuguuggaucaugucugcuuugugcuagcaccauucuguucuuugauucuuuggucacuauggcucuguaguguaucuugagaucugcaauagcaauccccuaguauuccuuuuugcucaggauuguuuuggcuaucuagaauuguuucuggucccauauuaauuuaggauuuuuucuucuauuucugugaagaauguuguggauauuuugauuugguuugcauugaaucuguaaauugcuuuugguaggauggucauuuucacaauauuaauuccgcuaauccaugaacacuacaucuuucucaauucuucagagauuugagguuuucauuguagaggucuuuuaccuccuugguuugguguuauuccaggauauguuguuguauuugaugcuguuaauuggaagugugcuaaugaucucucucuuggucuagagaaaagcuacugauuguacacuaugccacuuuucugaaauuguugacuauuucuagacauuuaauuuuuggggauaucuaaauagagacaauuuggcuccuccuuuucuuauuaguauacugccacugucuccaacccgcagagacaagaacgacacagacaccaagacggguucgugcagcuccacagcuuccuucuuacuugcagcuuuuugcagcuuucucuuuacuuaaggcaggggcuauauuuauacaguaguggcaacugaccucaucucgcuccacaccaccucauccaauuggaaucacacacgcucuaggcacgagcucaggucggccacagauaggcugacagauccggaucacgaggaauaaucuaacuuggcaggcagcuuacgcaugcaguuucacugcgcauguuccagcaagguaguaaacauguggguuucaugggaucuggcaaugggccagggcgccaucuuggcccaugcagccgcacccgcuucccacagcauaccuguaauuuucuuuucuuuucuuuucuuuuuuuuuuuuuuuuuuuuugucuauugauccaucuaagugcuuauagcucaguauugcaagggagugguugaguagugggcagcucuguuuugcucuuaauuuuaaugggauuacucaauguuucuuuauuuagaauaauauugguuguagguuugccauauauagcuuuuauuaucuauauauguuuuuccuccaguccuggccucuaggacuuuuaucgugaaaacauguuguagugugucaaagauuuuuuuuuuuuccugcaucuauugagauggucaugugaguuuuuuuuuuuuuuuugaucuuuaaguccauuuaugugauuuauuacacuuacugacuuaauggauguugaaccaacucugaauuuccaggauaaagccaccuugaucaugguggauaaucuucgugauaaguuuauauccaguuuccugauacucauugaggguaaaacucucuguuucucagggauaacagucuguauuuuuuguuuguuuguuuguuguaucuucaucugauuugaguauuagaauaauacuggcuucaaagacaaaguuuuggaguuuuccuucuguuucuguuuuuuguuuuguuuuguuuuuugguuuuuuuugcagaauuuaggaaacguugguuauagcucucucuugaaagucugauagaugucugcuuugaauccaccuggacugggccuuuuagacuuagaaguuuauuacaguuucaauuaacuccuuucuugugggucucuuuugguuauuggugucaucuugguuuaauuuuaauauuuuggaugaaucaaaauauucaucuauuuuuuucauauuuugcaacuuaaugaaguagaguuuuaaaaaguauucccuuuuaauauucuguauuucuuugauaucugauguaauguucccugcucauuucugauucuguuaacuuggguuauugcuuucuuucuucugguuaagugggccaagagucuguagaucuugcuuaucauugcaaagaaccagcuauuagaguaacugaucuguuauauuuucuuuguuucuauaucauugacgucugcuuugauuucauuuuuucugugacccacuuauuuaauuccaauuucuuagacuaucacacaugacugcugcguuuacauuucuacccagccuucuccuaccaacuccuccugucccucuacucccucucaaauucacaaccucugcuucuuuaauuauuguuccauauauauauauauauauauguauaaauacauauacacauauacauauaucuacacacaaacacauacaucuugcugaauccauuuuauguguauuuguuuagggacgaccacuugagacuagauaacgugccagugagcucauccuagcaaaggcucauccuuccucucucaacagccgucaaucaauugccuuuagucuucuucuaggguggagccuugugauauuucuccauucauguugcagugucaauugauguugccauugugcaagucuuguuuaugcagacauauuguugagauuucauggguacagcuucccugccauguaagaagacacagucacccaacagagcuuccaaguccucgggcucuugcagucuuucugcccccuucuuauacuguguucagugagcuacuuuaguguagggguuguauuggagauguaucaacuagcuuugguacuucauggccaguuuuuuucugaauuuuaaccaguuguggauuucuguaauggucuuagugaugagccuagaagagaacuuacugcuuccacuuuccuauaguuuaauuucuaacugcauucuauaggaaaguggaagcaguaaguucucuucuagguuccgugaccucaccagcuguggauagcuggcuagguugcaguacaaaacauagauuccuuccuauuaugcaggucguaagucuaguuauacagcuuuguuuacuagggaguagaugccgcuguuacacacuuggggaugucuugccuugcuugguauugugugguuuguaggcuuuauagcuagguggggcuguugcauccucccuuggcgauuacauagcaccuucggguacugugagagcagguccucagggagggggcuuuuaggucaguugcagcuugauuccuccaagaccuguaucuaaaguauagugucuucagcaacaggaucauccuuugaaguucuaaggagcaaccaaagacagaagcccauauuauuuagguccucucucaacucaacuccuaucaacaacuagaaggaagguguuccaagccugacaaacggaguuuuuguuagauaguuauggcuuuuggagagagcaucacacccagugguauaauuucauuaggacuucauauauacacacauauauuuauguacauauaaaaguauauuggcucuuaagcaaacauaagauaauguuuccuacagcuuuuagacgucucaguguccucucccucuuccuguuggcucuuucucaguauugcccuccauccccucuucccuuuucccauuucccucuucguagcaccugugucucacaguucccuacuagagcuccuuccuuauauuccacucuccgucuagguuagcaccacuugcuuccuuagagauugaagaugugucgguguuuauuuaauccucaaguuauguacaggaagagaaacuuacucauuugaccuaggguuuucuguaggacucucucaccaaauaguuauuguacuagguaacuauuuguuauacaagaccacauauuugcaugccagauacuguacuaggccuaggaaauggcaaguguccaaguguacagacaugcuuuccaaaaacuuucuaugauguagauuaucucaauucaauaucauuuuagaauuugcaaguuuaaaaaguaagaaguauaaaguuaauauauuuuauugaucucuguggacaaauuaaugugcuuaaucuauagaugaaaaucaauauauagucaaaauugcuaucaugcugacccugccaauccagacuuauaaauucuaauaccaaaguggcugacugaaacauuauuuuaaaaagucuguuucaucuuaguuugccuuuaaauguaugcuugucuugcuauuguacaguuuuguggaugggacagauaaugaacaagaauauauuucauguuuuuauaauucaugcacugcaaugauuaugaagucuguuuuauuaaaguacauuguuuuuaguguuuucccuaacacauuauuuuuuuuucccucuuauuagagaucuuucaaaaccagaaagguacaacggagacaauguaaucuacaaaccacccggggugaguuucuguuuuacagacugcuuaagacaccauaguuaauacaauuauaauauaagcaauagcuuuguuuuaaaugcuggaagaaucauugaugaauucuuaacuuuuuaaguacuagggauugaaccaaaggcuuguguaugccaggcaagugcuccgacacuucuacauucuggccccuuacuguguuugagucagcgucucacuaaggugccaggcuugccuugaacuugagauccuucugccucagccuccagagagguggggaugaaaggcuuguccugccaugacugaaugaugugacuuugaaaccaucauggucuaguaauccguauuucagagugacgcaguguucacagaaucccgaagguacaggccugcagugacagugcaggccccugacuucucucccugucucuguugcauucagucugagagccaaauguuugucaccacuuguauugugccuguaacuccaaaccugcuggggcauaaauuagcuucuugacaguaaaagcaccuagauuguuuuaaacuuggcuaaauuguuuuuuuuuuuuuaaaucaauucucuaggagaauuucauacaagugugucauauucacuccccucccccaacucuucccagaucuaccccuccaucaagaccaacuugcaguacuuaaauaaauaacacucuuagguauguagcuuucuaguagagugagauugacuuaccagggccuacccccuagcggaacgcuggcuauccuuccucucccuguagcuguguguugcuaaucacucaacugauaggagaggaauugugugcccagcucucuucuccauguuggauuuggucugcugugggcuuauacaguguugcaugcguaugcggucacugcugcugugaguucgugagugcagcagcccugcugucaccacagacacuguucccauuuugucauuaacagccuuucugcccccucuucugcaaugaucccugaaccuugagaggagugugggauauaugcuuuuuuucaggcuuagcauucccuaagaaauaguuucuuauauucugcaccuuugccaguuguggcucucuauuccaaucaccaucuacugcaaguagaaaucucucugcugagagcugagauacaugaaucuguggguguaaauugaugcuguugagagucgguuuaauacucuguccauugaacagaauagcauugcuagguucuccuuuugacuaaauuauuuguaagcguguuuaaacaugaaauaguuggguaggccugaauaaugguaggaacaacuaaggcaaaauuugcacuauguuuucuuaaauugacauaaagauaaucaccaugaauguuucacaucccaaagauagaaugaauuuuuuuuucuaggucauaguuagguuugagguuuguuguuauuguauuuuguauuuauuuuuuuauauuuugagacggggucucuauuaugugccucuggcuguccuggaacucacuauguagacugggcuggccucagacucacauaguuccaccugcuuuggccucccaaguucugggauucaaggcauauaucaucaugccaggccaagauuuuaucuauauaauuuuaaugugccuauaauguuuugauacuagauuuuuuuuauguagagaaauaauuuaccauuacuuuuaaaggucauuuucuaguccuaauucagauacuauuuuaauccauuuuucuauugcugcaccauaucuggaguagagugcuuaagaaaagaggcuucuuuugcucacaguucugacgcucagaaucuaagacuggcuuguuccuucuguuacucagaaggcuccccaaacugugucacaacauaaugaaggaguaggaaggagaaagccaugugcagaauguguuguguauggcaggaaaccggagaccaggggagaccaguuuuguucuuuuaauaacaaauuaaugcuacaaagcuuaaauggaguccugcaaaccugcauuaauccccucugggggaggcaccucagugacuuacucucuccucucaccacuuuguuaaaaguucuaucacuucuugaauccacgugcgaccaagcuuucagcucaugaacuuuuagaagacacacacaagcuguauuuagacccagacagauagggacuugccuguucauuccuagguguguuucuuuaguagucagugucaccaucucuagcuuaucagaacccaagagugucugugcuaugauguagacauuaaaugagcguggccucuggccuuagacugugccuuuggcugugauaugcugggaguguuucuucauuucugagugcuuuagauuuugucacuaagaaaaauaagugguggguaauagaacuugcugugcugggaagcugggagaaguaaaggaauugucaccacgugccuucgacagugcuggacacaauaaguuuccuguuagcuuuuugaucauuugguguauguuguauacucugauguuugaguggaagcagccuuuggugauugcuacuagaggagugcuugcgguagaccccagccucuucucuguuucagugagucugacugaccagauuuaccuacaacauuuucagugacaagaauagcuucauuacuucauuuggguaauucucuuuuuaccuacauuguggccuacauuugaugaaauugcuguuagauaauugucuuaaaucuggggagggucuuuuauaucacaaguuagauugccaaguuccuaauuaccacgguuuguccuuuuucuaauguauuuaccagcaaagauuucaguaaucuaauuuuuauuucuguuuuuauaacagcguucugcgccagacaugguguacuugggaucuaugacaaauuuugauguaacuuacaacuggauucaagauaaaugugucccucuuguccgagaaauaacauuugaaaauggagagguaugggcuuccccacggguaaucuuaauucgguuauauaaaagaacgcaucgcucuguuccccccucaugcuguucaucagguaccaguugugagagccaucacuuggcacaguugugucccagcugguuucauagagcauccuaacuggcuucccacuuacuguuccagaagccuucuuauguuuccgguaauggcaauaguugguaauacucuugacaaaggacuugagaguaauuuaugcucaaugcuucuaguacccacccuuggguaaggauccugucuaaguggauguccuuuagaaggacagaucuuaguugcagugggcaauccuuugccguuaaagguuugucugguauuagaaagaaauacaaagaaacaguuggauaguuauucugaagucuuuuuaguuuguuccuauuccuaacuuuaagaaaaggggcagauagacucucugcuaguuagaugaaugguguuggguuguuuuuguguuucuccaggccuugugucuguuuagcucaaaggcucaagauuugaaagaugaugcauaauacaugugcuuucucaguucuugucagaauaguuucaaaaacagaauuuaaaauuucagaccuggaaaaucuuaauucaacuccccccacccauggaaguugccacauuuaauaauucuguauuuuuaaauuauuauuucuuuuauugauuuucuguuuguggugggaaaagggcuugcagguugcuucucuucuccugugcuuggaggugggggucucuuguuuuuguuuauacuauguauuccacacuguuagccuauaagcuccugcagauucuccugccuacacgucauguccccaggagaguauagggauuauagaugugugccacuacaucugacuuuaugagaaugcuagugauccaaccugcaucaucagggucacacagcaagcacuuuuacccacugagccgucuccauagcuccacauguaauaagucuuaagauguaguauauguuggaauuaaccaccaugaauuauuuaaaccauaggaaagaauuuguuucucuugaguccgauugucuuagaauuuuccuaauacuuuauauguacucgguaaggcauuuguugguguagacauagacauggaagccuaggagucacguuaauuaccaguuuccacaugcuugauuuuggaaaauucauugcuguguauuucaggugauauauguuuccaaauuugucuguuguaucuuucuuaauaucuguauguucaugcauauuugugcugaguguaaugaaguaaagugacauaugcuuuuauuuuaguuuccuagcucuuguguucccuccgugggaagugaccagucuucuuucacaguaguauuuauaaaguagcacucuucuccuuguauuuugucauguguuugcccgaucuuucuguaugggaaauuggggagcagaaccaggcaugaagagagauuaucugcccucagggcuugguggucaguuuuugacauguccagagaaaggaacauguguccagugcagccugacgggcacuaaggaaaagccuaagaauucaaaggagaaaacuaauuuuauuucucuagaaacugggugggcuggggccauugcuuucaagacgagacauugcaauccugaagcaagggcugaaaggaaaggaugugcuaaggaggugaggacguaagagagcauugucacucauccuggguguuuacaaugccauuggaaacccaccuguuaauucuagacugagcuggguuuguacacagagcuaagggauccgucccuaugagcugauaauagaaacuguugcacuaggggaaauuaccaagccagaacagaaaaguccagagacaaaaguaugaggagugugauccguaaaugaagauuaagaaaaaauguaauccugggcuggagagauggcucagcaguuaacagcacugacugcucuuccagaggguccugaguucaauucccaacaaccauaugguggcucacaaccaucuguaauaggaucugaugcccucuucuggugugucugaacacagcugcaguguacucauauacauuaaauaaauaauauuuuaaaaagaaaaauaaaaauguaaucccaagagauaaagggcgaggaagaagaaaaucuauauugaauuacuaaaacauaaauguaaugccaggaaaugguagcagugggggccguggaaggagaguggcagcuaauagguauaugguuuauuuuuggaguaauggguguguugugggaugagugaugauuuucacacaaucuugugaauuuaacagcaaauuguacacuuaaaaugguggacuuuuguggcugaaaguuaccucucaguuaaaagaagagauaauaugauaaacuuacuuacuuaucuauauauacaagugaaacaaauuuaaauaugaggugggaacgaaaaauagucucaugugauaggucucagugauuuaaaaaucauuauuagagauaaacaguaucuaugcuucuugcucaggcaguuccuagacuggacucucggagggauugcuuguggaaaugacuauguguggagcuuuucuggacuuccucauacaaauaagaacauggcauuuguuuagauuauucaaaucuacuguuucucuuguuuccuuuacucucaauuacaguaaaacagauuuuaauggcacuuuguuguuuucaagaugcuuuguaugugugcauguugaaagacagggcaguuaauuguggaguuuugucuuuauccuuaaaacacuuuucagcuuuggguaggucucacauaguggaaugguuuuaauacacaccuuagaauaagcaugaauuugugaaugaaauugacucagugcucacacauuagugcuugcagucuuccuugugaggacuggcaauacuccucaguguuugucucacuccuggauugagaacugccuaguucuuucuucucucaaugcucuucaagagacugcccuuguacucacagaugcaguacuggcuaauacagcacuucucagccuuccuaaagccugugacccuaauacaguuccucacguuguggggacccccaggcauaaaauuauuuuguugcuacuucauaacuguaauuuugcugcuguuaugaaucauauuguaaauacugauaugcaggguaucugauauaugacccugugacccgacagguugagaacacugggcuaacagauugagcaaggaccuuccaggugaauccaugcauguaacagagcaguacaugugugcuuccuuaguaacugcaccuaacaugcaaaggguugaacucauuuuuuguuguaucucaguauuuuucccacuagauccuuuuuuucugacugcuuguaacugucaguuguaugaauugaguccacacuuguuccacuuggaaaacagcacugauuuucauugaaaacuuguuuccacaggaauugacagaagaaggacugccuuuucucauacucuuccacaugaaggaugauacagaaaguuuagaaauauuccagaaugaaguagcccggcaguugauaagugaaaaagguagacuguugaaggugucugacuuugccuuucuuucuccucccuuccugguccguguuugccuuuaacacaggcaggauaggagcuccccggguacuuagcgugcauuagggaggaagcagugcguguggggugaggcaggcuuucugugugcucgcucuggauuuucgagggaaagacaaacugcaugaagagcgggcuucugggcgaacuguaauauuuccugguaccuaaaugcuucucugacacauuuccugagacauugcuaagagaugacacuugcugauccauauuuauuucuguauaaaaguugagcagcuguaggcauuuucccauaucuuagcagaauguggggcaucggacagcuuccccuccacacugaggagaaaaggccaaaccauguaaacugaugcugugguaaagagcugccuacuucagucauuuagggaauagcuagguuugaacuagguuuuaaaggagccauuuagccuacaaggggcaugaagauggucccaagggagcaguguguaugucagaauuuggggaaccuauauagcagauggcugccgauugaagaaauaaaaaauucacaucacaauagcauuuaaauuugaguuuuccuauaauuucccuuauaauuucuaagggaauuauacucugcccugagaacuaaaaaaauccuucuuuuaaauacacuuucagguuuuaguuuuuuugauuuguaucaauuucaagaguauugauguuguuuauuaugcuauuuuugugaauucguaaucagaaauacaguuaaaaaucuaauguaguucuuaaaauucuguuucuuucaaagguacaauaaauuucuuacaugcagauugugacaaauuuagacauccucuucuccauauccagaaaacgccagcagauugcccugucauagccauugacaguuuuaggcauauguauguuuuuggagacuuuaaggauguauuguaaguaucucucucuuuuuuuuuaauuacugauaugucccauaaaguugaaugugagacaguugcuugacuauuuuacauacgugugugcugugaacguaauacucggguuggugugagaaguuagagugguuccuaccugucuguguaccauguggcgucacucaguggaggauuucagaugucgggugacugggaacuacucccuaaaaggaagagugugugcuaugagaaguuagguuugcucugugguuggucugugccaucacauaccaagcaaagauacauccuuagucaggcuggcacauugcuccucuauggagaugacuuguuccugggucugauucuucagcuccuucaccugcucucgcagcucacacauggaauagauaccagcuggcgagugggaucaccugcugagagugaagaaaucaggcaguugaagucagauuagcacuggcauuugaaucucauuccuggagaaugcaaacaaguacuagcaauuauccuguuaaauaauuuauuuugucuuuauuuaugugugucugugugccauguaugcaagggugagcuaccgguaguuauaagcuacuggauauggguacuggaaaucagucaagagcaucaagaacccuuaacuguugaguucauauucuuuaucacaccacucaguccuuuuauuucccagcuguagccuucuggaccaguagauagacuauuggcuaaguagagcuaaucugucagccaguagcaugcaugcucugcuuuggggaaaagaagaaagaaaucuggcaaucgaaaauaaucucuauacugcaaguggcucuccccuuuuacuccagcacucaagaggcagaggcagguggaucugagugugaggccagccucaucuauagagcugguucccggacagccagcacuccauaaugcugcauuugaagcucuuugaaauaguucacuucuuuaauuuuuuuuccuuagcucuccaguugccccuuguaagcacuguuccugguaacauuuuuuuuuuaauugagaggaggugugugcuauaagagcuaagaucuagcuaugugaauagaugcuaguguuaaaaaccaauaaagcaugcaacaagaugaaucugacacauuuaaucgcuugucuaauuguuauuaugcugccugaucauuaaagcugagauggugagugguuuuccauaaauuacuaucauuacuauuacuuuuuacauaguaacucagcauuucuggagccaucugacagaagugugguugucuuaugggcacaguccaugugugcuggagguggagacugccagugggacacucaucuucuuuucagagaaguuggauccccuuaaaguaaaaugacuuacaaguccacacaggcucacaguacugcauacagacagcgacauuuccccuaccuguacaacgcuauggaaaugcugguguuugaagagagaguauuucacaauggcagaaauaaaucacggcucuaugagcucuuggccuuuuuucauuguuugaucagguagauuuccuaccaacuugaaaggaauagauuuuauaugaagauggaagaguggggguaauuuuaguacccagauaacaauauugugguguucucaauccugagaaaagucacauaggacugggaauggacugugaagaaaacugccuuuggggcuggagaggugguucugugguuaagagcacuugcugcucuuucuuccagagaaccugaguuugagucccagaacccaugccagauggcuucaaacugucuauaacuccagcuccaagagaucuaauacccucuaauuccucugcaggcaccuggucacacaugcacuuaugcaaauacauacauacauauagaaaacuuaucuuuaaaacuguaguuagugaaugcuuuuacugaaguguuuauaacugucugagguuucgagugacaggagggaaaauagcagcuggacagauuguaggccauuccuugcacacuuuucguuaauuauugauacccccacccccaaauggaguagacuacucuaaugaugaguucuccaacucuggguuccaagucauuucuccccaaacaccaaaucacugaaaauuuuuauugugagccuaggcacuucuucucccucugaggccagacaaagcagcccgacuagaagaacauuucccacauacgggcaacagcuuuugggauagccccugcuccagucauuugggaccaagauggacaucuguuacauaugugcagagaggccaagguuuggcccgaauauguucuuugguuggugguucagucucugagagccccaaagauccuggcuaggggauucuguuggaguuccugucuccaugugggcucaaaauccuuccuccuauucuuucguaagaguccacaagcuccauccacuguuuggcuaugggugucugcaucugucugagucagcuucuggguggacccucucagaggccaagcauaacagaguaucauuaauagugucagggaccggucucugacuccuccuagggauguccauaccuccucccauccuccccccaucaguugcagauuuccauuuauuuucacggccauccagccaucucugcucuccuuuccagcaccugauccugaacccccauuccucucccacccaguucuuucccuccaccugccucuuaugacuauuuuauuccuccuucuaagugagauucaggcauccucgcuugguggaccuuccuucuuuaccuucuuugagucuguggaguguaacauaguaccuguauuuuauggcuaauauccacuuauugaguacaugccaugcauguccuuuugggucuugguuaccucacuuaggauauuuucuaguuccauccauuugccugcaaaguucaugaugucuuuguuuuuaaauagcugaauaguauuccauuguauagauguaccacauuuucuuuuauccauucuucaguugaggaacauccagguuguuuccaguuucuaacuauuacgaauaaggcugcuaugaacauaguggagcauguguccuuauuauaacuuggaacaucuucuggauauaugcccaggagugguauugcuggauccucugguaguacuauguucaauuuucugaggaaccgccaaacugauuuccagagugguuguacaagcuugcaaucuuaacagcaauaaaggaguguuccucuuucuccauauccucgccaguaucugcugucaccugaauuuuugaaguucuugucacacacgucuuucacuugcuugguuaaaguuaaaccaagauuuuuauauuauucguggcuauuguaaagggguuguuucucuaauuucuuuuuggcccauaugucauuuguauaaagaagggcuacugaugugcguggauuuuguauccagccccuuugcugagguguuuaucagcuguaggcguucucugggagaaguuuuggggucacuuacguguacuguuauaucaccugcaaauagccauacuuugacuuuuuccuuucuaccuuggcuccccuugaucuucuguaguugucuuauugcucuggcuagaacuucaaguacuauacugaauagauagagagugggcagcccugucucgucccugauuuuagugggauugcuuuguaucucuccauuuggucuaguguucacuauugacuugcuguauauugcuuagauuauguuuagguaugugcccuguaucccugauuuucccaauaccuuuaacaugaaggccuauuguauuuuaucaaaggcuuuuuaguaucuaaugagauagucaugugauuuuuuuuuuccuccguagaaaaauuuuaagucagaaagaacaugguuauuggugggguuuguccugcuccuucacccuuuuucuugccuucugcuuuuccuugugagacuccuaguugaaccucggguuccugcacgcuaauacacgcugcaucacuaagccacaccuuuaccccccuuuuuaauuuugagggaaggguccucuuguccagugcuggcuagaguuuguaguucugucucagccucucagcugagaguacaggcuugcuucaccaugccuagccugauagaguuuuguaaaaagcacauuuuguuuaucugguaauguuuuuauuauuauucccuguuaacaaguuggcuggaccaacugaguaucuucaucccaagaaagaauuccuucuuaugaaaauuuaccuuagaauucaucauagaucuaaguggaaaacaguaagcaaggaaauccuuaacagucagaggaagacaaaguucuaagagcaucaaaaacacuuagaaaaaaaugacaaauugguuuucaucaaguuauaaaccuuuguucuauggaugauacuguuaaaacuuaaacaagauacagagaugacaacuuagcauaugagcaagguuuccaggguuauuauauagucaagaaaugcaagguagagucacagcgagaugcuggucucuggccugauggcacgccaauacagauugaugguuucuuugugaaaguuacacauuuaugcaguaccgaccaauuucuagaaacuaaaguucauguaaaaaccugugugcauguauuugucauagcauuguuucugacuaccaaaauccugauaggauccaaauguccucaacauaaaugaguagacuucugugguacauauguuuguguguguguguguguguguguguguguguguguguguguggcauaagauuagcaaacacaugagugguugccagggaucagguccaacugcagagaucucaccugguuugcagagguaguaagaaaacacugcacauuuguuaaaauuuagagaacuuagcugagcacugugcuuagugaucucacgcagcugaaaacagaucuuuaguaaguuuaagaccaguccagcuacaugcugagagucucaaaacaaacaaacaaaaaguuauagaacuugagcuuuaaaggaaaaauaucuauuguguuucaguuuuuuaaaauaaaccuaguuugugcuuugucagaggguggacacaauuuacuguuuguauuuguguuucacugucuaaaaguaaaacauuguaaacaaacaaguuuggaagguggaagagacacacuuaguguucccguuaggaaaauuacagcccaaaaugaaaaucggauaaacuuacucuaagagucuucuugcagaucgccacacugucuacucagacaauuuagagcucuaaauccuugcuuuccucugucucacgacacggggaacgucaggucagggaaaaagccugucucgaguagucucaauuugucguguuugggauuuacucguucauuagcuauuccuugacuagcaguucuccuagucuuggcagcuuguaaaacaaaccagcaccguuaucucaggcaguucgaacauucggagucuguggcuugaauuuucuacuucagcacuuugcuguggcgugucagaggaugauaucagaagaaauguaaacugaucuccucucaguguuuaucucugauguaugugcaauuacuucugcaccagagaaccaaggcaaggcauucugucaauacugcuaccugacagucauuuguauuuguaaacugugcauuuggcacccgcugcuucucuauugcacugaagcugguggggaaccaacaugguguacaaugaaguuguugguagguacagcucaguggguguuuggaaaggggugggggacacaguacuuccaggaccucagaauagaauuuaaaaaggaaaaacuaggaacugguaauauuuacacagaguagcuguucuugccuaugaaaacagaauaaaaacaagaauauguaaaagccaggcuguuguacccaaggaacuaaaauauguauggaaguccauuuuugaaucuuuuuuucuuguuuguuuguuuguucauucguuuguuuguuuccaaauauaugugugcucuaucugcauauaugccugcaugccagaagagggcaucacauccuaguaugagccaccaugugguugcuaggaauugaacucaguaccucugaaagagcuucagacaaugcucuuaaccgaugagccaucucuucaccuagaagugcaucucauuuuuguaauauauuaaaaaaacaacgguuuucuguuugaaguauauaauaaucucuguaaaagguaggcaaaggaaaacauucaauuucucaagaaauuaaaauuaaaauucaguuauuacuuaucaaauuggcaaaucaacuucauuuuuuuucuuaaaucauguugacgacuuuagaaugcaaaucuauggauagcaaaaaauugauuagacuuguagguaucauuuguuuccauuuuaguggcuacaacucaaggaaaugauucuagagaaaccuacuuuguaagugugcugcucagcauagucuggaccaccucgggagaggacuggacucccagagcuuuugagaauccacaggcucuugcuggauucaaaugcugugagacacucaguggggcuaguucuaaaacugaauauuuuuaaguaauuuccucuaauauuuuccccuuugaaccucaacauuuuuaguguguuuuuucuaggauuuaaguuuuuuguuuuauguguaugugugugccaguaaaaacauaugaaucauuacagacacacacacacacacacacacacacacacacauacacacacacacacacacacacacacacacacuauuuaaguaucuaccaauaaagauaauaaaauauauuugggauacagcaucuugauaguauuaccucuguuagugguaauuauagaaaaauuucaaugaagcacgugcaauaauuagaacauuggugcugaggaaauaguucagcaguuaagaguccuugcugcucuuucagagaaacuaguucugguucccagcaccuaccugucuccuccuacugucuguaacucuaguuccaggggauacagugccuuuucuggcucucagauacuagccagccacuaguaucaguauguacauguagguucucaacauaaaauguaaccuaaaaaguuagaacacaaaagguguaucuaguugccuguaauagccaugguaggauugguaggauuauaaugaaauauuucuuuacagcacuaucaaguuaguaaaguagaggucagccuguuugggcaguuggagcuaaauaauuguuugcucuugguuuuagaauuccuggaaaacucaagcaguuuguauuugaccuacauucuggaaaauuacacagagaauuccaucacggaccugacccgacugacacagccccaggagagguaggacuccuguguugccaguggggacucuucuguggagaccgccucagaggggacuugagcuagaguugcggcuccugauaccucucugaagaaauuuggagcugacuaagacacauuuagguuaugcgccuuuaaaguuacuucuuaaaaugccaggucuccagaaaagcuguaaagugcugugucugguuucucaucaucuaaacuggggugacuggguaugacgcuguggggcguagcuauacaggguuaaauagagaagugagaacauaggauuugggaaaguaguugagaaagcagaucaguggacucccguucaagcuugcuuuugcugcugaauccgugcccucgcuguccuaaagcacugcucugucaccuuguccauccaugcuaagggccuucauagucgcacuguugauaguguucaaacacagggcucaggacagcuuucccaguggauagcugaauguuugacaaguauuuaucaguauuuuaaacuagcuuuuacucacauguaaauucucagguggcauguuguucuacagauagauucucagaaggacagacagacgggcuuucuaugucucugcucuaagaaagaguccuaaauuugcaucuugaugaguuauuauuuguaaagucugugaucaugaaacuaagagggagaugguacacauuaaaccccuucuuguuuuauauacuaggauuucagccuacugcuuuguccaaagaacuucuauuuaugaaagaaaaagagaaacugaauuuuuccuugccuuauuuggaagucagauuagguucaaagucaagaguucucuugagaaucugauaauguacuuuauuugagaaaugauuguuaagcuacuauuaaagugggggaacucucuaaugacagcauuccauagguaauuguuuuucuucagcacacagagcuguucaguaaucaguggcucgcaaccuuccuaauacuucaaccccuaauacaguuccucauguugugauaaccccaaccauaaaaugauuucuguugcuacuuuauaacuguaauuuugcuacuguuacuaacuuuaauguaaauaucugauaugcagaugaucauaggugacuccugugaaagggucguuaaacccucagagugguuaaaacccccaagcugagaaccacugcuuuauacaaucaggagaaaaaaacccuaguuuacuguauuauaguguccugauuuguuuuacuuucucccuuagacaguagacuccauauauuuuauuuauccacauuuuuguacuaagccaacuggguaacagguacauguuuauaguaauaccauuucagcuugagcauguaucugaacagaaaguaacuuucugaggacgugaagcccgacaaaguccaauaggccaaggcgccugcuaccuucuguucuccugggcacacgcucguauguguuagugucccgugugcacaugucccguccacuguaggacuguuauggaguacaggugagcuugccuuugagacgccugcagugugggaauagagugcaggccaugcugccuuuccuucagaacucacggacaucuguagaguuucaccguguguuugucucuuguuggcgcauaaguguuaccaaaguucauuacagcaguguuuuccucaucucagccagguuuuacugaguucuggcacugagauaguugauagagauccgcuucauuaacagaguagggugacuaauaucaaggcagucccucuuagcagucacuuguaaaagugaaggguuaggaccaagcuacguugugcugucucuaugggguucucuaggaggcaaggguguuuaguguugcuuccuuccacauagccucaguaacucugacaggcccagagucagugcugcuguggcagccaugcccugccuggacagugaguucagggauguuugaagaaacaagauaaucucuucaccuugacauauacuuuucccuuuuuauuuacuaguaaauaaguaauuauaaggccacugccaguuacguaauaguaauguaugauaacuccauaagauauuuugguaucaagauucuuuucuucuuuuguagcaagaccaggauguagcgagcaguccuccagagagcuccuuccagaagcuggcgcccagcgaguauagguauacuuuauugagggaucgagaugagcuguaaaaacucaagaauacugcaagccuuuccacaccagcagaggcuuacgugguggaaauagugaaccuauauuuucauaauucuauguguauuuuuauuuugaauaaacugaaagaaguuuuggguuuuuaauuuuuuuccucccccugacucaauugcauugucauuuaauacagccucuuuuuuacaaaaucugcuaggguuuuaaagaacaaaauaaaaaccagaggccugucuccacuuuaaaucuguccuggacagucuuuaucaugcaagcggaagguggcauugccggaagcacgccguuaacuuacacugccacugcacaggcaagagaaucggccugcucccugugugcuaucugcuuuuucuuucuucuuuucuuugcauauggucaaaaucuauugguauuuuuauuaucacauuucuaaaagcuaaggggauauauauucuaggggcuugggagggaaauaaauuaaaaauuucacacuguguacuguguuguacugauugguugggcauugcuuaugaggguuccauagugguucuucuuggauuccuaauguguaacuuaaacauacuaugaagaggaggagagccauaagccagagcauuuggcaaagaaauggaaguauuacuaaauuucuauaugucugucugagacaacagcauauggauggcauuuaaaacuuugaaugaauuaacccugaaaucaggaaagcagggacccugguggagcagguuaccagcguuaaacuagacauuuuaaggcuuucucugucuagaaauuuucauuuucaaagaaaaacuguauuucaauuauuguaaguccccuccugucuuuuguaguuuuguuauuguucuguagaucaaaagcaaagauguugaggaacaagcguuuuacauucuucugucaucaacugucuaggauuguuagagggcguuccccucgcuucccugguuccccacgccugcagugggcagucagaaggucccugccaggccuugcugaugccagagauaggagcagagggagaagacucuucacguuauaucaggaaucccagugccagaggucaggcaggcucuaaauuggcucuccucagggccuggguguggugcuauaggccaaggucauuuauccuugggauaagucagucccaguuuggggagauaauauuuuuaagcuuaaaagauugacaugugccauuauauguaguguguaauauauguaacacccuucaauccuuuuaaaauaaaaugaauauuuauaauggauauuuaauaacuaucagcuuccaguucuuaauuaugcaugauuuuguccauaguuucuguaguuuuauucagaauaaugaguauuaaugaggugauaaggggcuuguuuagaaugucucaccagauuguuuguggagaacuaggacagaacuuucuagaagccaggcuccauucugccacuucauugcuuuuagucagagucuugaauauggucacaguuuuuguuuucaugaccaaaucugagaggcuccagaugaaaacucacaguuacacagcacgcgcgcauacaaggucaaaaacagugccaaaaaaaaaaaucagcugaaauaaauuuguaauccuauaauuaggcuugaaaaauaauaaaagauaccacucaaauacugggcugcagacaacuaacugaaaacaguuauuagaaaaaaggccaaagggacacaucuucaauguggucuaaaaugacagacaugcuguaaagugaaagauguaauguguuacguagcuuuccugcagaucggaacuugggcuguagccugcuaaugccuucucugggugaugaagccauucagaacagugaugcugagccgugugucuguagugcccaccagcuuaaauacuuaaguggucaucuucacguguucauugaaagaaucagaaacagaguggccucgaguuguguuucugccauugaaagugcuuagcgcucuguaggacuugaugccaguuuauaaaaaguucuugacaagcucaagggcacuccaagaaaagaggacaguaaaauguuuuaaaacccaaguaucaagacugcuuuuagccuggcaugguggugguauacaccuuuaaccucagcacucagaagacagaagcagagggaucuccgaguuccaggacagccagggcugcaucguaagacccugucucaaaaacaaaagacuuucuuagagaaaaugggggucugagagcagucuguuuauuugaaguguugauguugucuguauaccaggggcugaauuagaacuggaggaagccaucagggagcaaauaucaguugacagcuacucacaguaacguucuuggugcuguaacuuuuuaccuagaguugcuuauaauuuguuaggucaaugaccuuguagaacaccacuguaacaagcgauuccagauuaaacauagaggaaauagagcuaaugugcuuggcauagaaacacagggucccaaaaaucucauggagaaaauucugcugagguuuuaaaagaugaacaccugaaaagagauaggauuugguguggauaugauaaucugaaugaagguaguaagcuccaugaugcacuaggaaggcguacucguagaaagaccaacucacuggaggcucaggauaccaaggaagggauuuacacuguuuugcagguccugaggaugguacuuagaagcaggucucagacuuaagaguucagcagaaccuugucagugcaacagagguuaccucacucagucugugcugagccucaggcuccucugcuguagcuagagaggcugcccaauugcccugaagaaugcuugaauaacuaaggaccagaagcuagagagacuucuugcuccucugccagcaugaggaagcaagacauccacuguucuguggcacacacucaggcaugacauguaucuaaaacauuuacaugaaugcauaagguagagaauaaacaucugaagugucucacagagagcucacugaugaagccaguuugccagggaucuuguggaaacuggcaugaaaaaaguuaacaggaaguaugcaauacaaaacaguguauggggggcuggagagauggcucagugguuaagagcauuggcuacucuuccagaggaucagguucaaaucucagcacccacauggcaauucauaacuguuucuaagucaaguuccaguggaucggauucccuuacacagauauacauguaggccaaacaccaaauguacauuaaaaaagaaaaggaaaacuguguuugaaaugggaaugcuuagaauggacucaagagagagugcugauuuggcuuccuuuaaaaaaaugcaccaaggaaaaggaauggggaauggauugauaaagcgggaaaaccagaguaacucgcuauuuuuccuucgacacugucugcuaagccaaaaguaaaaugacaugaaauuuagaacccauguauaccacacaagcaaacacaaaacuuggcccccuuaaauuauuaaagcuguucagcccauacucuguaucacauggcagugcuuuuuguugcaacuguugggucagcccgggaaaccauggaggauauaugguuaauggggcacaguguuccaguuucagaaugauugugcuaauggcaguuagcuaugcugcugaauaaagucuugugaagaacgugcaaugcccauggucugugcuggaggagauuuagguugcuuuaagcagaugagagcccgaggaucagcuguuccaggacuggagcugcggacugcugccaguaacggaguuacauauucauuaaacagccuggguaggaccucugcuuagcaacuuuucuagcuguguuugaaauuuuguauguauuuccaaguaauaaaauuauauuugcaaaauau

SEQ ID NO: 1893 - RNA, 1695 nt, Mus musculus
auuuucuuuuuuuuuucauugugaaaaagucuuuauuuuaagaaaaaaauuuaguuaacaaaaaauuuaacaaguuucacuuagcaaaauacacccaaaaggaaaucacaguacaaagaaagcuuuaagucaaggccucaccaauuccuacaguauuaguauugugucucaauucucaaaacuaacuuuuaaaaagcuuaaacuuaaccuaaagauuuuaaaugaaaauauaaacuagaaugaacaugagaaaugcuucucuuuugcaucagggaucuagcaccuuuggguucuccagaaaaguacauauccccaguguguucacuguggugugcuuaaagauccacucaacauacuuaaacuacuuaacucagauaacaucacucuuaaguauacuaccaaaaauguuaauugagaaaagcggaagaaaauaguuuuaguuuacucaauauuacaugcuagaagaaaaguuugcaugagaaacacugaagagguaauuuuuuaauccagauuucacaaacucauggugcaaagugggucccccagcuuccucuagaguuauaaacugcucuugacugcuuauuggcugccugugaaauuuucugauugaaauaacucaaauguuccuacaauacuaaucauauccgcccaugcuguucugaccgcuguagccaccccguaacagccacucacugacuggcucuccaggccacuguaaguugccugggcagcugacacgccuaugcccugcaucaccuggcugcuauaagccccauugcuagccccuguuguugaauucaggaagaguucuauguaucugugcugcauguuggcccuguccuuggacauagcugccacugcuucuucaugaguagcaaacucaacaucagcuucucccgucacccuuccaucaggaccaaucucaauaugaacucucacaggguugaguggagagaagaaguuguaaaugucguucuccguugcuuuguaggacagcccucucauguggacgcaguggccgguggugcucugcacugugaacucgcugucuccauaucuguggucauacauuccugagagacaauagcugaggucucucccaaacaggucaguggugaagccauagccaucacugaggccacuguauucuucauagcccccauagccugcacuauaggcaccagaccucauccuauccagaccugccuguuucacaaugccaauguaccuccgggcugugccaggccugucauaaggcccaggccuuugcacagacauaaacuucagagguggaucugaguaugaucuaacuuccuccugacugcucuuaaacacuucaauauaccugugcccuauucucuccuugugcuucccuaaagcuuucucagcuaacucuugugaggcaaacugaacgaaggccuccccuguaaucuugccuuccggguccacagguagugugaucccguuuggcacaauuuccaacccugagaagaacugaacgauuucuuccuuugugcauccaaaugggaguccccgaagccucacaaagccaucauuggcacugucggcgcuguuuggaccacugugcuucaacacccaauccaucucgguucugugugacuugaacaccucaauauaccggugucccaugcuuucccugucuuuuuucagagccaauuuuacaucaucuucuga

SEQ ID NO: 1894 - RNA, 1812 nt, Mus musculus
guuuuuuguuuuuuguuuguuugcuuuugguuuuuugagguucucuguagccuaggcuagcuuugaacuuacaacacuccugccucagucuccuuauaguugggauuacaggcacuaugccuguaugugaaaauagauuucuuguggcuugugacauuggaauaacacuuuuugggugcaacagaaaacauuaguuucauacauaguaacaaaugacaggccacaaaaaugguggggaaaccugaagacacucugcuguauuuuacuacugacaguaauguggaagauuaaguaugagauguggacaguuuggacaaaggaacauaccuucauuuucccugauuucaaaugacugcuuuuggaccuugggcacugcagcuguaucuugaaguagguugucaucugcauuccccuccauagguggaagcauguauugacuuccuacagaggugccauuaccaguagccgcaugagccagggucauuccucuugcuaguggggagcuugucauuuuaaagagaugggcacagguggcuaugugucaguuaagaguuagguugaaauccugugcaagaugguguggguguagaagauuacagaaagcagagauugcuuaucugggucucaugcauacaaagcaguagucccaggaggccgcaucuugggauuuccaucguuuucugucuuucuacgugcaaagccuuaggagggcacuaacucaaauuggaacagcaacauguacacugugcaaagcaauuuuuaaagaauuugaaagccugcugagcaaaaucagaaaacccuuagccccacugaauuccuaaauaaaaaagcaaacuaauaauucagucaaguuaaugcuuuccuuugucguucaaccaccugauucuauguuuuagcaccuguguauguucaguucauugaacugauuuauagacauguuuuuguuuaacacauauagcccaguuagacuuuagcaccuaucugaccggcuuuauugauugcuuugugcuugcuuugggugugguuggaccaaccuguauucccucaaauuuggggcuagacaaacacuccauuuuauuugauuucaaauagguuagaaauuuguagaacaaguugcuuguuauaugaaguuuuaaaagaguauuguauguacuuacauuaauauugaauguguuuacucagucuuuucuuaaaacuucuaugcugcuaaacaucuucauuuuuaaggacugcugguaaauguggauuugagagaauggucugauuacucacuuuguauuuaauuauaucuaaaugccauauaucuuguaauaugugacaguucugcuuuugacauauuucuccaguccacuauaaggacagucuuaccacaucuguggcccuugauuccuuugaaaguuucugaccaccccaccugcuacuuugugagcagccugccuuguguuacauaaauuagucaacucuuauuaaagauuuugcaguaauuacucugcuuuuccccaccaaaaccuaaaugaauguuaaaguucaugcugacagucauuguucaccuugcagcugcucucuguuucugcaggauggcccuggagagcagggagggugggggaggguguugccauagccaccugugaagacaggccagaccuggcauuagcugcugacagcccugaacuuaucacccauucuuacugcuggcgugaaggaagagguccugaguaaaacucacauauguugugaggggaacgucguucccugugcugcuccugugggugcaauugugcuguauauaaagucugagcacaauaugcuuua

SEQ ID NO: 1895 - RNA, 1339 nt, Mus musculus
ugucauuccucuaucacauugcuuuagcucuacauuuagcaauacccugucuuagauuauagcuuacacacacauuuucuggauggcaguucacuuuaccucugcauugucaauuccauucaaauuguccuucucaguuaaaguuguauauuuccauauuaaugaaucaauuuuguuugcuuuaggcuguccgguaaguugagcagaaagaguguuaccuugagccuuccaaacaguacgacaggcagugauucuccuauuuucagcaucucccuucauaauguuauuuuugugauaauucacagcucugcacaaacaaaucauugauaacaucagucuguaauuuucauuuggauugucuguauuauguacauucuauuuugacaagcuuguaauggcaguuucuuugaggucagaaauaguuguauaaacacuggauucuaccuaguuaucguucguuacagagaugaauccuuguccuuugauccuguccguuggcaaucgugugugugugugugugugugugugugugugugugugaucuucauaaauuugacuuuuaagaaugcuauagaguuggcagcaggcauaucaauagccuuuacagacugguaaagguuuucacuuagugacauauuuauuaaguuucuuucaugucuuuucuucaugaguugaauaguaaguuucauuuuauacugaaaauuaguaugucugaacaaacaacauauuaucuaauaacccugaauauuucugugauuugguaguuccuaauagagcaaccauaucucuaugagaacuuuuuucccagcgaguuuauuuacucaggcaaacacauagcucuauauucauacuuguauauacaaaagcacuuacauuagaaacugccaaacuuccagugucuauucugucuuguguucauaguauucugaaucacaauacugcuuuuaugcacuguugucacgaugcugcauuuugcacauucaaaucaguauguagugcuauauccuuuuucugguuuauauuuuucucauuggauaugcuacgaaagauguaacauaugcucuuuuguguucaaaacuauguuaacucagcaagaauauucucugguucuaugucuacucagaucuuucucugucacuuucugaucacauuauucauuuccuuuuagggaguuugaagguuuuuuguuuuaauguauuuuguauaacagucuucuuuuuauuuaccuuuuuguacucguuucccugucuaugauuuauuuuucuaucaugcauagcacuaacuuuuacaaagcaaaauagcuuaacuuuaacguacuucucuuucugaauucuuuuuu

SEQ ID NO: 1896 - RNA, 630 nt, Mus musculus
cauggcgcccagcuggaauggcaugauccugaagccccacuuccacaagaauuggcagcagcgaguggauacuugguucaaccagccggcacgcaagaucugcaggugcaaggccgggcagucaaaaccccucgacacgcguccagccccaucaggcccauugugaggugcccuacaguuagauaccacaccaagauccgggcuagcaggggcuucauccuggaggaauucaggguggcugguauccacgagaaaaaggcuugcaccaucggcaucucuguggacccaaggaagcgaaacaaauccacugaaucacugcaggccaacgugcagcaccugaaagaguaccgcuccaagcucauacuuuuccacaggaagccuucugcuucgaagaagggagacaguucugcugaagaacuuaagcuggccaccaagcugacaggaccugugaugcccauccggaauguguacaaaaaggaaaaggccagaguuaucacagaagaaaagaagaacauuaaggcuuuugccagucuccaaauggcccgugccaaugccuggcucuuuggcagcaaagcaaaaagggcgaaggaagcugcagagcaaaacguuggaaaaaaaaaaaaaaguaau

SEQ ID NO: 1897 - RNA, 630 nt, Mus musculus
auuacuuuuuuuuuuuuuuccaacguuuugcucugcagcuuccuucgcccuuuuugcuuugcugccaaagagccaggcauuggcacgggccauuuggagacuggcaaaagccuuaauguucuucuuuucuucugugauaacucuggccuuuuccuuuuuguacacauuccggaugggcaucacagguccugucagcuugguggccagcuuaaguucuucagcagaacugucucccuucuucgaagcagaaggcuuccuguggaaaaguaugagcuuggagcgguacucuuucaggugcugcacguuggccugcagugauucaguggauuuguuucgcuuccuuggguccacagagaugccgauggugcaagccuuuuucucguggauaccagccacccugaauuccuccaggaugaagccccugcuagcccggaucuuggugugguaucuaacuguagggcaccucacaaugggccugauggggcuggacgcgugucgagggguuuugacugcccggccuugcaccugcagaucuugcgugccggcugguugaaccaaguauccacucgcugcugccaauucuuguggaaguggggcuucaggaucaugccauuccagcugggcgccaug

SEQ ID NO: 1898 - RNA, 1623 nt, Mus musculus
ugguguuauuuguucuuuuuguuuuagagcuuucagguaauguguuacuaauaugaggucucuaaaauuuauguagacacuuagcaugauaaacuuccucuuaaaacugccuguguccuauacuuggcuuuguugucuuuuuguuuucauucaauucuaaagaguucuaaauuucuuaauuucuguauugauccauuuuccauucaguagagaguuguucaguuucuccgaguuuguaagccuuuuguuguggauaucuagcuuuaaucuaugguggucagacaggauacaggguauuauuucaauuuucuuguaucuguugagacuugcuuugugucuugacugugugguuauguuuggagagaguucugugaggugcugagagagguauauuguuuggugugaaacguucuguaauauuuuagguccauuugguuugugacauuauuuaacucuaccuauuguuuuauuuuugucuugaugaccugucuauaggugaaagugggggacuucaguacucugugaaggucucuaugugauuuaagcugugguaguguuucuuuuaugaauuugggugcccguguguuuagugcauagauguuaagaacuguaauauccucuugguggauaauuuuuuguuuuuuggguuuuuuguugauuaguauacagugucugucacucaucuuuugauuaguuuugguuugaagucuauuuugucaggcauuaaaauggcuacaugggcuugauucuuggguccauuuuuaacuauaacuuguuagaugcaaauccucccuaccaugccaagauacaaucugaggcagagauucuugggagcuuaaccaaaaugugaaacagacagcaguugaagacuccuaaccagugacacuuccaacaucuguggcagucacuccuuaaucaaaucuacuccucucccaaucaaauuuaucuacaaucuacaaauaguuuccuaaaggucauagcaaaccuuacugaauaaacucuguagaauacugacaaacaccagccaguagcugguuuccaaaccaaggcucuuuauacaagcugacccaguaucuccguucuggacagcugucagcaccacaaugaaguacaacaucaacucugcgccucaguacccaugcuaggaagacuggaagcacaaaucuugcugacagcugcucagcucacugaccauuuagguaucugguaccucuucccugguggagauucuccagugguaguacucuuuucaagccugucaccauuccucuaucuucccacauacuucauucugcauaccuguacuaauuuggccacuacuucuguuauagucucuguaaccagacaagccacucaccguggccuaugaguuuuguuuuguuuuguuuuuuuuuuuuuuuuuuuuuuuugcacauuuuuaacuuuaggucuuguuuccacacaaaguacaaggccaacugcaacauuuaaaucuacucauugacuuuuucacuugccaccaucuuucaggguguucagaccuaugguacuuuuauuguaaacuuaauccacaagcagcauuuucaucugugaccugaaaucgugcuuucuccucuugucuguuaacuggcugaaugggauucc

SEQ ID NO: 1899 - RNA, 17888 nt, Mus musculus
aaugcagcugcaguuggcgcuuguucuugcuuuggcagaaccacuuccuaacauucuccuuuuggaauucuuucaugcagcucacauggcugcuaccagacacaguaacaccuggaagaaagauacaaagaagugaagaaggaaagaaagaagugaaggaggagaggagggaaggaaggagggaaggagagaaggagggaaggagggaaggagggaaggagggaaggagggaaggagggaaggagggaaggagggaaggagggaaggagggaaggagggaaggagggaaggaaggaaggaaguuaggucauccuuguuuaucaaaagaacuuagaauacuuauuggaaggccuggucauuuauuauuucuaacaccucuacacugucuuuguuuucuuuaaaagauaaaauaugagugcuaaggcauugauaaauuauaaauauugcuucuuucauacucacaugugucuccuauugucuagcaauuaaauauuuuuucaaauguguuccagauauaaacaugacaucauugugugaaaaauggaggaaagaaggaaggaaaggagggggaaaaggaagaaggaaauauuuauaauauuuaauuuaaugauuuaguuacauauuuuauauauuaauauagauuacccaugcuagccacucacgaaaauuuagccaccccuuucaguaaaagaaaucaacuagguuauauuuauauugauuucuugggugaaaacaucaaagccuuuuguuugggccaauccgguccugugaagauuccuauauagaaguuguaauccucaguaccucucagucuuuggcaucauuugaaaauaauaguauuauaaauguaaugaauuaagaugaagucacaccagcugccuccaguucccugugugcaaugugacagguguccuuauaaaaagagaggcuguacaaagaaaugaucacaaggggaauacuacaaaaaaaaaaaaaaaaagaaggcagagacuggagugaaaacucccucaagcuaucaacuguaaaacacuaucaagccaccagaagccagaguggagagguaagagucuguagaccuccgagggagccaacccuugaaccaccuccaaaacugugagacaauguacauuucuguugugcaagccaccaagauuggaguacguccuuaaaauagauucagaaaacuaagacacuuucuuuggccuuuucuagaaacaauggugcccuucuugucagggaagccccuucucuuucuaacaccucacugaaaccuggcuauaggacggacaugcuuaagcucugauuugagaaucauugacuguggccacagcucuguaucaggucuugcacggucaugaucacacaaagaagacucggguuuauccuugcugcuucuccuagaguguuccuauauuuaucauaagcacuggccaagcaaggcagcaacugcugaaacacuaguguaagacacacugacaagcacaaaaauagggauaaccuuccuguugccaccuuuagccuccaccucaacguuaugcacuuauuucuuaguauuuaaucuuugauaugacauuagcaaccccuccaguaguuuacuuugucuuaauauaauuugaauaaaacuauaagcaacuacauuuccuguuguuuaaaaaaaaaaaaaaaaaaaaagcaagaugucugaguacuuucugccaucuacuggcaugacaaaguauaacaucauagagcuuaaauuuuaaguguucccucauuccucuuugauuuauuugaagaauacauuccucuuagcaccgcuuuccugugucccauaaguuuggguauugugugccuucauuuccauugaauccuagaaaguuuuugauuuucuucuuuaauuuuuuccugacccagucagugaucauugaguagaguuguucaguuuccacaaguauguaggauuucuguuguuucugcuguuguugaaguccagugcuaauccgugguggucugauaggaaacaaggaauuauuucaauuuucuuguacauguugaggcuugcuuugugacugcauauauaguuuuggagaaggauccgugaggugcugagaagacgauauauucucuuguguuugggugaaauauucuacagaugucuguuagguccauuugcuucauaauggcuguuaguuucauuauuuugcuguuuaguuuuuaucuggaucaccugucaauugaugagguugggguauugaagacuuccaguauuaaugugugggguuugaugugcaauuugagcuguaauaauguuucuuuuacaaauguggauacccucauguuugggcauagauguucagaauagagauguuaucuuguuaauuuuuuuccugugauuaguaugaagggugcuaccagcagggaauauggaaacugaagugucuacuuccucuagccaggugggacgucuugugaagggagggagauaucaacccacccacaaaaccuucaacccaaaauuugucuugccuacagaugcacagggauaaagaugaagggcagauugagggaacagcccaccaaugacugccccaacuugagacccaucccauguaaaagcgccaaccccuaacacuacuaaugauacucuacuaugcuugcagacagaagccuaccauaacugucuucugagaggcaucguucagcagcagauggaaacagaugcagagacccauagccaagcaccagguagaguucaggaugucuugcagaaguguagguagaaggcuugagggauccagaagggucaaggacaccacaagaagaccuagagucaacuaaccuuggcccauggaggcuuacagagacugagccaccaaccaaagggcaugcagggucuggaccuagagcuccgacacauuuguagcuuaugugcagcuuguucuucgugugggauuccaaacaacuggagcagggacugucuaugacucuguugucugccuuuggaucccuuuuccuaacugggcugccuuaucuagccuucauaggagaagaaaugcuuaaucuuacugcaacuugauaugacaugccugguuaauauccaugggaggccugcccuuuucugaagagaaauagaggaguggaugggggaacuuggaggagaagagggaagggaaagaaagaaagaaagaaagaaagagagagagagagagagagagagagagggcgggagggaggaaggaaggaaagaaggaaggaaggaagggagggagggagggagggaggaaggaagggagggagggagggagggagggagggaggaagggagggagggagggagggagggaggaagggagggaggaaggaagacuaguaaauuuaacuaacaauaaggaagucugaaaaaugaaauuuucucaucugggcugacaauaauauuccuaagagcgguagaccaucugacaaaggcaugagaaguccuuguuaguauuguauguuuugagugguuaguugaaauugucugaaagacccccaaacauuaaaggauauuacugucuauaggaucuagcuguuucccuuuuauugucucccagagguggaaagaaauuuccaauugcuggaaacacccugcacucagacacagaaccuggaagaucagagcuguaucuaaccugaaagucuccucccugaagaguagcuuccaagggagagaagcaaacaucaguucuacuuaccuaugaugccagugggaaacaacuaugaccagcauggcgcaauaagccuaagggugcaauaguguccuugauauccuugugguaauggcugcucucuaauaggccuaagacugccucaacaaaagggaaccaaugcuaguucuggaaccuagucaacuacccagggcaagcaaaauggaccuuggagaugaaacuaagaacugccacucugccaaaccaguguaauuccuaaccaggcucgaaguaucagucuuugcaccuacagacaaguguaguccucauuccaauaucaaagagacuucucuugggaauggauggaggccauuacagaaaacugcgauugauucaaacacagauaauaagagcuccuguagaugcccagucccagcugguaccucuacaacucagcuccuacacuugagacucaggaaugacuguagacaaugggcagaaggaugggaagagccagaggaauggaaagguugcuaugagacugucuccuaggaacaucagagaaacuacacccauggaguuuuaccaacauggcugccugaacaaggccugaacaacaauggugauaccaauggagcugcuaacaugaacaggggagagaugguggggccuuaacucuagacaagagguuaguguaacuggagcaugcucagagugggagaaaggguuuucuccagggaagaaccccaauugcuaguccugaggucagacguguacagguaacauuauacaaacuaugccaaugugugugugugugugugugugugugugugugugugugugugugugugugugugaaaacauuuuuucaaaagaagcuauguaauaguuaaaauaauaauuaucaauauucaauaguguagagcuguguugaauauuguacauaggccuguuugcagaacaaaucuccauuuggccaaacacacucacuuaucuguaguucaucuuuucacacaaauguccacuuuccuguccauuauguuccaccacaguuuauaucuaacuucccauaguuugcaaacuccuugguuuuaccucauauuccuggacucucuuacuuuauuucuuugggcuccaguuaauugacuuuguucuuuagaagcuacuggagaaagauaaaaaagaaaggauaaaaaacaaaggagaaagaaaggaaggaaggaaggaauaucauuucucaauaacaaauagguaugacuauugguguuauguuaacucacauaacguaaaacuuuucccacguucaaggugcuguacucucuacaaugcccuggauauguaccugaaaaacaugaaauccacuuguaccuagugaguacagcauguuauaugaacuuagcuuuguauaauuugaaguccuggcccaaauaucucaggauguaaccauauuugaagauaagacccucaaagagacuacuaaguuaaaauaagacuuuuaaagggguaaaauggccaaaaaaacaaguuucuucauaacaaaagggagaaagggaagaaaagagggacagacagacagacagacaggcgggcaaaugagcuugugaacacaccaagaguuaucuguaaguagcgcccucaugagauacuuugccugcugacaccuagucuugaacuuuauucuccaaaaaaagugaguaaaauguaaaauauaacugugaaauaaagcauaaaguacguaacauagucagccuggagcauuuugcaaugacggggcuggcacauuaacgcacuucucuaugcaacagcccuaaucuugguucaacaggcuuuuggcucuagaaugcaugggugacuccauaguaucuucaacuuuauuaauagucucacuucuuagaaaaugaaguugucuuuccuuuaauccugacucaucuuuggggaaacauaaugauuuuucaaggagauuuuuguuaauccaggaaugaagagcuguuuucuuuuuaaaaguucaaugaauuaucaaauaaauuuuacaaggcucccauauugaucgcucuuguguaggucacaugucaguuguuaucuaaccaggcaugcaaucuuccugugaucacugaacaggguuccugguacccuuuacaaauacacuuuugccaaaguuccuaagaacuucuaccacaagucgaaauucgcaauuaauccagcuucugccaggcuacacuauaaucuugguugagagauuauuuuaauguuuuuaaaucuucucaugguaugcuccacucuguuacucaaacuacucaaacugaguuauauugaauagugaacagcagaugaugauauaacccaaguaauacacaaaacucuuaaccuaucaggacuccgacucuuucuuauuuugaaauuuucuguuucaacuuuaucucauuuucugaucaccuuugucaaucacagcaaagugaauuacuaaaaauacaagcuauauggcugauaauugcuuuucuguuugacccugguuagccccuaaauguuaauacaaaaccauucaaucagagacacuaccccacaugcuaacaccaacauuaccacugacaacccccucuuuuacauuuaaacaccagccuugcagaucugcuuaucuuuucccagaugcaaaaugguauuuuugaaaagcaaguuuaaaugcauguuauucuccuugcuuggaggacuuuuauuucuguggcacauuugucugcuauuaaaggcuuuucagaaucaacugugguugcaggucuuuaguaacgcuuauuauaaagccaccccagaccacagcaaagguugcucauucauucccucagcuccuaagagccuuuaucauugcacuguauuuccugguuagaccggcaaguuacuaagggagggguuuaugaauucauuaucuucucauuucuuuauacuuagcacaauaauuuaaaacugguaccuguuaaugaaaugauuuauuuaacaucuggugggaagaaucuaucuuuauucauuuguuugcuuggaguuuuguuguuguuuuucuuuuccuguuugggcaauagaaagcaaugaaguagaaauucuagaugaguugauuugguaaugccucuguuacaucagcaaaagagcaccuuaaccugacagccucugugaucaccccuggccugcacuguaguucacauugaguguuggccuaggacaagcaucaguguuucuacacuaucuacugucaucucuuucaagggggucauagacuaacccuaugcucugcaucacacuuaagcauauaaaggcaaaccauugacaggcuguaagcagcagcaaaguucuacuaggaaaaucucaacucauuaccuuuacagacaauguuagugcuuucccccaacauuucuacuauuccaucucauaaacacacaaaugcacacaaaugcacacaaaugcacacacacacacacacacacacacacacacacacacacacacacacacacacguacacaugcaccgcucuaaaguagaccaucuggguuucuuugaguucucaaugcaggagcaaacaacagagauucaugucuugacuacucaccacuacaagucacuggcuuuaaucuuacugguucuuuuaaauuaccaucaggaccacguuucagaugcucauuccucuuuuguucuuccaacucaaugccuguuacucuuucacgaugauucaauuacuuauuauauaaacaccuuaaaauaaucacccuuugauucucaucuuucaggguuuauccuuuagcagugacagauuagggcaugugugauuaguaauguuaauaaaacaagagauauuugugugauuggauguagacauaaaaacagaaucucauacuugauggaagcacacacagaaaguaacaauuccaaugcucuaugcaucuucuaagaaagaaucauuguaucgcugagaagacacuugggcaucugaacaccagaguucagcgaugucauagcugcaaagaugucaaaaugacuaacuucagucucuucuggguuacucaggguuuuuuggguuuuuuguuuguuuguuuuuguuuuuguuuuuuguuuuuuggguuuuuuuuuuccuacugugacaaauaccugagauaaacaauuuuaaaggagauauuacuuguuuuggccuacaguuuugagacuucaguucaagguugacuagaugaauugcuuugugccugaggcaaagcauaugauguccugaggagguuggucagcucagggugccagaaagcagagacaucugucuugugacuuucccuuuccccuuuccucccaucugagugugcagcuauugcauuccacugcccacauuccauguaaaaucuucccugcuuauuugaaucucugcaaaugcucucacagaugcacucagcagugcacaguacuaacuuuaugucuuaaaugauuaguugugcauaguugaagucugggcccucuagguucuuggcaucuuauuaaagaaugaaacaaaucacauagauugcaaaguaaccugcaucuuuaaaaucuuuauucaauaugaaacaauaguacagauuguaaaggaacacgcugucaagacuaacccuggaccacauaaugagaauauucaaggaccuggauuauuguuugagguaccuuuuuuuuuuaggggcugaagcugaaaagaggaaaguuugguugcuaucuuaggguuucuauugcugagaagagacaccaugaccagggcaacucuuauaaaagaaaacauuuaauuagggcuggcuuaguuucagaaguuuaguccaucgucauucauggugugaagcaugguggcaugcaggaugacauggcacugaagaaggagcuaagaguucucuugauccacaggcagcaaggaggagauuguugcauugagcgcaucuugagcuuauauagccucaaagccuaccuccacagugacacauuuccucaacaaggccauaccugcuccaacaaggcuaccuuccuaauauugccacucuuuauaggccaagcauucaaacaugaaucuauggggccguauucaaaccaccauaguugccaggaagcauaguguggugguucuuugcuuugacugacagauuaaguuuaacaggacuaucuugauauucgaaugucucuucccauaauguauguuauuuuaaucauaugcacauccaauuuugcaaagacacauggugaggauuugccuuaaaauuuuacuuagaguaccaaguggacucagaaccaaucuuggccagacuggcuguugccauuaguuucaggguaauguucugggauguguuugaauaaauauauuauugagggaguuguuaagaggaguuguuucuuuccauuguuuaaaacaauuauuuauuccuucucuucuacccaagcaacaaguguggcagagauccuagauugcuaauagguugcuaggagcauuguauggagaggggcacauaccugaucuaaacuaaguaaaaguauagcuugcuaaaccauucuuuaacuugcuuaccucaccaacaaaauuagucaucacauccuccaaguauuaguuagauauaggaauauacauaaagcauaacaaugguauaaagucuguuggauaaucuaaauaaauaacaguuaaagaguaugcaccaucucuauuucuguaugacauuguacuaggugucauaucugauguacaaggcaagaaaaauacuaaagaauuagaaauaaaaagaaagacaaacuauuacuauucagaagcaacugguuuguggauguauaauuucucucucucucucucucucucucucucucucucacacacacacacacacacacauacacacacacacaugagagagagagagagagagagagagagagagagagagaaggaauccacaccacacaacuguucuuaaaaguaagacauuugacccaacugucaagauguaucagguuacaugacacagguacaacaacaaauaacuaggaaauauuucaucuuaaauacuguuuauaauagaauuaaaauaaaauaacugauagaaaccaucagaaauaguacaagguuuauaaaaaugaacgcuacuaaauaguuuagacagaauuuaaaaggaagcaaugaauauaagagauauccuuuggggggauuggaggacuaggucuuauucggagaucaauccuuugcauuauaaaauauagauuaaugucaucucacuuuaaacacaagcaugaucaggcauggugucacaugccuguaacuccaguaccugaaaggcugauaggaaaaucacuaguuuagaaccagccuagagcacauaaugaauuugagaauuuaaggucagagugggcuacauggagaaacucuguuuagaaauaaaucuaggcagagaguuugaaaaaauaaacaggaucauuccagaacuaaagaaauaaaaaugaucuagaauaagaagacaaagguuaaaugauuuccacuaucuuguuauaaaacacaggauaguauaagccauuaauccagccaccauuucacccauacaaugaaggacaaguuuuaaauggaacaaaaauacaagggaggggggagcagaaaggaucucacccacaucugguuaauugguuucaaugcauaauuaaaaugguuuaauugagaaaggcuccuguuuucccgcaacgggugcuguaauaacugugugucccucuugcacaacaggcgcaacauuuauucaaaguauaucauaggcuuagcaaaauguuugauagaccuuccugcagaacacccagaaucuucuuuuuaacuuuugaaaaucaaagauuuauuacacaaauguauuuguuacuuuuuauuacugauaaaaagccuaguauaagccaucuaaaggaaggaauuaaauauuuuggcucacaguuuccaaagguucagucuagauuguuucaugccaggcagaaaaagcaugcaguaaaagagaguuguuuacuucauagugaucaggaaaaagagaugaugugugcaaaagcaagccacuccugagagucugccuguaguaacauauaucccccuaggcuggaucucaagacggcaccagcaacuguggucuacccucucaacacaugaaaagcugagagggcuacuucauauacagaucaaaauauguuuucuccacggucucccaaaggggagcuggauccccaguagguuucuuuaagguagccccaguagguugaccgguugaccacauucuaacagaugaacccgaccuacacacacaugcgcgcgcgcgcgcgcgcgcacacacacacacacacacacacacacacacacacacacacauccaucagccuauggcagcacaaauugaacucaguggguaaaaaaaaugauguugagcugccaccaucuugguuccgugaucuucgcacaaaauacccggugaagccacagaaaccgucccugcuacagagcaggaguugccacagccucaggcugagacaggauugggaacagagucugacagugaugagucagugccagagcucaaggaacaagacuccacacagacggccacgcagcaagcccagcuggcagccgcagcugagaucgaugaagaaccuguuaguaaagccacgcagagucggagugagaagaaggcaaggaaggcuauguccaaacugggucuucgacagguuacagggguuacaagagucucacuauccgaaaaucuaaaaguauccucuuugucaucacaaaaccagaugucuacaagagcccagcuucagacaccuacauaguguuuggggaagccaagauugaagauuugucucagcaagcacaguuagcagcugcugaaaaauucaaaguucaaggugacgcuguuucaaacauucaggaaaacacucagacuccaaccguccaagaggagagugaagaagaggagguugaugaaacggguguggaaguuaaggacauagaauuggucaugucacaagcaaacauaucaagagcaaaacaacaguaacgauauuguaaaugcuacuauggaauuaacaauguaacuauuugacagcgaagacaacccccccuuccccccuuuuugguguuugaaaaguggaacuacagcuugguuuaaaauuuguacuguuucuaucacuaauaaaguuguggcuucuuguuggauggauuaaaaaaaaaugauguugcgagaugaggaagcauggauggaucagggaggaauuaaggaggagcagucgggaccaauaugaauaagauagguugcaugaggccauugcaaggcuauugucugaucuccacaacccaauaguaaggaccuauugcugaaggcaacauuuaauuggguuaucaagcacagagaaaucaagcugguacccaaacuagacauuucacccuuaccaacaaguauccaucgugauggaagguacccuucauguuaccagaggagaaagauuauuaauauuacccagcuacaaaccuuguaaacuaaaacugcagccuguauaccaguacaauaguggcacaaaugguaugaggcuaaccaaccacuuuuaaguucaauuuagaucaaaugccaucagauggaaacuguaucuggcacugcuaaaguagaugagaauuagcacagaaaccuauaacugagaaacaugaagugagagacauuagaauacugaguucuaagugaucuaaauagaaugucuuuaucaagucguuccccccccuacccccccccccacacacacaccucaaggcuuagcaaucuguguggaagaggagauggaaagauucuaggggccagaaaugguagauacauccaaggaacaguguuuuccagacacagcagcauuggcaugcacaugaauuuacagagacugugcagcacacauaaaaccuacacagcuucaagccagauagggucucagcacggaggagaaguggaaauaggcuaucaucccuaagaagccauuuguaagugauacccacuagcaaacuaaaaaugguuucuucaauggagugucauuggguauaccaaccaacucuaggacaggccucacaccuaggaguaguuggacaacacaaaauaaaguccacagaggguuuugugugaguguguuuuuauuucauuauggugguuuugucucauugauuuucuguuucucuauuuugauuuuuuguuucauuuguguauuuuguugcuguugugggggguuuggaguguuucuguuuuuguuuuuguuuuuuuugguuuuuggguuuugguuauuuuauuuauuuauuuauuuauuuauuuuagaaagagagaaaaugagaaaaugaaguuggguaguuauaguuguagggaaaaucuguaggggggaguuugagggggagacaaaacaaagaaaaagugaaaaaauacauuguaagagauucucaaagaauuaauaaaccauauuccaaagaggauaagggaucuaggauuacuucuaguuuucugacuagagaaaauucuaauauucaaguaccuagcacauuggguacugugucaguuccuuuacagaauaucucuuuccucacaaugacccuaauaaauacugacacuucccuuuuacaacucaacugaaguccgcaagacucuccaauuuguccagaaaacagaaaugacauguggaaguggaaaguguuuagcccuuuuugugaacaaugcaauccuaaaguuaaaaaguauuaauuauacacaugaucccaggcccauggauaagagugaauaaacaguagacccaaaggguacauguugauugcaaauacaaguuaguaaauauaggguuuggauuguaauggcuuaauuuuaggcaauaggucaaauacauaacuaucuuuaucugaaaaugaagaggcauuugauaagugaaguagauuauauaauggccauggcuauaaucuauuaaaugagaauaguguuauucagcuacaauuucacagcaaacauuuguccauguauuucccccauaccaccauacagugucaaacuucagagcaucucucaaaagcaggcuaguuguaaacuggugugauacagcucagcgggauaaagccagccauuagcauucuaacgucaagaugcuuuuauaugcaucagcuaacuuccccauaugaaaugcauuccuucaucaggugcaauuucauuuuccauaaagauugccuguaagucuucucauuaagccaucaucaggaagagcaguuacccaggcucuuguucacccaucuugaugcuuccauaucuagcacagcuugucucaugcauacuaugaaacucuccuaguugaaagagaaagaugacacuaucuuuuucuuuuacaucaaugcagcaagccuaacuuacuucauagcauauuugaaaaagaguaaaguuccuccuccucaaagcagugacaauaggaacaugcuuauuucuuguuugaauaacagcacaauuagacuaagcaaacuacuggugauaauuggaucuaugggacaucaucccuggaguuucaguguuuguaaugcuguucugacagauuugcaacuuuaauuugcugcaauaugggaaauuuuucaaaagcaacaaauagacuaaauugucuuccggaggcagaggcugguccuuuggagaauguuucuguagcucagucgcuaaggcaacuacagacaugaaaaaugcagacauuagguauuuuucaccaugagaauauccaucaucacuuucuuauguucaaagggaaacuccgauuuguuucccaaaguucaaggucuucaauuaguuucuuuuauaucuucagaaaucuguacauuauuuuacguaucgacucuccaaaccauugugagcaucucucuaggacuggcaaaagaaacugugaacuugggagcuagagauuuuccuucaugaagaauauuaccaagcuaagagaagaaaaucaucuuaguaacuuaaagguaaaaacacauuuguagcugaucuacaaauguaguuuugcaauaaggggggagcaaacgauugcuucuuuuguuauucucuuaccauguuuacuuaaugaauucuucucucgcuccaucuuaacaggaggaaaggucuugcugcaaaagcagcaaguucaccauuuacuggugacuucguggcuaaguuauauuaauaaccaauuguucaaacgugcacuucuacaauaauacucucaauuuagagaggcacuuaaauacaaagccaaaguucauaugaaggaaaaacugugagaaaauuuaaagcaggauugguugcuuuauauauuucugcucuguaauuaggacauacauaugaauauacuaccauaaaaugguucagggaaauuggaccucugucacaguguuuguuuuucugggauuuucgcacuaccccagaauugaagucaccguauuugugcugugucugcugauguaucugaucaccuugcugggaaauacuauucugaucuccaucacuauccuugauucucaucugcacacucccauguacuuuuuccucagcaaccucucauuucuggacaucugguauaccucuucugcucucacuccuaugcuggcaaacuuuguuucagggaaaaacaccauuuccuucucgggaugugccucgcagauguacuucucucuugccaugggcuccacugaaugugugcuccucucuaugauggccuaugacagguauguggccaucuguaacccacugagauaucccauuauuaugaacaggagggucuguguacagauugcaggcagcuccuggguuacaggcugccucacugccuugguggaaacuggaccugugauucaucugucucucugugguaacagcaucaucaaucauuucaccugugaaauucuggcucucuuaaaauuggccuguggagacacuuccaugguacaguuaauuaugcuggugaucagcauucuucuucucccauugccaauguugcucauuugugucuccuaugcaucuauccucuccaacaucuugaggaucagcucaauggauggccgaagcaaagccuuuucaacaugugcagcccacuugacuguggugguucuguucuaugggacagcucucuccauguaccugaagcccucaucuguaaacucacaggaaauugauaaauuuauggcauuaauauauacuggacuaacaccaaugcuaaauccuauuaucuacagucuacggaacaaagaaguaaaaauggcugugaaaaaauuguugaugaaaaaccccuucagugcuaucuuaacuucuguccucaaauaauauugaaauaaggcauacucaucuagauaaaucuucaaauuguugagagaacugcauaauaauacaagccaauuucccagaaaacacuaauuuuaaucacaacuaccauuaugucauauauccugauuugccuuguaaaauguuuuauaucaaugaaucauuuauauagaaauauguugucaagaagguaguuaguacuuauugcauauuaguauaaacuuaaaaugauguagcuaccuauuuuucuauuugaccuacuaaaugaucucacugucuagcagugacauaaccaugaaaauaaguaauauaauaaggaugcagaauuguuagaaaauucugaagugacauuuucucagugauuugcaaauaucucugcauuuaaaaagaaagauauuuuaaguuagcauguacauaugaccaucacuaucugguacucuucuaguuucugaacauuaaaauguuaaauuuauuuuuuucagauuuggaaagaccaacuuugaaugacaacuuauuuagguugcauauguugaagaaggauaaauaucuauaacauaacaagaauaucaugauaaggauugcaaaauuauauuuuuauuuaugugcuucaauagaaauauaaaaaugggagauccggaauuaugggucuaagaugaaaugauuucauauuauacuucagugucuuaauaaauucaucaauuacccacccaaauuauuaacacauuaaacaaccggucuggaauuguagcucgauacagcauguacaaggauuuagcuuuaaccccucagcacuguugaaaagacauuuuaaaaacauguugcuuaacugaccauguaggacugauaaagaaagaccccuacucuauguugaguguaguuuaaaagagauauuguaucugucuuuaaaauauauggacuaaaacauucauaaauguguucaauaugauugaacaaaacugcagacuaagaugucaccaugauacaaacuaaugucuuuuccuuuucuauuaaauccuccuagaaucugaacacaaagcugacauguauguuacuuccuugaaauuauguaaaugauggcuucauccugugaaaguguaucucgugcuacugcagacaagcuucauguggaccuuauguuuaagaaaggagagaugaucacacauaagcaucaccccagcacuggugugaacucuuguaaucccaaccuuguggaggcuuagacagaaggauuauagagccagcugugaucacacacugagauccucacccaaaacacagaggaucugaauaaagaaaaagaagaagaaaguaaugagggggagagagaaagagacagagaaacagaggcgggagguagaaugaggaagggaaaagggaagggaaaaaugaaggaaagaaguuacuaugugagacccauaccugagcaagacaggacucacaaaaaauaagucagucacuggugcauggauuuagggaagaaguuuauaagaagcauguaaggauucaguggggguagaauccuucuggugaucuuaauucaaaugcccucagcauguacgagagaaguucucacucucggccaucugauacuacagucugucaacucaaaauucuccaaagggagggacgguuauuuuuauuucaucucuacuuaaauagcucauuguaaacagugaccacaauauaauauugguuugggcuaagaguccacaguuuguagaggacauaucugaaugagaaauguccucuggaauagcuuaugaagcugcucagaggcaaaacccaguaacguggccucaguugcucugguugggucaguagccuaaacaagguccucuaauuuaagaguuuggggaguaagcuuuuuuuauagucuagauguuuuguguaccccacagauaaaccuguguaugca

SEQ ID NO: 1900 - RNA, 129112 nt, Mus musculus
caguaauuccgagggcgagcgagcgggccgggaccggcagagcccacuucucuccgcggcgcagcgcaaagcugggcagggggcgccgcgggacccgcgcaaccacagccggcuuggggagcugcucugcucccuguuuccccccacuuuuuucuuccccuuucuggaaggguuugugcagggguagggaaaacagacucaaacagcaaaguggaaaacagguaagagguucuucagugacuugggcauuuuguuucggggccaaggaagcguugggaagcucuccguuuuggggacacuggggggacucgaacucccauguaccuuacuucuggggaugcaaauaguacaggggaggcauaaacagggaaagaauguucugggacgggcccugucgacccugggacucagaacugccgcacucgggucucccggaaucggagaccagcgagagcaucuccggcgucggagacucgccucuugggcgcagugugagccaagguucccggacguccucgggguacagccagugggguagggagaagggaauccucuacaaagggucuccuuuugucuggcgcgggguaggccgucgcccacaagugucacaucugaguccucacuccauuauuuaacugguuuguguuggccucugacuuggagguucucuucccgggacugggacugcauguccuuguuuccaaagaacucuaguaggaaguguccuaaacggggucuuuuauguuacugcugcuugaguucucugggcuuuguucgacuccgggguccugcccacaggcuuccugcgcucuggagggcugcagucccuggcgcaaagugggagaccacuuuuguuccuucuaaagacagaaaacuuaagagagucugcagaaacccgaaacuggggugcccaauccacccucaucuuacugcuuuuugcuagucuucccuuggggagacuucgggcugagcaccgauugggaagcuggggcuagguugugcagccgaaugaccgcaaguaaccccaucgggcagcacagaacucgcagcucgggugcugggccgggcuccgccgccagggggugggggcugggcggccugcggguggccccuggagacuggcccgcagcgccuccuggccggguagccuagguauggccuggugcggagugagagucucuaguccuuuugcuucacugugaaucuggucaaaacugguguuuccaaacugggaggaaacccgaggccaagaaagccagucuauguuuucauguuguuguuuuuuucuuuuuuguuuuuguuuuuuguuuguuuguuuguuuccugacucccagaccguugcucaaugagguucuuggggauguuggcugaugacaaccuuguggauaggugccuguuuugguuucugcacuuaccucuggaaaagagagaaauacuuauuaaacuguuugcuuuuuuuuuuuuuuuugacuuuguguguuuguuugggaaaacuaagugucacuagaaauaauuaguuugccccauuugcugcaaugguaucaccauuccaaaacaaaacaagaauuuacuucgacauccuuccaaggaagugggcagaauaaauguacaauaaaggacagauaaacaaaaggaacacuucuggcuuaagauguaggcccccgguagagucuaccuuguacaagaccuuggguucuagcaccaccaaccacagaagcaaagcaaaacaaaacagcacaaaccuuccuugaagagaauugguacaccacuuucuuucuguggcucagcccucaccucccacagcacacaccugacacaugccugcaggcucgaaagcacacccuuaccucuuagucauaauucggaacccugacccaaguauugauacucuacaagacauaaaugccaauuaaaaaggaguuguuuaucaucaccacuuuucuuucagcccauuuuuaauauucuaaugcacacauaaggacaacguauugcuguucccauuguugaaaaacacuucccccacaucaaaggagguauagacaagcauagagaauauuugaguggauaguauaucaauauauaaauaauaaagauaaauuacaguuucuauuguaagcaugucuuuuccucagcgcuaucacaagucauuaaaauagggcuuuuuuuuuuuuaaagaaaggugugaugcacagaauugauuauuaucuaugugguaacaaguugaaucugaggguugagggaaggaaauuuucagcaacauaaugcucauaguaccauuuuggagcaaaaauugcuaccauagaauaagucaugggucuccuugugaaagucacugggguucuggaggggucacugguggugacuuggguauuugugacgggugucuucccgaagaugaguauuuuaaauccagcccccuaaaguauuuuuuauuagcacccaaaggcaggccuguuguggcccuuggaugcaucuugauuuggaaugugugcgugguugaugggagaccgugaauuagucuggaauuggaaagggugacuggggcugauugguuuucuaccucucuucauggaaaccccaaugcaaacacuauuuaaaaaaaaaaaaagaaugauacuuagcaacucagcuaugugcuaccuuaccuauguggagaggagcugggacuuuuaguauuuuuuuuucuuuaggcaucguuuuuuuccucucauaaaucaguguccuuaugugggcugcauauguagugacugaaaauagaucuuugcuuuuuuaaaaaaaauauacuuuuuaguuucuaagauaguuaaauggacacuucuuuaaacucuuaaauuagggacuuccuggauuuuuagaaaauauauauguguauagcuuuggccguucuuaaaacauucaaguauaaauauauuuuuauauauggucuggauguuaaauaaauaaugaaauuauaauguaacuauggucaauuauucuggcauuaaauuuuaaaagauuggucguaauacuuguugauuuacuugcauugggagaagguccgcuuuaaaaauauuggagacagcuuuacacacggaagagaaagcaccuggaauaccaauuauagacguguuugugucuuaauagacgcuuaccuggugcuguucccgguguuacucagacgcugaguuuaucuucaagccaaacuuguuuauuguaacuacagguuaagaaggcgggaggcuaucugguccuuggcucuccauuuuccaagaggcugauuugagauuugaauucacuucccaaagucucuaacuguccagauuaggggagacagugguacaauuucagaugccgugaaagggaauuugccguguauucauuugcugucauuuuuacuggaaacuuaugaucuguaucauauucccauauuugcucugggguagucggucaaauucucuucuggaagagaccuuggcugcaacucggugcaaacaaacaaacaacaacaacaaaacccaggcaguaacauuugcucaguucucauuuaaaaacaaagccaaaacuugguuuuaaaugagugugauccucuugccucagcuaauuaauugugaauagugugugaccucagaguaguuugcuacagauuauggggccagguggcauaaaguccgagugaacgucucagacaugaaaugguuucugcaggcaggucuuaagcuacaccauacucugucaaacacgaauggcccaaaagcagcuugucuaggauuaucguugacuguggggaacaucacauuuguggggguuuuuuuuuugaagauuuuuaaaauuuauuauuauauguaaguacacuguagcugucuucagacagcccagaagagggaaucagauuuuauuacaguugauugugaccuaccauguaguuacugggauuugaacucaggaccuuuggaagagcagucagugcucuuaaccgcugagccaucucuccagcccauguuuguuuucuaaaacaaugagacuuugcaaacuugaagaccuggcagaaagaauguuacccuccucacaagucuccugcacccccaacucccucccauucugcacuuccaugcagaauaugaucugagccccgugcucacguaugucaugcacuuagguuucaaaagagaggucuuugacccuugcgcguaaucugucucucuaauacggaaauugacaaauaccagucagcuaaggggcuggaugcugcucgcuuccuguguuuuaaaacuacuccaacaaauaagacauucucagcaaaguguuagagacugauacggccacggacgucauuaaugcaucuuggugcguguuuaaaugauuuaggcuagaugacucaaguagacgaauaguccugcucacccaguuccauuucccuuuuugaggcagcugcagggauuugagacaauagucugcgaugccccauuuaaauauuuugaguuguucauuaaugugcucuuauggauaagcgugagauaacuccuuaugugauuuagagguucagacacuuuaagaaguacagaagccucuucuguguuauuucuggcuuucacaguuuuggggugugugccuuaaaaucuagaguguuuuugugugucauuuccaaaaacuugggggccacgcaggaguaaggaaugguaccagucuaggugucugucgacagguaaauggaugauaaaggaagcucuuguccucucugaggagcuacaaaccugcuaacuaggccaggcucuacuccugaaggucccacuaccuccugauuacaacaccuuuaacacaugggccuugagaauacauucaagauccccaguucagcaacauuucucuugcugccuccuccaggacgcuuuucuuugaaaguguuagggaaacucacuccccuggacuccugguagcacguugauacugauccccagagugacugcuguucacccuuuccauccauccguguaugaggaaguggaugaaccguuuuauauguugggaguaggggcaguccuauuguuucuuuugcugacuggauuauauuuauuucuauggcuucuggguacauuaagcccuggcagaauuuuuuaaaaagccauuauuaaacuuuuaauuauuagauuuacuuauuuuauguugauucauuuaugccuugcauguaugucuguauaacguguaccugcuuggucccugcagaggucagaagaggaccuugcauucuguggauuuggaguuuauggaugguuguuaccaacugugcugucacuccagccucuuuuuguuuuaaacaucaucuauucuagucucuucauaauaaagaaccaugccuuuguuuugugucccaaagccguaagauuucuugucuaaauccacucccugagcagucauuaauuggaaauuaaauucuuauucuuuuucuuccuugauccuggauggcuucucuucuugcagaauacagaguuauaaugcccuuuagaauaguaaagagaaaucguguacauuaaauagacauggaauucuuaaauccuggccugcucucauuuauuuguugucucuguuggcccaguuugaauuguaaggggcuuuuucaacuggaacucuucuugcuuucccaaagacaaaguguccuuuagcuuuaaguucaaacaagaaggaacauuuucacagaacuccuggaugcuaaguaagggucugcgaggugauguuuucuuuaugcaaaaguauaaaauucugauacuaauucugguugguguugugauucgcggcagguguauuucuuuuuuauaaacuugugaaugaugguguuaguuguagugggaccuugaauuuagaauacagccagccuuuggucggcuuguguuuauucaguuaucagucuuauggggauuugcaaauuuaacuggacuggcugccauuucuccccuuugcagugcaggcuacacuucacgugaucagaaggcgagcggcucuccccugcugaggagagaagagugagcagagccugcagagcccaacaggccacucuguccucaaacagagcuccauuuggggacacuggcuaucaccugauguagccacuuaguacaguguugcuuggagacuggggugugcgacuuuuuaaauggcaccauaaaaucugucuuuuuuuuuuaaaugaggcuaccaacguuccacccaguagaugaguccacuuuccccugaauacuuuucacuugcuacucugaguauuugauuuguggaaucuuaauaacagagucacuuuuaaagaaaggaaugcauagaauuuugauaacacuggacucaucugacaugaauuuucuuuuugcaggauccucccaacccccaaauaacgguuuucuuguugucaauacuaaaaaaauaaaaaguggacacacccuuaaguuuuuuguuuuucagaaccaguuguggucuuauuccucuuuuucuccuccucuaguuagguagccagcaaaguggcuuguuugucuuuuuguggagaaggugucagacuggagggaaggacucgggccuuugggacugauggcagcugaaugacguucucacauaccugguuaguuggcgcuugcuguguugcagaacuggcauguuagggacacagggcaucugcuuggccugcuuccggagcuggcuggugaaagggcaaucuggagaaggguccugauaccagucaccugaucucuaagcuggcccuggacaagagcuccauuaugugaaaaugaaggcaguaaauuguugagguagaaaagcugugugcagauauugaaaggguuccuuaagucuuugacuugaaccugugggcuuagagcauuggguuccugagcagugcugacuguuuuauaguuugggaugaguccccggaacccccccccccccccccccccccgaagauguccuuuucagcugguauguucacaugagucuauuguuugcuuuguaacacagcuggaaauggugccuuggcuucggguccuuuaaacaacuuacucagcagggugcacuugcuaagccagcaaccagggaagaguuuagguagaugggaaaagaggugcaggauggaagcccagacuucuaagaugauugauuuagaagucgaaugaaaugagacagaggcagcuuuaggacccaagcacaacuuguuggaaagcagccgugggcuacagaaaacagcugaaugacaggacaauguggagagaggagagaccccagaaggggauuuuaugguaaacccuugguauccugaagggcuugcuaccagagauacccagguaaguuucgcuucucucaguagucugggcucaggagagagugccgugcucuggaaaggccauggaaggaaaugguacucucucuguagaccaagugaggagagagauuccguuaauugucugcucacucucagccccacccuggauggaagcuucacuccgugaaguggguaacacucauuucaauaacagugcauccaguacuucucuuguuccaggaacuagauaaauguuuuauagacacuauuagcccuguuugaugcagaggacgcagggcgucagaaucuuuaggguuccagagucgaugaauagucucugugccauccauaccuuagcauccuucagcgaugugagccacauaccaugguuguugcuaauaugccacuggaccacagcucccaagauguucuuggaaagucuucuuagaacaacaggcgguauuauccagucaaguuugucugcaaaucagggcuugcagguagcuugcagguagaucaggguaaaggaugcucugggccccugccaaaguacaucuuuacuccagcguuuugaccgcaguugaagacuuuuuauguuucucccuugcgacaagucagucaugaggguaguuugguuccuacagucagagaagguucauuucuuugugugccucaucccccugaccagggaaaaagcaaaugcuuguauuauuugcuaaauucuuccuuugaaguuugcucuguguuuguuuaguggaaaucagugagaggugagggggugaucuuuuaacauucgguuagaauuuuccccuaauuuuacucuagagggacaaggauuucgguucgguacagaucugcuuucagaaaagccaggcuuuuaagcauuuuaaaagaaguccagaggccauuuguguagcugauagcaacucuggaacucugagggcgguaaauaggaucauugacugucuaacuaucagagagagacuugaugggaguagcuuuugacuuucaggaucucuuguagaauagaauugucaacaacagcaggaauugcuuaagaugagcaauugcuucucaaaggcuaguuacagaucggcacaacauucaugccuuucucacauccgcuauugguuuuccuuuuuauuuuuuaauuucauagcucuuguuuugaaaaugaagcuaugcacaaagaauuuugucuuggaaguuggcuacguguuccagguuggggaaaaaaauguaugcagcuguuuauaaucucgcuguuacgaauaaggauguacguuugaugcauuuggcauuuugagcccugcugccuccccaguucuaauuguugggcacaauagcauccacagcuucuaucguuuuaguugggugguucuuagcucagccucuucuuaaacagugacaggaucaguucauuugagguugauuuuugucuugaagaccucuugcccucuuugauguuuacacauuucaguguuaagaaaugcaguguuaagaauauuaucuuuagguagugacaucauuucuggggugccuguuuguugauuugaguaagggagcauuuaagggaccacuaacgaggauggcuuugggguagugagccuaagacuagaggccaggaaggcuaaucaagacagucagcuuagcuucaggcauggauuaagcuggugggucagcuuuggagaaauuauaggaugucucacaaucccucccauuccacagcagccuaccugugaaaucauggaugcagugagccugugccagccaggucuccuggccuuuaguaaccucauuaggcuucucccugaacgugacuacugauccagagacauaggcuccgagaggcuauuagagaacaggccuuuucuauagcaagcauacucuguugggcuuacagguuucauucuugauauuucaggaccuugcacaacccucuggggaugaggccggagccucaucuggucuugcuuuugcaucacuaucucaugaauaugcaaucaguugagcucagcaccuuugcauaucggcuacaguuggaccuauuuccccgcuuuguaguuuaacugccucgccauuuagcaguaugaaacaccgcagauacacgcaguuuucaauugcccguuuuuaccuccccuaagaaaaggaaaucuacagacagcuguuauuaagacaugccuccagcuauggucagaaauuucaccuugcaucugguuucugcuaacugaaaaucuguugucuuaagaaagcagagcuuacacauaugcauagagagacacauauauuuauuuauugaaaguucuggagaauggcugucauauacccauugcuguuugaaaaugagaauuaguugcugggugcacaugcuaaguuucugaacuauuuugauggcaccgaggagagaacgcauucagaagacuaaguggacucaagagagacucaaaggcaugugacuguucucaaaaaguugcagccgggcgugguggcacacaccuuuaaucccagcacucgggaggcagaggcaggcggauuucugaguucgaggccagccuggucuacagagugaguuccaggacagccagggcuacacagagaaacccugucucgaaaaaccaaaaaaaaaaaaaaaaaaaaaaguacagcugucauauggaacacagacuuggagcucccaccccuuuccuguccagaaagaccaacuucucaguucuagugagacaugacacuuauguggucucugcuugaggacuuuugcuguugggaaacaggcacugucuaaggaauugccagucauggguugaaugacucuucucucguggagccuaacacuggaaucaugcuuguauucuuucaggaaggaacaugacaaguccacccuucuguccccaaacagcaaggguuucuaguaacaguguggccaugcacacacuuugucuccugcaucucucucucuuucacacgaacacgcacacgcacucucucuguguguaucuuuggcuguccugaagcuuguacuguagaccaggcuggcuuugaacuuagagaucgaucugccugccucugccuucuaagugcugggauuaaaggugugugccaccacugcccggcccuguccuacauuucugucaacagacuaagugcuuccggguugagguagucugaggaagacguacuugcugaccaagggggauaaauucuuugacuuuaccuuuauuguguuucuuccuucuguuuccaguaggucucuugccucuucucucaucucucuuugagauacauuugucaaguucaaaaugucaaaaugaccuggucaggaagagagugguaggcagagcucuaagugguuagcaccaucauuucccuucccaaguuuccuaugagcuucucccuuccucucccucucuguguguguguguguguuuucuuuugcuacugucagagucugucugccuggcuuuccaguuugcuuuagcgauguguaaaaagaauguauaaugcuggcuggugagcagccuauaguuggcccaucuucucacuucuuccuucuagagaugguucauuggagggaaccuccucucauguggccauuucccauuuuucucugcuaaagugagccccacccccaucccugagaauaggaucuaugccucucuuacucuccacugaguccuaagggucuggagcaucacaucacuggugauaggcucccacuagauauguguugugguuaaugggagccuggcagaguuggggaugaggauguuuggccgaauuacuaaguaaugauuucauauugaccuacuagacccccucuccgggaauccuaccauaaucaggccuuauaguaugcaacccuuagguuuaaagcauaguuguacucuugggguaugcuagguauuauaauagcuuuagagacuguuugguguuagguuuguugauguaugauuuacauucucuaaaauuuacccuucuaaaguauacaguugggcuuuucacagauguacacaaugguguaaaugguguaacuccaaccaccuucccaauauugagucauacaugcuccucuguggacuuuucuccucucacuuauaaccuuugacgaccagugguuuggcuccaagcuuucucauuucauuuuuuuucauagugcuuaguacaacuuagauauuauauagcugccuccugugucugcucuauuucucugugcguacagcuguugagauuuguguguguuguugcaugugucaaugcuggguacauuuuuauugcucaguaauacucccaguuuuguuuauucacuuguugauggacauucgguuguuucagcuggcuuuucugaauaaggucccuguaaacauuugcauaugucuuugugugggcuuuugcuuucacuucuuuuggguaaaauggggugagacgaucagaucauuucauaacugaauguauagcuuuauaaaaagcuaucacauuuuuccaaaguggcucuugcgacuuauguuccugaagucaguguauugaguuugauuauauccacagacuuacucaugcuuuagcuuuagguuuaauguguguguguaaugauaucucauuguguuuuuaauuugcauuucccuauaaguacucgugugagcauguuugcauauucaggaugguuauguuuuuagcagucuuucgucuucuguggacucuauaaaacuuccaaaugccaguggcguuugaaguaaaaauugcuaaacaaauugguggaagauuagagcagucacuucguccagaucugucuugcacaaaucaagguugggauguggaaaugacuagauugauaagggagacuaauggugagagucagagaaauugcucggaggaauugaacaugaagcuuggcagagagccaauuccaugaccccagugguuuggggaggucuacgugguccuuggcuaaaccugcuguuuaugcaaaguagacuuagauucacuuaagcuucccaggaugccugaggacucaccagggaagcuuugcaguccuuugugacucucuugagcuugcuguggaagcagcugaacacagggcucccucccuggggacaaauugccugaaucaguuaguuaaucaagcuugagaaaucaguuaccacaggcccaagaaugccaucacccuugaauucugagacccuguuuuucauagcuaucuuuuaaaaaacauaauugaggccauaucuccuaagugcucccaacaagccgguauugauuuauuuguuugccggagauaacagagauggagggccaggaauccuguugucccaccucagaaggggacagaccggguagggaaaguacugcagaaaaccugcucauucagacguugguagagagaggugaucaggaaggauuccugagcagccccauggaggcccaaacuuguggaggaacuaggcaggcucacagaucuggagaaaggguuguucugggaaaaggaacaggacaguguaguccaaggccuaagagagagugagugcagcuugucccuagggggaguccuccagggcauggccaaggaggugaaaggagguguuccuugcugaaggcccaccagggaaguugaggaaaccuuggggaggacuccauccaggguggcaggaagcuguugaaggguagacaaguaccauguguagauauuugauuuuagucaaauaggggugcucuuguguccaagggaggagaauggggcaagccuggagccaaggaggccaauuuggaguugcuacucuagucacguaggaucaagagaacgguucuugaugggugaaguuucuaaagugggcucgcuuccagccagugucuggaaauucaugcaggggcaggagcaagcguguuauacuucagaacauugagaaauccagcgcacagaacugccuuuccccuugugcuguuggagguuuguuuguucacuuccuugggaaacugauguggaaaugucccauuggcuuuuguuaccuggguagaagguauuuccaaucacuuugggaggaacauugcccucagcauggaucucuauguucagagauggggguaugggugagaauuaugcagguguccaggaggaggggugggcugcaacgucaccgucacuuguuuccguuuucacacccagagaagaacuuuuccucuagucucaugacauuugugcugugucccuggggagccuggaaucugaaacuaguugcagagacucagaaacucaucaacuucuaggaaaauguccuccaagaaaauccaguuuuucgucucaucccaagggcgcucugcagggcugcgcucucuucucucaugagcacgguguggggcucugucucuauuugccccugaacaucucugcucaggagucaggaaacaauuccagauauggauuuggccccagagagugacccuaagguauucagagcuuguccuuccuacuucauucaccccaccccucacuuucagaaacaagaauguccucuuuagauaagcagccgcgcagcugagggugcgggugggaccuggggaccuggguuucuuuguuauuugcauuaugccuagcacugcauucugaauuuauuucuaucaccucauuuaauacuauaaaauaccagacaagggagauacuacugcccccugucggaaugaggaacuugcugcucagagccgauaagauaaaucuuguccuaggaucacaguugggcaucugggagcuagugccuuccaggcuucauucugaggcuuuguuucccuuuuguugcagcacauugauuguauuucagccuuucuucuauuuuacggugggcucggagaaaauuucuguacccuauaagucagcuaagugauuucuggagaguggcuuuaacugaagaaaaacucgguuaauaauucuuuaauauuuuaagugccacuuaaaaacaauuuuuucaccucccugucaguguucugaguccaguuggcaucucucaacagggaaccgcuagccaaaugguacugacuaggucuuccucuugcuauuggccuaagucaucuuauuuuugcaguaaggagcuguggguagccugugcccuuucuggauuugcugagcaacaauaaagaagacucuaggguuugacuaccauaggauuuccgguuuauuacaucacuaauaaaugagcuagaauuagccgcucucgggcacccauuguucuggacauguugauuuuuguuuucuuuuuccuucuuuccuagacauuuuuaaucuuaguucucuuguaucagggaacaaaaggguaucacagggacuuaaaauccuaucaaaaaccucccacgcguuguucaagaucaugggcuugaugggugaaguuuuugguuuugucucuuagcauuucacccugauauuucaccuuugcacaacagaaggcuacuagacgccacagucacugggagucauuucauagcuucauagguuucugcugaggguuugugacuagcaaccauugcaugguccugacuuuaauaauccacgugucccuccuccuccuggcacuuuucaauuuccccuuaauccuuagcuugcuuuagcugaagucuuuggaaguuucucagcauugaauaaauacagcuggguaguggguaauaaggccacuggguaaggaagacacaggcuguuguacgaccuccuugugaaaaucucucagauggugaacgguccccccagggagaccuuugagacaucuguguaggagugaagcggccauguguucagguguagguagagcaaguccagaagugugcuccauaugucccaacuguaggagccuccugcguucacagaugcccugcugggaucaggccuuggcaggcucucuccucugugggauacuguuuucuuuccacagagacacaacacaagcuuuguccauaucacaagagagccagguguccguggcacugcucuggugcuuacgcauagucgucuaagacaguccucagccuuccaccuggggaaacugcgucgcaaaugaugccguuuaucacuugaagggcucagcuuugucuguagcgaaauguuagagaauaucacuagucacuccagggaucagggagaauuuauaagugcugcugaugggucuugggagaaaacauauauucauagggaaggcaggcuggccucucgggcucuuggauggcacgucugaucuuuguuuuggccagggaaaguuacuuucucauucuuaaaauaaucucaguggugcucauaugaugagaaccaucgauugcgucugaccagcugccagccuauagccagcaagccugccccggaagcucugucugcuggagauucuggggguuggcaguccaggacucaugaccuuuugacaagccaccagggugucagaggugucuggugagagggcuggagcagcaacucuucuccggcauagggcuuugaagcagugauugacagaucucucucucucucucucucucucucucucucucucucucucucucucucucguuuuaucuuucaguuaaugaccagccacagagucacagcucugugcucuggcugcucccuccagggcucucgagccgcagacgcaggucgcugugggugccggcuguggugacauggcuuguuggccucaguuaaggcugcugcuguggaagaaucugacauuucgaaggagacaaacaguaagcugugggcuucucugugggguucuugcuugcuugcuccauggggccugggcuggggaucggagagggagggaagagcgugcucuugguuuucacauggugguaauugaaugagucugguucuuguggacacaggacuguguggcucugaugugaacccaugacuuagcauggagggaaggugaucagucaggaagaaguaauagcuugggcuugcgcugguuucugggcauggucucucaccucugcaaccuggcagaaaaugaccccacuccccaucacuccauuaucuccuuucacuaaauuccugguagcuacuuggagccacccacgagcacucucuguaggccccaguguuuuuguaaagugaaguacugaagcaggucuuagaggugugccuggagaucucagcacucagccuuccucagcuuugacagcagccuggacucuuauaguaaugagacuugccaugucugaggaggucucuaagccgcccacuucccaugugggccagucuuucuuugaauaauccaguaggccccaccauuacuugguaggugaauguuguuuuccuuuggaagacugugaaggcuguagggcaaggugagcucccugaggcuuaggccagccuuccauguggcgccuuuaucugugaccacugugaaucuucucauccugcccucucaguuuagcuacgugucucugaagcucacuucuaaacuugguuccuguccugcacuuuuuguuggaccaccaaccugcaucuccauuuggcuaucuuaaugaaguucaaccugucuauaaucaaaggucuuugaaagucaaagaccuuuagugaacccugaagggaguuuaacuguuucucaaaguagacuaguacuuggagaucuucuaugcgagaacaaacaucccgagguacucuuuuguucaccgauguuuuuauuauaaaaugacuuaacuauguaaguaaaaguagauuuaaacccugaugauaaaaccauaggccccauacagauuuauaaaucaaggcaaaugaaacugaagaaagacaucgcaauucauauuauuaccuuaguuguagugagaaaacugacuuuguuuagcugaaauacaauauuucaguugccacgugaaauauggugguagaugauacaacgguggccauuuugaguuuggccagucuauauuacucugugcugaugauuuaguucuucacccauguuucuacuugggcagcaucuuuugauaccauuuggguuuccuuuugucuaaucccaucaauaggcuggcauggucauacuuugcauacacuaauaaaccugaccguugauggcuuguggcacaaguuaugcuaauguaaguaaauucacauaggugugccagaauuuguucagaugaucauugaaauggaaacacagaaaguuuaaaaucuucauggagaacccagguauaauccuuugaauguucaugugaauacacacacacacauacacacacaaacacacacacacacacacacacacacacacacacaugagacagggcagggaaagagggagggagggacagagagagugagagagagagagagagagagagagagauugauuccaguuuuucaagaguuuuugauuaacuuuuaauguuacaaaugaggaacuugaauucaaggucacuagugagagagcaaugacuagaaucuauguguccauugucauuaguaauaaugacaaaauauaaugcacauuguuauuuauaauaaaagaggauaauuagaaugugcuucuaugagcuaggcacauaauguguuauuuauauauuuguuuuauaauugcuguagauaaacuacagggccuugcacaugcuagaccagagcucuaccagugaaccaaacagccaacaaaguggguuauuguaccagcuguucuuaaaccccaugagguaguucucuuuaugguacagauaacagauuugauguacagagagguucaggaguuucccagaggucugcauugcuagcguuugguugcugauagucugacgccaacaguuacauguuagacucuguuaaacgaauagcugcuguguuagacugccauuuaguuauuggucuuuucaagaccagugacuuagucaggguuucuauuccugcacaaacaucaugaccaagaagcaaguuggggaggaaaggguuuauucagcuuacacuuccauauugcuguucaucaccaaggaagucaggacuggaacucaaguaggucaggaagcaggagcugaugcagaggccauggagggauauuccuuacuggcuugcuuccccuggcuugcucagccuacucucuuauagaccccaagauuaccagcccagagaugguccugcccacaaggggccuuucccccuugaucacuaauugagaaaaugccuuacaguuggaucucauggaggcauuuccucaacugaagcuccuuucucugugauaacuccagcugugucaaguugacacaaaacuaggcaguacaaccaaguuucagauauccuggaacucaccauauaacuaaggcugccuuugaacuccugauccuucugacuuccccuuccuagugccaugugggauuacagguguauaccaccauacccagacuuacaucacuuuuaaugguauaauuuuuaaaaaaucaacaaauuuugacauuucugacuuuucucuuaccuaccuccuguaccucagagucauuccuagguccugaugguccuaagucuguuacauuuuccucuuuaugucaguguccugccuggugggaaauugucucugcuuugaugggcgcguucaugagucacagaaagaaacaucacuuuagcaaugaaaagugggucucaagagagccugcuccaaauaccagauuuuacagauggggaaacugaggcacaaggagucgaugagacucucuagaucagucaagaagaagcugauauggggccagaggcuugagcccuccucacuccgguucucaauguugguucccuuucccaaucuuuuguagccacaugguagcaccaagcuugagcggaggaggaggugcucggguauggauucuugugcgcagacaagaaggaggcaggagcagacuguccaggaacacaaaaugagggcuaggguuaucuccucugagcaggucuucauuggauuugaucuugcugcuucuugcucagugcuguauuuucauuaugcuuacgaguuuaaaauuacuaggauuggaaagauaggcagauuuagucgaacacagcuuacugaggaguuccuguugaaguggaaaguagggacacagaccuuggacacagguggccuuuguaggauacaucacugcuuaccagcuugucugagucaucucccuuccugauugcuaaaguaaauccauuuugagaaaucagaaagaaacgcaguugauuuccagucacagauacuuuaugagcagagcaggugcugccaagaucuggccugccucuuguacaguuguuggagcugaggcucucugauggacacaggcucaaucccgaaguaacgucagaaccuaucuccugacauccuuacaggccaggccuuuaaaaguugacuuggcuuuauccucagcuacugcugagaaggugucacuccugucuaaucaucuaguuguguguguguguguguuuuuuuuuuaagggaugagaaccugugugagccuuuggcacuuucuuagcucacagaguaagcccauuaugaagggggaagagauugaagccccuugauagccacagauuuuggacauucacugcaugaucccuugguccugagagcaucuguacccauggcccagaaccuaggacagaaccugguacuuacaacauguguaacaagaauuugccugaugaguggugaauguguugcuggucuguuauuugaaggucuuggagcagcuaggggaauuagaaagaauaugcagaagcccggagcugaggaacgccagccacaggcagcacugcucuugugcccuugucuguagaggacucuuauggacccucgcuguccucucauugugcagacucaugggguacaucaaucagagugaguuuuccaguguaucucuugggcaaagaauacauugaauugaguugcaaaaggguccaaagcucaguuuggguccaaaguaccagucaacuagugugugggcagcaguuauccuaugcaaacagcauuugggacaggaaaggggguggacuucaggauaucaggucuuccucuggcuuuggccuggauccagaggccaaggucuccaugaaacagaagugacaacgugagguggccaaauggacucuuuugucuuugccuuuaaaggaaacagcaaauucuaacucuuaaguaacuuaaaggacuacuguugggacagucuggaaugaacgcgaaaacaguuaggacuccugcuuuccaagugguuagagauggucacagugugugggaacuccacuucccuuuccuguucccaauuccagggacgugccuuccuguccuuaguccuagcucaguaaccuuggucaugguucucauuccagacuggucagcccugagccucaguguuuucuagagcuuugauuuccacuucuagagaugaagaaagcuagaacaagacccuguuugcuguuucacugagauaaaugucugcugcgcauucauuccuugugggagacugugcuggguguguagugauaaagcagacuguccucaguggagcauagaguuuauugagggaagacgauauaacauguuaucagcacacaaguaaacauaccauuacaacauccagagugugaggaguaaacuggugaaccgugauagucaggcuuuaguagguauucauggcauucaagcccagaaccccagaaugguagcagugguguuagcaugcuaagaucaggggcacagaccucagaggcacuguauuuugggcugagagaacagaaagaagccagguguguuggcucacugaaugaagaguguggcugaagaugaguuggaaggauagaccauccaguuaaggacaguugaguuuaauuuuauaucugaaaggagcccuuuggguaggcacagcauggcuaaaaccgcucauccucugggucuugauaguggaguggugggaacgccaggaagccaggaagcguuugucauucuguacauacacucaccccaccuaaugcacugcgcuccuuagcauugcuugccuugaauguucucauauuugugaauaaucuuucuagugaggaguuccgaugugaggcugcacuugaguacuucaaagguacuuuuauaucuaccauuucauuuucacaguaauucugugcaaucuguuucgucaacgaagaacacauuauugguaaguuaguaagagagauguggggucuucugguugucagucuauuguggagugaugucaguagcauccuagagagcuguaugugaggcugacagugcaggucuguaagcucaaacccuauuggcaacacuuaguuugcaccuaguguuugcuguuucgaaugaaaucuucugaggguuuuaugcauacagccauuucuuacuuuguuguguuggcuccuuagcccaggagcucaggagcagguauacugggucaaagugacaugacccuugaagugugugaccagauguccuuucaaaagauaguaccaguuuucacagucauucugaggguucugaaugguuuugcaucgggcuguaggguacugggagauaggccugguuuauaaguuguccuucccuccggcuuuggacugauuuaguuuuaagauuucacuuuggguuuugcacacaugaugaagccugugucauuggggacaggucaagucgaaucuguaucuucauaucacaccacuccgugucuguacacuuuguaagacaguaauuccuuuccuacuuauuuuugggacauuuauaaaacuuuguccauauagggaaauauuuuggagucuuccauugggggauuugacaaguguugguugcuguauaacuuuucucauugcugaguaauuccucaaacaccugacaagaagcugcuuacagaaggaguggcuuauuuugacucgaaguuugaagggacagccuggcacagugaggacaguaucagagugggagcucgagauggcuggucacauaauaucugcaccagggagcugcaggggaugaaugucuuucccccuuuuuuuuucaguuuggaaucccagucccugggggugaugaugcccacguuuagaguugaucucuuccuugcucaguuaaaacuuuuagaaauauccucucagauacacuuaaaagugugccuuguuaaucuccuccuuuuuugguggggguuucaagauaagguuuuaaacucguagagauucaccugccccugccucccaagugcugguauaugcuacuaccacccagcuccuccauuuuccuuaauucagucaaguuaacaguggguaguaaccauagaguuaguuaccugguauuaccggagcacacaagucuuccuuuggugaacaguguucaucagagcagucugaugucuggggaacugguucuacuguguuucuuagauuagcgaccaugcugcagacagaaagcauguuucccuccccuuuuccuuggugucuguucucucugauuauuugucucugcuugaucaaacuccagcaucucuagcucaguguaagaagcaaucauuuugucuuucaaaccuucaauauuuuuugcuugcuuugguuuuuuuguuguuguuguuuuuuguuuuuugguuuuuuuuuuuuuuuuuuuuuuuuuuuuuuuuuuuuuuuuuuuuuuuuuuuuugacuacuguuauucagaagaucuuuucccggggccaaauuuuauuccauugaucuuucaguguucuuuaaacacagcccuugaaccacgccaaccuugaaauaauaaggauaaaucuugaagguaagaucaccgcugcugucuauaggcaaggaagcgaagugcacucgugcagugacugggguaugguguauuagcuucugcaaccaggagcaaaaguuaaaugugacuauccauggggacauggggagugugugcggcucagcaccacccugaaugaaaacgcaaaaaugguuuggugcuuaagacucucaacccuggugacggcagagcugcugagcuugguuuuaugcugcaucguuuacaggaagcagcauuuguuccuuagaaauuuacagcggcagcucacaacugagggcacggccccuuccccauccugggacuuagagguagagggcagggguguugcugcuaaacccaacauaguuuguaguagaaucccgaacaacuagcuaucugccagggccaauguugucuagcugagaaguccuccugcgggagugcuuguuccgaauccucagguuagaggugaagaguuaggagaaggggaugcacaaugugcucugguguucccuagagcagccaugacuuugauaacaaucacuucuugaaaacaacauuuucuaccauugccacuauauggugagaagauacagaguugguguagcuaugaaggacuuucaagaguuuucaguaggagcuucuaacaguacaagcaacaucuuugucccuaggcuguuuauucaugccuuaugcuuaggaaaaauggugagguuagagacgaggagaagucugacuuugaugaguggaucugaaauagugugccuggagaagucaaguuuaguuucuagaaggaggggauguggcaauaccuagaacguucugagcuugggaguggguuugauguuuagagacaaaaauaguuuuggaggcacaggguaaagaagcauaauuaaaucgaaucucccaugagcucugugauuuugguggugugaauauugugugcagagucuucguacauacauacauacauacauacauauuagugcucagcucaguagaagcuuugaaaggucaggagucuacacggucuacguggugagagaaaggggcuaaaggaaauuggugaccuuagugccgaagagaagcaucccuuaagcuagauuggcuuugaaucuaaacucuuucacauaccaguuccuugggcaauuuauuaaucagccccaguuuccucguauguaaagugaguauuacaguaaugauccuaauuuggaugucugacuauaaaaaacaucuaugaaguguguguguguguguguguguguguuguggugugaguugacuaucaugacugucacuguugguuuacuucauaucucuuuuccugaucugguuacaaauucugccuucaccuccugaguggucuaagguuucuucuggugcuuugcugccagagcuguggguaccauccgacuguucuuucaguggaugaaccuauucugaccacaugcugcuuuguggugcuaaguguggggcuacagagguguccugaacacaaggcuugcuuuacugggucggauaugugaugagguagaaggcaugugucucuagcauagcacugugagaggcagccugguggguacugcacagauuuagacauuaagauugggguuccaauggcucauaauuuuucugguccuccaaucaucauuuauaaaaauaguacuauugcagccuuugugagcgaacuguugggaacaagaggcacacaaaucacuaagugucuauagauguucaguauucgcuauaacggcuaccugucugcaggguguuaguuuaucuugugucuguggaaccuguagacauuuuuaguccaugcugcguagggagauuuuauuuguuuccuaccggagaugcuugucuuugucaaauagaauuucaugugaccucuggaaucaaguacagcuggcugccggucuuggcucugcucugacuagugcuguggcuggccguuccuuaagcaguagacuuuucaguauaaaaugggaagaauaaugguuccaugcccacaaugauguucugaggauuaauggaagucaacuguguaaaaugagcccaguacauauggagcucucccuaaaugguagcuccgauuuauccuguuaguugaaauaguggcuucggagugucaagaugaaugacuuccuguauauucucuguucaguuuuauacuuuucaggcuucauuauucuguaauucaucacagccaugucauuauagaaagcuuuauuucuauguuugcuuagcaaugugugcgagugguuuuauaaagaugcaggcuuagaauguauuggguucuguguccuguguucuuggauagugaaagcuggguuucauaaauguugcuguaauaaccaaguaaucuauuauugcccauuagauguaugcuuauguaaccauuuuuccuuuguugugugauugaguuauuuguuuacaacacuuuacaguuauagcacuucaaaucauguauacggcuuuuggggauugaguuguuuucuuauuuaguuugcuccuucggaugaauucucaggaggaugacaguuguucaaagggguaaaugugccuuuugaaugcauauugccaaacuucuuucccagaggggucagccgauuuuuguuucugucuuucugauuuugaaagcuucaguucacucucuuacccaauauaugcuuaccgugucaugcuuagcccuuaaccauguugcggauuugcugagaacacaguaacagaagggagagccucauauguaaacacagcucuugugccacaggcugauaaaggcacagcauaccuggaucucagaggaagggcuccagccuuacugguagagaaguuauuuucaguguucaggaaauccaggcuguguucucugguagaaagucauccccgacuccugccccugagcaguuuacagagguguaagggacaauaaaaauuguauggugucaugguuugcaauccgugcccaucacccucucccaaaggaguaguaaaucuauuuucuaugaaggaaaagagaagaggcugaguguuguuugcaaacguagagguuuuguuccuucuuugggauuauuuacagacaucuuuaguaagauucgucuuuucuucccugguccuugccauuuucucuuuuaaugugcucuuuguauaaacuacucuuuauaguuugugguaguagggguucacgaaccgaaggaaguauaaaaacuucauguuuuuguucuggaacaugcauagcuacuaucuuguuucaguuccucccugaagaucccaaaaugagcuugauguaaagucauaccaaaguucuuagaaaauucaaaguuccuuauuuaaacuaggaaaaacaaacaugguuaaaaaaacaaacaaaaaacaaaacaaaacaaaacaaaaagcccaaaugccccuaauacucuaaaguaccaguuacccagagagaguuuacuucugaucucgucauagaagggggaauaccaagagaccaugacagaucgcaauuaauaagacuguacucuacaaugaaaugugucccuguugagauagauguuaauuaagagugcuaugugggagccagugacugaagcagaucaucucgggcuugggggagaugugagagaggaacuguuuagguuugugggaaugugagcacaggaggacuuccuagcucaggcagaaagaagcauggcugagucuugaaaccuggguagaagggagccuuaaagacacagguguggaaugggauguuacaggauaccacccacaauucaaugcacuucaaguuuggagagugaagggagucagaagugccagaagucagucaauugcugaauugcucuguggguuucucaguccaguaguagcuggcuaccauguuaucauuuaaaauucacgaucuuguguuuuauuuucuguucagugucagcuguuacuggaaguggccuggccucucuuuaucuuccugauccugaucucuguacgccugagcuacccacccuacgaacaacaugagugugaguaucuguggaccacgccugagucucagugauggcuagcaaaauccagagugaagaugcucucaacugaaucuuuacaaaguugcugucuucaggagaaugccacaaauagcuugaacagaaaaucuggccuuuacuauuuuuuugguuagggcaugaacuugagauauuuguagucccaguuaaauaaugaugauaguaaugauaauaaucuuaacgguuuuuuaaucaugauaauaaaauagccuuagagucagaaagugacggcuacaaaucacccuacaguaguguuucaaaugccaguguccaguucccugguguuguccuuuugcuugcauugucuuuuaaucucaugguuaaaaaucauggaccauguauuggaacccauacuuucuaaaucaaguaugcauauaugucuguguggggguauaugcacaugaguaggugccugagaagaccagagguguuagaaccccuggagauggaguuacagguaauugugagcuaucugauaugaguucugggaacccaccucagguccucugcaagaguacuuugugggcuuaaccacugagcuaccuucucagcuuuuagagcauaugcagccuuuguguacaacaucucaguuugacuccuguaacauuucauuuuguucucaacaaucuuguauaguagacuuugcuauccuuugcucugauuuccugguagcuaaauuggggcucacacaccuauaaugacuugcccaaauuuacauuucuaguagagguggaauacaguucaggcugcuugucucgcucacucaugugauuugaaggcagucuugacagugagcgcugagauacaguaguggcuagaaacugacacauagugugucaccaugagcaagugauuuuagcuucucuauaaaagagagcagcaaaaccuaauuugcacuguugcugucggaaugaccauuuuacggucuggcugugcucgguggauggcuggagcaacaguuuagaaaggcccaaagaauuagcauuuguguaggaguuuuuguugggaccaaagcuuucugucccacacacuugucuuaccacucaccagcuccaacaggccccuugacuuagaagauuguguucuuucaagacagcccugaggccacagucaccuuuugauugcguuuuuuggucaccuuccccuuucuuacauagcauguaacggcaggcauugacauaccaguuugcuaauaggcauccuauauauucaggucacacacccagaugccucagauacauucccuuggacauggcuuucugauuucgucagaacagcggagcagaaagcuaaggugaagccugcagauauauguaugccucuacgcugggaacaaaggacuaguaugaaauucuucucuguaaaucuuuguaguucaggucagaguccucaagguccucaugaguccucugacuuuuugauguccauugcauuauuugacugggguccuggacacccagugucuaacuguccaccaugguguuucuauuugcccagaggaugggcugcagcguccaaggaagggucuuuguuugcccaggggaaggaaagguugaaaugucuucaccgucuuugccuuugaccuacacucucccguucuuagggcuacuaucucuacaaguuguaagaggagaauccugcuaacucuucacugauggaggagcagcagcucguuaggcaaggggcuuuguuugguuuuccuugaacuguuaacagggagauaaagagauuagcugaguaaacaauucaacaggccagagucccuacagggacugcccauggggaccagaucuugucacacccuuccauguggccucugguuggaauagggauagaaguuuuaaaagagugaaagguuccccguacugauauauaaugugaggugcaucucagccuuuggguuaguuuuggggagugucuauuagcauauuuacuugaaaaaaaaugaagagaaacugucuuuggaggaaggugggaguugugagauggaaagagagcauucaguucccuauggacagggguagcacauuacacaacagugcacuaaacaauaccacacuucacaguagugaccuacacaauaccacacuacacaguagugaccuacacaauaccacacuacacaguagugcacuauacaauaccacacuacacaaucguguacuacacaauuccacacuacacaacagugcacuauacaauaccacauuacacaguagugaccuacacaauaccacacuacacaauagugcauuauacaauaacaugcuauacaauagugcacuacacaaugccacacuacacaguagcgcacuacacaauaccacaauacacaguagugcacuacaccacagugcacaauaaugcacuacacaauacuacacuacacaauggcacacuguacaauagugcacuacacaauaccacacuacacaauggcacacuucacaauggcacacuacacaauggcacacuucacaguggcacacuacacaauggcacacuacacaauaccacacuacacaauggcacacuacacaauggcacacuacacaaugcugcacuacaugaugccuuagaaguucuaauuggacaauucaugagcauuuaccuugugcugggcccucuguaaaagugcucggccuucuaagccagccugggcuacagagugaaacuuugucucauaaaaauacaaauagaaucacaagcugcucuacugauaagaguuccugugacaccucuugcacagcaaucagcauuuuacaggugggaaaacaaggcgcuggagaucgacuuggagguuggcuuggcugugcuaugcacauggcagggacagagcuguaaaucuccaucgguuugucuccaaacucugcgaagauacaagcaagucauugccuggagccaugguucuucaugcucgccagaucuucagauagcccugagcauaugacgagagccagagccaauaccuuuuugccucaacacgaacaggcccuuggaauaacauuuaucuugauucccauaagcaauauuuguaaauccuugcuacaaaccuacccgugcuuuuaaaggcucugaccucagccagacauaccgguuauuguuuguaagaaacgacuagauguagggaaaagggugaggaguugccugguggauguggccucauuuuaucgaugagugaggaagggacaggaaaaccaagauagcuuggcaguuggcuucugucucaugugagcaugcuuuugaggugcuguuaguggacccuugggcuguuggaggaagugaagcugacaaacuuuugcuggaugaaggcagguacagguggagucuugagaagagugaggugauggugaaggcuaccgcuggaagggagaggcaugggcugggauccuggagaugaaguuucuauccccagccaugugcaucucugaguucuucaucagcggcaguaugaaggagcuauauuaggucacuguccagguccuucugugucucuuggagaugaggcucaugguagggauugagcaaauggcgacuugcugcuugccaagugguugguguccauggucugauagaccccauuuauuacauucccgagguugguaucaugaaucccaaucuacagaugaugccaaauagaaccauggucaccuuuacuugaugucaaauucccaccugucuucuaggacauggggaggggcuggagagauggcucagcacuuaagagcacucuggcugcaugcucuuccggaggaccugaguucaguucccagcauccacagaguggcucacaacaucuguaacuucaguuucagcggaguuuacagaccucuuuuggccuccauggauacuaggcaggcaugcacauggugcacauaugugcaucaagcagaacacucacauaaauaacauugauaagucugggacauggugaaugagacagacagaugugagaggcuuguguuaaaaucacuucacaggucuaaugucuucucugcguuuccuucucgauuucaauaggccacuuuccgaauaaagccaugccgucugcaggaacccuccccuggguacaggggauuaucuguaaugccaacaaccccugcuuccguuauccaacucccggcgaggcucccgguguuguuggaaacuuuaacaaguccauguaaguaccagaucggguuuucuuucccaaacuugccaguuaauacuuauccuuuccuucuuggagagguuugcaugagaagucugcagaaugaaugaagggggaauugccaccaggauuuaagaccgugggauuuaggagucacugugauuaugggaucgaaagcugucuacucagucagugcucugggagacugagcaagcuccaucugaucuacucacucagaucucugcugucccuuugaaguggacacuucuaggagccagagccacugcgcaggaagggucuggguucuccagcagcucagagcccaaggcaggaguguccuguccucugcucucaggucauugcucugaccccugaaaugacugcagugucucugcuguugacuugucuuucugucccugagugggagcugcccgagagcaugauggugcuuccuuagugucuguguuccuggcucagaugcugggaugcuggauauaaaaugcuccuuccagacgagauguugaggaucccccagaugugcaaagucacagaguuagagcagaccagggacuguaggaugugcugcugguuggagauggugcugcgguugggacaagcagggccacauugcauaaccaaaauguuaaaaacaugucagacuguugguauacaaaugcauacgaucaauugaaaauucauuacuggauaugcauuccuguuauauguguuccuaaugcauccuuuuaauaaaugaaaauguauuaugaaucgcuaagcaugucuugggauaaaggcauugggcuuauuauggccaguagcgcacacacauacacacacacacacacacacacacacacacacacacacacacacacgcacgcucuuacucguuugugcaucuacuugugagcucccccuggaggauggaguaauagcuagggaguaggggaggccaggcuggggagagacagcuggccuaacccaagccauuucuacuucuucuuauucccuuugcagcgugucucgccuguucucagacgcucagaggcuucuucuguacagccaaagagauaccagcauuaaggacaugcacaagguccugagaauguuacggcagaucaagcaucccaacucaaguaagcaaagcccuuccacucaugcauccgggagugaacauuucccugcccgugugucccagggcucgcucucuagcuugucccugacuguggcuuuucuucaguggcuggaugauuggucuucucugugggaagcauugggaacaaagcuagagaagcugguugccccagacagcgacuggggaugcagaccccagcaggaauggcacaggcuugcuuugccauuaaggccagcuggagcagaaauuguugccaagggcauuuuugagcuacccauaggauuuccauggauagacagauuauagauauuucugugccuaugagagcaguuagaguucuaauuugaucauggguaaguaaaaguuaggcacuuauuucuaauaggaaacucauucuucgcccucagaacuagccauuuggauaagccagacaaggcauuugaauucugaucuugaaacagugaaaucuuuaccucagauuugcuaaguagcuaggcaguuaguuccuggcaugccacugaggaagugucuggggaacauacaauuugcugaccgagacuuuggcuacagagauugugacaguccccugggcaguaagccugccagcgcgggugggggaagaggcaguguuugauguucacuggaacaggcgagaacggugguauccauagugaugaucaagaagugauccacaagccuccggaaagugcugcugucuaaacugcaccagugaggaaguacuccucucgugaugggccaacagugaucacugcuccaggaaagucuuuuuacccaguuugacauuugaagagagaguagacuggucuagccuuugcagaaaggccucccuccuaguucgugaggggagcagugguguaaaguucccagcacccaccucggguggcuuacaacugccugaaaugccaacuccggggagucugcuggccucuucuggccuccaagggcacugcacuuacaugcgcgcgcgcgcgcgcacacacacacacacacacacacacacacacacacacacacacacacacuucuuaauaagaggcacugucaugguggacucugacugaugaggugugacuucagugcagagguguggcguacucugguuccugaguccccuguaaggagcucgaagcugcacuguaccuggcuguguacugagaucguuugcugcuguuucccuucccuggaggacucuggucaaggccaggcauuucugugauggagagccucuguuagguugccaugcagcagaacugaguuauuucuucuaccaccaggaaacuggguagcacagacaaaaagugccggugguaccacgugacuuugugaauaaguuaccaggucccuuagagguuaucucuuguuauugaaaauggguacaguaacagacccacccagagucaaaccaguauuugacacguaaguaacauuuaaugaauaugagccaugauuauuuuucuaaaagauucuuuuuugaucuaucaguuuuguuuuauggguaugaauauuucgccugcauguuuauguguacacuguguguguuccuggcgugcaugagaccagaagagggcaugagaaucccugcaacuggcguuccagguagugggagcuuccauggaaguguuagaaauagaaucugggcucucuguaaaagcauccagugcuguccauagccaagauaggauuauuuucaagucuggacaucucagacaaaacauucaauguuucugagaccuaauuuccugaauuaauuauaauaguauuauauuauuaugcacaguauaaugagauauuauuacaucauuaauaugauaauuccuaagguacaaagucugacacaggguuggcccauaguagaugcuuuguuaacagaagccagugcugucuucauuguuucaugucugaccaucugaccuuguucuucugcuucuucauuuguggggcuggcaaaauggaccuggcggaauuuccaguucuuaguggaggcugcccuagagagcagggugcuuuuauuguccgagcaacuggaguccugaagugggauggaggaaagaaagggcagggugugcccagcccugcugaggggagcucucucccagugccuccuucacccuugcagcuaguucuguucuguuucaacuugcuuuucugugcugagcaucaagcccaggaacuuguccaagcuacucaaguacuuagccacugaacuacaucuccaggcccagcuggucuuugacuuucuguuauuuuucuuuguuuaucuuacaacagaaagccaggccacaguuguagaggaagcaugaaaaaaaaugcugccuccuucucuaggaagugggaacuuuuugcugauuuugaaaaacaccccaccagucugacuuggaggcuggcggugucauggucgaucccuguaccucauccucucaugagguagcucauguuggguguugagagcucaagcugucagguaguauuugccaccgucuuguagagaauuagucugauuccguguccgucaaaaauccaggaucaauuuuugugccuguuucuggagucuuauuuuuuuccggucuguuugucaucuacuccucuugcgcaaugcuuuuccucccaacuucugccucucgguguguuuaugucauuccagaaguuuaccagaaauuacaaaaguauucuagcagacaggagaaggggacuucugccugucugcgugcuguauuucuguccacacgucugagauugcaagaggcuuuucaaggucuugucauccaguucacucauggcccauuguacaaccaacucaaacugcaggucucgugaauaugcagaacugcaggugacuucuccuuucucuaacuguaccgcuggcuuuuugagcuaagcagacuuuaccuaucucuucuaauucauaucauuaaaucccgucuauccccuuagccgcucgagauucugauuuuacuaugauucuucagcuacuacacucugcucucugucacguagggguucagugacucucuugcuaucccagauauugaucagcaugagaacaaaguuugagauugguacuggcuaccuacuccuuuggaugggacugcucaggaucuuagaaagcuacuugccucuguggucauggcuggagccacuggguccugcuaugagaucuauuuggagacucaucuuguucuuugccucugcuaaugccauuggacuggccacaggaacucuguaggcacaggagucuacucaagcacucuugucuugccucaagguuuccugggcuacgacauugcuuuggucagaaacuguuuaaucucuguguggauucaugcacuggcuucuugaguuauucagucuugugccaacccugcucucccaggugcugagacucagggugagggguucuucuuagagggaaccugauacugaaaguggaggugacuucccuccaacccuggcuuccugauucauguuucuagaaagauccaucuucuacuguuucaauaauaguccagcuucaaaaaugaagucauggauugcuccucuaucacugaagcauccugaggggagaagcaggggugaagccuuacagaugcgccucccccaguuuucaugucacuggaacuuuggggucacuuuauugguuuucauuuuucucucuaagccagaguauuaccaauagguugagugguggcuaagucaguuuggggaguuagugugugaaagcauucccucuuuccuaccaugcacccaugcucaaaggcaguauaaacgucagcuacauucucagaaacugcagaaaaggugacaugucuagacugugacccugugacauguaaacugauuucugacaggacacaaacgacaaccuuugauucugacucacaugaaaaugugccugauugcuuaaauggauguugggaagaugaaguucaugaagguauuguuucauguggcuguggugaaaugcuggagaguaguuggucagugccugaggaagguuggcaaaugcugguguaggggagacuugaagcugcgucaagacugauuuggcaacaaauuuagguucuugcucucaccuuuggugaacucuugauucuuccuggcccucuugcuuguuagaaauuuggacaugaacuacauuuguggaucauuaagcauucagugaggugcuacaccuacggguuuccagcagugagcaugagcacaugggugacacauauauaagucaaaaaugcauugcucuccucacguuccaggguguuuggccuuugacaauuuguucauguugucugggcugcaaguuucauugucuugacuuuugagauccgguuaaacgacuugaugaugcuucaucuuagaguuuggcuugguccuuggguggggacaccugugagacagugguuuguguuacccaccaggccauagccuguucagggcaugaagugacggugacggugguuguacucugagcagccgcgugguagcagcaugguaacccugagagcaucuuuagagaaugcgcagugaaagcaagucuaguagcugcccuuucgccucauguaauauugucaagcgaaagcucuggacagcaucagagcaagcauagguaagugcagaaccgcuucccucguguaaaacaggccccacuaaaucagucuugaguuucuuucacaaaaucuaccucccacaauuccgcuggauaugcuaaucugaguucagaggaauaacaaguacugcaaagguccauauucacucucauggcccucuuugagguuuuccccccgcccacaguggggauuagcuguguguuuacccacauauauguauuuuuaaaaccugaaaagguuagguucuuuuuuaaauaguuguuuuugaagacagcaggcacugccugaauuccaggcacuagggcuggggaggaugcccccggccaucagggaggaccauucccccacagccuccucuuugucccuguccuucggcuuaccacaucugcuucucugggcccaggucuuggugacucuggccuuuuccccagggguggggagaggaggagccucaaagcaguccuucccaguggcuuguccccacagucagaggacauggugacuggucuuuugcuguuggcuguacccucacugcugguuaaugauagucagcgaacaugcucauggcugcuucuugugagccugucugcucagggaucugccuucuccuagugucugcuucugucccauccuccauggaugcaaguuacuguguccccagggcuuccuacuggcgugaagucgggacguguuucuuuaagcugugucugaggauucuggcuuuucuaggguagaacauccucacagucuaagacauucucuuccucucccccuccacuuccccccuccuuuccuccucuuccccacccccacccccaucuuaacagucagcuaaacccuugucuaguuagugagucccccagaggcuuacuuaaucuagggacaaucccuccgguuuguguggguccuguagaaguucugcauucuuuacagcuguggcaugacccgagugcuguggcuagggcuaucgguucugugguguggcuggaugccagauagcugaucucuugugugcaugggacucagccaagauccuagcuccuaguucuuaguucuuagcucucugggugucuggcucugucccaagugacagccacauugauacacuuuaaguccugaagcccagaagguacuuuagggacugcagacgacuauuuuucugguccuuuguguuugggucaggaaagguugcuggggcgguugagggaugggcuguaccugugugugccugugcuccacagcccauggaagugacacccuccaugagagcugugcucuuucaagucgggcacuguccaccccacaugguuuucuguugcagccuauguucucuucugcuuccauuaguacagacuauggacaguugauaaccccuaccccugccccaucucugguucaggggcuuuucagauguuuucucuccagggugcagaugcccucuagcucugaaaacuuuuccgagaaagaaccagggugaaucuugggcucuggacuggauuaugugucuagguuguugagguugagaggggaggagauccagggcaguguuguguaugcugaguuaugucugcuugucucugucucuuuagcuagguguuguguugaggcaauggcguggcuggcuuggccuuuccauuguggcuuggacccagguuaucugugccuuuccaucugcaagccaaggguuuucaguuagggaaaauggccgugccauuuugccugucuguugauacugacaaguccugauaagacauaaacuccaggagccagggugguuguggugauaaggcaaggaacuuggcugaggcagggguuggagaacagguguugaugaacagugaauaacuuuuaaauauccccugaacgugagagucaggauggcuggguucaagccuggcuucuguaguuggucaguuauacccaugccuaaccauguaacauuccugugccucacuuuccucaagaggugacaaugcuagcaccuccccagggaugggacuccucaaggaaaugagccaauaggaacaaggccuucccauaccaaccugauacacaggaagugugagaucucuuccuuccuucacuguguuugcaguuacgggaggaaggccauuucucuuugugcacaugaaauucagagaggcuaaguaccuugccugagaaaccaccauuggcaacggcuggcaagaguagaauuucagucuuucauacuuugucgcuguuacauccuagggagagcugcccuugacaccuacgagguccccacacacagacaggcuggggugaggaggaugagagagcuucugucagcuuuccuucccuuuuaggcuacgcguccaagcuuccugcguagcagacacuaggggacuuuucccggaggccuagcucuaaagaccaucucgugacucacagcuacuucucccuuuugccugaaauucugcccuuuguuucaucagagcaguugcucaaguuggguuuacagccccgaacucuagucuucuguccucauaccugacacccaugugucaucuuguugugagaucugaugacgcgugucagcaugucauuaaaauugagaagccuguaaaaaucuucgggugauuguaauucauguccugugugugcuugucaaaaguuuugacuugagauuuuagaguuuuauaguuugaaaccuuucaucucccugaacauuuccccagaccugucaaagcccggcugugccccagagccugggcuguugguugccauccagggcagaggccuggcucuagccaaagcagugccccagugcacuguugaaauauugcuugagcuaaaucaaaccaaaggucaacuuuacccagacaagcauagaaaauacaauugcauucaauuacagaaagccauguuagcucacaauaucaggcugcuuuuuaaaaagcuugacuugugaccaccagacaacagugucacaugucuccugccuuuccuguaugagauucguuuacccuguggguggcagagagcagcuugggcauagaguuugguucucccugaaagcuuugugcuucaagcccgcccaccucaguugcacggaagucccaaaagacaguguucaauugacucugucuacagacaagguuggacaggguagcaacgccauuuugcauuaaaagauaucccccaauaguauaaauucauuguacaucguuucaugucauauaaggauuugcucacauagguaugcucuguauguuuggucccgugucauauaaggguguauucacauaaauagguauuguauguuugguccuauguuauguaaggguacauucauaggugugcauuguauuguccuaugccauaaaggacauacuaaacauagguauguaugcauuguauguuuggucccaugucauguaaggccauacuuacauagguuuauucuacauguuaaagaugcuccucacauacccucuccucuccucugcucaacccuccuuuggcauuauuccuucuguguuccuagacaauuugcuucuauuuucuguucuauguauuuauaugaaaccuaggacccauaagugagagaaaagcauagaguaucucucuuucugagacuaacuuaauuugauuaauaggauuaucucugacuauauguauuaucucaaaaaagccauagcuuuguucucuauggcugaaaaguauuucuccucuuucucugugguuggacccccuagauugguucucuaacuuagcuguuacgaacagagcuucagugagcauugaugugccuguguuugaguggaacuuuauauuuuuaguggacuacugaauuugguucuuugaagcagcauuaguggaucaguacuauccccauuuuauugaugagaaaacugagucugaaaagguuguaucuguugcucagugcuauggaguuguaacuuagguucaggucuguguggcucaaaguuccacaucucuccaccacaccauaugcccacguugccucacuucauuguggggaagcaugguugacaucaccagcuuuugauucuggagaguaacacaauucacuuaguugcuaacagaguggaaagaacuagaguuuugaaaucaaaguugcuggguugacauuugccuuugguuuguuuugugaccuugagccagauacucccuucugacaucuuuccuggguuggaaaaaugagaauaauagcaauaccuuucuuggaagcugguuuuagagauccuggaaauugaucuguguaaugugccugaggcuuugcaaauaugagucguguuuccugccucaaagugccaccacguccugcuacguuuauuaaucuuagacauuagaagaaaugaggcaaugugugcaggaugcauaccgagaggucuccccuaacugccugcaaagagucccaccuaagucccucacuugcacggucaucuuccuuuccuucucuuguucccuguuugucugucccugccuuucucucucugucuguuugucuuugugucucugacucuuucucucugugucucucucucucugugucucugucucugugacccagucucugucucugucuuucucucaggaggccagaaguugaugucagggcucuacucaccuguuuagcuaauuuagcuaccaagcaugcucuagggaauccuguguuccccccccccccccauauccccugagcugccucaccaaccccuguuccguggguuuuccaaguucccaggaacugguuguaauccuucauccuguugugucuggucucaaucaguuagagacaaagucauagcuuagaaccggguggcuuaaacucucccaucucccaugccuccugucucugccaccuucucuuggauucaguuuuuccuguuucuaauuaguuucuuccuauuguugcccuuuccugcuuuucuccuuccaucuuccaaguauccccuuugcuuugcaucgcucagguguucacaaaaggcucucuacaaaguaugggggguuuguuuguuuaccagcugucuucuuguuuuuuccucauaugggcuuccugaguuuuguuucuccuuagguucagaacucauuuggaccaguguuagcaccucaguauucccucucauuuuccuccagcuaucucagccaaccugcugucucaggccccaccugcuggccagugagagccacagcccucaauggcuccuccuuaccacccagacucuugcuagaugacucaagcucucaucccagaggguucuagcagcuucccucuuguuaggaaggcaugcuuauuuguuuaauccauucuagcuuccauaagaaaauacccaaggcucaguaauuuuaccugauagaaaugguuucuaagaaucccagacguccaaguucuguugugggcuaccgucuccuggagggcucuuuugacucuuaacuugguagaagagacagaagaaugagcccaccccucaaggucuuuaaaaagaagauuuauauuguuuuaugaguguuugcuuucaucuauguauaugugugugugugugucucuucaaucuuuuuaaaaagcgcuuucauaaaaaucguaagcucgucugagaggacucucucugaugacugauuuccugggaggccuccaguuucccagcauucuucuccugucagccaguggcugccuuagagcauggaucuggggaaagguguuuccuuccugcugucaucucaauugugacugauucucaauagcacacagggcugcucuguucuuacuggaugcccacaaucucuuggauagcaagggccgggauuaugucauacgauaccccuuuugucccugccuuugggaagcacuaacuagguuuuuuccccuuuuauccuuagcacugguacugugauacaguagacauuuaacugaugcaccaaauaauuuaaacagcauacagugucuaaaguuguacaauuucuguuggucuaaagacgagguuuuggcagcaaacgguucaggguguauagccacgaauagucaggucucuugggaacuggucaucuaauugccaugacgauuuuaucagcauguauuuugacuauauuuagucuccaguuuauauuuucuugugcacuguaagccaugcuugguguuauuagugcuuucggaacccagaaacuuggagggccugaaaagugacuuccaauguccacagaaguagaacauucuguaauggaaaugugacccagguucauuagacuccaauuagcacuucuucugugcuguugagaaagccuucacugcagggcaagaaaauucuccggggccccgugaccaccauggaggucucaaggcaugugugcccacagucuggcucacccucguccacgcucacagguuccccagggcauauccacccagcuacuauuccuucucuccagagcaccccacaaagucuucuggagacaucucacaggcccagcaccacaaaaugaaccaaagcaacagauacccgaaguugggcaugaugguguguuuauaauggcagcuuguggagguggaaguaggagaaugaggaauuggaagccgugagacucagaaaggaacuaaguaaccaaccaacuaauaaacaggugugauuauuuccagccccuuuguagcugaaaauauuccaaagucuuguuuauaagacuaaucaaauaggcuaaauagaaccacaagacugucauccagccccccacccccaagucuuugcucauuugaccagccagggcuaggagaccucaaccccaccucuacuccacccugcugcugccuaggggguccauuuaagaaggguaugcaggcuggggcugcuggcaaggcuucuuucucugcuucuccuuuuccccauuucucuccuccacccacgucucaagcuguugauggcugugguuccuuuuguauagagcacaagacugcagagaacuugaaacuuaagcuggggcuuagagagggcacugaccgagaguaaccccaguggcugcugccaggguuuuccuccucugccuuccucuguuguuucccucgcccuccuccuuccuccuccucuuccuccuccucugcuccuggguuccagcaggcaggugggagagcgaacgcuuccaugaccaggaagaccccccccccccccccccccagaguuaggcuucucucuaacuucuaucugccugugcuguuuccuuagcuuggcuguagugacuugacccagaugaauagcaagaaacccaggauugugucucacucugucccagcccacagaugcaucucaucuguuugcucuuuuuagacaccagccuuuuauuuuguuuucccucucuccuccccuuugcccugcuucacugugcccaaagcuccagggacauggcaggcggcuggcugccucuccggccaaucaggaagcugggcuccgcagaucagauacuuucguccagcaaugagagaacuccuuuggcccuuuguugacuacagcuuucuggcuucccugauguucacauucuaacugggaccacaccuucucauguaaacacucccaacuaaccagcucugggucuucagugagugagugguguguguguguguguguguguguguguaugugucuguguguguguauuguguguacucguuuuagagggcagacaucaguauugaauuuaggaucucucacugaacaaggagcucacugauuuggauacaccaacuggccagcaagccuugagccuuuguccaucuccccagcacugagggcauggaugguucaugacuuuugaccuugauguugggggugaauacucaguuccuugcgcuugcccaguagguguuuuauugagugagccaucuuccuagcuccagucucuuguucauacucuuaaucauugcauucuacaucaacuuaugaauguuacuauuuccauauucuuuuaaaaacauuauuacacuuuauuuuguaugugugugaggugggcugggugugaagggacaggacagcuuguggaagucaucccacgugugucucauggacugagauuggggugccaggcuugguggcagguacuguucuugcuaaaccuucuuguuggccccaacuccauuugaugucuaagaaacugagguuaagagagaacaaagaaaggggccaagugagguucauggucacacaggcaggaaguguuugaguucagccucucugauaagagucucuggugcuggaucaauuggaucuguguuccucucagaaacauggaaaagaguuuuucagagaacuuuuuccccaaccacacauuccacagauaauaaaaaccagguccccgucaauucauuugguuaggguuaacugagugacugucuuucccacgaagcguucuuugucuuaccuagaauaacuugucuguuacuggucaucuacuugugucuagucucacaguuuccagaagauaugauccuuucauugaugcucuauaaaauuuuagguuuauuuauuuuuauuuuucccugugucuccauauuccuuucuccucucucucuuucuuuuuugcaguacuggggauugaaccuggggcuucuacauguuagaaaaacacucuacccuugaccuauaucccuaccugucuccccacccacauauuuuggugagaugaguuguugaguugcugaagcuggcuuuguacuguaauccuccugccucagagccccagauagcugggauauaacaggccugugcuacuaggccuggcuuuuauuaauuuuuuucaugaaguucugaauaggcacuugagugagcuuugaccuuuccuuuaccuuguagcagguagaaaaauaaaagcaaaauaguuuuaucucacucagacaaaucuauaauacauucauaaauauaugugcccacacaugugcacacucagacacaucuuauggggccacgaguuuggcaucucaguguucuugucaaagucaccucucucuuacuaucuauuuugaacacagcagcucagcugaugagagaagcuguccuuggacaugaucagauuagaagaucuguauggagcauguaacucggcacgggaauucccauggcuggcauguaccuuucucauguaaggcucacaguagguccagaaagguggaugcucuugucauuuccuuuggguuuguuuucuuacuuauuuacuuuuucuuucugguacugggaauggaacucagaacuucaugccugcuggguaaguucacaaaccacugagacauacccacagccuuucucucacuacguugccuggaacucauauuguggaccaaggagaccuugacuuugugauccuccuguuucagccucccgaauagcugggguuacaaguguggaccacugcaucaagcucugugucaucaucucauuaacucagcuucccucugcuuuauuccugcugugcuuccagcuguuguuuaccugaugcggcuugucacuuggggcaugaaaccaaguaggcggcuuagggauaccguagccaucuugacccagucugcuucacauucguguccugauuggucuguccccuuccuacugccagaugaauuuaccucuucaaaauuggucauuucucaggucauaucagcucauuuuacauucaugcauuuguauucaucuauccaucauccaucugugcauccauccauccauccauccacccacccacccaucuaucuacccauccauccauccauccacccauccauccaucuacccauccauccauccauccaucauucauccaucuagccauccauccauccauccauccaccuacccagccaucuguccagccagccagcuauccauccaucuauccauccauccauccauccauccauccauccauccauccauccaguggcuucacccaagauuacuagcuguaucagucaucuggcuugguucauucuuugcacucuccuacacagcuagcugcauacagaagacagaaaccagcaaggacaaagccauuguggucugucuucauaucacuucuuuuuucuuuccccccuuuccucuccuauaccucaaaucugugauaaccaagaaaaucccuagagggaagaucuguguucuuauuuuuuccugcacauugcucuauagugcaguaagacugccauuuuagugacaauuaauauauuaccauuuaauaaacauuugucccuagccaguugcuaauugcucaaguguaugaauacgucucuuauccccaggacuuuaagguauaguggcaucuuauggccacacagcuaauuuauagcaagaaacagcauuacauuuugggcuuuaugguccuaaacuucuuuuugccugcauaguuuuguuuugaggcuuggacuuccuguguaagcacggguguggaacuuacuccguagcccaggcuggccucuaauuugcaguuuacugccucugccuccugacuacugacauuacagauaugcaccaccacaucaaacuugguuagauuuuuuuuucuuuuuuuaauucucaagacccaauucuuguccuucacaguucugguucauugugcugggggguguggccugggcuuugggauuuuuuaaaauucccaagugggccuagcagccuccaagguuaagagccaucauaccacacaccuuugucuuccuguguguguauguacugcagcugucagcggugauaggacagcagcagauaaugugugcauauccacgugaccagacugcaaguuguuuguagccaaggcucuauggccuuccugcaucauccccacccagcaucugccacauuauguucaugcacugccaagggcuguuggcuguuuaaccagcuucuuugguuucugugucucauccagaggauaggcaguugguguuugaucacauccagcuguuuaucugcagcgucuguugacauaacggaagcaucauauaaacaugcuaaguacauuugcuggucuccagaguguugcugggugaccuagguccuuucagagugcagucugggucaaaccucccacacuucugcugcccugaaggaaggagcuguucugaaguuccuacguaggaugcuguguacugcuguggcuuugcucaggaggaauuuguguucaacuggcugaucugaguguuaggucauagauuuauucuguucuaucaagguucacagagcucucuuuugauccucauuuuuauagguaaggccauggaaguuuaaguaggucaaauaaacuuagaaauacauggauacagagcccagaauuugguuucccaguaugagguguguguguguguguguguguguguguguagagcauugcucauauugaaaaaagugcucuauugaaugaucuauucuccaccucuucuuuugagauuuauguacauacacaaacuuaaguauuguguguuuguguguguguguauacauacacacauacauaacuaauuuauaagcaugccugccuuuucaccucaagcuuuggcugaagccucucugccugucuuccuuccuucuccuuaccccccaccauggggaugcugggauguucuagauguuguugucuuugaaaagacacuuguggucaggguucuuauuuccuccugggcuauagccuagagauuugaugcucuugcccuccuuggucucuuccuggacccacuaaucucaaagauccuucugaagucuuucuggucaccucaucuagcauucagucaggugucauugcuggagcaguaauuuuguaccaggcuuuguuccagguauuuggaacacuaagauaaaagaccuauucugcauuuuuauaaguuagaguugaaugcaggcuauacuuaaguaaaauaacauuucauaauauauggcuuccagacccgcuguauuggaaauguggaggcugcuuauuaaaauggagauuuguggguggucuaccuuagaaccccugguuguaaucugaaggaauagacacccagaaacuaguuuuugugugccucuuaagugaaucuuagguguucuguggguauggcaacucaaagaauugaguucagugguagcaguguggggucuuguacgauggaaacaccaggcagaugacagauggcugagugcugauuucaaggagggacauugacaggccucagaucagcuguggcauaguaugaggaacccuaggauaaaacuauagaugaguugaggagaaucacuguuuuaucagcuccguucaaaauuacugaaguuugcuccaugcugaagaugccugggucauuuguaucuauuaagaaucugcuuggacuguuugucucuacgaagggagacccuuuuagaucccaagagaaacgguuucaucagugcacacugcagucuuguuuucagauggaaccccucuucggguaauugauuugaguuuguaaaguuugcccucuaguggucagccacuuggucccagaugagcuugguuuuguuuuuguuuuggggggguggugguguugguuuguuuuaauuucaaaaaagaauucggguuauuagaaguuuaaagggguaaggaagaagaaagaugaaauagucaauaaaauaaggcaggaaaaugguugguguuucaggcaggcaccacucagcaucugcucagaauccucuugcuuuacagaugauggggcccaaggcucagaaaggugcuaaagaaaugaaauucaagugguacuaucauaccuagccuccagccagagacugacguucugaauucuuggccagugcucuuuucuauuucaugccacuggagugaagccuuuuuucgauguacucggagagcuuauuguuuaaugggaguugguacuuggagagcuuauuguuuaaugggagucggaaugaaagccuuuagcagucacugcauuuaguaaagcaaagggugggauuucaaacauacguuuacauauuuuucucaguguuuggaggaacuggacuuuauaguucugaaaucccagguuuuguucugaaaccaagaagagaccaugucuauuuaaacaccucgauaugcucacaggacuccccugugauucuuggaaguguggucccaggcaggcaacaucagcaccaccugggagcuuguuagacaugcagcugcugcagccagagcuggcagaagcagaugcucugagacugcuguccagccggcuagcugaggcaacccaucaagcgauucugguucacagaaauguuagcgagccauugccugcugaucugggagauuagccccuguggcuuguggaaauaaggcacucaguauuuucagugcuagcuacgugaggcggcacugaggagucaggagcagcagggcucaugucacaaaccucagguaggauggaugagaucauuuaaaaggguugguuuuucaauuggcaacaaggaaagaccauguguguaacaacaccacugugcuguuggacugugggagcccacacugaguguggcucaacaugucaucagaaagcaaucuuuucaugucucugccagcgagacggagcuccugaaacucacuucucgguguauguaagccagaagccuguggucacccauccguuuaaaaugaagcaaucaauauucuauucuccaccuuccccauagcgguugagucuuuuuuuuuuuuuuugaguuauuaacuguaaacaaacacaauuuuccaauagauuugaagcuccaggauuuucugguggacaaugaaacauucucuggauuccugcagcacaauuugucccuuccaagaucuacuguggacagccugcugcaggcgaauguuggucuccagaagguaagcuacuaccuucagcuaaaucaguggggccucacuauuacccuguugggggcccuggaaagaaagaaagaaaaacccuggccuuugaaaaagcugugaaggaaauggucaggcuucagaaguuuaguuucaucucauuugacucgugacucugguugucacagacgaacccuacagugaguggggugugucacccagcaucagggccaguaugcugaaaggaaguugauuucugugucuguccuuuggcauuguaaugacuccccccuaaagggguuauauuuucuguuaaggugaauuaagaagcuuuuuuuuuuuuuaaauguuguucugaaauaagagccagagacguagauucuuaaacuggaaucuaucacaaaagauuaaaugaagcacuuacugcuuuuuaaagacagggaagcugcauaaagagacuucugaucaacuuuuaaguguauguaauauuaguguuuacauaggcuuugcaucuuaggguccuagagaacuucuucgccaucauuuauuuuuguaccacuccugggcagagugcauggcuauauguuguucccccgaaagcuuuuucuucacuuuauucucuggcagaaaggagaauugaccccauguacagccuuucggcucuauacuggcuugacuuuacaguaagcagaagucaugggcggggcugaugauugaagagggcuuugcuucacauggcugaaaauuuuccaaguuagaaaaaagaaaaugugcuuacugcaugcucuuaugaaacugggaaaauaugucuuguguuuaccaauuguguggcugggaggugggccagaggcagcagacuuucgaaaucauuucauuuagcauaauuuccauugcccccugccaauuucauaucuguugcaugccaucaguuuaaacuaagaggcauccagggaaggucuuugcaugguaauuugaguuucagugucuuagggguucuucaccacagcauggugacaaggacuuauggcaggagcaagcuuggaguguacuugaguaucuggcagucagugacaggcgaguggacgacaugguggcgcagauucccuucacuguuugcgaaacugcaugggaguugagaggcuuugguuucgccccuugcgaugcucuacagguuucugugaccagaauggacugcguucaguuaagcugauagagggguugguaauauuguaauaagccauccauucaacaaauacuguucuaggguuauagacacagguacgagccuuguaaaccaaggcagccccauauuauugcagaggucucucucugcuggacagugagacucagguaugaaaaagcacuacuuauuuaaaccuaggaaggguagcuagguaggagcguauggccaaagagaguuuccugggguuugcuaugaagaacaggugaggaugacguagaaguacuuuacaguugaguugauagaggcccacuuuuccguauucuucuugggggcaaguaaaacaaaacacucacaauugugauguuccuuaaacauagcuuuaugcauuugucaaguaucuaaaccuacagauucacgguauaauuguuuccaugaggcagccuaauuucagcguccaauaucaauacauuucuggaagaguuagcauaaccuuccucucauaguuccagggguuuagacucuggguuuccauuagcugagucauguguuccagucgcguugagaaaaagacuugccuuaaggauuucccggugcuauugggacaagagagugggaugcauugagucagcaugcaguguuggaacauggcugacuguguccgauucaucccaagguucuuuccuccaugggugacugcaguagugcuuugcuucagcucuuccaagauguacugagguuacacuccccccaaagugucugggagccagccuuccauccugauaauuuuuucacagcucuguuuacauccaacccuuccagguauuuuugcaaggcuaccaauuacauuuggccagucuguguaacggaucaaaauuagaagaaauuauucagcuuggugaugcggaaguuucugcccucuguggucuaccgaggaagaagcucgaugcagccgagagaguacugcgcuacaacauggacauccugaagccaguuguggugagugcugaagguuugagaaugagaaaucuuuuccuggacugcacaucuuguuuuuguagaaacuugggccuggcuggaacuuggugauauaauuuagcccagucauacucuggguguucuuucaaauuucaguccauuucccaagggugacuuggagaagaauguucuggguguggcagaguccaggcucaaggucucuggugcugguuucaaccagaaaagauccaucuuucauguuuuuuuaaaaaaauauauuucugaggaagaguccauuugaagaaagaccgcccuccccccggccagguuuaagaaaaugucuugaaaugauuaauggggaaauggcuacuuauuaguguuuuuaaaaccaguagaagagggagauuguguuagauaauaaaacauugggauuggguaagaccacauaaaaauaauuagcucaaacaaugacaaaaauguauuagaaagacauacaaaacaaaccauaaccgaggaaugcaagugagcccucguguauugauuaucaggguugguuauagaaauucugcaauagagaucugugaguuuucugagaucuuugucaaaaugacuccaguagcaucugcaguagccagcacucugcuuuucuguguaccagggagagcuguugugucaguagguucucugaagacauguguucuucauuauaccaagaugaugcuguaaucaugucaaacucugugaagcuggcuuucaguaagggaaccauacauuccuaugcgguccuaagacggucaguuuccaucagcauuccaagccuagaucauguggguuuuagaaacaucucagaguagacucucugaacugacccgggagaaguucuuauacauguuucaacucugcagcuguugugggaagaauaggggguggccaaaugacaagcuucuucuaggugcuuuuguggagugcacacaugccaauuuuugugcccagccuaauguuuucucacuccuaaaguaauucauuauguuucagguuuuuaaagcuaccaagugcuugcuuugguggccugugaguccauugguuauugccuuuaucacuguaguuucaagugagauguauuucuuuauuggagauguuuguagugcucugagcaauagcacugcauaguuagauaaguguacugcugccaaucucugcgcuugacguuuugugagacacaaagggucaagguccuuacaaaugucgugaaaggugugauaugaaauuguguuuggggacugcuuugcccacuuaucacuauaagauacagagguaaacacuuagccuucaaguuuaggaaauaugaguuauuuaagaagagacaguaauugauucuggugcccauuuauuugauuucauucccguuuaaucauugaacaccuguaguguuuacagcccaauaaauccuuucuccugcagaguaucugaacugcuuucuuuuuccuuuuuucuuuuuucuuuuugguuuuuugagacaggguuucucuguauagcccuggcuguccuggaacucacuuuguagaccaggcuggccucgaacucagaaaucugccugccucugccucccgagugcugggauuaaaggugugcgccaccacugccuggcagaguaccaccauggcccucaucaucugucuguuaacagcucagauuucgacuugaaaaucuuccccuuugggaggguuuccaacaccaaggaacuauaccuuuaaaccagucagccaugugacaucccguccuguuguggccuuguagauuaguagguucaauuuagauggcuucaguguacccccugcaugucuccuggguguagagaguggaauucugcuucugccccuucgcuucugcugggaaccgucgcucauaaagucagaacaugggggcucuugaagacgauagugagugaucaggauugugcuaugugaaaauguuuuggaagcugccucugggaugggaugucuuucaaacauucugugauguuacuuacugaauuaagcagugcuuuaauuggaauacugggacuggugcuugguuuauaauaagcacacuuuuucucuugcuacucugaugaaauuuuaauuugucacggucaguguguguguguguguguguguguguguguguguaugugacuugugcugaaucgugcugauggacaguuaauugugccaagaacuuugaggacaacagccagaugcgugacccaauuagcaugggagaagacuguucuguuaaugugccauuucuguaacaaaaagggcucaucauaagagacauguuuugaaauauuuuccacuuguauuguuauuauuuuagguguggguauuuccccauuuuucagccaaaaauauugugacuuucuccugguucuccucuaggugguuaggguaauagcgucuggauaacauggggcaguguggcagaguuagaagaccaugauuugaggucaaugagaucuggguucaaacauuggcucagcuuuuuauagaugucauugacuuaggaaaacaaaaucuuagauucuacaagccuccauuuccuuuuauuuuauauagagauaauauaguuuaucauuuauuaugauuauuuguuuuuaauaucucuauguagauauaucaagaggccggugcauacuagaugcucaacaaguagaagcugauaguuuaauugacauaaauaauaaaaauugcauguuaaaaacaguugcugguaaggcagauguuucauuuuguaguucaguguuaagaagcagaagcagaauaaacaaagcaauccuggagaauauauucagugcauaaugauauuuuuuuuugucuagaucuggacauaaaccccaaacaaaacucaccaacuacacaccaaccuccagacuaacucacuugcugaacagugcuguacgucagaauuguucuaggaacccuacuuaguugagguucucaaaaagguguuuuuccaguuaguacaaggguagauugauugauggaacccugucugucucuaggauaaauauaacggaggucauggacaugcugguaauccugaauauucacuguguauuguuaagaccgggauguaaaggaaaaauaaaagguggaggcaguacauuuaaggacuucuuuccagguucuggggugaagugauacuugcccuagauagauuggggcucuggucccgucucacugucgucucaguagugugggaauggugucugaaucuugagguuggaaggaaggaccacagauuugucucaugucagcaacaccuuggauauagcucgcaugacuacgcuuauuaggucaucuugaccucuaagaauaccaucugccuaaaagggagaauccugucucuauggaaugaagaacucucuucaaaugucuuguguuucaugcuauguguuccuaccacggcagaauuugguucuuauauuagggggccugugguuucuggaagaccagaaaccucacagcugggcugucugcccuccaaggcgcaaaugaguaaugggcgaauggaguuaccuuaucuggaagaucugggcuuguucuuaauuucuguagacaaacacucaaaaggacauauggggcuugauauuaucuucugcuuggugaccuuuucuucauuugcucuguguguguguguguguguguguguguguguguguguguguguguauguguacgcgcgcgcacaugugcccgcacaggcaugcguacauauuuguaugaagguggguacauguguauguguguaggcauacauaugugugcauguaggucagaaauagaugcugggagucauucuucugcacuuuauucagugaagaagggucggcaugacuugucucauuagacaucuugcuuugggggggcccucaucucucccuuccaaggcugggguuacaggcaggcugccaugcccacaugauaucuguguggguucugggaucugaccucugguucucaugcuucugucaugagcacuuuuaaccacugagccauugacucagcucugcuuaggauuuuuaaggguucaguacuuuagcaugucacacgccgaccuugcuugcagcauuuauuuauuuauuguaggcuuuuguagaggagaauuuuuauguagguuuuuguagggaggaauuguugcuuguaagacuugaacauuuguggaaaguuuuucaugaacuggcuuuaccgucuagcugcuugcacgguaugccuuugucucuaagccacgguggcucuuaucauuugguauguggugcagugacaagcugugacgauuuacucucaggccgugugcucaucuguacaaacugagggauaaauuggugaauaucguaguguuuugcuaacaugacugcucaacucugcccaaacacgugugucuuaauuauacuauguuugcucuggagaaaugcuguggcuuuuaagguaaaggcuuguuuuuguuuucuucuaaauuaugcuaauaaguguauugaacuauauuuagaagcaccauaaacaugaaacauuuuaagguaugaaacacauuuaauauaaaacuaaauauuuaacuuauuuuuauauguuaaugccuccuuuagacaugagguuaaucauuccccauuuuaauaaaaauauuaaaauguuccucaaaggaaagcuuuauugucauggaaauauuagacuccguuggguuggguacauuccaagugggauggccauaaauaucauggaaauauuagagacugauugauuaggauaauucuugccugugguacauugcugacuuguuuucaguuuaaagcuguuuuuuucccuccaaauuuuauuuuuuauuuuauuuugugcguauggguguuuuauguuuaugucuucauguggaccaugcgcaugccuggugccauaaaggccagaaaagggcauuggauccccugggacugggguuacccaggcuugugaguugccauguagguauugggacccaaacccagcaugagaaccucuggaugaacagcaagugcucugaaucaucacucaggccuugcguugaaagcuuauuaauccuuaaucuagggcaagaggagugcagagcuggaguuauaccugcuuugggaagucauucagggaaagguguuuuuuguuguccuuaugauagcaucuucauagaugguccaggucggccuugaucuugugauccucauacuucacagcugaaugucgggauuauagaccacuggcacaaugcacaacuuaaaagaggagucggacacgugccagagaucauuguguaaaaugcauuuacaaagaggcacacaaaauucuauuuagaggccuaaacaauggauguuaauaaaaauagggaaugcugcuaaaagaaaacaugguuugugcagagucucgaggggaacaggaagagaaugagauguuuaggggaauaggguggguuggauguacugauagaggggacauugacgggaggagcagagaugggaugugaugcuggggaagaggacgaagucuauccaggcggacuugugugauucaugacagagcacuaaaugucauucagaccaagggcagccauggcagguuccagugguucgugacuugaggaggggcauguaagacaacacuucuagggauuugcuuagcuucugaggcaggauuacacuggcuuaguucuucccucuaagaugugucuccuucccuuuaugcuuuucuucugaaaacaucuacugagauaugcuaacaaauaugcauggcccuguauugauuaaaauaccagcucaguauucagccaaguggagacuucuagguugucgaccuuuaaagcguuucaaucuuucacagcauaacuauuaagccagugaggagagacacaauccucugcuggaggauggggacagaauagccuuugucauuuggggccuuuuaggaaauacuguucugauaccguguauacauguuacagaaaauggguggaagucuuugaguaauaagguaagaguuuguauucuaugauauuacaguacuuaguuauguucuaaauauaucagacaaugcacggauuccuguugagcuaaauacagaagguacaguccuuaacuaaguauuuuuuuccucuuuacucugugcaggaaaauacuuuucuuccugugggcaauagggacuuaauuugaauucacagucaagagaauguuuuuagucaggacaaaaacaggaauucugagcugugccuuacugagcauguuaaguucaucggcagaguuuugcggagcaguguuguggcaagcucugucuuggccgaugaggugcgagcaggagggcacagugaguugccgguguggauggcauuccguguucaaguuucacggccucaguuauuccugagcuaugaugccaccaacgacaucucuguauccuguaagaucuagcaauauucaaagacaugagcugccuuuaagaugugacaugcgcucucuucuucaugucuacaaagccacccuucccccuuuauuguaguuguauugcauuaaagagaaaauuggaaaacaugucaaacguguguguguguguguguguguguguguguguguguguguguguauauauauauacccagaaugacagaaacaaccccugugggcugcuguccucacucggccaucuuuacugcagauuguagucacaaauuaaaccaucauagauaucacacuauuaccucuguaacccugccuguugcccagcggcaaccccaauucuggaguugcauguuuuugaacauuacaugaacauauuuaaacaccgucaacagcagcacuugguaugggcuugcguggguucacauuguguacucguguuugcugagcugccccugugcuuucugggaagccccauggauuggagaucaagcaucgucaaugcauuuguaacugguuucuauuacacgauagcugguauuccgcuuuauacuaaagauguaaaaaaauccauuauucuagucuuugacuuaauguuuuaggucauuuauagccauaaaucauuugaugcacacuuuuuacauuuaaaauauacauccacauucucauuuuugguugaauccauuuuuuuuaauauuuuguuuaaaagucuucugagcucaaguucacaauuguauuuucuaauauucucuccaauuuguuuuaaacuuuccuauuucuuucagcucuguaaucuaccaagacuuuauuuguaaauaaugagguaagacggaaaaccugacuaucuagcugagccaggaguaguucugaauagcuuaucuuuuuacugucgguuugaagcauuauauucugcugaugccaccagcaacaucuuuggauucuguaagauccaaguuaaaaaaagaaaaaagugcagugaggccuggagcaaaaagugucuggauaauccaagcuggagauuggcugaugccgaauuugaauugugugcauauaucuuagcucuguuaugucagucugugccucgcacauaaguuuguaucaacugcaggucgccgauauuguuaaaguauacugaacaucuauuuacaaguuauuuuaaaacuacaccuuaucuguuuguguguggcacugccuugcuguggcacauguguggaggucagaggucacuuuugugcacaucaguccucuccuuccaccauggaugucagauucaggucgagcacacuuggcaggaggcaccuuccucaucucaccagcccugaccuucacggugacauugacugcuauaccauauuacacauggaugguuuagccaauaagaggcuaagaccccaauaccucaguuaagccaacagacuuagacuuuugaccaucaaaucaucgcauaagacauugcuuaucaaagcucccguauucauaguagagguccuugugcuugcauaaaaggcuaguuacacucaaaggggugcaagguucauaccagcaguuuuugaauuguagaaaaacaaggagaauaagcuuacucuaaacugucuaaauuaaaaaccaaauugagggcuggucacuacuuaggaagaugcaaauuuuuucagauggagaagcuauauaggacggagugcucacuauauuaacaggguagacuaucucaggcauuuggugucuuguagaccugccuggcacagggcaaggcacagaggcaggaugguuguccuccugagcacugggaggcuacuuuuaaggaagggaagaaaugggagaugaaaguguuuuuccuccugaaacuuaccgaguggcagacucugcucaaagcacuugguaggcaucuugcagucaguguuuaugaaacucugugaugcacugagcacugccgcucugcaguggaauagcugagguuauggagguacggaguggggguggcaguggcggcugggggggugggaggaguugucuugccuuggguucuguaggcuucaaaagagaaaugcauccaccuacauuucugacuccggaaauuuuguuuuguccuuauuuauuuuugauuuauaaucuugaaucauaaauuaauucaaaaucaauaguggugggccaugcuaaacacaaaacuaguuuaccuccugcccuucuaauugggaccucuucguuggugagcauuucccugacugagggaaaucaccgguucagcuucugcugugccgugcugaucgaucuucaguuaaguagugaacugggagagagaaagugagagcugagcaccccacuguuucugcuccugagucuccucuggaaggaacagccuuuguagugaucugugaguuauaucacaggccuccccaaguauagcaucuauggguugaccauaggucccucagaggaaugugaguguggaagcucuggaauuuggcucuuacucacaggcuuucccaggagaagccauguguccagcagcucuaguucucuccuaagcagauguccuuagaaaugugcauacaggacugcgccagccacugagaccgugauguucauaacucaauauucugcauuuggaacucacuuuaaagaacacaucccacucaggaugauauuuucuaguuccauccauuugccucagaauuccaugaguucaucguuuuuaauagcugaguaguacuccauuguguaaauguaccacauuuucuuuauccaucccuguguugagggacaucuggguucuuuccagcuucuggcuauuauaaauaaggcugcuaugaacauaguggagcauguguccuuguuauauguuggagaauauuuuggguauaugcucaggagugguauaacuggguccucagguacuauguccaguuuucugaggaaccaccagacugauuuccagagugguuguacuagcuugcuaucccaccagcaauggaguagugcucuucuuucuccacaucuuugccagcaucugcuguuacaugaguuuuugaucuuggccauucugacuggugugagguagaaucucagaguugcuuugauuugcauuaacccaaucacaaaagaacacacaugguauacacucacugauacauggauauuagcccaaaagcucggaacacccaagguacaauucacagaccacaugaugcucaagaaggaaaaccaaagugcaggugcuuugguccuucuuagaaagggaaacaaaauacucaugggagcaaauaugaagacaaaguguggagcagauacugaaggaaaggccauccagagacugccccaccuggggauucaucccauauacagucaccaaucccagacgcuauuguggaugccaagaaaugcuugcugaauggacccugauauagcugucuccugagaggcccugccagagccuuacaaauacagaggcagaagcucacagccagcuauuggacugaguaugugguccucaauggaggaguuagagaauggacugaaggagcugaagggguuuucaaccccacaggaagaacaacaauaucaaucaaccagaccccccagagcucccagggacuaaaccaccaaccaaagaguacacauggcuccagcugcauauguagcagaugauggccuugucagucaucaauggaagaagagguccuugguccuaugaaggcucgauagaugcgccaguguaggggaaucaagggcggggaggugggaguggguggguggguggaggaacacccacauaaaagcagggggaggggggaggagcuaggggguuucugggauaggggaaaccgggaaaggggauaacauuugaaaugcaaauaaagaaaauauccaauaauaauaaaaaagaacauacaaauagaaaacaucuccgaggcuguuccuuauguuaguccuguucacuuuuagcacucucuguuccagucucgcagcaaucuuugacaugauaauugcugucaaaacggucuaaaauucucaagguauuagauaaacuacugaauaaaacaaaacagaaccugugaaaacacuaggaaaagcugccuuuccccuggagacuuucuuccuuauccuuccuaauugugggacugaaguugaaauuccuucuacagcaauucugguuacacagccugugggguuuugucucagcugccccccgccccgacuuucuauuguaauuuaucuuuccuuugggucuaauuaauuauuuucucuuguuuacugugcagcuagguuauguauuauguuaauuaguauauacaaggugaugacuaacacuagacauaaaaacaguguucuauguuacaucuccaguauuuaaaaauggugaaaaucuacugacucaacagaacaaaaggagaauuguucucuugcuuugguuauuauugaauuuugucuuuuccuacuuuauugauugacugauugauugugaaccaucacacacucuuuucucaggccaugccuauaaacaaaugucuuguagaacuguagauagauagaguugggacuuucagguuagaauuuuauugaacacacgugcacacacgugcauggacacacacacacacacacacacacacacacacacacacaagccugugccuacuuguguguaccacauaagauacuuguauauguugucuauucacuagccuuugaauuugcacuccugaaaccaucaugaagaagaaauccuuaucugaagaaaagaaacacacagacaugcaguuagaguaauuauccaguguucuuuauuuuggcuagaaguuucuuaaauuuaaucuuuauuaggaauuguuuugauuuauuuauuuucuauguagagauuuuaagccugcauuugagcucauacacuaagauuuuuuucuccuucucucuagacaaaacuaaauuccacaucucaucucccgacccagcaucuggcugaagccaccacaguguugcuugacagcuuggggggccuggcccaagagguaagugguauuuuuuuaagccacaguggacagacuaaucacugucauuucuuuaguucugaguucugacaacaggguccuuguacuuugaauaucaccugcugcgucaaacuaaauuuuagaagcacaaguaauuuaaaaaugaaucagguuugaucuccauuggagaggaagaaacuaaaauacaucaauguugcagagauaauuagugccucagaaccccauguuuagucuagaccuuucucugugagcuccuucugccccuguguacauuugugaagagaacugucucucgaucuaccuccuacccugugcacugacucuguuugacagcagcuucuucauguugcuucuucaacagcaaggccaccauucagccauugcaucagaauucaccucugcuagccaacaggaacgcuguggcuuuccucgcccugcuuuuugccuugggaaaucuggucucugaggcucagcauugggaauucgguuccuagugagugcugagcugauuuggccguuaggucuacauguugucccaugugacagagugaaccuugaucacaguucaccuugccuguggaucccaccacugucugucccauuggccauggguagaacucaaggcaggcuacagugcucaggacacuggaauacaggaauccauggggggaaaguuucucagacuuggcccauccugauuuuuuaacugagucuuuagcucauuuuccaugcuuguaucaucuuuuuucccuucugaauaucaaaaaaguuaccuuguuuccugacaauaaaaguauuucacguucaucagugaacaagcagugcaccuggaaaguuuagaaaauccugagaccaagcacaacaccuccucccucccacccucccucccucucucccucccuuccuuccuuccuuccuuccauuuauuguaacucugcucagccaucuuugacagaggggcuuugcucucauacuccuccccuuaggagccgacuuugucagccuguuauugguuccucuguuagggagggugagugaccuuuggauaggccaagaaacuggaccaguugggguucugccaaagggcagaaagagaaaguccaucuguuuccauaaggccuugugcguugacagugcucuggagaguccccuccuugucucauuuucugcugcucauuccuggagaaagccaaguggguguaguaguggccgggugguugaguggugggguaguaccuguaaauucaggguuuguggcagcaaguuucucuucuaucauuguaccugcuuuuauucugggcuaaaacaaaauaauugcaaagcccuugaugugcccuguggcugaauggguggaaaccucuagcaguguacuguguacauuuuucuuaacugucucuuggaaccugcuuacuccuguucccacaucaguggugggcaaccacuucucccaauaggucacccucaagccgcuuuggucaugucucucucagugcuuucucugaguaacaauaaagaaaugcauuuuuagaaagguccauguuuagaaagaaacuuaguugcuauguucaaaggcuaacuguugacaggaaaacacaagauaucauagauggauuguggcuguuugauuucauaugacuggcucauccucaggguccagugaagcaccuuuuauugugcccauuucacagauggcacuggggcacagaaaagucuuugcccacagucuuguagagaguuaauuggucgcauggucaggugcuuggccuugccagcuauuccagcucugcagugagcacagucaccucgccaccaucauuuagcccacggaaggguggaagucagaaauaaaccaguccagcugaugaugugaccgcaggcaucugugcagugaagaaaaaauaaaccauguaagggauguagaaagagggaugagaugccauuuuaaaagagcagagugaguugacuccaaagacaguggugcucuauuccuagagaaguuaggacacugcacaggaagggcagcagauaccagucacaggaaccgugugcuugagagcguacacuuaagguccaugaaggaagccagaggaguuaaaagaggguguuuaguguggcuucauguuugcaaaugacuacacucuugcuguuggacugaggaagaggcuggaucgagaauaaggagggugggggcauugcaacaaauggagacugcauggcccugguccauuugcuuaccuucagugcaaccacucuucuuggccuggaagaugaaugguuacccuccccugugagccaagggcaagucacagagaauguguccagugagagcuaugaugaaggagagugggcaggaauucucuccucaagcaggugcuagggggagccaccagaugggaauagcaagggauaauaagauacugcaggucccagcaccacagguggagggaagaaggccuuggcuaaucaccagagggcuuuaaggugaugcuagcuagacacaguauguucugcaacacugcuuuuagguuaagagaauaaaguguuugcuucucucuugucccauccuuugcuugucccuuuguccccucuccuuucucuuuccacccugacaccagcuguucagcacaaagagcuggagcgacaugcggcaggaggugauguuucugaccaacgugaacagcuccagcuccuccacccagaucuaccaggcagugucccgcaucguguguggucacccagagggugggggccugaagaucaagucccucaacugguacgaggauaacaacuacaaagcccucuuuggagggaauaacaccgaggaagacguggacaccuucuaugacaauucuacaagugaguugacuaugcagaccaaagccauguccucauuccgaucaaucucaggucuggcucagccugugucaccccgucccuguguccucauuccgagcucaggucuggcucagccugugucacucagaccccaugcuuuccuuuauucuguguaguagcaaagguuguccucucuguuugcucuuaugacauugcuccucaaguacagaguccuugauaagugaaucucucucaguucugugaauggaggggccugaucucucucagguguuuaguaacaauacccaaaagaugaauaagugauugauagcuagucuuuccaguucuuuucauaugugggcucuaaaagaaaaaaaaagcuacacaaagcagggaagaaaagagguugcugggggcaguagagggaugagaugagauguguugguuagaaugcaaaguucacuugugcaaaaaugcauaccgcuggagagcaaauggauaagguagcaagggugugguaacacuguguuauaucuguaagcuuuguaaggaaguucauauugauguuacugcacagacucagugggcaucuacaugaagugauggagauauuaacuagcuugacuggguuguguuaaucacaucauagcggauacguguaucggaacaucagucuguauaaaauacguaucauuuuuguuguucauuaauaccugaguaaagccagaaaaccuccuaaaaaugaugagauauuuuaauuuuauauuauuuuaauuauuacauuuaauuaucauaauuguuauaaauuagcauauuauuauaaaagagaauaauuauaaaauaguauaaucauuauaauuaucacuauaauuauuauuauauuacugugaggcaagcuuuacaauaaacaucuaaaaggggguaaugguaauaauagcaauuacaacagcuacaggaaaaccuaacauuaaagcaaaauuuccuaugcauaaugcauucuguuuaaauuaccuauuugauucuuacagaaacccugcaaggaagguucuggaaccucaaauuucauaggcccagagguuaagugucuugguuaaaguugcauuucuagguaauccccaagagcugggauucaagucuaaguccucuuggcuuuuugaggugaacuaccucauuaaugguggcaugcuugcacugucacacucacacauucagcugccuguuuguuuugcauucuggguguuaaagagaccuguaacucuauaucuagucaccacccucgggcaguuuucuguggaagugugucuguccugcaccuggucauauguagcauuuguccagcgcuacaggucuaacaauggcaucuuugccuugaauacaccacaaagcuaagccauuccugauuuccaaccgcaggcaagaagugagacagcuucauguguggcuguaacacagccugugcccucuggggcucagcacucuagcacuuuacaaguugcuuuagaagccugaagaagaugguaauguaggcaguuuuaugaaaccagcucuucuuccccagccugcagaucaauccaaggacaucucuugcuuauacaacagauauaauugagggcuuguuuccuuaggaaaauauuccagccuuggagauaggacacaacgauagagugcuugcauaccccuagugaggccaugggucauuucuaguaugccccacccccaacucauuaccuuuuuuaucauuauuuuaucaccuguguaucaagcagcucagagacguugugugguauccaagcaaagcccguucuguccucuugaacuuuggauauuucaguuuuuaauuuuuguuaaauauaaacauuaguugugguaggaucuauuaauuacuaaggacagacuuggcuuuuuccucuucaaacaaaaguguaaaugcagucuuccagcuuccccaggaagaauccugcuuguguccagugaaaagcacugugagggcuggcaugaggguguggagcuagaguugggauggcauguguagucaaaagcuuccuucagaucagcucagaugugagucugagagaggccugauucuuucgagcacugaggaaagaccucacuggaaauaccccaucuaauucucaucacagcucugacaaguggauguuacgaacuuuccaacuuucauucuauagcagcgcaaacugaggcucacauaaggagguuauccgcugcaugacugauaggugaugugggagggggauuugcacccuggacuggcugcauggcucccaaaccuucuaaguuccuguuggcaacugaccaugauauagacgugaaugucuguccuccgucuucuuuguagcuccuuauugcaaugauuugaugaagaacuuggagucuaguccucuuucucgaauuauuuggaaggcacucaagccacugcuuguuggaaagauucucuauacaccugacacaccagcuacaaggcaggucauggcugagguaagcuguccaggcuuaggacuccguccccaaaaucuccccagaauuagggguaggaagugaacgcagcuucagguaguguauguugaauauacucuuggccaugauggggcuuuuaaauagucaaaaacaaaacaaaacaaauccacauguaaucuugggcuccauauccccagccuugaguauuugaacuaugucuguagcagggguuucuugaggaagggaaggacugagcagagguuucuguaaugagugguguuuuuuagggaaucuuggaauguucauugccucugccucucuucuauuuguaugaaucccgauucccuaccugacuguaggugaacaagaccuuucaggaguuggcuguguuccaugaccuggagggcaugugggaagaacucagcccccaaauuuggaccuucauggagaacagccaagagauggaccuuguccgggugagugacucucuucucggauuugcuugcuugaucuagaaaagauuucuggacaucuucccagaaaucccugagaucacaguucuguaaguuaaagcaacugagaucagcugaagccacacagccaccacuucuguagaagcaaaggccuuagugcagugauagcccugggaaugccagcaucgcuguccaucaugguccaguagcaguuuugcacaaaacccagugaggaucagaaauuggagucuugcaaagaaauggcacaaaacccagggaagaucagaaauuggugcuugcaggacacuagaguauuuucauuuggucuccagucacuaagauaggcacaguaucuucuuuagccugccaugucucagaaggagguuugggaacagaagcgugaucuggcaugcggacaggucagggauacugguucuccaggcacagagagaguacagcaucgcagccacugcuguggaggggaggaaauugcccuuaacauauagggggcacuugaaagggaagcaugcuccagacacaaccagguucaaagagagagagagagagagagcagucuggaaugcagugucugucgccuuugcaucaacagaaaagccauuuaaccacuuccucugggccucagucucagucaggaucauuagacaaagucuuauugccauggcgaggaaguccacuuccuuuuauuucuucugccauuaagaagcaagggaggauuuuugccagguuacuggaauugaaucucugugcccugaggguugcuggguuuuuagaggcugcacuucuuugggaguuuaggggugcucuagguccucuugggggacagguuacugaucaaagagcaucuggagaugaaggaaccagagccuccuuugauacagccgugcuguuacaccugugcagaaugcuuaacuuggagccuugguacacacgggacgugagugagaaaaccaagagcaacagucuuaugcauucacggcgagucuuaugcauucacggcgagucguggcgcaaguuggcacuggcggugcauugugugcacgcuacucuuucuuuucugagggauucgugggaugcucucacaggacacacugcaguguggacccuaggccugcuuuccuugccauccauauuaucuaccucuugggauuguucuguguuugacaguaaagggauuuugaauugggcauauguagauauuuccuuacacuuuuuuuuaaauuagguauuuucuucauuuacauuuccaaugcuacccugauagucccccacucccacuucuuggccccggcguuccccuguacugaggcauauaaaguuugcaagaccaaugagccucucuuuccacuauuggccgacuaggccaucuuuugcuacauaugcagcuagagacacgagcuccgggggggucacugguuaguucauaauguuguuccaccuauaagguugcagaccccuuuagcuccuuggguacuuucucuagcuccuccauugggggcccugugauccauccaauagcugacugugagcauccacuucuguguuugcuaggcccuggcauagucucacaagagacagcuauaucaggguccuuucagcaaaaucuugcuagugugugcaauggugucagcguuuggggacugauuaugggauggauccucggguauggcaguuucuagauaguccauccuuuugucucagcuccaaucuuugucucuguaacuccuuccauggguguuuuguucccaauucuaagaaggagcaaaaugucuacacuuucgucuucguucuucuugaguuucauguguuuugcaaauuguaucuuguaucuugaguauuccaaguuucugggcuaauauccacuuaucagugaguacauaucauguauguacucacuuuuuaaaaacacacuuuuuuaaaaacaacaucaacaacaacaaaacaaaaagcagugucucgcgguguaguucagacuugucugcaacucacuauaugccccagaugaccucaaauucauggccauccuccugcuucagcuucccccagagcuggaauuccagauaccaaccacugugccugggcuucccuguucuuagaucaaggguuuacuuuggaggcugcaguuguucaucgggucuugguucuuaagggacaaguccuuacaaacaugugguggcguucacuagggaugcauauguaggggaaucuugagaguguaacagaagugaaguagccuggaaggaaaggccugggaggcuguaaggauccuuauauuuagagggggagagcagaugguuuuaagcaaguggagauguugaugcgguauucuagaagaaagaugggugcaaggcugagacggaccucaacagagauugaauaggugaguggcaagggcugagugcagaagaggaggcguggcagcagcuuaagguagacaggcaagaagaggaugguacaggagagcccugacuuuuaccuggacaggcaggggguagcgagagaccaacagaaugauggcuccuggggucuguuauacagaggcugauuggcaugggguuaaugguaaggaauugccacccugucaguggaaacuagggaaucucuauccuagcaucauacagcaacaauuuuaaagaagucaucaugggagagaaagcguuauuacugaaauaacuguuauugcaaguaauuuggaauagacuagaugguauacaguaaaggaguaguuaaugaaauuguaggagauacacucuguaaaaucaucauguuaucauuaaaauaacagaaagccacgggguuggggggaacuugcaagguuagugaaaagaagacugaugaaggaagucauaggguuuuggagaucuugcucaguagagcaaggaccucccccucccacuaggaacuggaaaaggagcauagcagcuguguuuccauuuugcccagucagcaguggccucauuuuccuggcagugcaucaguguagacuuuugccccagucccccugggcaggcugguugaggaccagaauagcuuaccuuuccacauugacaggugauggcaggucuucuuuucuucaucaugaucccauguccuggaguuaggaaagacgaucuuuuauuuguauuaaccaggaguauuacuuccuugaacuaagcauuaaaaguggacucagucuagagacaagguuuuaauuugacaucaccagacccuaucucaaaagagagggugguacaaugcaauguguauuaugcugccgaaagcuccuuagcuaccuuaauauccccgaaguuccauuuuccuguuugugagguggacaguaccaaagucacacccuuggagcguugugucaguucugaugccuauagaucccucagcacccuacugucacuguuguuagaguuaaaacaauuaaccugggcugucugguacagugggaaaccugugaacuucgaagucagaggucugacuuugugucucagcuuaucacuuagccuuggccaacaucagccaugagaaacuucaaucuuugucagaugugcucuuuaccaugacacuugaugaucacuguucgcauguucuuccuggaauggcagacgcuguuagacagcagaggcaaugaccaguuuugggaacagaaguuggauggauuagauuggacugcccaagacaucauggcguuucuggccaagaacccagaagauguucaguccccaaauggcucuguguauaccuggagagaagcuuucaaugagaccaaccaggcaauccagacgauaucucgauucauggagguaagggucugcuguacacacccuuuagcaaaggcuagaggcuuuuucccuuugagcuguugcaauaaagaugcaggcagaaggagagcuuagaaugaaugugcagugucauguacagcuguauccugcaggccuggugagcaagauaaacaccagaugaauagccuaacgagcacauaagcuuacuucuagauuugcuucagauugacuccagcguuucuguccuuuaucuucuagcuuuuccuguuuugaaauucuagauccuaaugauaauaaacugcuuuguuauaaaggcauuauuuaugaaacuuaucuaaucuaauuugggacugauaaaacuuuuaaaucuuuaauccuaaaaaaugauggaaaggaaaaaagcugacuagauuuuuuuucuuaucugauuuuuaguugcuuaguugcugugacucgacacugcuaagacauguugcuaagagaauagaaauugcuaagagaauaauucccucgcacaaagcaauacaaguaacuuugaguauuucacucaaaccucaguucugaaaccuggaaaacuacuuuagagauggauaggccgugcagauuaagaauucuggcagcuaguuccugccucucaaaggaggcugaguucuggcuacugcuugucuuucuggucuccaguguucuaaugaggcuuccuucugucugucagugugucaaccugaacaagcuggaacccauuccgacagaagucaggcucaucaacaaguccauggagcugcuggacgagaggaaguucugggcuggcaucguguucacaggcaucacuccagauaguguggagcugccccaucauguaaaguacaagauccggauggacauugacaacguggagagaacuaauaagaucaaggauggguaagaugaaacccggucucgcaaagcuccagaauguaacuugggugacuuuuaugacuggugguacuuuauuaaggaaugucaacaacaaagcagccguggcacaacuucaguaaaguuccauugccggggacuguuauuccaaggcuauaaauuauuacucuuuccuuuuucacauuucuguuuaaaagacuaaaggacuuaaaagucaggaaaaagaaaggaaagccacuaggagucuucuugcuagccauacguauuuucacaagaagaggcaaauaacugauaaguaaguugcaguauguucaucaggugcaauauuauucaccaguaaagggaaaagaaaaauauacccagaaggaguguuuucauugauuauuucuauccaagaauuuauguacuugucagcugugauaagaaugggagauagaaaaauaggaggaguggccuaggagguguaggggaaccuuggguaauuggauuuuuucgggguguguuuuguaugaguguuucaucaccugauguuugauuucagguacugggacccugguccucgggcugacccuuuugaagauaugcgcuaugucuggggcggcuucgccuacuugcaggaugugguggaacaggccaucaucagagugcugacgggaucugagaagaaaacgggugucuacgugcaacagaugcccuaccccuguuauguugaugacaugugaguguaccaacaagccaacaucucccuuagauaaccagguccuuggagagagugcguguaugugcguguuuuucacugguugagagcgaaagcaagucaauaggacauccuagagauacugaccuuuagcggaagaccaaguuggauucugcccccgcccuuuguguuuaguacuuaguagaguaacuuauauuuaucuuaauauuacccuauccauuuccuagcuauuaaagagagccccugaaaaaauuuugcacggccauacccucgaaacccagguuucaucucuguccacugcuaaugaaaccuuuggucauuugagaguucagugggccuuucauaagcgacccugaugagguuuguccuccagugugcaaggccuuggaucggugccgggcucacacuuuucauuuuucccaugccuuuucucugugccuccaguuuucugcgggucaugagccggucaaugccccucuucaugacucuagccuggaucuacucugucgcugugaucaucaagagcauuguguaugagaaggaggcucggcugaaggagaccaugcggaucaugggucuggacaauggcauccucugguuuagcugguuuguuagcagccucaucccucugcuugugagcgcuggccugcugguggucaucuugaaggugagguggacucacucacucuucuugacaaggaacucuugaguggccugauaacauagcgaaggggguaaagggaucucuguguccugugugcuucccuccauucugaauugaggaaagccagagagggguaaggacuugcuccagucagcccacugggauaguuagcagcuaaguagcuagaacccagggcuccuucacaaauuuacaugcaccacacugguacuggguggggguuauuuccaagauuguaaaugcaacaaccagaaagucagaugcuauuaaagguuuggcucucuggaggaagaggcugaggcauauuuuggaauauggauauuuauuagggauuaguaugauggguggagcgcugggucaugcagagggagaaguugagccaugauucaacagcccagugggauguucuggagaacauacagcuuguccaagaauuucccucauagucacuggacgggggcucaugggacucaccagggaaaggguguuccagggccuguuggcucuccuagcuaugacaacagagguccuaacaucuggaugucuuuuaccuauagucaaguaagccccccucuuccccugcuugccuuaaaguugagucugggcagugagguuuuugccucauacacaaaucugcucuuaagcguuuuugcuucaauaguuacuucauacaaagaugcaucuuauaaaaguuaguguuuucuaagaaagcaagagagcaaagcaggagaaucuaacauuuguccuaauagcagcuacuauauauuacauaugagcgcucacugaugccaggcaccggucagaggacaugcugugaacuccgucagcggagccuuccuacaauaacccauugagugcucagggaaagucagagccucacuaaaauacccagggacggcagaaucaagauuuauuggcauguuguucugaaacaaacucuuuucucaugcucugguauccgagggcaaggaccuaagccuugugacaaggguagggauccuguggccagugugugggaacggacuaagucagccggguguugacagggccugguucaguguccacagugacuaccgaugagcucagagcucagaacuugggaugagaggaugaauccacagaacuugggaugaaugaagacucuguguuuaccaggggaaaguucagguugccuggccuuuuuccuaggcuuuuggagagaaaggaugcguaggcuguugucucacacgacuuuuuucuuagaggcaauaguuguccuuagacaaggagaagccaaauuccuugcucucugugagagacggagaacaaaauuauccacuaagaucaagucgaaaguccuggacuuuguccuuaaccauaauucugccgugauuuuucaugcauagucucuccaguaaguuauuucacaugggcuucauguccucaucagaaagucaagcacaaggguuucccugcguuagcucugaaagaauuauaugucaaaaccagcauuaagaucacguaugugagccgccgggcuugccaaggcuacacguuuauccagacucuuccucuccaguuaggaaaccugcugcccuauagugaccccagcgugguguucgucuuccugucuguguuugccauggugaccauccuacagugcuuccucauuagcacgcucuucucccgugccaaccuggcagcagccugugggggcaucaucuacuucacgcuguaccugcccuaugugcugugcguagccuggcaggacuaugugggcuucuccaucaagaucuuugcuguaaguaacucugaucucucugcagagguuguaguccuggugccccuccaccuccccaggguguuggauaauccugucuccccucuggcuaaguuguuucuccuuugccccuagaguaaauacuagguuggauuugguuuuugucagagaucaucagauugugccuugaacugguuggagauaaaugacauucagaaauggaucuaguuuaggcaguagguaccauguccaccccuuaacuucuagcucuuuggccauaaaagcucacagcaaggucauguccauggacagcuugagaccacaaaugguucauucuugucccuugucuuucuuuuauccauuguguuguuugacuugggaaauauuuuccagacugaaaaaaaccaaacaugacuuacccucccacaaaucccugaccaggacauuuuagucuuuugugaaauguagguguguagucuuuaagcaagugagaauaccaauaaaggccacucacuaucugcccugcugggucacugauaacgauauuaggcucucaggaugcuccaagugcugaaagcuugagucuccuagauaugaugccuuaaagcggcuucucugauccugaauauucaaugacugaucagugaaaaaaguccuugaugaaugucagcuggacggggggaacaggaucguugagccuuguaaugucuugggaagcauacaguucuaaggucucaccugcucucgugcauacauuucugaaacgugucugcauaaugagugcuuauaaaugaaaucauuuucuaugcugcaagugaguccgcuucuccaaagggacucuaggagaauauuuacgugccuuauaauugauguaauuugcaaagucaaacuucucaagguggaauuuacaucagaagagaaaaaugagagaggcaaggauguagaccaguuccuuuugccucuuucucucagagccugcugucuccuguggcuuuuggauucggcugugaguauuucgcccuuuucgaggagcaagguaucgggguccaaugggacaaucucuuugagagcccgguggaggaggacggcuucaaucucaccacugcaguguccaugaugcucuuugacaccuuucucuauggcgugaugacaugguacaucgaagccgucuuuccagguaccccaggcuuccauacugcuuuggcugacugaggggcagagcaacuuucggccuguagguucuuccuuucuuuguguugcaguugcugaaggacgagggagcgcccugggaauuggcuugggcuuuuagcuuaugaaaaacaaauagucuaaggaaaggcacuuguguugaaagcaugcauguuacuggcauugugcuacacaucucuugagcccagugugccaggugcugagcaaaguacuuuauacagacucugguucggaagguuacucugggcuguuugcuaagguaaacaguuucuaaaagagagagcuaacugagaguuugagggacuugccuaaggucaugggucuguuaagugucagugcuuggagaugaccucagcugggcuauacugggucagagucuggcagguuccucucaguacugacuggguucuuaggacuaugucuccagaagaggaagcccuaggagaccaucugucucuuaacuacagguuauaaguaauauaauauauugggucuuagcccuugccuauugcuuaagggaaauuaguauucaccaaaaauuaauuuugaugcuuucuuacccuucuuugccaaguacaacagaacaggaacccucuuuaggauacauuucugucugagaucagauuuuaggggaggacucauuuucacccucugaaucuccuccaaggaaacccauuugaaauguuuuuuaaacccguaucugaacuuccuccauugaccaugcaauuugcauguauauucugagauucaaacucuugaguccuuauuuuuugggguaagugaccuuggauagggcuacuuguccuucaguuugcucaucucuaaaaugagguugcuguuaccaccuggggaguuguuggaaagcuguggagaggugcagaauauaugaucugcccaguagauuucagcaaaaguuagccgucucccuccagccuauuccuuucucauaggguuggucaaggagaaagaggauuuggcuagacaaugucagaaaugcucagauugcaccagcuugggucauaccuguguuauuugugcuuugcuuucaggacaguauggaauucccaggcccugguauuuuccuuguaccaagucauacugguuuggugaggaaauugaugagaagagccacccugguuccagccagaagggagugucagaaaguaaguaccacuuaccagcacucucccacaccuaaugcugcuguggcccugccagagcagggcaugccuccuacaucuaacgugaucccaaaaccacaaccacgguagaaaaaccccaugcaguccacccucuccaaaugcacuucuuccauugccgucgcaugcacuuaagggaacccuaucuggcuccugaggaacaguucuaggaaaguauguuuugaucaguguaaccaucuuuuucccaucuuggauaauugugcuauucugugaauccaagaggaauaacuacaguuagccaucacugugggccucaucucucugccugccuugcugggguggucuaugccagggaaucuguacgugaaugccagggggcuguuauagaugcagcuugugcuucguaacuucccauccuuucuuacacagggcacuaauccccucuuagcuccugacuggagguagaggugccccuguucuucccaggguuucuguuugugucuuuguucuugguguggcuuccuucucuauugucagugguucacuuucuuccugugaggucaguagaccugcuuccuuccuacaugguccauagucugcuaccuccuacauugucagagcugcuuccccucuacacugucaauaggccugcuuccuccuuaugcugucagggucucucuuauuugcccuuccucagaucuucagugguuagcuuuugguacacccugguguggauagcaggcaauuuuuaaaauuuuauuuuauuucuuuauuuauucacuuuacaucccacucacugcccuccucuugaucacccccucccccucccuuuuuccucugagcacaugagagcaucucugaguauccucccacccuggcacuucaagucucuacgaggcuaggugccuccucucucacugaggccagacaaggcugcccagggaguagaacauaucccauguacaguaaacagcuuuuggaauagccuccaugccaguuguuugguacccacaugaaggccaaauuauuuuuguuuguuuguuuguuuguuuuggugaguccuuuucucacuugguauaauucuuuugauuuccacucaaauugugauauauuuaauucauuuuuuccuuaaugaguaguauugcacaguauggacauccaugauacuuuuagauauguuuuuaaaauggcuguuggcauacuguauuuuaauuguuugugcagccuuucuucaucaaaagacuaaugugguuuuuuuuauaaguucauugcuacugucagcucacguguuccaaggggcuuaaaauauuucaucuuguguuugucuacaacauuaaagguugagcauagacagaaacuaguucuaaaagucuaagcauagacuuuuguauuuguguacucuacggaucagggcaguguuuccugugggaucaucucugucuccuuucuuuugucacagucugcauggaagaggaacccacucaucugaggcuggggguguccauucagaaccuggugaagguuuaccgagauggcaugaagguugcuguggauggcuuggcgcucaacuuuuacgaaggccagauuaccuccuuccugggccacaauggagcagggaagaccaccaccauguaagaagagggugugacucucccaagaucuaccucaggaaauccccacuuagaaacauagaccuaaggaaauugaauuggucgcuuggcuaagaguggagcaugaugggaaggaaugugucaaucacgagaaugcuuucugaggucuagauuuugcuaggucuuuuccuuuagucuuuuccuuuugaugagcuuucccaugcaauacucagaauuccucagcuuucuuggaaucuugagguuucugaacuuguugguucagaaauuugaagcaugagacuagaaagaaagaucaaacaagcuagaggaaaaaggacagucccccaaaaaaaucuaucuccaagcagaggagagaaggccuggacagcucucucccucugccuucccagggaccugugaggacagaggaagggcuauagaauaucauaguuugcuugugguuuguaguguggucccucugccauuccagagguugaucuucucggggugacaggcuuucuucuucaacauaaaaccaguguguuaugaacaugacugagauacucagaaauucuguuaugcaacacacucauuucuuucuuuuaacaguacguucuuguuuguucauuuuucuguacaagauguuaggcauacaaaauauguuuugaggaguacauccuggugcaaauuaagagugucauuuuuuuuucagaugcucuuagcaaacuccucuuccuaagacauaggcuuaugcuuacccacucacuaaaacaaauggccucugcuccaugggcaucuguuagauuggauuggaguagauuagauuagaaaggaaagaaucauguuaaguggugugaucuguucuccuugcccaggcucugcagcccugaauagugaggcuggguccuccugauucuugagucuguuauucuuguccucaggucaauacugacugggcuguuucccccaacuucuggcacggccuacauccuggggaaggacauucgcucggagaugagcuccauccggcagaaccugggagucuguccccagcauaaugugcuguuugacaugugaguagcagaagugcacagagaggagcaccacccccacucccacacuucccacccccaaccccucaacccccucugggaccugggaguccuggugguaugaguagaguauuacuagagaauuucccuuuuuuggguauggagugguaguaggucuuuccuuuccugacacacaaugacaaguugccuuuuaauuucagggaaaaaaggugaaguugguguauuggcugaugggauuuagaaagccauguucucuguuacuggauuggaggguguuuauuuguuuguuuuguuuuauuuuuagcucagccaucuuccugaugcauuccuccuugcucuaguuuguuuuugguugcugugauaaaacaaugaccaaaagcaaccuggagaagaagagguuuauuuaauuuuauaauucuuuggucacagaccaucacugaaggaacucagggcaggaaccuagaggcuggagcugaagcagagacaacagaggaauggugcuuagagccuugcccuccauggcuaacuuaacuuacuuucuuauacagcccagaaucaccugccuagggaauggugccacccacagugggcuaggcccucccacauuagccucuaaucaagaacaugcuccacagacaugucuauaggacaauaugguagaggcaguuccucaauugaggguccuucuuccugagugacucuaguuucuguguagacuaaccagcguauucauuaaggcaugguacaagaaccucaaaagagaguuggcacaauggcccuguguucucugcucaaguuugcucccacccagguugucccaccagcaaguuggauccuaaaggagcccugguaguagagcagaggaaggccugagcucucugguggaggaacaaagaauguccugagcccucugacugcaggcaaagccuuucuuuccacuuuguagguuuuaaggucccuuuuucuaaauucaauggcuuggaccucccuuacuuuagaacuugagacccauugagguucauucacauuagugaaugcugagcuaacauggucacaaaaaaaacugaauggagaaccuggaauuuaaaguuuuaacggccuggugucuugugaucaggccuguuggguauauccuuauauaugcaccauucauuaccaugaauucucccuucugguugccuuuuuuuuuuaaagaaauugagugcuuuuuaaaggcaagaacgguguggaagagaggaaaacugugccaagguacauccauccuacugggccccgagcugaccugccccucuuucccccaggcugacugucgaagagcacaucugguucuaugcgcgccuaaaggggcucucagagaagcacgugaaagcagagauggagcagauggcccuggauguuggcuuacccccgagcaagcugaaaagcaaaacgagucagcucucaggugagccccggacaccuuccuuuccuuccuucuccagacaagcaccuagaguucaagccuggauguuuggugacagaauccuaacccucuuaugucuccagauggguacuuccagucaucucucaccacgccuuacccccacuuaccauuugaggaugugucuugcucugucuuguaggugggaugcagagaaagcugucuguggccuuggccuucguggguggauccaagguugucauucuggacgagcccacagccgggguggacccguacucucgcaggggaauaugggaacuccugcuaaaauaccggcaagguacaugcuguuacuuauuuccagucaugacccaggguagagaagggcucgugggaauuguggcugauuguguuaguugcuucucaagaaaaguugggagccuccuugaagcuccguuucuguccugcugugcaagauucuuguuuguuuguuugucuuggguuuuuuuuuuuuuuuccgagacaggguuucucuguauagcccuggcuguccuggaacucacuuuguagaccaggcuggccucgaacucagaaaucugccugccucugccucccgagugcugggauuaaaggcgugcgccaccacaccuggcuuugcaagauucuuaagacguauacuucauuauuuaagggccuacuagaagagcagaaaggguauaagcauacacauacauauuguaguuagaccauguccuuguucauguuggccaugacuaaugggaaugucuguaaacuucuuagcacacuugacggagcaggaucccaaauaaauacugcucuccuuuuugugacaauuguaaacugccauccccccaagccuugccauccuggggucacaucuauggagguuaaagaccuccccaugucuuucucauaugugacaucuuugccguuugugccacuuugaucagugagaacugacaagucccaccgucccgucuccuugucuccuuguguuugugccuggcaggccgcaccauuauuuugucuacacaccacauggacgaagcugacauccuuggggacagaauugccaucauuucccaugggaagcuguguugugugggcuccucccuguuuuugaaaaaccaguugggaacggguuacuaucugacccugguuaagaaagauguggaaucgucccucaguuccugcagaaacaguagcagcaccgugucuugucugaaaaaggugagcagccaucuuggggcugggcugguguggggaugaggcagccagggcuuguuuccauagauggcuugcacguuggcgccccacgcugcuaagauuaaggcaacauuccccucgcuuugugggccuguugcaguacaucaugguuccuguguggaaggccaggagaccucugcucccgccacacuaguucuagcccagccccuuuauauucccucugcaagugcccuggguuauggagacaagcccuuugagggcuuuauccuagcaaagaaaagagaacuugccaagagguaagaguagccuugcuacaggaugccccgccauuccuaccugcugccuuaaaucuuacuggucuugacuuugaaacuaugaaacaccaaauauuuacuagauauugauuuuaaacccucccauccccuuaugaccuguggguuuagaaaaaaaaauaauguuaacaguacauuuuuggucuguuuauauauuuuauauuuuccaaguguagagcaaccuagggaagacaggauuauguuuauaaucucagaugaagggagugaggcuuguaggaacuguagcauauucaaggucucccagcaaggacauaaaagcgaggaccagaauccuggaucugguuuguuauguguuucuuacaugcuacauguuugagauguguuuguguggucagucacagcaggccaccuaccuacccugucuccuaccugauuugaacucauauccauuuauuuuccuguuaacuggagccgaggccucauucaaguguggucugaaguguagcauagcagccucaguugggaauucauuacacacaugaugacuugggcccccguucagaccuacuggauccaucucugcauguuaauaaggugccugaguaacugaaugcauauucacaucgaggaagcuuucaauuagcuaaguguucagguaaaucccacgcggggacaguuggcaaaugaccaguggcagcauugaucuguggccacaguucuguugacauucaguuugcugacuucucucacccuggucagugaggccguccauauggagcacacucauggcagcaguggucucugaagccauggcugccagcggcacacuucccagggaaagcuuucugcucuaguuuuaugccguagaacuuccuggaugcucuguccaucaaagguggugguggcggcuaugcccgguuugaccccugacccguucucaccuccuucuuugucaucaggaggacaguguuucucagagcaguucugaugcuggccugggcagcgaccaugaaagugacacgcugaccaucgguaaggauucugggguuucuuauucagguggugccugggcuccccgcagcugggcagaguggaggcagaggaggagaggugcagaggcugguggcgcugacucaagguuugcugcugggcugggcugggcuggguggccgugggaguggauguagccuggugguggcuuggccuaacacuugcuggggagcauggggcuuggucuuggggcugggagggcaggauuccagagaacagaugugacuggaagucuggggaauaccuuggggggcgggggaguggauuuagccagaugcuggaugagauguagaaggccaagccaguuggaagggaguugaacuccacaucuaagaauggugagagcccaggagauuagggagaacauuucaauuucccucgagcagugccuaugagagacuaguaccaccaguggcauauggaauaaaaauauagagcugacugucccaacagcuggcuuuuuccaggaagguuucugcuuccacaaacuguuugauuagucaucuccugagguaaaucauggauagccucaucugaaaguugacagaagggcagggucuuauaugcuuucuaaacucauucuguugaagaguccugguacagacacauuagacacaagacacccauccaucacacaccuagugacuaucagugggcuuagguuuugugacguaagaaugaguuaagagacagucuuugcccuccugcuagagacgaauaagccaauggguuuggcaucuuaggacguacgguauauacggggugcuucugagcuguugggaaagggagaagcaagcuggcccuuucuguggagucugugaugacugaacaccuucccacucuggucccugcagaugucucugcuaucuccaaccucaucaggaagcacgugucugaagcccggcugguggaggacauugggcacgagcugaccuaugugcugccguacgaagccgcgaaggagggagccuuuguggaacucuuccaugagauugaugaccggcucucagaccugggcaucuccaguuauggcaucucggagaccacccuggaagaaguaagcucaacaaucccaaggccagagaggccacuuagccuggcaacaagauggcaauagaguugguuacuggaaguuuaaggcauucgcaucuggguaauguuagcccaaguuaaacaauguaagagcguagguagugggagacagcaguguguuggaguguuaggauugcucccuggagugaauaguguuguggccgggugacaacacucacacauaguaaaugacugauaguuaugaccagucgacuggagccaggugcugaacuugaugaguuugguguuuuuguuuuguuuguuugagaugaaacuugacgaacagcauuucucccauccuuugcauucuuccaaaucaucccuuacacuucuccuugcucaccuucaaacuuuggccucguuuauuuuauuaucauuauuaucauuccaaguagcaguaucuguauuuuauuuaagauuuauuuaaucuauuauuauuauuuaaucuguuauuacuauugguauuuuauuuguuuaagauuuacuuauuugaguacacuguaguugucuucagacacaccagaagagggcaucugaucucauuacagaugguugugaaccaccaugugguugcugggaauugaaccaggcucucugucagugcucuuaaaugucugaauaaucucuccagccccuguguuuuauuuuuuuuaaauaauauuuuuacuuauuauuugagacuauauuccagaauauuaauggucuuuuuucaguuccuuccagaucccucauccuuaccucucuaccuacccaacuucauauuuucucuuuuaaaaagacaaaauaaguucaugggaucuauuuguguugguggacugcuccugggugugggguguggccuggaguguggucaguguaucugugucacuccauugguggccuuuguuuuuuaaauauugaaggcucauuaaugaucacagcaggaugagaauuaauaaugauguugauuuaagauuaugaaucagagguuuggggcuucaaagcccagguaacuuuccuauguagcaaugcuucucuuuagagauacaacaucacaagccuucaggccugggacggcuguaaacauugucugccuuggcugguucccaggguagauugugcaguagagucaucugugaugacaguagagauccuaaagcuccugucuugcgccuuugaguugggauuucuguagacaugacuuuuugagcuucugucacaugcuuccuacagaguggucuguaggcgggcuuggaaaucagugacuucauucagauguccgucuacuauaauauuuauuucuagugauaagaagcucauuuccucgucguuugucuugcaugagugaucccagugcuguccugcucaaaggucugggagcacagaccugagaaaagugacuugccucguucucuguagggucagcaugaauuucaucuacacacauaauguacugguuuguuuuugaaagaguugccuggacugauagcugucacacgugaggagauguuuucugccccaaacagcuucucuaaaauucugauaaaauucuuguugauaaaugcagccucuaccuucuuaucuuaagagccuaacgugggauuccauaaccuaaucugggaagugauaacuucuuucauaaaacaagugcucacuuauauuguauccugcuuuaauuucucagauauuccucaaaguggcugaagagagcgggguggaugcugagaccucagguaaccugucugagagggcugcacacuggguaggcuuucuguuggcuguuggagcuaacccccuuugcauuggucugauucaaucccauuguuaguguauggguuugcucugggaagguuugcugucuuacaaauaaauaaaccauaggauuccuuccuuuuccauuuagaugguacuuugccagcaagacgaaacagacgggccuucggggacaagcagagcugucugcacccauuuacggaagaugaugcuguugaucccaaugacucugacauagacccagguucgcacgggcaggaucucuguucuguuguuugaacuugaguuugucuuuuauguguuucuuagcuaucucuuugaucgccuuugguuaagaucacagauucuaacagguuccaaagaaaaguggaaaagaugagagagccccuuuuccaauguggcaugucuggucagacaugaagaaacccucccuuaucacaucaucuaauagaagguuuucucagauggguaugagaagaugacccauccaugcucugaagcuguuuauauugucaucucuguaggguaccaguuucuugcacaccuaagugcuuaaguguugaaugaaaguguauugaauggguguuugauuuugaaggaauaaaagaggaaguuguguucuuugacauguauauuuuuuaaugacugugcccauaugugguugagacggagaagggcaguaugaaaugaaacgaauucguagacuugucuaagugccucaguuagcagucauuaguuucagacaaggauuucuagacaacuuuuggugaggacagaaaauuaccugcuuuuaugagucugccuuuuuguacuuacuucauguuucauugucaggacuuagauguuuuaaauguguucacuuuuuaccaugcauauaaaagauagaagacuaauaaccaucaugugccagccuacgugaauuccaguucauggaauugggcacagcuugcuucuguuauuugugugcacaucuuugcuuguccugagggaucuucauucucugugcucaucagauguugagaaauauaacuuugaguugaaaguugaguuuuucaagaaaccuguuuacuccugugagguacuggaggcuucaaaccccagcuuccaagaugacuacugaagcuaguagaggaaagaguagagucguacagagacaggugacacugauuauagccaacccuccauuugugcugcuuacagaauccagggagaccgaccugcucagugggauggacggcaaaggcuccuaccagcugaagggcuggaaacucacccagcaacaguuuguggcccuuuuguggaagaggcugcugauugccagacggagccggaaggguuucuuugcucaggugaggugugcugggcucugccuucuuggacuggugaagacaggcuaggacuguggucaagauagagaugcugggccaguaugccagugauuucccugggcuucaaauucuucaucugaaaaugagcggggauguguggcuguuagggggaugaaacgaauuuauuuagaauggacuuugacauuacuuggggagguggcuauaauuuagaggagaucauggcagggacacaguuuagacaaaccaguugggaaaauucaacucucauaacaugagagucgccaugcugaguugugcuuggcaguguacuuauuauuagaaacaugguggguauguuuuucucuuaauugacgagagcgagagagcuaggaauggaacaggcccauugauucccccauaucacaguuugcaugcugacuuaucaguuaaagacagcuauaaaguuacuucauucuacaaaaugaagaauuauagagaacacguccaugaagcccucccugcagcccaccugggcaacacuaacucagagcaugagcaugaagccugcagaucuggauuuggaaucugguucagugaaucacuggcugacuucccucagauccaugaugcucuaguuugugaauggugauaaugauacuaacaccaccaauaacuacgaaauaggauauuaagggggcugauucucacuacaguacuuuccaguggaauuauucauccagugauaauuuucuauauugaaauauaggaauauuaaaaucagagugauuguuuggauucuuauggcucuggggauggaaucccagggugugugagcucucuacuaccaaguuacaccugcagccaggguuaccauugaaucacugaaguuuuuaaaggguaaauuucucagaaaggaaggaagagaucccuuagcugacccauacauuauguuguuuucagagaagggauauaggaaauuuggggaauuucaaggaaagauuuagauaauuaugcuuuucgcagugcucauaggagagaugcuggcugcugcugcuucuggcgggggaguuggugucauguucucaguccucagauuuacugaugucacauaggaccccugcaaguggagauggaaccaggauucagucuccuggcucccaguccagggcuguucagccuucuaccugagucuaugauccaggcugguuuuuccucagucuuuggaggggagaaaggauugagccuaaagagucagucacucugacucuuuacucugugacauucccagcuuuugccucuguuaggugaccauagccucugucuuugugcuguuagcauccggaaaugccuugggagaaaggggcuuaauuuucagucuccuuucucuucaagcugccagaaauaccuugguagaacucagccccaggccuugccuguauuccucauuccuguguugcuaggcuauggggcuggcuagacuuucaggggcuugcucuucaggcuucuaaaaacguguccuauugucucuucccucuccaaugccuguuuauagauuguccugccagcugucuuuguuugcauugcccuggucuucagccugauugugccacccuuuggcaaguaccccagccuggaacuucagcccuggauguauaaugagcaguauacauuugucagguauguuuguccuuugugccucagggcagagaggguugaaacagaccaacaguguuucguauacugagagccaaggagucagaauccacaauucuacagugggaugggucuugucaugaugguucaggcuccuauacaagccaauacuguagcaaagaacaauaguaaacgauacugggaaauacaggugaaucucugcugggcauuuccccuuguauuguuaggcucuugucagguaugcuuuaauucacuaaucaguaaaucuuucagguuaggauguuagcuaagugugcaucuucaggcaagaaugccccuauuccauacugauccuguuaaaaaucagaagauaggggacuuuugagaccuuguuuaguacagguuuucuucaguucugaugcacggguaggucuguagaugggagaaaguggcaguaauauagagggacguuuuaaaaacucugugugaauguguguguaggauauguauagaucauauauagauuguuuauuagccucuauugcucuagcucacuuucaucuccuauagguaaaaguucguucgaucccuuucuagccaaugaccuagcauugcccauggcuacagaucaugacauugguuugugcucuaggcccauuauuucuuggacuuuuuaauugugcauaccaauaaucaauaaaaucuuccugucuguucuuggaauauccuagcugucagugucaagugguaauuaucaaaguaguuuugaaauacugaucuucaaugauuuuuguauguguguguguguguguguguguguauaugcacaccuucacauguaaucucugcacaugcuucauuggggacacuguaugucacccugauggcagauguuugaagcuccuugcagguggcuuuuguauauaauuuauuuuagucuuagaagcccauuccucagaaaacacuuagcagagcguuuucuguaggaacuuuuccugccuccaaguccugguuuggaugagcgacugaccuggaugucucucuuguaucucuaguaaugaugcucccgaggacaugggcacccaggaacuccugaaugcucugaccaaagauccaggcuuugggacccgcuguauggaaggaaacccaaucccgugagugacacuucagccuugagcugccuucucaugacggccgccggguuuucuuucuggugguauugccuguuucauugugaccacugucagguuuuuuuuuuuuuuucagucaauuuuuauuuuaaaaagccagaggauaaccaaaucaauuuaggaacaaauaaacucuucuagcacccuguacaccaaaucauuaccaacauuuguuuacucugcuguauguugauuuuaaaucacaguguucacuuacugaccaaaugcucuccccuucucuccuugaccccagcucccauacuugcgugccauaguagacuggugugaaguuugcaucuuugcguaucaguuucuuuaaccaacagagaugacauacugauugcauuuuuauaacaacagagacuuuuuuuguacaguugcauauuuucaucaggacuaguuuuaaaaaguagguaaauaaacucggugauaugcccaguugacucucuauguacugaagaagcaagucauugggacacugugguuaaaccaguggagaggugaggugcagugaacuggagcuagaagacuuagcuucaaguuugcagguccagagagaauuuaugccugagguccauaugcacgggcagugcgagauagcuaaggaacuguggagaaugauagagaagcacaaaaaggaacauuugaaucccaaacggcaaaggugaagauggccagucugugucagagcacugaauccgauggcuauguuuauaaaaaaccuagcagauuuggagaugaauauuucuguguauuugucaguuuuuaauuauuauuuacuuaauuacuuuucuauugcugugauaaaacaccauggccaaggcagcuuauagagggaaggacuuugugggggaggggggagaauuacaguuccagugggcuaggaguccaugagccucauugugaggagcauggcugcaggcagagggauaugcugaggcagcagcagagagcucacauccugauccacaaacaggaaacagaaucuuuugaauggcaugagucuuuucagaucucagagucugcucccagugacacaccuccuccaacacagccacacuaccugauccuucccaaacaguucuaccaacuggggaucaaguauucagauaucagccuuugggacgguucaaaccaccacaguaucagaugauguguuagacaauguucugucccugagaaaaucaacuuaugaggagcagagguuuauuggugacuuguggugucagagcuuuugguucauagcuaauuggcuguguuguuuggggccccuuuggggucccuaguuagguagagcaucgugguagggaucaugugcuucccuacaauauaauagcugcuuauaucauagaugccaagccagggagcaaaagaagaggaagaaggcuugagguucuaugauuuccuuugaguguguguccccagagacauaucuuacuucucuuagguccugcgacuuacauacaggcucugucagcacccaggaacaccacaaucuagggaucaagccuuuagcauuugagccuuuggaaaauauugaagacucaaaccauaguagguaguuacuaaauauccuuaguacuuacuagaaggacacagcuucuccuuaacuucaccaaaaaguuaagauuccaugugaagguuuuguaggaaaggaggaugagguaagaugauaaucuggguagcuggguccuuuguugguaagcugaauuguauggauucggggauugauuccagcaaaggccagaucuauaggagagagaacugagccgacagcuggccugcagagauaaaagaaauguccaugacaucagaaaguaugugugcugucugugcaccauggaugcucugcuggaagcagucugaaaggcagagccucaccccaccaucucagacugaaauucaaauuuuagguuccuggggaucauuaggauagagaauucugacuaaguugcuuuuucaaguggucuuuaguuugucucagccuguugucuuuuaaaggucuuagguaugaguuucauaaggguaaauauuuuagggaagaggcuuuaaagagaaaaugaggaauuauuugcguaaaaagcacuugugugcauauuuauaaacacacacacaugugcacagaccugagguguaaagguugugucccuaguuuaaauuguggaaucuugaaaauuggaaauauggaagagaggcuagaaaugagacaucauuuuauacucuuauuuuaucaguagggauaaaugaacccugagauugcaagggacuugugauucgcaccaaacagucagggcccugcguugucucugaggaugcugguagacaaccuccccuuucauacagugaccauucccacuccacucagcucaagucucugcucauuauagaacaucauuuggaucuugccauucuccacaagacuuugaacaugcugagccuaagauacaagcuccuaaccaugacucugucauggagcuccuccccucuucccuccucauugucugagagcucaucucauaaccuucuuguuuucaucaaacacauacacucauuucuuugcagagccuuuguaucugacugcccacgggugcugccuggcauguucauucuccacuguucuuuuaaaauuaauuuauguuuguguguguguguguguguguguguguguguguguguguaugcaugucaugauacacaugaagaggucagaguauaacaagaucgagagauugaauccaguuuuggcuauagguacauuuauguaccaaggcaucucuccagcccauuaucucaauucuuuaacuagcugauaguuuuuauguuuugguugaagcugacucaaaggucugcuuucuccauguaccuuccuguuguguuugcuuuaucugggguuauguaagauuggauuuguugacuuguagucccugaagaauccaugaagucagagaguuugcauugcuuucuccagacucccaaagaugcagaacacugugcagcccauaguggacucuucugugugucgugucagcaaacugguuagcuggguugagcagagcucugcgugaccaucuggagccuguucacguccuauuuuccuggguuuucugugauucccagcuuccacaggcuucugugagagcaaacauaaugaagucaagcuguuuuucaaaugguaggacuaggcacauggguccuuucuaaagagcaaaccugagcucuaagagcaucaaggaaagacaggccccuuucaggagagucuagaacauuugcuaucuccuuuuacagagauaccccuugcuuggcuggggaggaggacuggaccaucagccccgucccccagagcaucguggaccucuuccagaauggaaacuggaccaugaagaaccccucaccugcgugccaguguagcagugacaaaaucaagaagaugcugccugugugucccccaggggcaggggggcugccaccuccucaggugagucccugucggcaugacugagaaguuggcucaggguaggaccugggagccucuguguggcagcaagaaugagugacaugugaagucacucuugaucucucuugagaaaagugaguggguuuugagagaggcgagugagcuacauugugccagugccugucacagagcaucuguaggcacagcuuccuuuccuggugcugccacagugggagcugcuggcccuguuaacucuuugggccuguguuuucacuucagaguaaaugggccacaaagcuuagguguaucucaucaacucugacauucucugggcucugagguuuggagggagaucugagucugugugugugugugugugugugugugugugugugugugugugugugugugugguguuuuguuuuuguuuguuuguuuccccugaaaauuucaggacaguagucuagguuggaggguggggacagggaacuuuuaguggaugugaaaacuuaaggaagucaugcuugucacuuuaaaaucaucuggcccacucaccaacaugacucgaaaguauagaagaauucauugggcaguuuaugaugcucuuccuuaaguauucaggugauguggagaaucccaucuagauauucaagugaauacuuuccuggagauaauuuuggcuugguaugagcgagggacaagugccaauggucuugguggugacuggcugagguucuugcguaggcccugggguccuauuguuuuugucuguuuucugcccugauucuuaccuguaugauacgugagcuugguuucuaugugaugacagagaaaacagaaaaccgcagacauccuucagaaucugacaggaagaaauauuucagauuaccuggugaagacguacgugcagaucauagcaaagagguaucguccuguugaaaccuggcuugcugcagauguagacuugagcgguagggaaauggacaaucauggcucugugggaaauuuagcacuugauaucaguuagacaagaugauacgggggcuugugagccuugaaaguucagcuuagagaacgaggcugccugcuuuaggcugaaaauaagugacaaauguggacucagauuugaauucugacccauuagucucauaacaucuucgcuuauaugaauuuuaauuuuuauuuuacauuugauguuaguguugcacucuuaaguucguggugagggguaagagagaugauacgagcaaaagccuguagauccucuuuccuguauggcuccauaaacaaggucaggguagacacaguagccuuucuuucauauggagccuuuaaagagacuuguaaauuccugggacauggucauauagugaccaauauuuagucagugugcagagaauauguuuccuuuccauaaguauggucagguguccgguccauaauguuugaacuaacuuuaaaugacaaggauauaauagaauaagaauaggccaugcauuucucagagcuguaauguugccacaugagagucacaauaaacagcauuuaguucaguaauaucugggaugguaaugcauuuauuugugugucuguuuguuuuagacagggucucugggucuguaaggcauuuauuuauuugucuguuuacuuaagacagggucucacuacauuaguccuggcuguccuggaauucucucuauauagauuaggguggccucagacucauagaguuucaucugccucugccucuugagugcagugcugagcguaaaggcauguaccaccaugccugcauguaagguggguuuuuacauuggcuuaauuuacuaugugauucucauuagaguaagguuucuaagacagcagacaggacaugcugagaguggccuuccuuacaugcaugcaacucuacagcacuggucauaggccuaguuaaagaagugcccguuucuaugcuuuguccucaaguaaaugauuacuguugccucgucacuaugaccucugcuuucuagaucugauuuuugguuugucuuuucucucugcagcuuaaagaauaagaucugggugaacgaguuucgguaagucagucccuucuccccauucucccugagucacgucaggucucaggagaaugauuuagauguagggcucuugaaucaagacagaguuacagguuuggggacuguugccuugugcacacucuugggugucaccucaccuugagggggacuggggugcugcagaccaacacaccaaggcacgguuauaguagacucacuguggaauuuguguaacucauucuucacuccggaggccccugaaauauuugauacagugauuuccuugaggaauuucagaaaucacucaugggccucuugagacuuaagaaaguaaaaugucaugaaggaaaaaaaaaccuauccuagcuguauuuucccccagacagauucccaagugugcccagggacucaaggaaaaccuuucaggccuuucauaugaugugaggucuugguggaaaggaaagacaucaaaagcauuuguuuccacccuguuuccacugauuuuucccuacuggauuuugaaggagcaguugagaguagggaaggaagcauucuugaagucaugaguggcccauguggcuguuccaaagaccucaaagguuuuauucucaaauuuccauuuuccacccugccuuuucuccaggggucaggucccuggagcucugagcagagcagucauaggcuuacuuaaugccagggaagaucaccugucugugaucccucccugguuuucaagacugcccaucuuccugucuucccgccuauagcaugggugccuaucauuagcucuaggccuucccuacugggcagcaauuuugagaauuaagauagcuagauuucaccaggggaggcaacauguaccuaucuuagccaaacguugguucuaguuugaaaaagagguggcucuccgagaaccuuguacacugugcuaucugcugccgugaguaauggcuuggguauggcuuuuaauggcgagccuuucuuuuagguauggcggguuuucccugggugucaguaauucucaagcacuuccuccgagccaugaaguuaaugaugcuaucaagcaaaugaagaaacuccugaagcugaccaagguacagcauccguccagacacgggucagaaaagugggucuggggccuaagccacagcagcagcggucgccaucuugguccgggacccgccgaacuuaggaaauuagucugaacaggugagagggugcgccagagaaccugacagcuucuggaacaggcggaagcacaaaggcgcugaggcagcacccugugugggccggggacagccggccaccuuccggaccagaggacaggugcccgcccggcuggggaggcgaccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccuuugugggccggggacagccggccaccguccggaccggaggacaggugcccgcccggcuggggaggcggccuaagccacagcagcagcggucgccaucuugguccgagacccgccgaacuuaggaaauuagucugaacaggugagagggugcgccagagaaccugacagccucuggaacaggcggaagcacagaggggcugaggcagcacccugugugggccggggacagccggccaccuuccggaccggaggacaggugcccgcccggcuggggaggcgaccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccugugugggccggggacagccggccaccuuccggaccagaggacaggugcccacccggcuggggaggcggccuaagccacagcagcagcggucgccaucuugguccgggacccgccgaacuuaggaaauuagucugaacaggugagagggugcgccagagaaccugacagcuucuggaacaggcagaagcacagaggcgcugaggcagcacccugugugggccggggacagccgaccaccuuccggaccagaggacaggugcccgcccggcuggggaggcgaccuaagccacagcagcagcggucgccaucuuggucccgggacuccaaggaacuuaggaauuuaguaugcuuaggugagagucuguaccaccugggaacugccaaagcaacacagugucugagaaagguccuguuuugggccuucuucuucggccaggaggagguccaaauacaagauaucugcgcaccuucgcuguaagagagcuugccaacagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuggaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuacccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaauaaaauaaagucaugguaaaaaugaaaaaaaaaaaaaaaaaaaaagaaaagugggucuggaauugcuggcacacagguguagugauacuagucugaacagguuuguauacaaagcaguucagauaaaccagacuacucauacccaacacacacacacacacacacacacacacacacacacacacacacgaacauacguuucugaaaguguaagucaaaaaugaacucagagauuaaaagcucuuacaaaagccaagcugcuaaguuagcuagugggcaaaauaaauugaauuucaaacaguuuccuaaaacagccauuggcuagacaggaaaugggaaaaaugaguucauucacuuuccauguugguuggcugggcuuuaagagcagcuaaggccauauuuauuucucccuaucucagguugcccaaguugaaauggucaggugauguggacucugggguuuugcacaguagucaugggccuagggcgcuuaagccguaggaugcaucugcaugaccuauggguuuuaguucuugggaugaugccaagagacucugaagaaucuuggaaauuuaauuuacuuucacuuaugaguauagguggcuagccugcgugcauguuuuuauacuacguguguggucugguacccacagaggccagaagcguauauuugcucccuugagacuagaguuacagaugcuugugagcccccaugugggcgcugggaaucgaaccuugguuuucuggaagagcagacuguccucuucaccucuaauccaucucuagcuccaaauucuugggauuauuuguguauuuauguauuugugugugugauuuagguuaugugugugugugugugugugugugugugugugcgcguuugugagagagagagagagagagcgcgauuuuuucccaugacuugugacuucauggcaacauuaguacgguggauucuagugacuuggugcucaggaacuacauaugcauuggcuuuagauuuaauuucagugacugaagaggaaguugucuugguugauacagggcugucucauugcuugcugucaccccuugugugugugaacagacaccugaggcaggauucuguuguuuacaggacagcuccgcagaucgcuuccucagcagccugggaagguucauggcagggcuggauacgaaaaacaaugucaagguacaccccugccuguguucugccagcuucuugcuaaacaauaaucccguguuccuugaaaucuuacgggcaaguaacuagggacauucgugguagaaaagggcaaacuguuagucuuaccagugacaugauucagcauaguuagugacuaagagaauguguuuugccaccagacguaacuuguaaacugcuguggucuuugccuuaagcuaccugaccuguuuaaguauccguuuccugugcagcaggaaggcggcaaccauggcugccucucacucgauguggguaacuaguuaaaaguguaaaggucuucaccuagucccucggccagugguugguggauccugaaucuauaaugcuuuuguuuggugugucacuaaguuucugaaguuuccaugcacguuuugugcauauacgcuuacuucuugaagaacaguuuggcaguauuaccuugaguuuggucuguuuuacuucaggugugguucaauaacaagggcuggcaugcuaucaguucguuccugaaugucaucaacaaugccauucuccgggccaaccugcagaagggagagaacccgagccaguauggaaucacugcuuucaaccaccccuugaaccucacuaaacagcagcucucagagguggcucuguaagugugucuaaagggaugggcgugaagaccuuagggugaccgagcaccaggggaaaagaccgcaaagcugguuguaacagcuaguaauaauuauguuguaugagccugaguugauccagacucugggcagaaaaugauugguuuaugcacugacuggcaaucuuucuugacuugaagaaggaagaccagauaugugaaaaucaucacauugauaaacucacauguagggaauuaaaauuguuagugaaauccaagaguaauuacuacuucauuugcuugaaaaugagguuuuuaaauucagugaaacaugcauuuaauaguuucuuucuugaaacauguguaugcauguguggcacacacacacacaugcauguguauacuccuguacaugucugcaaauuuuaaagucuuggaauaaaagaaucuggauuuaacuuuggugucuaagcuuuauagguauguaauauuagaugagguaauuuguauacauuucgucagccagcacccagcacagaguuaauaaucaguauauuagauccccucuuggauauguggggaauggcacuuuacuauaaacuacuguagaauauuaauguugaucaucaggaucuuuacaagacguuguauaaugggcuuuuuguacauauuagaugguguuagacugauauguaauauguguguguauguguaauuuuuuuaugucuuagccugauauauguauccuguugcuuuccacuuacuuauaguauagucauaugauuaacuuguaugacuaacuuccagauuagauuucuuucuuguuugaaauaguuuccaagccacaccuucuuuguauaugggaguuuacaacucacuacucuaagaucagaaacuggagacaaaugaccgcuauuaggccacaccuauacuuuguucuguaguuucauuaugggaguagacccauuuuaauauuuuccaaaucaguuuuagguuugaguuguuguuguuuuaacguuacuugaaaauaauuagauggaccccugagauaaaauguuuggcgacugggguuuuguuccagcugugccuugguuguccuuaugucuagcuaauuauauaccauguccccagcugcaucaaagguuccucugaucuuuacugucucuucccuucuaggaugaccaccucugucgacguccucgugucuaucugugucaucuuugcgauguccuuugucccugccagcuuuguuguguuccugauccaggagcgugugagcaaagccaagcaucuucaguucaucagcggcgugaagccugucaucuacuggcuguccaauuuugucugggauauggugaggacacaggaccuucuaucucugugugaaucucaauggggacugugaaggcauggggcuaaggaaaaacagccugccacuaaccccgggaaguaucccacuuaguguaaaccaguguaaaauaggaaaaaggagagcccgcuggauggccccaggacaccaaacauaauguuagccuuaaaauguaauugcacaccaugggaccaucugaccaccgugacuacaauuauuaccaacgauuaccuuacucucuagaccacaguucacuaucaaaggcaaucgggauaggaagucaagcagggcuggaaccugaacagggagcuacugcagaggccauggaggcaugcugcucacuggcuugcuccuagugguaccaaggaccagccuuggcuuggagagggguucugaggaaggagugucugggaguggugaaaacaaaggacuccaagcucugcuagagacagcuuuccaagcugcuuucucucuguucugcauucuuucucucugaucugcuuucucuggagaucgaucuucagacaacacacacacucucuagacagcuguuucuugcuauucucugcugagacaguccuuucuuacuauucuaaaaaguucucuggacaaugcaucgcuugcagaucauaagcccagucuuuuauuuuauauaucaauccagucauuugcuccacguucccuuuugauuauccuaggaaucagugacccagcccuuugauucuuaggagacagcaacccacauguccuuuuaacauuggauucagagauuugccuaccuuuguuaagcacaaaggauaagcuagcugggugggauccgguccacugacccugucccaggagcacguguucccaucaaggcccaugucggaccagcaccauggcuugcucagccuucuuucuuauagagcccaagaccacuaaccuaugguuggugccaccagacuugggcugggcccucuccuaucagucacuaauuaagaaaauucuauacagccagaacuuauggcugcauuuucucaauuuaguucccuccucucagauuacucuagcuugugucaaguugacauaaaucuagccagaauucccuuuaaaaauuagacuacaauuagacuucauaaaaacccaagccagaacuucuaacuuaucugauguguuuuaacuuagagucaggguguuuuuuuuguuuguuuguuuauuuguuguuguucuggguuuuuuguuuuguuuuguuuuguuuuguuuuguuuuguuuuugccuuacuaaggaagccauuugccacugaaaacuccagcaucuugucugcccauugucguuuaucuguuuuguaucaacuauacugcauuguuuucguuuggaucaauaugaacgacuucauagaaccaugaagguccaauuauuggcaacuauacgcccuuauggccgucauuaauucagagcagaucuaacucuuugcccaauaaacguuucccccagacguuuaaaggcaacucucaguaaagaaacuucucucgaagacgagaugguaucugagagcacccggguucucuaagacacuguacagagaugcgugaugaugacggagauaaugaaauugcauaugcuaaucaagacaagcucuaagaccugccagucuccugaucugaccacuccaucuaucaauauuccuuuccaaaagcaaagcccugaauuaacucugaguucaggcuguggucugaaugguuccgagucuagaaaaagcuaaucuuuaucuaaaguugcccugccuuauuucuacuugguaaugaaacugaaaccuauuuccugugaacuguuaaucagggucuuguucauucugugcuaaugcgcagaaucaacuuguuugaaccuaaucauuuuuuuuaaacugcuauuaaaacuggaucuugucagcauuucuuugcuuucuuuuaucuugacguagcaauccauucauuuaaaauccgcugagugcuuacugcguguuugauggugucuugcugugcuaggcagaggucauucagagauggaagagugaguccuugaccucagggacaucacuuggacucugugaacuucugacccucccugccuaagagccugcagucugcugcaagcauguggcuauuggagucguugauaaacacauuaagcagggugggacugagaccuucugaagcuacaauucuuuuacagucugccaauccacuaucaccuccauuccaugcaugugcugccccccuccaccucucugccagcuaugaauuuucauaauugucccugggucaagucuuuauuucuucauuuuaaugcuugaagcacugucaggacagacuguaaaauuauucccggugugaugaaacaauuuugacauucauguuaugagugcuuaucucacaaguagauuacaugugggauugaaugcgggcagaccauaauauagcauuaaugaugaaacagacgcaaucaucucuggguagaauaauggaaacucauuugccuccugugaaauugaaaugacucugccugagaauccauccuucaguaaguuuacugagcgugacaccuuggcugagcucugggaaagacagaaagggcaugcaguuuauaaaaucagccaaggguaaaaugcuugucaaacuguauuguccggaauuuugauuaauaguuuauguggcuucauuaauucaaaguuauucuccaacaucuguaucuguccuuucuugugggaugguggugaagacuugggguuuguuguauaucugacuuaggggccaacuuuuauuuucucuuuuagugcaauuauguggucccugcuacacuggucauuaucaucuucaucugcuuccagcagaaguccuauguguccucuaccaaccugcccguucuagcccuucugcucuugcuguauggguaaggcaacucugaguggagcucuccccccaggggacaaggcauaugguacccggugcuagagggagggcagaaggcgccaguggaugcuuacguuugugucucaccagguggucgaucacuccucucauguauccagcauccuuuguguucaagauccccagcaccgccuaugugguucucaccagugugaaccucuucaucggcaucaauggcaguguggccacuuucguacuggagcuguuuacaaacaauguaagugucccauugggcagagcaugucccauuggcuggcacucuggguucaagagaguggcaguugucuccaaccuuacuccacuugccuguaacauccacaccacugaccucucugcuuuugcaagcuguguccauacauauaacucucucucuguccugcugugccuuguauuucucuggucaagucuuucugguuccuuuauuuuuucauacuucuuucuccuucaguguugcuuuggaaaagacuguguucauucucuucuggcuugcuuuccuauuuaggcagcauuucugggcgaugccguucaucuucaggccuuuaccaucauugcagguuuucauuuuuaucucucagauccaugcuuugauugucucuuggaucucuguucuccaguucucacagccuauuggaugacuccauuuaagucauuuauagguaccaacacuagacacauugucuuucccacuagaaccuauugguccucuugccaucucuguuuacuuggugacaucucugcaguuucucauaccucucuuggacccauccauuuguguugcgguuuauauaugauucaucugaauucucccaguuucaaaucucauaaacaagacucucuguggcccuugcucagcacauagugccuuguuggcuauauauuacuguauccccucccaaugcuuuaaaauuucagcugaguuuucccuuaaaccacuauacuccuguaggucugucuugaaaugcccuucauuugucaugggaccugagagugucuccauacccuuuaagauuuaagucuaauaugaagcuuuccucaucugcccaguaagauauaagcuuucuuuucucuggaccaucagagcccucaguucuuccuucagugcaguguaagcauccuccaggcucuggcucagcacaaccagcaaguaacaacuuugcuggaucuuuucuauuuuuauuauaugugcauuggugccuugccugcacauauuauauguacuccaugugccuguagugcacacagggcccacacgaaggcguuggauccccuggagcuagaguuauagccaccugugagccauccuguagaugcuggggaccaaacccugguccucucuaaccacugagucauaucucuagcuccaggggcuugauauuuaacaaaccuugucuuauggggucauaauacauucugauguaauugagaagauggcuuugaaauuccaacagcaugcugaaacucggauguucaccuagauaggagugaguugcuuuaaaaaugcuaagccaauguuucauuguggauuugugucugguuaaaaguuaccaggcuuagagguuuguuugcuuucaaacacuaucgcugcagaguuccugaggaaaaucccgccgcuguucacugguaucugcauccacagguccaggacgucagaugcuuugcuucaaguccauauuuuagacuuugauagaauuguaauguagacuguaagugaugugugucucucccucucccucccucuccuucucaucugcagaagcucaaugacaucaaugacauccugaagucuguguuucuuaucuucccacauuuuugccuggggcgagggcucaucgacauggugaagaaccaggccauggccgaugcccuggagagguuuggugaguaaggcagugggaagcuucgauggcggugugacaguuuuguaggcaucggcacucugauugcugcuuuagaagggggacugggugcaggccaucuguccucccaacugucaugggccaaugccaacacagcugcucugucugucaugagucccaccauauagguguguauucgugccucugauagcacugagauaaauggcggguguggggggggggguuguaaacaagaaaauccuagcauuuguuugagauaaauuccuaagcucacuacuggugagcuugucaaaucacuggaaaaaucaagccacagcuuuggcaaguaggugaggcuggagauuaaagagagagagagagagagagagagagagagagagagagagagagagagagagagauacccuuugauucuacuaagaaaaccugggccugcaggugugcucauauauuguguuuuaugccuucucuaaagagauaauuuauugaaucuuuuuuucuacuuuuauaaugguuaaaauaucucuguccauuaugugacuauuauucauuugcugauuaauugaguuaauuaaugcuacuuaacaaacauagaagaggaacauuuucaguuuagugauacagaggagacaugaagaauuaagggauauuauccuaaaaccaucuaacuuaagucacuagguuacauuagauacuguagaaauagacaucuuuugaaugcauuuucuaauacccauacuuucugaccccccccccaaauuauccaggauuauuggucaacccaaacuugaauuguuuggguuugggugggggcaugucucauuaaaaaggaaaucuuaucaauccuaaugaacuuacagaucuaaaagcuaauugacuccgaaauucugaccugauaccagguuguauuauaguuuuccaaaugaaaucucaaaguagacaccuauguuacuccuuuuucuucuugucaugagucauguuucuagaaaaauugugugaaacugaccccccaaaugaggaaauccuuucuuccuuuccucacuuuccuuccccucccucccucccucccucccucucuuccucccauccuuccuuuuuuuuaauaugaaggaaguccuuuaauauuucaagugugaaaaaaaaaaacgaaauuuuacguuaagcuagccuuuaagguuuagcauaauauuaacuaauuuaaaugaaaaagcauacaaacaacaaagucacgcacagaaucucaucucagaaacaggaaguagggccaugauuucugaugcccgccccucugaccagauuaugucugcauugugucucacaggggagaaccgcuucgucucuccgcucucuugggacuugguaggacggaaccuuuuugccauggccguggaaggggugguguucuuccucauuacuguucugauccaguacagauuuuucaucaggcccaggugagcuuuaucugagaacuguuccagggacgugaugggugcagagaggacucacgaguccugggugggcugaacucgcccaguuaaagggauuuucccagccgugagcaugcucuguccacccacgaagugauggcgcggggccuugauaaagugcuuuagaagcuugaauuuucccuuggaaaagagcugaaaagauugacuuuucuuaaacacucuuucucccaagaccuguaaaggcgaagcuuccuccuuugaaugacgaggaugaggaugugaggcgggagagacagaggauucuggacgguggcggacagaaugacauccuagagaucaaggaacugaccaaggugggcagcgacuguggaccccacagcuucucuucuguuuucugcauuuuaucuccucacuagcuuucugcugaauugcuucauucaugacaacaaaacaaaacccggugcuuccccaaaugugccucuacacaaagcuuugucaguuuuacuuaaacuacaccacggagacuucuuaauuaaaaaacaaaauccuacugggaauacuucuguaaugcaguucccacucuucagauuuauuuauugaacauacuugcauucguguuagugauuaaaacacucuaacauuguaugucgagacaaagugcagagaacaaauaguugauuuugauuuucauggcucaaagauccucucuaccuccguugcucagagagacaaucugcuucgacccuuucugaauaccacgacccucacauuuuaguuuauggugauugaaacauuuuauuauagauuccaaccuacauaauuuaauuuuaaaauauaucacugucuuuuaaggaaaaaagacucaggaauaaaaaguuucagggucagggaaaggcuacucauugcggagacagagaaagguucuuggcacaucuguguguggugcagccauccgaugaguucuguucuguggggaguguggcuuucagagccccuuccuccacaguuggcugggagagcccagagccuccaaggugcaugaucucuguguuuccuugguugcagaucuauaggaggaagcggaagccugcagucgacaggaucugcaucggcaucccucccggagagguaaaugcacugcgcuccuguuguguuuugucucuauuaauuccgacccuagcuaccaaaccaaacaacaguguccuguaacuauggaaaauggcuuuucaaggcuucuguuuuugugucugugagaagcgaucagucguggagagaaugagaaccucuugugucagaacagaacagguuuggacgcucucaggcagugucagaaaacauucacaucuagauuacgccuugggggauccauucagggaugaauuucaaguaggguaaaauguagauuuucuccuuucacguauuuuuuggacuucuuuuauguucuuaggguggaugguagguaugcauuuugaccauuuggcuuuuuuauugcucuuuauagauagaccuuggucucaacuugaugauucagucuuuauaaaaaagacccacaaacaacauggcucauacauaaacucucuccucucuccuucucuccuuccccaucuccucucugucauacacacacacacacacacacacacacacacacacacagagagagagagagaggcaggcauacaugcucucaugauaucugaauauggaacucauugguacuuaagagugaagcucugggcuccauggugaagcacacccaggcccagggggcugguucgcuaggccauucagacuaagauuugggaguuuguuccugccgcucaccuagucucgcuuuucagugcuuuggacuccugggaguuaacggagcugggaagucaacaacuuucaagaugcugacuggagacaccccugugaccagaggggaugcguuccuuaacaaaaacaggugggcaaagaagcagccuguauuugcugccgagguuuucuuucuccagccuuaagaaauaaauguacaguuauuuucugacuaucuuauuacuauagcuuguaaaagcauugaaguuucuugaguucaaaaccucuuaaaaucauguccaaguucacuaccuggaaauaagccugauuuuuacauuuucuuucaguuucccucuuauuuauccauaauuuacauacauauauauauaauuuccuugaucugagagaauagaucugugauuuuuagucaauucauugaauuacaugaucacagccaaguucuagagcuaucccuuggcuccgaucuguuaugcaucuauaugugccauaacagagcacagcucuauauagacuuugagucuauauuauaaauaguuuuauaaugaagauuuuacaauggguuacauauucuaaaaucuagaaacucuaccaaguaaauauguuuauuugaucaauucauuauaaauguugggcacuaauuaguuucucuauucgcuguuuaaauauguccuuguagauaauuucuguuauuuccucagaaaauucccuacaugguaaaagggcauauaccuguuaaagugcccucuguaaaguguguaacaauugauaaagacaccauuaagccauuuacuaaucuuuguggauaaagcuauguaucagagaccuguuaggugguauuuucaauguaguacauauauacagacacagagguacacauacaccuaaugaauuaaaauggcacccaccuacuguuacuacuuguaguuuacccuaauaguucauacacuagugugcaucaugccauuuaaaaauugcuggcugugaccuacuaaauuuauuucacaaccuaguaaugggagauugcucacaguucagaaacauugacuagagauagucaauauuauuguagagucagaggcauaaugaacucauccaucuucuccugucucuuacugacuuauuuuucaguagcaaucuacaggagccuuaaaagaauagaaauucugggaauagugaugacucccuagucugucuaguaccaagcuccuggaacauguagagagacaauaaccguccauccuaagguuuaucucagcuacugauuacauaacugacuuggauaauguagcugugagagagagccaggcacaauguccauggguaccuuaguuuuaagucuugagaaggcuaacccaagaauacuaaauaagcagaaaggacuguaccuauaugucaaguucauggcuaucuggaggugacugaaaggcauccaucagacuggaauaugaaugucacaauuuuuagauaauagcaacuauuaguuugacaggcuuuuuagaaccuagagguugccccuacggauuuaaguaaaauuauuuauauguguauuuuuuccuguuaacauauuagaagaucuauaauuaauuaaauagaggaauaaguggcagucugcauuguauauuugguggaauaagaacguuuggaacaugaauguuccaaaucaguaaauggggagcagaaggcagcaagaacccaggcccagcauuucugggacuuacgugguacugcauggucuuaaggaagacuagaguauagagacacuuguuacauaugaccagcucacagagucagauuugcaguggaaacuuaauguugaaguuccagauuggugugacugagucuguuggcaaagcccauauugcaguuguauagacucauuuugaugcuggaccaagcaugcagggcugagacaggacccuacugauagaaagaguugacauccuagggacagaaagguugguccucugaauagaagccgguguauauuuguucuauacaagcauauauuuuuaagaacugucaagccagauugucuccucagaauaucucuaaacacuuaaaaccugacugguccugucuuccuuacagcaucuuaucaaauauccaugaaguacaccagaacaugggcuacugcccucaguuugacgccaucacagagcugcugacgggaagagagcauguggaguucuuugcccuccugaggggagucccagaaaaggaaguuggcaagguauuguaggaaccaggaaagcagacugucuuuugacaccuauauauugaauaccuucuucauacaugacaucaaccugagacugucucuuuacucacacugcagucucugcacugacuucaggggaagggaggcaugcacaggcuagagggcgggggcagggagugcaggucccacuacauaaguccccucucccuccugugaguccucagagguagcugagacuugaguccgauucaaugaaagaacuuuccuacauuguguguaagaaagcauggugacaauacucagccagacaaaaaucaaaacgcuuuuuaaucucucuagguuggugaaugggcaauucgcaaacugggccugguaaaguauggagaaaaauaugccaguaacuacaguggcggcaacaaacgaaagcucuccacagccauggcuuugauuggcggaccuccugugguguuucuggugagugugagaggggugugagugaguggaggguggaaauuguucuucugucuugaauagacaucauggcuuaucugaagucacauguaggccuuugcguacuuggcauggugauagcaaguccaucugcugguccagagcaggcuucucccucacaguuucucccucacagcuucucccucacagcuucucccucacagcuucucccucacagcuucucccucacagcuucucccucacagcuucucccucacagcuucucccucacagcuucucccucacaggcuucucccucacagcacgcuggguggcucggcuguaccuuuacaggcuccugaguagacaagcuccacucaucuuguuuccuugccuuagauaaucccuacaaacauggcugaaggugaaggugcuauuugaauagucucaggaauauucuucaugacucuauguuguucauccuccaaagguagaagugaggacauggcuucuagauggacauaguagccacagaugaccauaguagccacugcaucauaguugcucccauacagaugaauaaaaaccagaccagacugggcagugguccuugauccucauuuuguagagaacacugggaguaugggaagaagccuuggguugaagcuuuaauuuuuauugaccauguggauaugaaauuucucuaugauuagcaaauguaauagaacaaggagaaaaauaugauguaaguuucacugcucugacuucaaaaauaauuuuggacaaaaaguuuugggguuuuuguuuugcuguuguuguuguuuugcuauaagguuucacuauguagcccuggguggccuaaaacuuccuauguggacuaggcugacuuugagcucauagaaauccacaugucucaccccacccccacucugggaaacccggcaugaucauuagcauugaaaaaaaauugucuugggcuggagagauggcucagugguuaagagcacugacugcucuucuggagacccugaguucaauucccagaaaucacaugguggcucacaaccuucuguauucuguaauggggucugaugcccucuucuacaguguacucacauauauaaaauagauaaauaaauccuuuuaaaaaauuguccuugacauuuuuuuuccagcaaauaaacuuguuuuauucuaauuauaggaugaaccaaccacaggcauggacccuaaagcccggagauucuuguggaauugugcccuaagcauugucaaggaggggagaucuguaguccuuacaucucauaggucuguacuguacaaucuuggcuucuguagggugcuauuauaucuggucauuuuauaaaaaugaaaaaaacaaagacaaagacugaaacagcuaucaccuggaauuauuccaucuagagauaacuauuaccauuugucuguaucuacuccaggguuuuucuuaugcaaagauauaagcacuuaaguauuuuacaaacaaaaauuuaauuauaacauagguacugaaaacaaaauuucaagucauauaauugaggugugccaucaugucucgcagcugcauugucauuuguaaagaucuacccuaauuuaugcaacuguucuuccuguaaacauuugaauuauuuuucccuuuuuacaacuguauggcacaugacagaaaagaucuauuauuucuguuucauggcaagguccuaggauaaugggggucuguuucauugaaaggccagguuucauagugauacucugaugcuuauaggagcaucuguuugaaaggaaaaccucauucuguuuccccacaguauggaagaaugugaagcucuuuguacaaggauggccauaauggucaauggaagguucaggugccuuggcaguguccaacaucugaaaaacagguaacggggaccauuucuuugggauagcacauacugaagucauugggguuuuuguuuuguuuuguguuuuuauguauuuauguauguauuuauuuauuuauuugauguguguuugcaugauagcuuaaaauaaaaacagaagaguauaggaaaaagaacacaggcucuaaagccuaaaugggcaguauuccauuugccuuugcccuguacuggcuggcugugcgauuuguaggcagguuacucagcaucucugggagucaguuucugagacuauuccgaauuuaguuauauaagugaaacuuaauaauucacuugugauguuaugauaacaaggacacacuguggagguaacacaaagagguuuauauccuuacccugccguaacugggcguuaacucaaggacauggacaggugacuaaauuccuugggcuucuguuugucucuaugucagacuuccuagguccacauugagguuuuaauggaaucucguauucaaggcugugagcuagguaccauacacagcuagguauucgguagauaaaacugguucuuucucagaaacugcuccgugggucugauguuuuucuugguacaaguugggguuuucagaauugaguauccucuugaguaguuugcuacgaaugccccauuuguguguguguuuggguuuuugcuuucagguuuggagaugguuauacaauaguuguacgaauagcaggcuccaacccugaccugaagccuguccaggaguucuuuggacuugcguuuccgggaaguguccuaaaagagaaacaucgaaacaugcuucaguaccagcuuccauccuccuugucaucucuagccaggauauucagcauccucucccagagcaaaaagcgacuccacauagaagacuacucugucucucagacaacacuugaccaaguaagcuuucagugaaaaguacauuuagcuacaggcuugggaugccugcuccuuucuccccaccaucagcuugagagaacuucagccugugcuuugauuccauuccugcuauuacugccuauauuauacagauuucugugggcacaugcaaaacguugaugcuuucuacuauauauaaauugugacuguaguaacaguagucacaauaacuaccauugauuaccugucaugagucaggcauuuugccagaagcauucucucuucuuuuuuuccuuuuuucuuaucauuuuuuauuagauauuuucuucauuuacauuucaaaugcuaucccgaaagacuuuaucucuucuacauaacaagauauccuguagcaguaaucugugaaacugcucugagguccuagcugaugaucacauuucucgccacccacgagaguucucuggauccucgaaauaaaagacacaaacacccgaguuaauuuuaauaugcccucacugcacaaggcugggcuucucccugacuucauguggcuaacccacucuccccucugauauuccagaguuaucaccuuuuaaaaucuauauuuuaucucuacugccccagacacaccugggggauuggccuggggaugcuuuccugacugccccauggcuggauaauuucuguccugcagcucuuagaucugaccucucugcuuccccaucacggucauggugauucugacccuccuccuucccuuaguccuuuguccaggaaaucuaaaauucccaccuccaucucccugcccagccauuggcuguuaguaacuuuauuggccaauuaaaaacuaacuggggacagggaccuucagcaauuggacguguauauuccugugugauugugggagccaaauuaagacaaugcaugagaaccaauccccagcaauauaccagacagagcuuggcaguuaguagguauccagcaaguauuuuuucauuuccucuuaauuaauccuagauaugcuaaaguggaugauugauaaaugggugguuuaaauaguuagugaugugggugauguagaaaaggauuucaaugcauucugugcuucucgagagcucucccuuucaugggggauuucuccuucaaguacuuacucaauucuguguucuccuaaucucaacacaaggaaaaaugccaccauaaauaaaaugcagcuacaacaacaaaagauucagugcagaggccuucaugaccgucugucuuccuuuugccagguauuugugaacuuugccaaggaccaaagugaugaugaccacuuaaaggaccugucacugcacaaaaaccagacaguuguggauguggccguucucacauccuuuuugcaggaugagaaagugaaagaaaguuauguaugaagaaucccguucacacagggugaaugaaaggaaggaagagcgaggucuuccuuugcacugugucaaguguucuagaagaaagcguccugcguuucuguggagaagaacaaacuggauacuguacugacacuauucaaugcaaugcacuucaaugcaacgagaacacaauuccauuacaggggcagugccuuuguagccuaugucuuguauggcucucuagugaaaaugacuugaaguuaguucauuaccuuauacagaugugaaacucugguguggaaccaagcagacucuggguuuggauucauacuuuuuuuguuccuguguauucucacuaggauugcaacaacagucuaucaaauagucauggccagugauaaucaaagucaaaggcacacacauccucguccauuaagccauuaagccaugcugaaccacaaaacagguuucccggugacacauccauugcuggcaaugagugugccagaguuacuagugccaaguugcucagaaagucugaagcacugagugugucacaaacacuuuugugaaaaccgcccuacugucgguugacaucauuaaauaucaggugacaaaaacggugccacaugugacuaaauccccauuuuccuucucucuuugaugagcugcuguuguggcugucuuguacaaaaugugcaucucucuaacccagguacuugguucucuuguucaguguugcccaugccccugucauggcuugccauagcaucuuucugagacuuuuucaaauacauuagauccuccuaagcagcaaagauuagcagccaaacugcuggggcugcaagcggcucaguucaggguguggcaugaaagauccagugcauuuacacguggcaggucuggguugguuugugcugacugucuccuaacacaagauggguacacuacaccuugagauccuucauuauuuaacagaaaucuaguucuuucuaacuguuugaauuaaccuagaaaaugaaaggguggcauuucauuuugacaaaaauguuugcauuguuaguauuauuuggaauuuuaaguuuuaucaaugcuucuggaagcuuagaacuguacacgugugaugucagucacauagaggaaugugcccggacugccucaugccuuuauuuuccuugguaaauuugaagauagaaugucugacuagcgcagugaccagaaaacaaugugguagucaacaucucaggccauauuuuaagauccuguagagcacuauucauuucagguugcagauggaguauuuuugaaacaucauuacuauguagaugcuuggauaggagugagggggagcuagcagauuuccugugccauuuauucagcugauugauguacagauguagguuuauuuuguaaaauccacugaaagaauauggccacacccuugccuacuugauagcaucaauacagaagccaagaaggaccacuaaguaacccccucuucccagggagagcagcuagcuugaaaucucucggauacaaucgaugcgucugaccuuugggauccucaccauaugggcaaacaaugggcuuugcaggaugagagacacccacuuaaaccucugacgaucucgaaugguucaucucuuccgucauuaaccagucauggaaaacaaucaacaaacucugccacgugaaauauuuuuucagacuuuucuaacccaagcuuaauuuguuuucaucugcaagcaacguggaaaaaaauaguuauuucaccagugcucaaugucauccgucuucauacaaaacaaaaauaugaguaaguuccuguauugggcaaaguucaagugagcuuuugcuauccuuauuuaacuucuucuaaaaauuuggaagaauaagauuucagaucuauuucaaauuauguuuauauaauguuauguaauucauugcuugaaaggaaaaaugacaaguuugauacuaaugucaacauagguuucuaaaaugauaaggaaaguguguuuccaguaguuauuggcauaccauucauuuuagauaucaaagauaccgaaaucaaagaagcaugucuuuauuuuucaaaaacaaacuuccguuggcuuucucaguccauuaucaccauguacagcccuuagaaaaauccuuguuuuaauuacucagauuuuugaggccacaaaacaacaacaaaaguaaggcaccauuuuugaaaacaaaaucaauugaguguagauuuaaaaucuuuucugaagcuagagacaaucuguagcuauuauguuaccuuuuacacuaucugaagagcaaucuucaacuuuccuguuuaaacguaauuauuuuagaaaguuaaaaaucaauccuaucuucaaauaagaauuucuuagauucccuauggagaugugcauugugaguugagaaauucucaagugcaaacacuucugguuuacuuuaaaaaaaaauaguggaaaacuuacuaacugugaauaugagaaagacaaaagaaagugaguccucucgcuagauauaccuagcauaauucauuaugaaacaaacaaaccucaaacuacuguauuuuggugucuguaccgcaagcauaugccucaugacuauaaauguuacauacaucauuugcucucuguauaguaggcauugacuuaaagggauuguuuguugucuucucaugguuguauauaucagguaaaauuguuccaaagagccauguguuauguaauggggaaccacuuugauacugaauuacuaauuuguacuuucauuacuauuugcugguaauaguguaacgccacaguaauacuguucugauucaaaacuguugcaucccuuuuuguagaacauuuauauuuccauaaggauucgguauguucuuuucccuccugcccuaggaugaagcugguuuugugcuuuuucuuuaucauuggcccucauuccaagcacuuuaugcugucuguaauggaucuauuuuugcacuggaauaucugagauuugcaaaacuagacaaaaguuucagagcagauuucuaaguuaaaucguuuucauuaaaagaaaaaaaaacugaaaaaaauuguauugugaauaacuuuauaugacguguuuuuuuaaaagcuuguuucuauguuaugagucacaaaauaaagcugugacaguccugcuggucuaca

SEQ ID NO: 1901 - RNA, 2556 nt, Mus musculus
aaaagggguugugaugagaggcacacucuaugccgcugagcagaacccaacaaagcacucaucagggagagccaagggauggaccaaucagaucauuccgggaaggaaaauggagacaagugcucauccaaagggagaagaacccuuucccaucuucagcucugggugccgucucagccgucucagccggcagagcagcugugcagagggccagaccugcggaguuugcuguuccuaaagacacaccauugguugguguagagucgagagucugcagggggcaccuagacgcucugaagauucauuucaccuacacagcuuuuucauacccgcacauauaaaacuauguauauauacaugcacucacacaugcacaacacacauagaggaaaaacaaaacaaaacaaaauaccaaaacaggcauuuuugucuguauccaaugacaaguacugaaaauuuuccaaagaaagauaaagcccagaguuuuggcuucuguaagccaauuggaacaucugacaauuuuaccccaacauuucugacucuuugagacauuauggacaugccucaaguugugcuacaccccacucugcuuucuguaacuacuuuguaggcacggagcuugcaauaccauaggaauuuguucagccgagaguccauucucucaccuugggccaccucugcucuuguaucaacagaugcacuguaucuuuguauacauugucucauauacauugaauagggaguaguugauuggcccaucugaaccuuggccucugaugccucuaaggaggcagccugucggagcugcucugcuugagugguaccuaaagacagagcucagcucaaaucucaucucucucucucuguaauauuugcuaacuugcuuaaucucucgaauauaguuaguccauagcaaaauacacagaauagaaucuccugccaggacaugucuaagaacuaaaugugguaaaagcuguaaagugccuagcaccuugggcaucucucagcuuuugcaaugccaugagccauuccauucucccccaggaaacacuacaaacccuuuuaucuuuguagugacauacuguugagaauagacacuuaaugaccaugugucuguugggugucuagauuauaaucuaccuaauuauuauuucuuucucucaaaugcuuguauaugaugggugugcauguguguauccauguguguuuuuauguauuuugcuguuugugugcaugccaaguacuguacaaguagguacgcauaugcauggaggucugauguagacuuuggacucucucuugauggaguccacuuuauuuauugagucauggcuucuccuuggacccagcacucacucauaggacuaguucagcuagcuagcuugcuuccggugguuuccugcuuccacuucccgaguguuggaguuacaggcaggauuuugugcucccaccauauuuauguagguucuagagaucagaacucugauucucaagcuguacagugggcauacuuuaaccauugagccaugguuucauccccuaauuuacuuaauuauuauuccaccauuggacacucaguuuguucuacuuuguuuguuugagauaaggucucauuauguaacccuggcuggccgggaacccuuggguuuuguaggacaagcuggccuugaacuuuucaugauccuccucucucagcuacccgagugcuaggaugacagcuggacacaugugucacuacaucuggcuuaguuguuacacuuuuggaaaauaagaaguuuugguuugacccuuuuucuucuuagugguuacuucuugauaucuaguaucauuuccccacuuugccacaucuuuucuuagcccguuucuucucuuaauuucuucuaaagaacucagggcucucuuacuuccuuuaguacuuacuuuugauguguggucucaguagacacaugcaacauggcauuaaaugccacugauacacuuaaaaaaugaaauaauuauuuuacgugaugagaugcauuuuaaaauuuguguuuacuuauugugugugcuugugcacaaacgugcauguaugacauggcaaauguaacagagaacauguggaggccagaagacaguuuaugagacucaguucucuucuaccucauguguucuggggacugaacucaagucaucaacuuugacuucaagugccuuuaacugcuggaccaucuagcuagccugagacaaaugaccaacauaggcuugucuucugauucucuuccccagccagaauuaauuaucugguagccagacacauuuucaaucuucccuuguccaaaaggggaggaaacauauuugauagagaaaaguuauaguagcaagaguguaggggaagaaggcaacugcuggaaggugauuaggugauagguguuaggugauucuuaugggguacgggcaagaggaagacuccagagaaguccaagaaaaguagauaaacaaagaaauggaauuuuaguaacaggaauguauagcucuuaaauaugggguuuuacuuaaauguuuucaaaauggcaaguu

SEQ ID NO: 1902 - RNA, 182086 nt, Mus musculus
ugccgccgccgcccgccccuuuccgcuggggagcagcugcagcagcaggagcggagccggagccgcgcagccgccgccgccgccgcugccgccgccgggggauguggccggcgccugccccggaccgcgcagccuccugaguucuugccgcugucgccgucgccgccgucgcugccgagucgugcggggccaggccgcgcccuccccgggcgcccgccggcucgcaugccgaggggcuccggggcguagcugcgcgcccggcgccgccuccgggcuccuccggccccgccaugggcugcugcagcuccgccuccgccgcgcaggugaggggcucccgccucccggccgcccgcccggaugccaccccgcgcugugagcgccugccgagccgugcccuucgcuccccugccgugcccugcgccccuccgguccccgccgaccucggcgcuucgugccuggucccccaaugcccgcugcgcucccucccccgcuuucgcaccugagcagcccgucccgcccgucugcagguagaggcgccccgggcgcccgcucugccccggggaggcauacgcuucccucuccuuggggcccgccagccugcucuccaccuccgccgagcccccccgccacccacagacuguuuuccguguccccagaagguguaccccagcuugggcucuucaccucucuuccaccuuauucuaguuucggauccauuuaauaagcugcccauuuccccuggucugcgggcccccuuggccgggaucaggugcuucacugggucccggugcccuuccagggcccauuucacagaucccacccgcucguuccccaucccauccccccucugugccuugacccugagcaccgcggccucucggcgcaccgaggccccugcgggagcggggggacugggcugggaaggagauugggcaccuggugggugacgggagcguuacggaaacucccucuuuguugccaguguaacaggaggaagaggugccgaauuuaguuuuucugugggcacuggcuggauguugucgcugagggcugagaugcagagauuucucucagcugccacccugcccccauccaaauuucgcuagccgccuucucuuuccgaucagagccuuuaaccuggguggaaauguuuggacaacuguguaaggaucagauguaauagaacuugacugcuggccacuaauaacugagaggaccuguuuguaaauuaucuaauuuaguggauuagugaguguauuuacaaauacgauaaaaagcaaucaggaauacugcaucaaacugucugguggugguguaugaaaaauaggcucugacaacgccugggauguuucuccacaguuucauuagcguagaauuuaacaguagucugugauuuguuuguuuggugguggugauggggagaaguaugcgcuugcuucuagaaauaaaggcugguugguucuuggcgaagaaaaaaaaaugcuaguuuuuuggggaaaaaaauuccucuagagauguagcaucugugacacagaagugcuuggugcuaagugacuauauauaacucagguuuaaauaaccugcauacuugcucugaaaaaucugagaucugucacagaaacaacuaggauuggagaugaguggaggacauuuauggcuuuauugagcauugauccuguuuguccaguucuuaggcuggcugguuuaguuagugaaaccuuauucaguuaggauagcaaaggaaaaccaugugccugguguuaaggaaggcuggaucacggcuuucuauuagcauauagagguguagaaaaacacauaccuuuggggauuuaguuggggauuuaggcagggggugcaucuaucaguugggcauugcucaucuaauaguuguuuacauagaguuuucaucaaaaagugucuuucacauucccuuucuuuucagaaucggguuacugugcaugcucauuugguggugaaaugccuuuaagacagcaagguauugauaguuuauggauggcuuguucaaugugugaaggauagugugggagggauggguucugccucaggaggccacuuuaaaugggcagugggucacgggcuugucucccuccaugcagaccgcuuccucucucccuuuccccuucucccagccacugcuuucugcacgccaugugacacagacaagacuccugucaugcaccugggggugugcuuuucucccccuguggauuucuguaaccaaucagcaguuugucaacaugcuuuaguucaguguuggggacuugaaguauucaguggagcguccaggcagguuuuuagguacagggcuugccaucauuuuuuuuuuucuuauuuuagauuuuuuuuucccaucauuuucauuucugaaguguucucgauccccugaugucuucaacacucaucucagaagcaucaggcaucuagaaugcucuuguauuuauguguguuguguugaaauaaaauagggaugcaacuuuaaauguucucuagaugcaacgcugcacauuacugagcuaaucuucagggucaggagugucuuuucaggcagaauauguuugauucugcuuucuacugagcugugagguucuugaguguagaauuugccuuuuuccccccucccucagcuuuccauuuaugcaaugccucacuguaugcugcagagcugcucagcugcgguuauugaauggagugcauacguaaauuuaaacauuuggcuagcaagucacugauugugaagcccccccccccagcccugaucugugucucgcacuuuccacgguuugauagucuaaguucaccagacuauccuuuucugaacucaaaccucaacuuuguaaaguuaaaauuuacugugggagaccacauuuauuccuguucugucaguagcaccacugguuuguaaaacggagcagcuugccuccuuugcuccugacaccuugcucaguguggguauuuauuuuagucagugcagugcuauagcaucuuaaaagacuugcgugcaagcucugaugauacccuguagagucaaucaaaauacgauauacucagagguaucaccaggaacuuugaagcuagacuuuaucaguguauguaaaguacacuuuauuuuuguucuagagcuggguguugaaguguaguuuucccuccuagucuuuuacugcguugcagaugcucauaaaagaguuuauggucuucuggacuuugauccuuuguaguccagauacuauuuuuucccuuggccaugacuagguaucguaauuccccaccaaaauaauuauuccacuuugagaauuaaaauuaaaacaucauauucugugcagguauuuuacugccaaggaagcaaauuauuugcaaaauaaucuguaugguauuagacacauacauuuaggaaaagugucugguuccaugggcacuuacagaacucuuagggcgauuuuucucuggcuuaaauaauagucaguaguuacacauuguuggaaauggcucaaaacaaacccaguauaugaugccuaaaagucugcuugaaggggguaucaaaguaagaugaucuggaguuucuuuuuacaacauuaauccuaccuaagaguguuaaaauuucuccccaucuguccauaauuaguuucuucugcuauaaccugcuauacauaauuucuauucuuguaaugcuaaacuucaaaguucccuuguaaaucuucagauuuauuaaauguucuuucccauugacaaaccaguguaaaugaaggggguuugugaaagauuacuuagcaaauugcuguaugucuuuguccuuaauggcuagaucauuauuuuccacugcagugcuuuagaggcgaggagguuucucaagcuuuugagguucuguguccuccuccuaaccucagaauuggaaagagcuagagagaggggugggggagggagaggaagagagagagagaggugcacagacuuucuaguggaagagacuaccuguugugagccucaauuuagaagacucuugggcacugucuugucccaagcccuucaaacugagggugacauuuuuaacugccauauccuaauugcuuagccaugcugccuuaaaaacaauugggaauauuuacucauuacuauuugucuuauaauacuuuccuaaugcuguauucucaccugcuuuguagaauuugaagucaggugauagaaaugaaauugaaggauuaguggaaucacugacagagacuaaauuguucaauuaaaaacaugaucugggaaguaaacuucauuuagaagcauaaaagaucaugccagaaauauguaaggcaagcuguguugguggccaggccuauaaucuaagcacucagaaggcugaaggauugcuacaaauucaguagcagugagaauuuccaggccagucugggcuacauagcaaacucuugccuccagcaaacaaacccccaguaugcuaaaaaguuaaugucagaauuggcugggaaauaauauugaagcuguauguuguuuuaucuauuuucagagucauuuucuaguuuuuguguccuuaguaauucagauugauuuuauuuccauguuacaacugaagacacugugacuuggagauucagaacguggcuacagcaagagaugcccauucacugguuaaaacauccugccagcauuuucugcaucugccuugugugcuuuuucaguguucacauacauaguugcuaaaucuaaaguugcugcgcacuuucuuuguucuagucugcaagaaaaggucaaccuuguaucaaagaauuugcagguuaaauuuuguaccacuuugauccaccuguaggugggaacuggggaggaccauugugugugcucaggguguauccagugggaaugcuugcagacuuaacagggucuguccauacuuuuugauguguuagcauuguuauuuaaaaaugcuacugauaagggaagaguauugucuauacacauauguuuugguacuuguacuggcugguucugugugucaacuugacacaggcuggaguuaucacagagaaaggagcuucaguuggggaagugcauccaugagauccagcuguggggcauuuucucaguugguggucaagggguggagggcccauugugggugguaccaucccugggcugguaguccuggguucuauaagagagcaagcuaagcaagccaugggaagaagcaagcugguaagaaacaucccuccauggccucugcaucagcuccugcuuucugaccugcuugaguccaguccuuuagugaugaacggcaauguggaaauguaagcugaauaaaccuuuuccuccccaacuugccucuuggucaugauguuuaugcaggaauagaaacccugacuaagacacuacuggcaauuggucaccucccccacuucccaugcucccuacucauuagaguaucaaggaagaaggaaaucuuaggguuuguagguuuggacugcauuucauagacuggaagagaugcaauacauaaagcagcauuacccucuucuuagucuauggauccaaacugcaacucagaaacaugacguugucaggucagagaacuacguugugggguaguuggcacccuugcuguuaauuuuugauaccuuaauuauucucaaccuugacuacacauuaggauuccugcagaaguuuaaaacugucaaugccuggggcucaccccugggaauucuggucuaacugguucaguggugcugccugggcaucaacauuuugaggcgcuccagugaugauggagagaaucaccuuuguccaggcaguuucuuccccggugguuucuguuacaaccugugaggguaguccccagacugaaucaccucguugaaacaagccccuucugaccuguuacucgagacugauugacacugggacauugugguguagauacucaguuugcauguuuaauacucaaguuggacuccagauuugucucaucccaugacucacugaaugacaccaguaguuguggggauaagaagccugagucacaaagagucugucuccuguccaccacgcccauuaccuuaacuugcugccagcuuccuagcuaagugccaucuccagccagugccuugugaccuuucaggcuuccaucuccucuuucuccuuauugaagccuuaaugguuuuugaaaagucugaacugauucacuguguuccucuccaacuuaaaaucauuuagugguuccgauuacucuggggacaaagacuagauucuccuggcaucaacaagacggacuuaugcccucugugccuccuuucucagugucucagacucgugaaucaucaggcggucgguccuaugccuuacucucacagcuuuuccaucuaugcucacuuguagagaaggcuccuugcuucucccaccugagaccuuugacugguuuucuucaguugcauccuaaaauacacuuuuuggaagaccuuccuuccuuccuuccuuucuuccuuccuuccuuccuuccuuccuuccuuccuuccuuccuuccuuccuuccuuccuuucuuuuuuugguuuuucgagacaggguuucucuguguagcccuggcuguccuggagcucacucuggccuugaacucagaaauccuccugccucugccucccaagugcugggauuaaaggagggcgccaccacuccccagcuuggaagacuuuucugagccuucauuacacaccaugucuucucauuaaacuccccauugccuuggauuuuccccuuugaacguguaauagcaguaagcauauaauuauagccacuauugaugucuagaccaugagucugccucccauagccuauggauagagucugaccugcuaaccuguauuuauauggcuuguaagcagagaacagcguuuacaguuuugaugaggugaucaagacaaauagggcugagacaaauaaaaagagaagaauauugcgucaugagaagcauaugaaauuuggaugcuccuguuccaaaguaagguuuuguugugaccccgcuguacuuccugucugcaggugcuuugcuguacagugacagaggacaguaguucucagcugcacacaggaccaguguugacucuggguccuuugcaggggacauuucccgacucuugcucuguccugggcugaugagaagaugaucauuugugcccugugugcuccugcugggcacugcuuagcugacacugcugcacagaaauucuugggaaguuugggaacaaauccuucuaguggguggggauaacuuacuuggccagcucuacucuuuaaaauucaauacaaacuuuuuucuuaagaacaaauucuuuaaagaaagucccaacaaacuucagcuguuuccuuagacagccuguggugaaccccaugguucauggcuggcuuaaaacauaauuucuucccuuuuguuccuuuuuuguuuucuucuuuaguugaaggagaggauguagagguauaaaugugaguggaagccaguggauagccucugguguucuuugagcugucugcuuuugugcuggaggcggucucuuguuggccuggcacucacucaaugggaagggcugggugguuagccaguccauggcacccgcaucucuccacaauuggccuuuucgcuugggcuuuagggguugaucucagcuucucaugcugccaaggcaagcacuuuacgggaugcuccaucuccccaucccaucuucuuucuuccuuccuuccuuucuuucuuucauucuuucuuauuuauuuauuuauuuauuuauuuauuuauuuauuuauuugagacaggguuucucuguguagcccuggcuguccuagaacucacuuuguagaccaggcuggccucggaaauccaccuaccucugccuaccgagugcugggauuaaaggagugugccaccacgucccgcccaucuucuuauuuuuaagguugccauauacauaaagaauauuaagcucacauuauuccucuauacauuuguauaauggcaagaaagaaaauagcaugaagacagaaaaauuccaaagagguaaaacugcuucaagaugcuuaaguaacagagaugggauuacuugcuuuauuuagugguacugugguacaugagcaaguuuccucauuguaaaucgcuuaggguaauguagccaagagaaguaaauuacaaaucacccuuaaauccaaguacuggaaacauugaacagaauguguucuuuccuguuuguucucucucucucuguguccuugucugucucucuuugucccacuuguucaggcugauuucagacuccugcuuuucccucacccuucugaguccugagauugcuguaugaacagcuacacccugcucuuucuccugcagucuugaaaucugaucugggucuuuccagauggacuuuccuuccucuuucucuuucucuuuuucuuuuucuuucucuuuuucuuuuucuuuccuuuucuuuuuuuucuuucuuucguucuuucuuucuuucuuuuuuucuuguuuuuuuucgagacaggguuucucuguauaacccuggcuguucuggaacucacuguguagaccaggcugaccucgaacucagaaaucugccugccucugccucccaagugcugggauuaaaggugugcaccacugccuguccagauggacuuuucuaacaaucucuacuggcuuuucuugggugagaauuagggaagguuauaguucucaucccuguauaguaucgagcagggugaaaacaaagacccagugguugguccagucugcagcccacaugccccaagauaacuaugaguggagcacaacacaaaaucauaaacuuacagaaacaugaaauuuuuuuaauguguguuugauaauugugcagugugaacuuuguaaauggcaacauguugcaaugucagaagguuggacauaccugguggacuaaccagaauuugccuuuaagucagguaggggcaaagucacacacacaguaggacagacagcugcaagugggagggcccagugguggaggcacggcuggguaaggaacaggagccauaguggggugagggcuaguagcucugcugguuuuuuucugucugugaaaacacuaacauaguguuuccugaaacuucugugucauuccauuagaaaccuuuugcaguccucaguucugagucacacacaaagugccccucaccuucagcagccagggcuguagccgcugcugaagcccguuucucccucaccgugccugcugcccgucucuggcugacaggaggguagcuucaguaacgaagguucgaguaugguuacauaguuaauuacggcuccucagagagucucagaggcccugacuguuggaagagcccuuuccuuuccagcccucucacucuuccauuucuacuccucagauuucuuacauuugcuggcgcccuuuagcucugucugauugggagucuuuuuuuuguuuguuuguuuuuugagacaggguuucucuguauagcccuggcuguccuggaacucacuuuguagaccaggcuggccucgaacucagaaauccgccugccucugccucccgagugcugggauuaaaggcaugugccaccacgccuggcugggagucuuuuuuuuuuaacacuccuaaaacuuuuaauuuuccuucuguuucuuccuacuucuccgugauaaacuuuagagcugugguuuugagcagaaaguaauauuagagccagauaguagagugccuguuaguuuuuuauuuaccugcuuaauuucagguucguuuuuuuuuuuuuuuuccuuauaagaccagugagaaugaagagucauauuauuuagaauaucccuacuauagaaaguggucuuucugcacgacaaauaaagcucuguaauaaguagcauuuuggaaauggaaguaagcagcuaauguguaaaaauguucaauuucguuauuacucaggcugaaggaggggcaccccuuuaugccagugaccuugauaugaguuaacagaauacuauuaauugccucugugguuuugacucaaauagacuuuauugauuugcugaauaaauuggaguaacccccuugggguacugcuugacaaccugcacuaaacgccguuucagaaagucguugaaccccccuaguaauccagaguggucauguggugugcaggguugcuacagcgcuggcaucaguugcuuauuucuuuauugugggugaguguaggcacguggaggucagagacaagcuguggcagucaguccuccauaccauggugggcuccucagauugaagucagggugucaggcuugguggcaggugccuucaucugcugagcuaucauguggguccuguuguguuauuuauaacagccaaggaguucagguuuaacuauuauauuucugauaacaaacuuuucuuccuuuuuaaaauauaaaauccauuugcuauuugguauaucggacuuggccacugcccgcuaaauccucccuuaguggguaaguggcggcuggccugcuuccaagguuuucaucccuccucugagaggcuguggggaccaggggauugagcaccauuaaguaccggaaggagcgugggagcugccagccgacaggcuuggguuucagucccaagaccaggucacucauuugggccgacuucuuaggucauugguaccuugguuucaccaggaguaaauggaaacaacuucuugggcuuauaucaaacuauacaaaugauuaaaaaaaaaauaacaacaaaaaaacaauucaggaguuuccauaguaauguaaacugaaaagccuccagucacccaugcucccauuaaaaaggcaggcucugguuugagacuuucgaauaugaacaauggauccaauaauauuccaauaauaccggggaugagugcuaagaguaaaauagguaauaguacuagguagguugguacuucgcaggugaacaguuggcuuccugaacaugacuuuucaccuggccuggauugaggcagaaugagauguagagaagggagaaggaagaaagaucaguaguggagaggaugugugggccagcgcugagagagccgugacuuacugcaugucaguauggucagagaugaccagggagggggcucgugugugaauggaugggaaaugggcagccacaagguauucacaaagaccugccaacuguguauuugagcuuaugggggagagaugcaaggcagaggcugcagaggaaaccgaagagaccuuguggaguuggagaaaaaauuuccugccugaauguggacuugaaggguaaugcagagggauaggacauguuucgaucggcauucagaacuccugugcacuggcaugaggcaguugugauugauagcuugggaacugauggggcugguaaguggggagaggaaggacaauugaauuuuguuuggguucaguagaagugaugcuguucuuggugccuccggcuagugcaucuaguuaacugaugguuuugcaacgagcuuuacuucaugagcagggaggagcuucaaguaugggugauugccagggggcaggggaaggcacucuuagugcagucagugacuuggagaggaaagguuuguguugggagacagagaucaugcugggggaaggcacagagucuggggcaacucccuuuugccacaaacaaugcaauagcuugguuauacagugauggguccagaagcagagauugaaaucuggaagcaaggcgcucuauagccaucaacgauccacccuuagugacucacccucaauaaccagucugccaagcaggcuccacagccuuucagaauagcaccacccuguggggaccagguauucagaugauuagagggcccggguuacacauuuccuauucucagaccuaagguggguaccugaguuagcugcaauuuauagauggaacaggcucaagaaauguuggguagcuaucccaguaccacccaguaguauaaaaccaagucaguucugagggcauuuccuguuccuuuaucuuccccuuacuuuuuaucaagaauugcuauguuaggcggugggauggcuggaccuuagauacaucauucuuguuaagugaguucagagauuaagugaaaauguggggagagggcacugagagcagguaaagggacccugggaacaauguccugacacacauggugugaggagagaaggaacaccuguagauugucuucugggcuccagucaggugcugggcacccccccauacauuuaaauuauguuacauauuaacuuuuuaaaagcauauguuggguaauguauaaaaacuuggagcagugucagugugagugcuuuuuaugaagcuugagagccagugacugcauugcccccuggccugccuguguuucccucugagaacuuaggucuaagaaaguuuaucauggaaguagguuuguuaauaugacugugauuuuaucuuucccccagaacucacugguucuuucuauccucuguguguguguguguguguguguguguguuauaccuuauugguuuguuuguguuuugagacaguugacagugaucaauacgauuuuguuaggaaguuuuggaaacgauagcuuaagaaggcacuucauuuuaaaagugagugggauuccaguuuggugggacuuuaaaccuuuguaaaauacaguuuaauuugagcgaguaaaacagggacaaguggagacaauuguuucucuuguguugcuaagcggcaacagagccuucucggugcugcuacuuuguguuagcucuugccggguaggguugcucauagucugucugucucacuuaaagauacaaauuacuucugcgagaguacccugaucacugccuaaagccugcgcuccugaagccugggggcuuugggaggcuugugcagugcuccucugcagaggcauuugccaacagaaaaggugagaacucaguaccaccucugccuuccuucucuuugcccaccuugaggagucagaguacuugcaaacaugcugaaaggucauucccacccccucaccuccccccccccccccucucccccauguccaggagggaauuugcuucccuggccugcacuggucuuaucuaucuuguaaauaccuuucuauuuacaucauccauccugaaucuucuccuuaaggauuuauguccugcagaguucacuuugaaaagccugguugagauguugcuuuucaauuccuugauccugagugacaacaaagaugggugugguaaagcaaugaggaaauuguuggaggggcuggagugauggcucagugguuaagggcacugguuagucuuauggagaaugcacauggaaugcagcugauaccaucuguauguaacuccagcuccuggagauccaaugaccuuuccuccaagggcacuguacguauacauaugguacacaggcauacacgcaagcaaaacacauguauacauaaaaucguaaaaaaaaaaaaucuuuaaaagaagaaauuuguuuguugggucagguaacagcuucccuccccuaauacagggauuuuuaaagucugagcacauuaaacgugccaccacuuaaguucuucucuccuuuuccucuccauuccucuuuccuguuaguuuucuuauuuuguucugcuguuuuuuuugagacaggguucucuuuguauauccuuggccauccugggcucuguagacuagacuggcuuugaacucagagauccaucugccucugccucccaagugcugggauuaaaggccugugccaccaugucagacaaaaacuuuuuuuuuucuguuuuuaaauuuuauuauuuuaauuuuauauguauagauauuuagccaugcaguauguccgugugccacaugcaugcuugcuaaccagugaacacagaaaaaggugcuugauccccugggacuggaguuacaaaugauaugugguugcugggaauugagcccagguccucuggaagagcagucagugcucuuaaccacugagccaucucuccagcccucaguuuucacuuuuaaacgugugagggcagagaaccaccuucaggaguugucgggcuuccauggugaguguucuuaaccacgugaacucucgccagcccucucuuccucacucuggccuugaguucacagugcuucuguguguuggggugaaggcaugacccuaccuucauuguuucuuacuugggugauuugggguuuccagcuugaguucaguguacuucauugaccaaaauaucuuugaaggaagaauuaaagcggggcgagggggguaugguugagagcucaugguuuuagagcagugguuaugaacccaugggccuugaccucuuggggagucacauaucauaugcuacaugucagauauuuacauuaugauccauaacuaggaaaauuacaguuacgaaguagcaguggaaucauuuuuauuuguuuugguguuuugagacaggguuucucuguguagcccugucuguucuggagcucacacuguagaccaggcuggccucgaguucagcaucuaaaggugugcaccaccaggucuaccuucuaugaaauaauuuuaugauuguggucaugaggaacuguauaaagggucacagcauuaggaagguugagaaccacuguuuuagagggccaguccccauggcugcuagagcuuuguugcuggcccugauucuguugacgccauuagccagauacagugggaagcagccgucagccuacaagugggccagaguuguauguguguauguauguauguguuuggaaaugaaaacauccauagacuaucucaguacacguaaccauuccugaaugccguuaaaggggauacaguggagggaggcgggaccuuuugucccugagcugaaucucuuucuuaucauagacagucaacaucguucugguguguguaugcaggagggaccagguuggagaggaaggggugcgggauaccuugccucaaaaaaaaaaaaaaauuuaaauuuaaaaaagagaaaagggaaaauuuguuauuguuaacuacucugguugccuuugcugcuuuuauccauuugaccgaaucacagaucucugucuugucacuaccaagagcucaacugcucaugucauggucccuaagucucuugcuuacuggguacaguaccugcuuaaugaucccuagccauggaaccacagaauccaggaguccaguguuucauaucacuuuuuacacuggauaccaccuuucuaccuuccugccaccucccacucagacaaugucuucacucuccugccuguguuuauaccuugccugcuuccagguauauauuaggugauuuguaaccaaauauaaauauuuuuaggacuuaggugaauaaucaagaggugaguguugguagacgugguguagauggaagcagagauguaccgggugcccaagcuucaccuagcaacagugucugggcauggcgcuuauucagagaaagucaucacauagaaguuuucuacaggaaucaaacacuggcuggugcuaacagaguuagcagugagguagccaugacuuuuauaucaugucuccuaaaugaguuugguucaggcucugcauaaauucuuguagccagugagaagugacugcuucuugauggagcagccagcuccuuuuccaguuauuagaaacccuugucacauggcugagcguauguccuuguaacuuuauuguuggcccugauuuuugccacacagaaugacaaacugaaaccagccuugaauguuugccaaguuuuauguguaugucucuuuguauuuuaaauguaaaaaccugucauauaaaaaaagucauguuucuacaguuuuugugguucuagacgacuccuuuuucuuuaugaucuguuuaaaaaauugcauagcaauguuaauauguauauuaucuguauuugaaaagacuauauauguacacauuuuaaagcacuaaacauuuuuaguguuugucauuuauuuuuaaguauuuuaaguacaguagagcauccugaagcuggaguuaccugacauggguugugaagaggugagucaccugacaugggugcuggaacagccaucuaagugcuugccauuuaaaacaagaaaaguggccucucuuuuccaucuucugcucucccgaggccaccacucugaguccuuugggucaguucuuucucugucucuagcaugcaugugcgauggauggccccuuacuucuucaguucccagcaccaguucccccucugggagaugaagacugagcccuuccaacccuauccacugugcacacccuuccugugggcacccaugcucugcuacgggauguuauaacuuugguuaccauucaguccuuauaucaugacuaaguaaaugcucucagcugaaucauggcguuuugauguuguucuuggggauaaacguuaucuuguuuugcucuuugcuuggguuuuuuuuuuuuuuuuuuuuuuuuuuugcccaaaugacuaauugguuucucaguguucaccuaguagauuaacuccgaauuaucuaagcuccgauuuuaaggcucuuuccgcuugaguuuuuuuuuauauuuuccuuauuagagugauauacugaaaauacugaagucaccccguauuguuucuggaccugucugucucuuuauguacaacaauguuaucguuugguguauauaugcauuuacuguguaaucuagguugaccuugaacuaacuauaccacccagccuuccgaacaguuaggagaagcaugcaucaccaugucuuugugggcuggucccucuguuacuauguggccuucaucucuucugacuaaguuuggauugaacugcuggguaggaagauaauuacuacauguguuuugagacaccuuuuagguccucuucccccccuacccccgagagcaugugugugugucugugucuguguguaugugugugugucugugucugugucugugucugugugugugugugucugugugugugugugucugugugugugugucugugugugugucugugucugugugugugugugugucugugucuguguguguguguaugucugugugugugucuguguguauguguguaugucuguguuuguauaugucugucucugugugugugugugugugugugucugugucugugugugugucugugugugugugugucugugucugugugugugucugugugugugugucugugucuguguguguguguguguguguguguguguaugucugugucugugucucuguguguguguauguuugccgguaaggugaauuucucacaaagaauagucagauuauguuuuuaaauucauucagcuugaauauaucuuaauuggagaguuaugacuguauuuagagguauuauugaagaauauauaauaauuuaucccuuuuuaaucuuaaagaucuguugauuuacugauuugauaguauuggauucuuucuuauuuguuuaccuauucuuuuauucagauuuauucuuuuucucuaagaaaaaagugcaaguuauuaaauaauuuuuugacacagguuucucucuuuuuuaaauaacaugcucauguauguguguguauauguguguuuaugugcaccauguucaugcaguugccuucagaguuucuggcgcuggaauuaugggugagaacugagcccagguccccugcaagaauaaguauucauaauuguugaacaccuccuguuuuguucuuauguguugcuaauauuugaguaaaauucuaaauuggaaguuuuuuuuuuggaauauauguauggauauagugguuuggggcacucaaaccuaggggcuuaacacgugcaaaacaagaacuauaccacugaucaucauuccaguuuuucucucaauauuuuauguauuguuucauuuuuagagguuaaagagccaagauuacuaaguaaacagaugagcuggaauuauagugccaauuucuguuauuccauuauuuuuuaagugccaugaguuccacuuuagauugaugaauggcuuacuggguaauugggggcgggggacaucaaaugggucuuccccaucugugcagagaacagguucagagcucugggauuccuuguaguccacaccuguacguagguuacaaaagucaguggucccacaaccuacuagagcagagugacucaagaugguuuuaccuucuuauauuuauuuucaucagugacacugucaaagggccucuucuguauuuccuuugagguucuggaaacugagcccuuggcuucagauaugcacagcauaaacucuaccacggaacuauguacccagaucaacagugacauugcccuucucaaaggggauuuccuguuugucauaaacuauuacuguuggcugauugugcuuaacguaugaguucauuuugcuagaguaagaguuacugagauacauuucuaggauguaguggaugaauuaauggagguuggacauuacugcuuaguuuuuaauacaguugaugcagacuguggagaugagcggguuuuguuuugcucuuacucaugcgugugagcugugcuuuuccguucuugguuucccaauucugauugaauagguaccucugguuuggacaaagaaucuauaugucaacuacauugcugggcucaugugccauuucacgguagaugauauguguaaaauugugucugagugauacauucauugaaucagggaucuccaagcuuggaguccaucguaaguaaaugccuggcucuucaccugcagucacagagcuugguagucacaccaucguaugugucccuauagucugucugcucaccacuuuggguguuguucugcgauuacugauucuguuuuguuuuguuuucuucaggaucaugugacuauuuuuguuguucugagaaauaauaauacuaagguguuuuucugguuuugaaagcucccuagggaccagacaguauuuuuuaaguugugugaaacccuagguccuugguuuuuaucugugucaacauagccacacgacaaugguuaauucccaaaguuacuacuucugucuguaucuagcugugugggauggugcugacaaccaugcuggagugggaacaccagcaacggguuaaggauagucaaggcugugcuucaguaagaucugcuccagcaaacccuucaucccucauuagagacgcugacuucccuucuaagcaguguaagcuuccucguaauuacuucuauuuuguuuagcaauuuaucauucuuuucuuucagcauuguauuuaaacaucccucuggauuuugccaucaucuuacucaucugauuauuuuuacuaagaaaggaccguucucagggcaugguggccuucuuagagcagcaucugcucuccagccucgcugcuuucaaugaugaucuccuuguuuagacgguuucuucauucuauccaaacagucuucugaugagucagcacauauccuucccucucaggagaccuuuaucuguaguccacacugaucauaaaaccaguucugccuagaauguaauaguacacagcugcgcucuguauggcgugcuucggugcacuggucccccauaguggacaccaacauuuugacgcuuaccaagcaucuuuugguaugugcaaagcuguguacuuucuguguguuauggcucuuccauaaggaaaucaagaugcacucaggcuaaaugaguguccucaggcgugugcuagccucuuuauaguagaucuaggacugacuaacagguuugccaagcuucuuuguaccaugccauagcagaaaaucucugcaugucuaccucacacuuuuuccuaacaaccaggaaaguuaagaaucagucugucgggugugguggcgcacgccuuuaaucccagcacucgggaggcagaggcaggcggauuucugaguucgaggccagccuggucuacagagugaguuccaggacagccagggcuacacagagaaacccugaaucagaccauuuuucucugaguaugaugucuuugcugagagguauucacucgcugcucaucaguccagagggcgucaucacagggccagccuuugugugccaguaaguuaaagugcuugaacauaauaguaacacagauguauguuugucauguauaugugagggagaaugaaaggggagcaaaagaagggaaugacugagucccacagguccaugggagagauucuugucuccacugggaggaguugggacaguacuggaagucggcaucuuuuugacaucagaagggagauguauuuaggguuucagcuucagagaaugcagcuugcauuacucacuagucaagaaacccucggaguuagccaguguuuuugacguuucuuuauuugauaacacauaaccuuaauaguucauuagaagacuuaaaaaauaacaaaaccaacugcaugcgaguccuuuaguauuguaccuaggacauuaaagacccaggaagggugagucaacauaauuuuauuaaugaggaaggaaccugagggagcuugagaguagcuauugaauuuguggaagauuuaguccuuugggaacuuaccguguugaauagugggcucugccuugaaaagcagaugaaaauuaguggcuucgguacauccuuucucuugcaagauucugcuuucucuucuucaaacagugggggagucauuagaguuucuccauuagguuuaauuuuauuucagcagacguuauaggcugaucucagggaaauuaaauaacagaaggaaaacuagggcagagacggauggggggucagggcucuggccaaugacacagcggaugggggagaacuauucagaguccauguaggugcaggagguggugauggagauggacugugaaagcuugcauaaaccuucucucagcuguagacacaacaacccccaaauuaauuuguuuaauuagauuauaaaaucuuuauauauuccuuauuaaguuugaaauauaguuacucauaguucuagcaaguugagauaacuacuauauacuuuaacucccuuuuagagcuaguaugguagcuucuagcacuuaggaggccgaggcaggaggauuacccugaauuggaggucagcuuuggcuacauagugaguuccaaggcacugugaguuaagagugagacccugucuucaggcacagcagugcaaagcagagcuggggauagggcucuguggguaaaagcaccugcugcacgaagcuggcucgggacucugaucccaggagccacggacucgggaacauugucuucugaccaucacaccuaaacggggcugccccucuccaguaauagaauaaauucauuaaaauuguuuuauaaaaaucccagugucuuccauccaauucagaaguccugcacacccauuauuuaguuuaagacauggcuuuuucucacugaaggucuaugcguagguaauuguuguaauuuugaggcaacucuccuguauuuaugugccaaugggucuauacuuuguugagauagagaaguggaagauuuuuuucuucagcuauaucuguuuuuggaaguucacauauugagaaaccuugcucucugugcucuuuaauuuggauuaaagaguuugagugacaucgauuuuugugacacuggugaugcuuuaccuucaaaauuuuauuuugguuuuaggauuagaacccuauuuuaacuuuuacuuccaacuaauugaauauauacugagaaaaaguuagcauacacaguguuucuguguguguguguauuccgucuagcuucuuacacucauugcuggaguguuuacuaaaacuacauaacauuaauauuggcauuccgccauucacacaacuggccuggaauuugcaguguaggccacgcucacuucauucaggauccucuuggcccggcuuccugaaaguuagaguuacaagggcaagucaccaugcagaugguugauuucuuaauaucaaccaaaaccaugauuugugauauuaugauuucagaacgacuaaauaucacuuuagaaaguaauuuaauaaaccugucuucgucuaaagcacaaaguucagcggcuccugcucccaugcaaagucuagccuagcccugucuaguucuagucauagagcauugcuuaccaaguguaacacagugucauuugaaggacuagccaucaucugcagcucuaggguggguuaucagccaagcauaccuugucuugcgguaacuuagcuuaaccucagguagugcugcccucuggcuuucucucgcggugucugggguuguaagcgcacugggaggcugagugcugagugcgcggcagaugcuuuaggauagggcuaagcuugcgauugucuucagagugccauggcuaucagcuugguguugggcccauuuugcuuucagcucuuguauuuguucaugaaaauccgagcacuaccacugauaagugcuugguaguucaggccuguccccgaggguugugccgcagaggcaaacacagacaguaagagugugacaguucugggaaucacggggccggggggcuggguaacugugggaagucuccaguugcuugcucacauguccguccggugugaacccgagcucugcucuggccuuggucccccacccucagcagagucagugugguguguucagaugucuugucacaucauggaagaacaaucuugugugucgucagggggucggacaaguccagccacucaaagcccugucauucucaguguccuugaucugcagacacggcucuauaaaucucuggaacaaguuuucccaacuuagcuguaggucugcaguaaaauaaagcccacuuguccgcuucaucuucuccagauucuugcugcauuuguggugauuaaggugacagccucaagaggcacagucguaagcugucaauucguucaucaucucauacagcgagccugauucauucauucagugaguagacacugagcauuuucaugugcuagaaacuguuuuacauucuugggauauaacacagaauaccuaggugaucuuccagacuacaaagaucuaugacuagguaagauaccguaauuuagcuaacaaagauguucacuguauggagagaagcgagguaugaaagagggugagcgucgaccauaguguguguguaugugugugugaguguguucaugaaaagccucccugaaaugaagagacaaacuagguugauagccaggaaaggaaggauaguaagucaaaacggaagagacagagcugcguuugagagggagaaagggcagucagaacgccagaguggcugggcagcuugaggucagagguaguggguaccagggaccuaggaugcuuuacaucguauaaaaacuucaucuuuucacggcuggagagaugucucagugguugggagcuaugacugcuuucagaggacccacacugggugucucacaaccccucuaacucuggcuccaagggaucuaaggcugucuucuagcuuucacagguaccugcgugaaccugguacacacacauaggaaaauaaauauuuuuuuaaagaaugaaauuuuaauguguuugaauuuguaaugacuacggaccuuuuuauauucuaucucauucucuacgcuaucuaucuaucugucugucugucuaucuaucuaucuaucuaucuaucuaucuaucuaucuaucuaucaucuaucuuucuauccaccuaccuaccuaucagauaucagaguacccuauaguaagcagaagauggcaucaguucaaauuguuucuaugagggauucaaauguuucugcuaccauacuauguagggaagccuagaauaacuccauaugugcagacucaggcacuggaaacaauaggguugaugggaaaagagaguuaggguaggacacuaaaccaagaaagcuuaaagaaaguccaguaauugcuaaaaguacgaaugaauaaacagcugucuagaguuaugccuguuguuuaucuaggcucacacuggggaaggucugugucaucucauguuauggaauccuguguccuuugagaaggaagucuugcuucugauacaucauuucauaagaggcaaagggcuggucuaguguacagccugauuaguucagacagagaggaaggccugggcaucuccuucugcaucugcagcccacauugaaaagaagucaguguucugaagccacugaguuggucaccacauaagcuccgggaagucauuucuguagaucuccagccauccucccacccaagguugucuucuguugccaaugcuuucucuuuaauaauagugaaaaaaacuuaccucugcuugaacacaucagcaugcugggaaaaaucuccugggagccagugugaccuuaggacauaaugcugacugaugccaguuggguaugaggccggaaacacuguagagucgacuguacugcugcccucguuguuucuuaggucugaccugcagcuaggaucagcuucuuugcgauucuuguucaaauagauacucagggauugcagauaugguucaguuguaacauacuggucuagcaaacaugcagaccugggguuuuauuccuaauacugcacgugaagauauguggacauuuagcaagaaauaccauaacauuaguuuaauagugugaagagagguauaauaguguauauuuuuaaaucuagcacuugggaggcugaggcagaacugcagguucaaggcuagccugggcuauuuagacuucaagguuauucugggucauuaaugacuugauaucucaaaaacaaaaauaaaaauaaaacaaauguggaaaaaaagcccaacaucuguuuuaaaagcaauuuuaaaaaaaucacacauauacaaauaguguugcguuggggaugaaaauggcucaacuguuuggagcacuggcugcucuuucagaggacauuuuaauucccagcauucacaauggcagcuuauaacuaucuggagugccaguccuuagaaucucaugcucucuguuggucucuacaggcagugcacacacaugguacacagacagucucucaaacacgcauacacauaacauuaaauaaaaugucaaaaaaccuuaacguauuuaaauaaaacccauugcuacaucuuuaacaagacucacuuguuagguaacuuaaugucuuugacagugaggacuuaguuuacguuagacauuuauacugagauuauuaucaccauuaacauuguucuagaagauuaauuagugcaguaagccauaaagccaaaaacaagaagaaugacuguaagcggugaguuaggaaacaaaaucaacuacauuuauuaauaaguucuguggaacacaguagucugcauguguaguuaaguaagaaguuguuuauuaaaggagucauugugaaucaacaaaccauuuauuaguuauuagauuuaguuaaaagcuuuggauaacuuaaaaugugaaucacaguaaauccuaagaaauagauagcagguagagacaauuucaaauagucaagggacuuaaaagcagcgagggaaagaaaaucugaagucagccugacuugacuaugcagaacuuuauuuuuacauaacaaaugggaugguaaagugagucacugcaugugauccuguugggauuuguccaaaggaauuaaaaaaccagaacagucagaugugguggcucacaccuguuacuccagcacucagguuguggaggcaggauuuauuuuuuuuuuuuauagguuuucucuguguagcccuggcuguccuggaacuagcucuguacaccaggcuggccuugaacucagagaucugucuauuucugcauugugugccaccacugccuggcugguuuguuuguuuguuuguuuuccuuucccuuugaguuuaccuuucauuguaggaacuaggcuucaauuggauuucuguagaauuuauuugcaagcugggugugauacugcuagaagcccuguaguuguuugauggcuguuccagggaauuauuacuuugguaguugcuuuuaagggacuaauggagauaggucuuaaaacagaacagggcuuguaauggacacagagaggccugaguguacccugggggguggggugguggggugggguggggcuggcuuccugaauaggguauaaacuagucaguaccaggucugagacuuacuaguuuuggugacagucaaaaauggcuucuuagggguggggcauguuaaugacuaguuauggagauugauagcugcuuguuuuuuuguuguuuuguuuugauuuuuucgagacagaguuuucucuguuuagcccuggcuguccuggaacucacucuguagaccaggcuggccucaaacucagaaauccgccugccucugccuccugagugcugggauuaaaggagugcgucaccacgcccggccagcugcuugcauuuuuaaagcacuuauuuacuguaguuugaucuguugccccaccccuacccccuuaauaacagaauuagugccagucauuuacagggcuauuaaguggaugccucaguguuauuccuuacuuacuugggaauuucuagacuuuucuucuggccuuuaaucacuuucuagaucucucuagcugguuugucuuacagagcuugugaugugagcguguguucuccuggaagcauuuaugcugcugagaccauugacucucagaacuaggaguugucgucucauacugguguuugaucuuagaguuuccguuguucucuucuuuaccuugaguaaucuguuggcuuuugagucuuugguaguucaaauuuaacacuaaaagggguguaaagguuuugggacaaugugucacccucacauuuguagucccuugacugauuagucaucuuugggguaacugggggccagcuggguugucuggugaugaagaauugcucaaagucaggguacccuuuaguaccuucacccugacuugggagcaucugugaggagaggauagcggugcaaauagguucagaacgcacuccuaauguguucucagggcuuccgucuuuaagggugaggcugugcguuggauguugaugauggagaaacugccuauaugcggguaccacauucuccagcaguugcacagaagcccucugcaguagccucuucuuucaggcaggcaggcccagccuuuuggcauugaaacauugaaaccauugucaaccauaagguucacaucugaggacugcacaguuaaguuacaaaacaauaucugugcacauaaagacgccauaauguuuuaaguaagcuuacacgcucguguugcgauuuauucauagcuguccugggacacgugcuuccuggccacacauagaguuugaacucuauuagaugagguuucagguuuacuaugcaaggcaccuaaggcugucaacaggcuugaccaaguaucacugacuuaucgauuucccugggcauuugagccucaugauuuuacuaauacacuaaguaugcaucugucugucagcauaugcaaacagcaucagaaaguccguguguccacccugaaugcuaauuuauuaaagacuuaacuaacuacacacuagaaaaaucuuaucugugaggccagcaugaagacaaagccaaauuaguuaauauccccuuuccccaggguuucucuguguaguccuggcugaccuggaacucacucuguagaccaggcuggccucuaauucagagauuugccugccucugccucccaaacucuaagauuaaagucgugcaccaccaccaccugacucagaauuacguacuugugauugauaaauaguuuuguuuuggguugauugguuuguuuuguuuuguuuucccaugacaggguuucucuggauggcccuggcugcccugggacucccucuguagcccaguuuguccuuuaacuuggggugugugauaucaccuccuggcuuagaauuauuuacuuuuaauugguaaauaguguuuuaaauaaaauccaaucaaaugaaguccuucaugaccccaccucaugugauaauaagguuaacaacuuacucugucucacuccagagucacuguauagguaguaacuucuauuauacaguuccauuauccaguagcccucagguuuuguugcacacauugcuuguuaacuugggggcagccagagaacagggagcagacugccugacuagaugaaaucaaauaaaggagaguaggacgauucuaagaaaaucagcgcuuuaguugguaaaucuaacuuaggauuuaaaaaaaacccaaaccaaaccaaccaaacaacaugggagcuguaaaggugguucagugguuaagagcaugcaccgcucuuguugaagaccugaguucaguucccagcacccagugucagguggcucauaacagccuccuaacuccagugccaaggggaccugaugucuccugugccuccaugggcuccaucaccuguacacacccacacaaagauucauacuuggaaauuaagauaaaucuuugaagggcauggcuauuugucagguuuccuuagcacuuugacggggcacuuuggcuuucuucugucugaugugauagcuguacaaauauagcucccuccaguucacauggaaucaggacuucccaugguggggcuggggacagggucuggggacauucuguuuuucauguaacgcuuuacugaaauauaauccacagcuguacgauuuucucaacuaagauuuacugcugggugguuuuuauuacuuccucauaguugugugaaucaucaccuuaaucaauuuuagaacacgcucacaagcuguucucccacuaacaaaaccccaguuacuucuccuuccccauuuuucuaaacucccacucagccccggggcaggcacugcgcuaacugcaaacuagagauuuaucuguuuugcagcuugcacacaggcgucugggucccuucacagaguguuuucaagguuugcccauguuguguccuauaucacaacuucuugcauuuccauuggacagauauuucagagcugagguggaccacacuguauaugaucccucaucaaacauuuguauggaauuuuaaaaaauuuaauuaacucuaugugucugggcguuuggucugccuguaugucuguguaccacaugcuugccugaugcccuggaggccagaagagggcggaggccagaggaguguguuggauuccuuagaauaaccaccuuguggguggcugagaaucgaacccagguacucuauaagagcaguggucuuagguauuggaccaucucucuaagacccugauaugggauuucucuuuuuuuucuuuguuucuuucuuucuuuuuuuuuuuuuuuuugguuuuuggagacaggguuucucuguauagcgcuggcuguccuggaacucaauuuuguagaccagguggccucgaacucagaaaucuaccugccucugcuucccucugcugggauuaaaggcgugcgccaccacacccggcuaagggauuucuuaauggcaaagaaucacuguauauuuuugcucuuccugaagugcagacauuuuccagaguagaugcugcagauggucaagaggaaacaacagccugcuucuaccugugaaacaccacuggaguguuuuucuucaaauaccaagaguaauuauucagacauuugggaauuaccuaugaaaucaaaacauaaaaugcuuuaauauguuuucuugguuaggaucuguaauuuucuuauaauaaaagggcuaacuguauaaaaugugaucaagaucuuuuuuccuauaauucuuacacauuuccuuucccugucucccccuaccccccccccuuuuccacauaggauauuucagugucauuggguagaguagccauggcuuauuugcuuaacugaaaagagaggcccaaaggugaggaucaagcgauggauucccaucugguccagcauagcuuuuucccaugguaaugaccaaaggaauagauucguaaaaucaucauguucauuauggguuucagaacuaguguucccccgaccuucguuaaaaauuuaagaccuuccaacaucuacacaucccaggacaugacauacacaccuucagcugugaagaugaacuaauaaucuaucauaaucacaccgucagcucccacauuguacaucaugugaaagccaguguucucuugucucuugaucacaguugugcacccauuuauuucuucuuggcuuugcaagccugaguuuuacuugauguuacaucguggggcggucucacagguguuuggggugaguauuugugggagucccuuucuuugaugccgccuagagcaguuuccuggacugcacuggcaaagggcaugaagagcggugcggaggugacgaugggaagagaagcuggaguuugagcaggugggggcuccuuucccugcugugccagcguuuucuccucacacuccugccccucauucuccaggaagagccuuacuucugcccagccuauuuuuagcaugaaacuuucuaaugaacuuugaaguguucugaucugucuucagugucagguagauuaacuuaaacauuucuuucugaugguuuugauguugugucccuuuguaguugacguuuauaccaagaaaguagaaaaagacuaaucuggagaagugggagccaacauucucuuucuuccuccauaauuaaaugguauuaaugaaacuugagacagaaaauacauuauaagucagauuuaguccccuccccuucccuggcuuucauauuugcauguauuguuuuacauagcucucaaaccagaguaucgauugaaauuucaucccauguuuuuaugcaaccuuuaucauaaucaucuuuauguuacuauacaguuuucuuaauuauuuuuaugauugcuuaauauaccauuuucauauugaacaguuuucuauugucuagcuaauuucuaauuauuucucauaauauaacagugcacugaacauauuaugcacaguuauuauucuguuguagauuauuucaguuggguucuugaaguauauugccaaauuacuuucugaaagugacuaaccaguucauauuacuguguuaacguagcuuuaaacaauguugccagccuuuggugugaauauuuuucagcagaaauaucuaccuaaccacagcccucauaaccauguuuuuaaaauauagugagacaugccuggacaggucggucagcaguuaggaugcccacuaccuuuacagacgacucagguuuaaaugucuccagaacccauguugggucacucauuaccaccuggaacucuagcaccagggggucugaggcccucuucucagacacacacacccacacacacaccccaauaacaucccaguaucaucaucaucaucaccaccacaccacuacugucauuaucaucaucaucuuuaaaaagaaauacaguaagugagguuauguuguuuucaucccaauuucccggaggcuuugugaaucaauaauuuuugaugaguuucacuauaaaggcuuagagaaguugucugcaaaaccuagacuuaggaggacuaaagagaugccucagcaguuaggaacacuggccguauuuccagaggaccuggauuugauucccagcaccuaccugauggcucuuaacugucuguaacucuaguccagaggaucuagugcccuuuucuggucucugugagcacuaggcacacacauggugcagagucauauaugcaggcaaaacacaugugcucauaaaauuaaaaaaagaaauuaaaaaaauuuuuucuaaaaaaaaaucuagaguuuauuuaccacuauuuacaaaaauauagacuuuauuuucugacauaaccauuaaugaacaucugagaaauagagcuguaggaaaaggagccagccugugguacagugggaauuaucuauugcaggagaggcagggaggauguuugccccucaacaucucaucccgugguuaggaaaccuagccuuguugauucauucauuaagcaauuacccagagccugcaauguaacaggcuuuccuccauucauggggguauaguaguaaacaaaaucaagaaguccuggcccccaaauauacugugagacagacugucuaagggaagauucuguacauguuggauuuuuuagggggagaauguuuuagccccuguauaugcagggcugacuucuguuuuaaacagacauguccuuacccuccagaaacucauauuguaccaggaaauaauuauuuagacuaguaauuacuguguugguaauacucacacacaggguguggccaaagagaguuaaagaacagagccugacuuacacuugaggggcuccuaaauuucuuuuccaguaugggaaggauaugaugccuguuugcauuugugucauggagcugagcuacauuuccauccauggcuacuguggacugaagauaccuucauugacuaaaugccuaaguuuaacuuaagucauaaacauacucagauucaccuacaccuaugugcuuucuuaugacuaugagauuuuuauguugccucucauagguugcuggaacuucccaaaacacaauuggaauaagaaccuuuuaaaaaaaauacccaugaaaagauuuuuccaaaguuauaggauagcaagaaaacccaggaaauugauuaguauucuagagacgagccauaccagugguucaccucugggucaccuaagacuauugaaaaacacaagauauuuacaauacaguucauaacaguagcaaaauuacaguuaugaaguagcaacauaaagaaugcaauggcugcacgggucaccaggacaugaggaaguguuuugaagggucgcagcuucaggaaggcugugaaccauugggagaugcuugguucugucugucuguccuggacaccauuagcuacugaaguuucaacaucuguaggauguaauaggagucaaauggauccuauaagauaauuuuaggagauuaauuuuaccuuucaaacacugcuucagauggauucaaaggaaagaguugcugguaauuauacugcucaaggauuguaggcagcuauugccuggcagugcaagaggcagaaagugugguuagcaguguugcagaaagcacuaaccuggugucugcaagaaguggaguuaccaagaaggcaaggaacagacccaugguucuuucuguaagagggguuggagguaucaugguggcauugguaacauaucucccugggaucuuucugucacuacacacagcucagaaaguaacucuaacuugccuuuuccuuggacagguugaaugcuucuggcuuagcauaaaguucaugaacuuagaaaaguaguuagacacagacguccguaucuuuccacucaguguaucuuauuacuguuaacugccuguuaaaaaucagacuucgauuuccacauucacaauauaaaugcccaucgccaggcuuagcaaaugaagcagauuugcuaagggaaauguaaguaguuacacaccccagguccuugaccgagcuuacccacaggacaggcagugucuuucagaaauccuauuaugagauuuuauuugcaggugcggugagcacaaggcugaaagccuccauguuuuauuccucccgacuucaucaugccugcucacccuauugaaaacugccaaaacgaugcacaucaguucuuuuauucuuuuguuacuacucugugcaaauaaaagcaucuugggggauuuaaugaugcaguguguccuuggagggagcuuugggagaaucugacuacacaauucuuugucuuuaauaugagaggcuuuucuguaaggcagauugacaagaaccaaauuaagcccucauggguaggcuaguauugccacauaagagccugagucacacacauuuccuguguagcauuaaccucugauagugacauauccaguguguuuuaggaauggaccaaggagcaguuggaaugguagaaacuagaguagagcuuuggaacuaucagaccaucuuggaaauggcuuguuuaagccaggaaauaagggcugaugcucauguuaaaauuaaaaaaaaaaguugcaaauuaccccaguagcccaggggugugggccaaaugaaaggccauaucaaagcuagcaucaccauucauaggcacugggcuuuuuauuguaaucugggaaaggcagcagcaguggauuugugcuggaaagguuuaaguggcagacaggaugggugaccugugugugcuuguuguuauauccuggcuucagguucugugccggccuagccuaccagcuucaugcuccuuauugcugauccgugugcaugcaugcaagcacgcacaugcacgugacuacuacauggauaacccagauuuugacucaguuccaaaguuuugguaccuuguuauaugggcgauggauguuugaacaccuccuggcuaugauuugucuuguauuugccugcaggcuuaaccuucccuggcuuaguuccagguuguagcaacccuugcuauauggcaccagccaguauguaacucaggguuaauagguaucucaccagugacauguacaggaaaauacuguucaggaagcuugguagaugcaguccuuugcuacggguuaagaaaccagaagcuauuuuuccucauuucuagaaucuuuuccuagaugaagacaaaaaccuauaagcauauaaaaaaauucugagagauagccaacuuaguguuucuguuuguuuucuacuaaacauuugugaguggaaauaaauuuccuacuuggcaguggaugguucucugucauagcgcgcaagaauuuuuaguguguuuggaggcacaugacauuccgauuuagaagaacacugaaggaucguuucaggguuugcgucagcgugcaggcugcaggcgauuaccaggugauuccaacagggaacccuuucccagugggucccugucugcuuccacagcagcucuuacaccccucuguguuggcgcuguuugcugugucacagugcuuggcuuaugucuuucccacuaaccgagagcuccguaagggcaggcggugucucaccugucuuggaaucacagacgcucuguguagucugcagugcucauugaggagcuauuaaaaugcggaggaucccgucccgcaggcagacacaggcuagcugaccuuuuggugguguguuugcuguuggaaaccaugcauauagaaacguggccuuuuguaaagggaguuucagagccugccaugauauguuauuguauugcuuuaggaaucuucccgggaagcuuugcaugucuguccuaacuaggguaaaguuuacacacaguagacacaguacaagcaggggacagaggacauucgucuuugucuuuagcuguuuccugggccuuuuucauuuggagaguuuacccuucuucuuucuccacauuugagaccuaguuggcgcuuuuaaauccagauuguugccuuugccagucugaucuuuuuauagcuucuuaauccguuuugcucugccuaauucuaugaaguagauuccuaucuaccagcccucucccguggccugcccaguuacagcuggugcucuccaggcacuugugacuaguaaacugaacuaacuaguuacagcucagcaccugccaacauuucuguaugcugguguuagcuacaaauaaguucacugaauauauuucuccaugacauaauauugaaaguuguacagguugauauccuaaagaaaauucguauccuucacaaagcucaucggcuucuugggaggccauugguucagcucuuaagaguuuggggugaauauagggucagucauacaguuguuuagagcuuugauguuuauaagagguauugcagaaacuaaaacguuagaugcccaugcaguguaaaguguaggaauguagagaugccaagucuuguccuuaucuagcuuuaaggauaugagaacauaaauaauaugaaugacauauguggucuggcauagaagaauagauacacauuuuuuauguaguauuugugugcgugcgugugugugugugugugugugugugcaugugcgugugugugugcgugugugugcaugugcgugugugugugcgugugugugugugugugcgcgugugugugcacuugcaugcucuauuugucuuauuuggcauaaauuucugauuccugagacaugugcuucgacuucuuuuauuaucuucggaaaacuuuucaguuacuaugucuucaaauauuucccauuuccucccaucuuccuuugguuccugcucugcguauguuaggucaugccaucuuugucauacccuuugaauugugugcuucugguuucugaguuggaauucuuuucuguuuguguuggguaccuugacguuacucaucacgaacuuggccauauuuauuuacagacaagcccggcugugcuuguuuuaaauuguuuuuuaaacguccaguauguccuggagaauuucuucgcauuguucucuccgugcuagaguuugagaacuuagguuucagggaaguguucccuuagucuucauuuccuuuccuaaauaaucaaagaguggagauuguacaauacugauggggauguuuugaggauugaaagaggucgugaguacaguaggagucuuugcugagaccuuuccucucucccuccugcucucagacacucauuaaagggcaacuccgcaugguuacuugguucuguuuaguuccuaagugguaagauuuugugagaggagaaagaccgaacguuuaucggcagucuauaucaaucuccuguagaaucugacggaagaauaaaacucacguuuuaaagugcaccugcagcccauuuucugggucuguaugagauguuaauuggaagaaacagauagcauuaaauccaguugucacuugguuacaucuguuaaaaaaaucauuaaaaauuuucaacuguugggcuucuuggcucgcuugagaaauuucauagcucauaauaugccucacucaguuuucccacaccuacaggauguuaacguuaucauccugguuuccgaguauuugcaaugugaagaauugcuaaugccacuuacugacugcuaauaggaggauuuagcagucuuacuggaguugacuuuggagucauggacuuggaauugaaauccuggcugcacaacucugaacaagcaaccuugagcugcuuauuuaauuuuggagcccaaguuuguucaucuuugaagcaaggaugguaccugcaucagcaagaccaaguguguauaaagcuuuagguauaggaauuccugcuuaauaagaaaccagucguugguagcauuauaaauggcagccagaauaaaauauccugccauuagaccaauaguucaauauaacuaaaagggaaagagaguuuaguauucuuacaccuuuuaugaaaaaaggucacauuguaaacaaauuuuuaacauuguuuaacaauuaggagggugguuaaacuaaaaagugaauauugauguguaauaaaaaauaaccaagaauccagugcuuuugagugacccauacugucaugaagccugcucuacucuucuggacugucuccuuuguuauaauguguggcccagcugcccuucuauguuuccagucucccuggauucugucaccauuuuuucuuuguaacucucauccucccuccuuacauucaguagagcuuuguuguguauuuggcacagcaguggcucacaacagcucuaucuguugcagaguugagucuuuguauuugucuugucauacugaagauccucuggcuuuaugcuguagauggaaacuuaagcagcaacaaacugaauguugagcugaaaaugguugcagaugaagaaacuccaucagucgggggcucugacccuccuaugcauuggguuuaagacaaacaaacaauaguguuuuccaguagagcuggaaauuacgcuuuguaaguuacuguggaguaaauauaaugaauuuuggaggucuccagauacugugucugugaguaauuuuccugcaaugggcacuauucaagacugaaauuauuuaauacaaagaaucauucuuuuuucacacagugagcagcugucuucccaaguacagaccacaauucaggcauugggacaacuuaagaauaaugguguuacuuuguaguugcuuuucuuuccaucccaaaaguuuguaccaaaguacaauccugaucuuagauuuguagaguuggaaauaauguaagagauccagucucucucuuucccugccauucaaggagaugaagcaauuuaucugaagucagcuaguuaauagcagagucggggagaggaguccccaucuguuaaugccacagugcugcucuccucuggaggaaacugccuacucauuccugggucccaccccuaguuaguguccucggugaggguuuuuuccaugacuaguuaguguucuuuuguuuucuugugugggugucugggaacacgcuaacaguauuuuuguuguaacaguugaacaguguaaggcauaaggagacguuugucuuuagugcuuuaggagucagaaagaaaugguuguagcucaaguucucugccuucauuguugcuaggcaguuauuuaguuguguaugacauauaaugugugugguguuugugugcaugugaaggucagagauuaacaucugaugccuuccucagucacucuugacagcacacacacacacacacacacacacacacacacguacacgcgugcacacacacacaucauucuuucuucuaugugcaugcccuacauauaguaugcauguagcggucagagaagaacuugaguugagggagucaguucucuccucuccuguggauccuggggguugacuugaguucagcacauguugugguaggaaccuuuguccauggggcccuccaucuuauuuuuggagacacagucacauacugaaucugaaacucccuaauccaacacgacuugcugcugacaagugccacagauccucuugccuuggucuguccccaacuaggauugcaggugcaucccugcauaccugauguuuuuacccaugugcagacaaucaacucagauccuucaccaaacgaucuuucuuuccaucucagagguggcuauuuuuaaaaagauuuauuuauuuuauguauaggcauagcugcauguauacacguguaccaugugcccauggaagucagaagguguugacuccuuuggaacuggaauuacgauaguugugagcaaccacaugggugcugggaauugaacucagguccuuguaggcagcuauuuuaaugggagcuuccuaaccuugaacuuuggauuccuaagaaaaucauauaaauacauguguauauuuuaagacaagaaucuggagcuuucaucaaaggauauguaguuuaacacgguuguuuagaaggagaacuaagccugauuauaacuaaguacugucauaccacaggaugucaccccugucuccauugccuucugcucgggcccuucccacugacagcucuuccugaauugcucguauggaaccaauaaaggcuucaaucuacuucuugcagggagguuuccccugacuuuucuuuuuuuuuugagauuacaaccuuuccccuuuucccuuuugucucuacgaacccucccguacacccaucccugacauccuucaauuucaaggccucuuuuccaguaguuguuauugcaugcauauaugaugaauauccaaauauuucuaaauauacccuacuuaguucacauaccgucacuugcaucuagguuuucaggguugaccauuuggcccugcacagucaauuggugugcucucuccuggggcagaccaucucuccugcccccagcuuuccaugguugccuacaguuccugugugaggccuucuucccuccccugcuccauucucaggacagggugugagauuuagggauguuugcuccuuagaguguucaggaggguaauuucauggccguuugauuugaaaaggaugugagggcugacugaugcacuaagaaaaaaaguugaauuggaauuccagucaguacuuugcaaauguacggucagaaugucuguacuucuguagguaggaaccucugcauuugaacuagaaacauuugcauuuucuaggauacugugaaaauccaaggauaguggcuuagcaguugcucaugucuaucuagaaaaaaaaaaugaguauuuccuucuugaauugcauuuaacuuagacaaaucuacuucauaagaagcauuugaugggcuucccuucccaaaagagaacauagagaaagcauguucucauauguuugcauauguuuguuucuuugucuagcaucugcacagacaaagacaagcucacacaaacggaagagcauguucauugguuuguucauuucaggaagcccucacugagaacauauaaagguuuaggcauuaucucaacugaugggaaaggaggcuggccuggucuuuugcuaggcucaccguaugcuacagaauaauaacgguucagggcugggcuuagcuuggcugguaggugcuugcccaguauguaugaugccuugaguuugaucucuagcaucacaaugagccagauggauggcucacagcuguaauucuaauacucaagauacagaaauagaagcaggaggauuaggaguccaaugucauccuuggcuacauaaggaguucaagaccaacccgagcuacauuagacauugucuuaaaagaggaguagaaaagaauaacaauucggcaugcuaaauauuucuguggaguaccacagaaacuuuccauguuaauuuccauguuaaugacugccagggggagaagugagaccagagccacuuugcuguuggccauagaagcuaggguugacuucacaaagacauuguccagauauaaaaggauguggguagaaauggugugcuuguaccuugccaguuuuaaugaaaauuggcucuuaccuguucucuuacuuuguguuuugaauuagagcuccaaacgagaauggaagccauuggaagaccguagcugcacagacauaccauggcugcuucucuuuguucucuucugcauugggaugguaaggacacccauguuaaccacaccucaacuuuggaugcaagggaaugaugggggcgggggggggggaaguaagaccuuccaguguaucuauggguauguaugcaucucaucucuucccuacuguuuauaacugggaucauugcagggccuaagguacgaugggggcaggggguauuuuccuuuuuuuuacaguucaguaguauuugauauccuuuugguauuuugcuuuauuuuguuuuauuuguaugaaaacugagaugaaaaugaaggacccagugggagucuuagcuucuucacccaguccuuugugagaaccagaaucccgaguaccaacuccugucacacaagccucauggcugucuuugggccagucucuucuuuuccaaggaacuugucauuccuuuaaaagagugaacguuagcuaucuuauauccaccacacuuugaacucucauaguuuugaguucuuuuuccagggaaagagucugcucagugcuuuguuccuuaugucaguccuaggccccaaccuaccauucacuaugaugaauggcaucucucugauggcaguccagacaucugccgauuccauacuugguagagaagaugagaaugggcaucugugcaaggugcuggguuuguggcgcaccuacucugccuugccagaauuuggcacucauggaugugguugcugccaggugcuaggcuucaaaauaauagacauacagcugcuuuagcacugacugguguuuggagcuuugaagggcuuaggaauacucaucuggcucaucaccuccaguuuauagauuaaaguaugaaaccuacagaggaagcugagaggaccacccuuaggccacguggcagugaguggaagagcugcuuaacagcucugcgauuggucagugcuuucuaucacccucuucagaggaacugcacagcggaucacucucugucucauggucucuuaacucagagugcaaucguacugacuccaguagcccagggcuuauaaguugauuuuuagccacauuuuucugccuuuucuauacagguuccuuuuggacuuacugcuuuucguuuguaauaaaagucuucaagauucuugucucucuuuauaccaucauguaagcaaguagccacagcuguagucaagguucuaguccccagcagaggaaaaggaaacaguacauuugaaugaaauaugauacguucaggaaaauaagcaguaguuguuuuaaagauaaaaguacacuuuguccaaauuugggaaacaccggaaaggucaacaugcuaacuguggccuuaugagcuauuguugaagaguuugcuuccuuuagugaaugacagauauuccaacaugugugaauauucaugaagaaccagccuacagcuuccccacacccauuguaaccccaggacaaauagcaacuaaccuucaaaauuauguuuccaaaaacaugugccaugccacccaaggugcuuuugauuuucugugcucaaauagcccaggaaagugcaaucauuaauguuaauagacugauuuaggaguuacuugagcgcuaggagcuguuuacugaaauguuuuaaugcagugguaauuaauauaauguugauuucaucacgaugguaguuaagacccacugugugugcuuuuaaauauaggcacagcauuauugguuuuggagugaaucuuuaaauggguuacuuucucauggcauugaccugaugucagguagugaagagauggaaggaaucaagaaguuccacugcccaucucacaagcguagcggaggcucauaguuuugcuucugguucuggguuuuguuuuauaugguuuuucauucaccccacuugaaauucauuccauagcaaaccauauuccaaacauuuggauaacgauugagaaggcucagugggcaaaggagcccucugccaagccuggugaaugaguauagucugcaggacucacaggguggaaagagaaccaguucucucaagcuguccugugaccucaugugcaugcaugcagcauguacaaagaaggacaaaauuuuaacaucaaaauauuggagcauauaauguguagaguaucucggggacagaacccaagucuaaacguagaaucccuucauguuucguauauaccugauagccacacccugcagguaauuuuauguaguuuugguugcagcucaucagaggaggucacacauggaauuuuccacaugugucccauguuggugcucagaaaguuccagaucuugaugcauuuuagauuuuucaggauuucagaugggaaauguaaucugaauucauuuuuauucuuuuaauuuucugaacaauguucuucacuaauguuaaaagaauucuucauuuguuaguguauuuuauuuaugugugcuuuccuugcauguauuuuggguacuacacgugggccuggugcuggcagaaaucagaagagugucaagucuccuggagcuggaguuccagaggguugugagcucccauaugggugcugggaguugaaccuggguccucugcaagagcaacaaaugcuuucuaaccaccagggccaucuuuccaaccccagcuagaauuuuaaaaacaaacacucaacaaacauuuguugaacauuguuaaucuguguaauucucugaauuauccagugagugaagcccauguauccacaagguauagugauguuaaauguuagccuauccaguaaguggcaaagauaggaacuuuccauguucuuuuccgugauuggcccugcuugcugcuucuuugcuuucuuucuuuucuucuucuucuuuuuuuuuuuuuuuuuuuuuuuuuuuuugguuuuucgagacaggguuucucuguacagcccuggcuguccuggaacucacuuuguagaccaggcuggccucgaacucuugaacucagaaauccgccugucucugccucccaagugccugcuugcuucuuuaauagaccguuuccuaguuagcuuguagccugguguuuaggccuuagcuuuauugccuaugcacagugucuucuuggauauuuuaagaccuuguucucuccccucacacccccauacgaauccuuuauuugcaugugcccaucuccuuguugugacuuacucuuuguucucaguuacaagguuuuauugcuugaauugucaagaacguacaauguuuuucaaaguaaauuguuaucaguuuucuugagcugccaucauucaugcuugaauuuaauuuuggggaggagagggggugcaaaaucuuauuggcaggcugagauuuaauucauaaucuuuugggcacagcuuccugcgugcuggguuugcagggaugugcugccgggucuggucccuguuggccuggaacuugcaacccugcuucugcuaggaucuguucaucguaucuggcauaaccuugcgcuuccaaauuccuguguuucagucaaguaguucucaauucuaccuguacacaacagucaucugaaauuuuuguuuagaaaucucacuuuucaguccccguuaauaauugcuaggcaccccagagagcugaggcaggggagacucugcucugugcucugaugcuucauagaaaggaguugcaaaguugugacaugacuggagucuagaaggggaacucugauucuaguguuaaagucagcuucgaagguagaagauguuuuagggaggacacuuuggagacuaggacgacaguccaaauaaguggugagaaacucaaaauguagcacuuugaaaaaggagaaaaagaggugaaagaagcaggucaguaacauuuaccagugguuacagugguaaguaggauugguaacaaugauaacuuuaccacuuguuaccuugguaaggaggaucaguaacauuuaccaguaguaacguuuaccagugguuacagugguaagcaggauugggaacauuuaccagugauuaccgugguaagcaggauugggaauauuuacugugguaauguuuaucagugguuaccaugggcagcacugagagucaagucagcaugacugagguuuuugcucuagugauucuggguaggaccuuucaguuuacauccuaacccauuucucuuaagguucccaaucauggcuucuauacguaccaggaauaggcaccuaauuuuaugcuucccaaacccaaauuuucuguuugguaaagugacuugggccagcuaaagggccugguccucuuguggaaaugcguaugaaaagagggucuagagaugggagaugaguuuaccacaaaaaggcagggauaagaggaguguccccagugcacgugaggcaucuguuuacuguaggguagugauugacauauagaaagacguuucugucucacauagaaguguacacuauauugauacaucucauguuuuacagauuaaggaaaccacaacacagcuauauucaauacgugaacuaagauuuuacaguggcagccuuaguuccaggaggaagaaggacuugauagaaucacauuguuaccuggaaucaggaacaacagaagguguuuuugucuaagacauggagcuguggaacagaguuaacuuauuuccagcuggugucugagacugacugaacaucucggccauacuucuuccucgacauggacuuauggagcugggggaggggugguggugcggaaagagaacaaagagcccucuuacuccaggucuccacaugcagccugcagacucuagauggagaccaggguguacaggaaagcauggugacugaggaaguguggacaaagacuguggcuuagggacauggagaguuucccaagaguacaccaucuugaaugcaagguuggaauuuuggaggcaggucugaggcugagcuggauuugggagcugcuauauagguucugcuuuagggcccuuccuaauucucuagcauuaguguaguucccagggcaugauguugcuagcaagcauccuaagugugggugggcuugugagagagaggcagugcagugcugaguucccuguuggauguucucugccaggaucauagaguaaaagacuguagaaaauuaccagagggauuuuggcccaggugacuaccaggcuuuuguuaaguucauuuucuuuucuguucuuuuuaaaaauagugguaaaagggauuuagcauauaauuuaccauuuuaauuuugcuuuuuucuuuuacuuuugagacaggaucaucuguguagucuaggcuggccuuacauuccacagucuuccucccucaacuccagagugacagaaccugagacugcaggccccuugcugcuaugcacaguaccacuuuaacaauuuuaaaguauacaguucagcuaaauaaauccgauuuucucuuaucacuguaguaaaccaagugaauuuuauauucucccugcaauuagaccuuuaaguuccccucccuccccucgcucacuuuucuuuagguagaauuugggauguggaagagcuuggaaaagacuuuaguucagucuucuacacuaggaagaccacaggccagagaguucaguuucugaggcacauuagugcgaaaggcaggaucaggucucuguuccuuguauggcuuuguugcuguuugucuuucuuuucuuccuuucccugucucugucugugaaacugagucuuagauuuggauuuccaucccucugcaucccguguuuucuuuuccuuuaagaauauucugguuccuuuaugguauguuuugccucugcauuuacuaaaagaaugcuuauugcguagaaguuucugagacuugucaaacacuguuuuccuuccucuuaaagcaaugcauucuauuaaacuuuaacagaaucugcaaguccaguguacugacaaaagcuuuguuugcguaagugugcuuuugugccaggccuucuagucugacuuuagcugcuagauccugaugucccucccaguugcaggauuuucggaagaggaggagcagaaaucaaguauuaucccacugcuuuaaaagugugauuuuggggagaccgacccacccagauugccagcuaugauguguggcguuugagaaagggcugggcagguguguggccaugaaccaccacucaucccccauucacuauuuuugggguauucacaucuuccuccucaccucagguuuuuguugaacucccagccccacaccuagugaagaccaucugcucugcucaguugcuuaguuaaaaugugggugugaaaaucagacauaaaguguauccugauggugcacaagucuaagcaaaaaucuuacuuaaguaacguuagcccuguggcgggggagcagcagaguuucuuauugucaguugucuuccucucauuuguaacuagcacccaggucuugucgucaccccaucccucagcucugugccuuuaucugcuuauagccacccaguuuacaagugguccaucugcugcucuucuucauccccucaggcuagcagcucccaaagcccuucaaaagcuugaauguuuucaucacgguucccuuccaguagcagugguuguguuuugcuccacauugacgagccuuucuucucccaaacauucccgucuguggugugguuuccuucugcugggugccuuuucccuccucuaucuggaaagccauugaaguauugaauguauucugagugcuuucccccacccuguuuuaauuucauguacugugggguuuuuucucucuucugaaauuauaucauugccuguauuuggauuuuuguguuuuucuuuuuaaagaggugggaacuuuaauuagcuuuggccucguucugcaucggugcuugaaccaagugggaaguccuuaggauaagaguccugguuucuuaccccuuauuaucuguuaccccacccgugcgguuuuucauacucggugcuguagugcuucuggaagcuucuaagaacuuugaaugaccugugugagaauaugacaaugucucauuuuagcauacauauguaacacuuauaauguauagaagcaugcucgagagagaagugagguggcguccaggcaaggguagggaaccugcccuguggaacaucauguggaacccugaaaaagaaaccaggaggggaaauccgaaaccaucucaaggaaucuguaacaauguuccuaucaaauauaagaagaaaaacuauaaauaaugaaagagaaacauaaccuuuuaguugaccauuuugcugcucuggacuaguaaagaaguuuaauugugauccaaaaguuuuuuggauaauaacaaaaauauuagcauuauuacuuauuuuuugcccccccccccuuugcaaaauuuuguuuguucugacaaagguaacagauggcggguuuugucacuucuuaguacugauggcagccucugcgggccaaacagcauucauauuacuacugacagcuucuauguauuggucagcugccagguagcugauacuuagccagggacuggaucuguguuaucuccuuuagcucuaucauuaugcugagaacagacacgcucagcguuagagaugaagagagcagagugcuuggaucaaagguaccagguucuaaguauagggagaguccagacacugagcucauuuaaccugcguuacuccaugaucuuucuuaguacccuucuguuguuauaacaaguuuuuuucuucuucuucuucuuauaauccuaguguauucaucucaggugcaggguggaauuuuuccaaugaauagauguguaacauagaacaaagaaguugauauuaggaacuccagcuguagucuucuagguucuaauccauuuuuuuauuagauauuuucuuuauuuacauuucaaaugcuaucccaaaaguccccuauaccuucccucugcccacccacucccacuucauggcccaggcauuccccuguacuggggcauauaaaguuugcaagaccaaggggccucucuucccagugaugacugacuaggccauuuucugcuacauaagcagcuagaaacacgagcucuggggguacugguuaguucauauuguuccaccuauaggguugcagacaccuucagcuccuugggugcuuucucuagcuccuccauuggggccccuguguucacaaguucuugauauaacagugcuagugucacuuagcauugacuugacgacguccacaguggacucagcuuuuuucgguguauagaggagaggaaugggagcagggcagcaggggagugaacucaagugacccagcugccccagggucagugcgggcaacucagcugaugcuuugaggggugaggcacuagcacugaccgaggcaugcaccucccauuguugucuccaguguguccuacaacagccuuuguguuaagggauuguaaucucaguuaguagaaggggaaacuuagguuugagcaaguuugaccaaaguuguacucguagaaaauggagucauccgugucccauugacaacacaagaguguauaacuccaaaggccagagucucuccuguacaugcucugguuucuaaugacagucuaugagcugugacuaagcucuuacuauagugccguucaagccuuaccccagcucgaggagcucuguaugcuucaugcccucucgucaggugagucaguugagguagggagucguucagagacuaggaaauugggcauggguuccguucuggguccacuuucucacugagggcuuuuagaaguuucuauggaacagaucugugcuaucaucucucauuaccugcacaaugaaagucagaagagcucucaagaaauaaaagaguuguuagaaguuuuuagacuuuuuagguaaggaugugcaaagggaaaaauacuuuccucugaggaauagcaugagacugaggcaugcgcuucugcagccugagauccugcagcaucauuuagauaagaaucgcugcugaccgucucugccuguuuaaccugacuaaagagaguagaacuuguccucucucugacuaggucccauuacgccccgucucuaguagagccauuaucagccaucacuggucuugcucuucuuauucccagcgggcugugguggauugcuggcuucucuugcuuuacugugaccagccccugucugaguuagccagcacaguguaguccccagugucuggggacuugccuuugggaccugggcgaauucccaugaaauaugugaccuuuacagccagugccuccuuacuuaccucccuccacucuccaguauuaagagugagcuucaugauguaagucuugggucuuuuuuugcaggaaggacaaaguguugugcucacagaggugauaaugagucagaccucacaugcuguuguucucggguuguaacccccauuuauccuuugcuguucacuuacuggauccccuuucugaccaagucaccugcagaaugaccacagcuggcugugaugcuccacagugcucuugacuagcuucuguggcucugcuuaacuuacucagaccucugcaggagacguagagaauguaugauaaacucccugcaugcagcuuagcucagagcagguguucaaaauggaggcacuuccaugaaugucacaaaaugcaaaggcgaucccaagguguggaagauugggauuuauuuucuuccaguagcaaacgguauuccccuguggacuucaugauguuccuaugcagaccagggaaaagaguguaauaguguuugcuaaaagggaauauagcucuuuguucccuucagcagacaaaagaaacucauuaucauaucaaguggugacugcugcuguugaaaugguuuauuuguguguguuuuuuucuguuucuuuucuagggauuuauuuguggcuuuucaguagcaacaggugcagcagcaagacuagugucaggauacgacagcuauggaaauaucugugggcagagaaaugcaaaacuggaagcaauaccgaacaguggucuggaccacacccaccggaagugaguagacucuuguauggugaacugucuggaagcuugggggaagccugggagggugugauucucuuuguaccuuacaguuagugucugugggauauuuacauauacuucuauacagcgauuuuuuguuuguuuguuuuuuguuuuuuaaaccacugcugcuuucauuuaacaaauacacucuccaggaaacauauuuaauugccugguuaaauaguggauuaaaaaaagccuugacuugaaagaggcacuuuugugcucugucuuuccauuagcccuuagguuauguucuccuucuuaagaaaauaaaguaauauucuuuguauuagguuuauauuuaaugcaagacugaaggaugauaauggauaucaaagccuuaaaguuauaaagaaauaucuugugaugcaaguauugaagucuuuccaguucuauaaaagcuacagacugagauaauuauuuugggcucucaguauucaucuuuaggaugucaugaaacuccugaccuuaauuguccuuacucuucaggaguuacuauuuuauuucuaauaucaacaggaagaugcauuuccuccaguaaacacaucauauguaugauugcugaaugacauuucaggccaugaguguguauaccaucaaauuucauuaucuuauaucaaggcaaaccaggucuucagaauuaauaaaacuaauuguacaauaacaagguuaauuagucuaguauacuuucucgggagugucagaguagaucguaacagcuugugauuuugugauucucuugguuaaaucuuggggcccuucuguauaagaugaguuugaugaguuuaugaacuugaagaacugugauuaguuguuaucuucuuagagacaguccucccucuaaugaagaagagaugguggaggucaaacuaacaaaguucugaguaacagcaaggaguauguacauagcuucccacaguugacaagcaaggcaggaguaacagaggcugagcuacuuuguuacucugaggugaccaccaaggccgagugggugguuggugggugguuggugggcgguggaggguccagcacagccugugagcaucuuguugcugauggcuuuugcuacccugccuaagcuccaggaauggacugugaugccggcccccacccagcuucccuugaauccauggauuaaaaaaaaaaacacacagacacacauugcuccauuucaacuugccuuauuggcucaauugcuggacauuauuaaacucccguggcuagcaugcccuccugauacucuuaacucagcacccuuaaucugucuucggcuuuaguugcucaguuaccuuuaguuccagcucagcauccccaacuucuuaccuguaaaaagcgaccagugggcgcucugcccaagaucacggcuucuggcgaacucucccuuccucuuaucuccugugucugucucuugcuuguggggacccggaaguccugccuaauuccuuccucucagaaguugucccauggcuucuuuacuaauagaucaagaaccaauuggggaauaggaccuuagcauaagaaucaaccccuacaccucaccuuuucuguccaauaauccaauaaaacaaaagaaaacaaaacacucuucucccagacauaaauugaacaaaaccauaacaaucauguaaauuacaaaguaugauaugcaauuaacauccugcucuucauauuugucaauuagauacaguacucuaccaucauuucuaacuuaacaaauggugauucuaucccuggauuaaugccaucugaaagccaugucuucugcucuauagucuuuuucucaauguuaacuugaguuugauuaugaggcuauaacugguuuucaacccugucauuuucugaagugcaccuauauccugcauccuuugagagaaguggacaaugggucucagcaguuuagaaaauuauuucauguauguuucuuuuuuuugguuuguuuguuuuuguuuuuguuuuuuucgagacaggguuucucuguguagcccuggcuguccuggaacucacuuuguagaccaggcuggccucaaacucagaaauccaccugucucugccuccggagugcugggauuaaaggcgugcgccaccacugccuggcauauguuucuuuauuaucaucucaugaaauuaacaugguuuagaccuugggucaguuuuauacugaaaauacuccuaucuuuuugguggacuuuuuauuuugaaauaauuuuggcuauguagaaguugaauagcuucaauuuaucuuauuagauagcaccugugccauaagauguuaacauacccagugcuguuaaaaugaaccaaauauaugagacuagcaacuaagggcguaggaaagagagaguuucuuauguuagcccaccguccuuugcacauguguuuaccauagaugugcaggccugacucaccauauuuaacccugugguguucauccaccggcugggggcggcacauuccaaaucuucuagcuaguuuauguacauguuggccucuggcaaacagaaauuaaacaucauucugagaaaagagccaccuuuucugaauaucuaccuuagucaaaagccauuuguguuuaaauguggggaauccaaguaguuuuuucuuaacuuauguacacgcauugaacaugcauuuuugugcacuuuguaaagcuucuuguuuguuuguuuguuuguuuguuuguuuguuuugagacauggucucacuguguagcaugggcugucuugaacucuuuuuuuuuuuuuuuuuuuuuuuuaauuuauuuauuuauuauauguaaguacacuguagcugucuucagacacuccagaagagggcaucagaucucauuacgggugguugugagccaccaugugguugcugggauuugaacuuuggaccuucggaagagcagucgggugcucuuacccacugagccaucucaccagccccugucuugaacucuuaauguagaccuggauggccuugaaaucagagguccaccucccuuauccuccccagcgcugggauuugaaagugugugccaccccauauuauuggccuccacuugaucuccucugcacuauuaccugcucaguauaaucuagccaaguaucucuauggaugguauugauuuguaggacugguagaauuuuggauaucaauuuucagguaagucuacauauuugaacuucgugacagaagacggcguucuuugucugccuuagcuuagcugauccucuucucuuucccugccauguguacuugcugccucugucuguagucauuccuuguccucauggcuucacugaacucuggguccuuccacaguugaugcaguacucuuacaccugugucaugggcugacaccuggauuuuuucuccuaacccucauccgaagcccuuauugcaaugccugguccuuauuugaccuucacauguauuuguugaauaaugcagcaacaaauccucuaaaacccuuucaugaguauuauuucuucuauuagaauuuuuuccccuucccauucuuaacguagcuaaauucuacucauccuucaucucucaccagaaaggucacuucacagagaagcugucuuuggauuuacaaauuaaacugugagucugacauucugccuaggaaugaaagaggcacccaucacaauucuaauuaaccauuuaaaaguacacucuccuuauggccuguaauauaaauaaguauccuuuuuuuucuucuuuuaauaauuuguuagagggguggcucacuuaaaugccaugaaggcgauggggucugcuuuuuucagcguugaauccuuagcgcccagcucagugucaggacugaagcaggcaauccauucagugguugcugaaugaguaaauaaauucacuauaaggagugaauuagugggguugaggaucugaauauuuuaagauuauuaaugcauauuucugaauggcuuuccauagagacuguugcauuuacauucccaccaacagugucugagauugcuuuaucuuagccaguauuauuaguuuuuauucuuuacuaauuugauaagccacagaauagugcuuuauaguuuuaauuugcaagcuuuugguuauuaauaugcgugcagcccccucucccccacuuguuagccucucaugacaacuauuguauuuagcacaucuauucuuggucuucuuaucuuuaaucagcucuguccuuucuacugugauaggauuaaguucuugaaaauggggcuuuuauuuugccacuuuccucuuuaagagccuuugcuuuccugcuguggucuauaguaucaaagaugagcccacucagccccugcccuuguaggccuuuagagagcuggacccauuucaccuacccaguccucucccacuguuccucaguaugguauuauuaccguggcauuugauugauuccaguucugugcuguugcuucugccugugugcuuaucugaaucuuuggaacacuuaugccaggucucacagcugaccuuuuugugaaguguuacaaaauaacacuauccuguaguaagcuuccuguacugugauugccugaacuuuccugucucacacucauuauucuauugccuucaguuagcucccuaauuauauuguguuucucaucugucuuuuaauuacugguugcuagguaacaguaucauaaauuuagugacuuaaagcaagacacauuugucaugucagugucugaugguucagaaguuuagauguagguugcugugguggcaguuuacuccaucaggaccaaugaacagcaucuagagaaucuucuagaacaauugaaguuacaccucuaugugguauacuuacgcuugcugugaaaaucacacucggugcugcaguuguggaagugauggaugucaucuuugccaucuuucugcuggugaggcacaaauuucaggucccacucaaacucaaggagaagagaauuucauaaggacaugaacaagagugucaggguuaagagaggccucuuggaccuuauauggugcucuccuacgcucuaucuucuggaagcaacauguuuuuguagcucucagcucugaguaugucucuuccuugaugaggacguacuuacuuguaauucuuacggaaggaggaguuaggagagagauggacgaggggaacagaucugguuuauuuuaaccaaauguuuaaggugccaagaugacuauaaggauuuucuuauuauugaagcaaaaucuauguauuacccuccuaguuauuauguuuuuucccuucuaguaauacuucgcaccugauaguguauuucuuauagaaauacuuauauguugcacagagaacugccccaugguguuuaugagauccaggaaagccucaacuucagauggaauuagauuuaugucugaauugcaugauuaagaaacuaagacuauccugcauagaagcaaaaucagauuuuagccaaguuugggucaauucagauaaaauuaucuguuauagaaccauggaguucuacaaugugagauuauuuaucuaauaacagccugccaagcacuugugaacagagagugacuuaccuuguagcugagcuguugugaugauacuacacaucauggguugggcuuagagccagacuuuugauuauagggaauggguagugaacugauuugcaacuccaaaaacagaccuacauguucuaauuugguccauaguuuuuuaaucuauagcauauaagcauccuaagaaugcauuugaaaaguuauugcuaucauuguuauuaaaaagaguaggauauuagccuugcaggcugcucuacugcuuaggccucuggcaacggccaaauggucagugucaucauguuauuguugugcugggaggagaagcaugggaaggcaggagugcugguauagagccuaccccuuaccuugccugucagugugggcacagcaggaugcaucagcuuuugucagauacugagacaaggggucucacuuugcuggccucugcaaggagacucgagguaguggggagggcuuggugcuuccagaacaaauauucugagauccugagugcccagaagagaggguauggcaaggggacagcagcucuuaguguagggaagggagggcaucuucuuaauuguuccgauugagguauuuaguuaugaaaacuuugcccuccuuccuacacaugaucuugcuuagugucaacuugcuuuguuacucugagaaauuuccccaguguaucuuucuugcuaguauugauuucuuuauagguucugaagauguguguguguuuuuuuuuuuuuuuaaucuuucaagucuuuccucuaaagaagcuauuuaaaguucuaguuacaggccccuaaaucaccucucagauuugagauaaucuguguuaacguguacaagaaguuaaaggucugaggagggggauggcaucuaucugugaauugucaauaugggcacaucaauaagaggaacaucuuacuuggugccuucuucagauuuuuuuuuuuuugcauaauauuauaggaaauggaguaaaaacaaccagaaugcaaggaauuaccuucuugguuguauuuauuuucacuguaagcuagcagcuuaccauguguguacuuacaagggaccuugagaucauugaauucauuuauuauaugaguaaaagaccuugcaucuaagaaacauaaguaacuugauggagacauguagacauacauguaaacauguacauccccgauggaauuguucuaguacauauacucucguacauacugaaacugguucugcuuccauccuucuuauaaacggcagaguauucgcuuauaagcugugcauguccuucuuaucuuaaccaucuaucaauuauuuacaauaccugauacugaguaaggagcucucacacuguguuguucagagaauaguaagaaaaauaauucugaauauaacaguacagggacauucuaucugucugucugucugucugucugucuggucugugugugguuaggcaaacaugugcagagaccaaggcuaauugagacucaucuucugucuaguguccgggcauaugguucugcgggaucuccugugagcauacagagauuuagguuuguaccuuuuuccuucuggagauuccucucaacauuucaagggagcauggaaagagacaggucauguagugucauaaacuaggagaccuugagagagaccaagucuauaaggcuuuaaagaacuugaaagcaaccacaaauuaaauucuuuuucuguuggugagagaaugugagcugaggggaugaaccacauuauuuuuauuucauacuuagaguuuuguuuuacuguuucaugaguacuggucuuauuuuggagaaauguuacaguuuuguuuuguuuuguuuuguuuuuuuguuuuuagacucuuaugaccccuggucuuccuaaaaggauagaggucugcaucaucuacuccacaccccuucucaguagaggguuauauggggggguuaggauacuacuggguaggauguguucauucauuaaaugauugcuaugcuuucuggggcuauacuucauacagucuuccauucuccagagaauguuugcuuuguuucugagacagucuugcuguauaggccagcugaccucauacagucccucugucucagcuucucgagugcuggaauuauaguugugugccuuuucccuguuguaauuuacaucucuuuggggaaaucuaucaagaguuuucaaaucuuguucacugaaaauccuuggcccuguuugaaaaagaaaaaaaaaaaaacuacagguaaaauuugauugaaaaggguguuuuaagauuccuuauggcuaggugcagcucuuuguaccuagaacuagcacuuuucuucucccugcugacuugagcuagauugcugugcacucaagggcuuuuagucaccaugaaaauucaggcugggcauaguggcacaagcccuuaauccuagcauguaggaggcagaggcauguagaucucugugaguuccaggucagccugguuacauagugaguuccaggugagccacagcuauuagagagacccuguguccaucugaucugccucaccacugccaaguaucucucucucucucucucucucucucucucucucucucucucuggggcuagagagauggcucugcaauuaaggacugcucuuccagagguccugaguuuaauucccagcaccuauauggcaggucauauccaucuaucccuguagucccaugggauucccucuucugaugugcagacaugcacacagacaaaacacaugcuaaauaaauaaauaaaaauaauuucuuucaaaaauucuaguuauuuuauuuagcccuugcccuacauucauugaaaauaaauuguguguuaugagcuacuucuagugauaauaaaauaggaaguagccuaaaugucucgauuaaaagggacauucagaucaauucaguuauucacugguaaacucuuuuucuguuucuuuuuucuuuucuuuucuuuuuuuccucagagucuaaauccagguguauaaacuguccauauacucuugagcuacauagacauaauuacuuauuuuguggaaauuguaaacugguaaaaaaaaaaaguaggacuucauaaaaucaugcaaucauagaggcuauagcuagcuaggggaaguguugcaaagggguuuuagagcucaggaacguacagugggagaacagggcagagacccaguagccccaaguagcgguggggcugccccuguacguugaaugcccagguacauuauuaagggaaaaaauaucaauuuuauaaugcacagaggccaacuuuauagauauuuguaugaauguacaagucagagaaugacauggaaauauuaaugcuguuguugaacaguggguagauuuuauuuucucuaaguuauuucuuuacacauacugugugcauuaaauuaacaacagaggcauucauagucccuguccuugaggaagacaaaugcaggcgugaacaauggcaggagcuccauccugugcgagggcuagccauugacaccuugugacucugcuguccuggguucugcuguccugggugagauguagugugcuuaucuacgccuaucgcagcugcugaagagaggaaaguggggcagcuggauggaaggaccagaaacgccauuguuugaguuuacuuaaagcuguugcagcagaaugcuguagccuagugauugaaagcaaugggguucuauaaagcagaagccaguggcuuugcuggcuagucucauagccaugcugcagagucuucuugcagcucuggggagugggucagcuucccaccguacccuccugcccggaguucaguuccauguggcuugaggacucaggucuuguguccuugcuuauuauuacgcaaggagucauuuuucagugccuaacaugaaccuguaucuguggcucacgaucccuuccuuguuccagugaaagccuuuccaucaugagccuucccucagggcagcuucuugguuaaagagccucaggcagagauggaggaagucuuaggucagggucauuuuagucagauauagagccccaguuucacagggagagguucaguucgaggcuuccagucugucagguugguguucuugcaggccaggcuaaugcaaggugaggacuggucuauaugggagggaacuuguaacugucccuuggcauugaagcgugaaggugggauguagcacguuaugcuuuguacagaagcuggagcuuggcaguguucuucagagcacccggcagcucaccugcuugcuuacacagugccuggaaauagguagauauagucuuaguuugugagacgggcucaguuuugagcauuuuccuucgcuuugaaggaaaucaccaaccccauucucccaucagguugcuuguagcugccaaccuuagcuugcugccucucucuccuccuagcuuagcauaaaaugagaagaaacacccuagguggagaccucaaaugaaccugcauuuguagauuuccuauaccacagacaucaucaccauucagaaaugguaacacuuaugaucaaauugaaauuugcucuaucauuuaugcaagguccccacucaguuucucucauaacaaaacauuaaaaguuggaaaaucuaaauuuucaaaagacaaguuuucggaggcauauuuggaaaauaauuuuugcuauauuuugugaugccauuauuuuuuuagcuuuaauuaaaaaaaaaaaguggccgggcgugguggcacacgccuuuaaucccagcacucgggaggcagaggcaggcagauuucugaguucgaggccagccuaguauacaaagugaguuccaggacauccagggcuguacagagaaacccuaucucgaaaaaccaaaaauaaauuaauaaaucaauaaauaaaucucugaauucaaggccaaccauuaaaaaaaaaaaaguaaauucuagugagauucugcccacugucauaauacuugcugugacugcuaauacuguuagcagccugugaaggacaccaaguguguguguguguguguguguguguguguguguguguguguguguguguauguguauguguauguguauucaucuuuagggaaugcaagagauggaaauggaacaguuuacagauucuaauuaggaaaggcucaagcaggauuagauggcaugaaugcagcugagcaaggcagggcgauugcuucccacuaugcaggacuaggguguacauuugccauguccacguuaggcagccggggugcaagcuugacuuguugguucugggguaaccagcaccacaaacuuucuuuuuaaagguuuugagagaccuuuguaacauauuggguuaaucacuucaacuaggaguuucauggacaugguuuuacgccuguccauguguaucugggucugcauugagggcaccaggcgagcuuaaaggcaugcaguuguuccaugacgauccauacacauccauccacauccagaugugggugcagagcucaagaauuacucuugggcucaaaaauaugccagaacucacaaaagucacaaacaugcuuccagcauauuccacaugggggacaugggugaggcaagaaaagggguacauuguucucauguguggaaagaagggagugaggcgccauuggagcacagcacuugccuggcagugguguguaaaauacagagaugggggaaagggaagcccaccucaagccuggugcuuaccguuucauugucuuuagaguagagaugacucagucuuuagcucucugcacacaggucacauggauaccaccugaucccggacuccucaucugcacaaggauguuggucucucuagaauaaucuacauacuguaggguuucuacaguauuugcccucaucauaaaucauauuguauggcugugugucaugaccuaagacccaguuaaacaaaggcacuccucuaagauacagagaguaacucccagaaaccaagagcaaaguuuagcucucucucugaauaaaguugaauucuuaccuaauaccagugcuauagauuaaauaggauuuuugcaaagagcaauuucaagaaaaaguucuaaauacuuuaugguuuuauugaaguauaauuuacauauaauaaaauaacauaaccuauuuagaauguuggugaauauauagaauuaagcacuguccacaaugauccacaucucuuucauugauagaaaauaacuuugugcucuuuuauaacuauaaagacccuaacuagccccuccucuauccuagcuaauccaagcagcugcugaucugcguuuugucaauacaauuuuacuuuuuucuuuuucuuuucuuuucuuucuuucuuuuuuuaaggauucuucaacaugaaaacaugugauauguaguguuugucugcaucuuuuuucuuuuccuuuuccuuucuuuuucucuuucucuuucuuucuuuuucuuuuucuuuuccuuuucuuuuucuuuuucuuuuuccuuuucuuuucuuuuucuuuuucuuuuucuuuuuuuccuuuuccuuuuucuuuuccucuuucuuuuucuuuuucucuuucuuauacaagcaccaccauaccuggauuguuuuuugauuuuuuaaaacauagcauaaaaauguuacuaacauucauuuaaguuuuauaaauaugcuaauaguuuauuccuuuuuaaauuuuuagguaauauuucauuuugugccuguauuauauuuuacuuauucaaccuuaauuaacaguugcucuuaccaucgugaguaaugcuggcuuggaagcuuguggacacgguuuuguaaggacacauauauuucagugcucuuggguggaugcuaggauuuggaugguucacacuguuucagugguuucgccauuugccucucucuuaggaaagugggaggguucuaauugcugugucuccuuguggcauucuguguugucuauuuuuagauauucuaguggguguacaauggugccucagugacuugugguuguaacucccuuuucauuuuucauuuugcuuauuuuucugaauucccauauucuuaaugaccagugaugcuggacuucuuuuaaagcaguggcugacaguucaccugucuuuugucaaguagccuuucacacauuuuuaaagcaauuuaguuuuaauaaaagaguuucaagaauuauuuauagucucaauacaaguccuuuaugaucugauuauaugaccuuugcugguuaccuguuuuuggugauauuuucuguagucuguguuuuauuuacccuuuuuuuuuuuguuuguuuuguuuuuggggaaaauugugugugugugugugugugugucugagugugcaagagugucagaucccaugcagcugaauuacaaacaguuaccagucacuagguguggaugcuaggaguuaaagucagguccucuguaacagcagcaaguguucuuaaacacugagucaucucaguggcaugggggguggggcuagacgaccaucuugggugguauuuuucaugaggguucuuuccccuccccuccccuccccuccccuccccuccccuccccuccccuccccuuuuuccuuccuccucuuucuccuccuuauucuuauuugaauucuucuuaagauauggucuuuugcuaggaccauuaaacuuggguugagauuacaagguuuuguuuugcuuugcuuugcuuuguuuuuaaccccucugagcuguuuauauaguucuguggauugaucucagaucuucaggcuuguauggcaaacacuuuacccacugagccaucuccucagcucuccuaauuuuaucuuuugauaagaaaagguuuucaauuuugaugaucuuuuagugguuuguguuauuuuuuguucuaagaauuuauuacuuuaccccaaagucacaaagauuuuucucuacguuuuauuuaagagcuuuuaauuaaguucuuaucuuugugaguacuuuuagacaauuuagguggugugaaaaauagacaagauugaucccccugccccaaagaaagaugcagguguuccagcagacuuuaucagaaagaauugucuuucccauuggcauuuuuuguugaaaauucaaacuugaagccauaaaaggagucucuaguaggggcagcuaccaagguuauguagagguagaaguaauuuaccuaaaacaaacaggaugcugccuuugcauaucauuguuuuaaauaacuaguuacagcaaaucacauaagagauaacuggaauguacguaugccauuagagagaaaaauaauacaagggauacaauacuguuuaggaguugcaacaaaacaugcccuaaaugagaugcuugaguugcaaguuauaaaacauaugccuaaacaaauucaggcauuuauuuuauuauuaugcugaaaauauaaugaaaaaauauauuuauuuuuuacaguaaagucuaucuguacccgcauauauauauauauauauguauauauauauauaugcauauuuauauauugccaaaugcagagaauuauaauauuuuaauagaaggaaagcagaauaauaauaaauaucaaaucuccuccuaguggguagucuuaauguaguaaauacaacaauacaaccaaaguuaauuuauagacuuaauacaguaccgguuuaagaccccaaugggaaggcaaauuaauccugguugcugguauaaaucauaaagagcagauaagauuuuucucuagugaggaaugcuuuuaaaaacuauucuuguucacaaaauaauuucaggguauuaaaagaaagugcauauauuguaaaacaguggacugguaccugagagggagagauugagccaugcaucagguaugucugagaggguagaccagaugucuaggcuauguguaguuacugaaguugaauaucaaaggagaugugaaauuucuagcuuugaaaacagaaagagaaccuuguggguuucacuagagguugaaaacccaaagccuccaggccaacauuguaaguuacauaaauagaguagguguaaagacccuaggagauccggggugcuuugaccuccauacguagugguuuuguguggugcucagauagagaauguagguaagaaggcuuugauacuaggguuguuuuucuuuucacguguaugugugguguguguauaagcauguucuuggguggggacgugugugugugugugugugugugugugugugugugugugugugugugugcgcgcgcgugccuauaugcacacuuguacauagagguccgagguugauguugggagucuucuuccaucuuauucuuugagacaaguucuuaguugaacccagaguucauuuauauagugagucauuagcuuacuuacuccaagaauccuguguaucugucuuugaagggugagacucuagguagacuagcaugcccaccagcuguuuauuugguuccaggaucugaacucugaacucugguccucuuauuucuacagcaaggcuuuaacuguuuugagucaucgccccagcccauuuuuuaacagaccagauaccuguugacagguuaaagaagacugaggccugccaaucuucugauuuuuauuuuuauuuuaaauguauuuuuagauuuauuuuauguauuuuauguguuuuauguaaauauaugucuauguaucacaugugugcaugguacccacagaagucaggagaaaggguuagauccccugaagcugaaauuauggaugucugugagcugucauaagggugacagggauuaaguucaggucuuccucaagaacaaguacuguuagccucugagccaucuuucuagcucugaacuuuuuaaguguuggcacuuggaggggugggggucgggggcgacucaccuaguagguccauggcucaaguucaucuccacuccacaacacaacaaaacagucaacuguuggcaauuguuguguuggccagguaagacagacugaggauucuauaguugccauuguuauauucuuucuagggaagcaaaggguggagggcuugcuguucuagacuaaaucauauuccaagaguauauucuaagaacugucuacauguagguccacauagucauggagacagaauggaaguaauacacuaaaacucaagagaaguagaauaugugaaagcaagagucauuuaacaauaaaaaaauaaaauaaauucagaauauugggcuggaugguaauauguugaauacuacauucagaacuauuuuaaucucauuucauacaaacuaaauuccagauggauuaaauauuuugaaacgaauauuguaugucauugaagaggggauaauuuguacauuguugaagcaauaaagaaauuaagucauaccuagguuggcauguucaauuaugaaaauuuggauucucuaauaaaaaagauaaaagcaauacaauggaaagagcauuuucaauuuuucugugaugaguugaauuguucaugcaguugaggguaucuuuacagguagauccauuggagagauaauugaggaagaguuugcccgguaggaaauagcaacaguaauuuuuuuggucaaagagccuuguugguaguauggacaugcagugguguuuuggaugaauaaguguaauagugauauuucagccuuagcauaguaccuggaauuauaaguguuaacugcuauuguggucuucauuaucuuucaaaggagguuugaaaguugucagugcuucuuucugauuuuaauccagaugggaagacuuuuagcccaugggcauguugcuuacaaagcucuuuaccauaucuugccccauugagucucacucuggcccugggaguauuuaaauguuucucagugaaugcuuucaggauuuacucuuccauaguuauggagucacagcaucuguaauuguucuccuaauaaaaucaacucaacuggguugaaacccucuauucuggcagcaagcaugucuucugagugugcacauguuuugcuuuguuuccucggugcaucuauucuucagccucugaucuuuuguuccuauauugucuccuaggugagcuuuuguccucuuucauccuuacuauuuagcccucuuucuuguaauauuuuuuuucauaguauugccacaauaucuagugucccacuauucugucuuugguacaaauggauaaaaaacugugaugggcaagagagucaagggacaucucuccaaaggaacugaaaggcaauaugcacacauaggcuugugaaagacguuaaacacuguuauccaucagugaaaugcaaagcagaacuagagaguuacuccuuucucuuccacuagaacagugauaauuuuaaauuauuuuguuguauggguauaccacaauuugguuauucauucaucaguugauacacauuuuuaaauaugcauaaggauuuggauguauuacaaaaggaguuuaaaauggaauagcugccuugauaaacauggacuacuuuucaaaaugucagacauaguuacucucugaccuagcaagucuacuucuugggaccuaccuaaaagaaauuaaaacaugugaacacacagagacaugcauaugaauguugauagcaauauaguugacaauagcucucaaaggaaaaaaauuauacagauuuacaucaccugauguauggauaacaagauugugguauagccauacaauggaauauuaugcauaaucggaaugaaauagugaaacauacacuguagcgugaugagcuuugagcucaugcuaaguagggguaggcaaugaagagaacugagcagugaaagguaguagauauggagguucuuuagggaugaaaauacuuuggaguuagauucuugugauaaauaauucaguaauauauacuuagaaacacugaauuuggugaacacagggauacauaugguagcccauguggcagggguauagggcuucccuguagucauagucccuaguccuccccauagucacagucccuugcgcuaccuauugucacagucuuuaguccuaccuauagucacaacaggcuauaggcaaagaagugagaaggcuuagguaaaaagaggaucccuugagccaaggaguuugagaccagccagggcaacuuagugagagagacccuuagugagucuuaaaggaaagcaaaacaguuugcacagguuaacuuuauggcacgcuaauuauguaucaguaaaguuuuuauccuaagaaagaacaaaauccuuuggcauuguugcaugacuuaauaguauuuuuuguugugauuguuugaaaaguugaauuuuuccuccuucugaccgugguauugaccgugaauuuggcuuugguaguauucuaguuaccuuuguuaaauagaacaauuacuuuugauagcucucaugaaauguuuuuauaaaguauuuauuuucuuaccucaguuuugcccaagagacagucaguggauuuauucuaauauucaucuucuccuucuugcuuaaauuuauuuuauuucaugugugcaggcaugccuacuuauagcugguggaggucagaagaggucauuagagcccuugggauuagaguuaagggugcugggaacugcuccugggaucuccagcauguuuucucuuuuugguacauguauaaguaggaaacagacacuguagcuccauagaauugaucuugucucuggcuucuccauuugccugucuuuguugguaacuaauauaucaaggguaccaaacuggggcuuucuaaagguaggcauaguguuguuuaucuucugugcucuuccugucuuccugaggacagugucccuuuugucugcauuuucugagaagucuugcuucauaacucccaacuguuucugggcuugcauucuccaaucucuaccuucaucagugcuaggauuauuaacauugaccacagugcucaagguuuuugguuuuguuuuguuuuguuuugaguggaacaggguuauggcccagccacccuggucagacuggaauguucuucuccuccucgucaggucaucacgcugucuuucuuguuccuguggaugagugaaauccagucucagccuaaucccagccaucaucucuugguacaaauccuucagccuccuucccgccgguuagucaccugcuguucguuuuccaccgugagcucccaacaacuuuccagcuuuaggaggaacuccagcuguccugccucugauaccuuuaaggccuacguccuuaagcagagcgcccugcuuagccucuucauccuucgcuacaguccacaucaacuguguaaccuuuccguguucucaucuuuguggccguaccugcucgucuuugacuccccucccagagcugagugacucuugcucauguuuuaguugcuuuaguuauguacucucuaggucccuccccugccacuuuuaagagacccauuugauccuucuugugcuggccucuuugcccaggugaggcauuuuacauugcuugcagcuccggugucucugugccaugaaggcagggaagggagacuguguauuuacugucuuugguuauugguuugguuucugagcuaggaucuuggcuaggaagcccuggcuggcuuugaauucuguagauagccuaggcugcccuugaacuuaacuuaagacuaucuggcccagccucccaaguacugggauuagaagcaugagccacaugccugccuagcaaguauggccauauuuauaauuauauuguuuacuuaauucuguaucuggcagagagcauguuuaaaauuuuuauguugaauaacaauauuuucaccuuaaauaucuucuccccuacuuccuuuccaccucauuuuuaccuggcaaaauuuacacaagugucaucuuuuuagugauuccauaaaugauaauggauuccuuuuucauugcaggcauuauuuagguacugaggguauagaaauagauucaauagucaaccagcccugcucuccuagaguugauugcuacugguggagauugauaguaacacauauguaagugcugaggagcaaauaaggcugguuuucucucucucucucucucucucucucucucucucucucucucucucucucucucucucucucucucucucccucucucucucucucccccucucucugucucugucucuguguguguguguugaggggcaggguuucacagccuaguuuagguugaccucagauuagcacuuuccagucucagccccugugucuccugaugcugucccuagucuguucaugacagcagugcacggucaccgcuuagagcucccucuuccuaaugcugccacagugacaaaucucaagguguguuuuugguuuuuauuuuguuuuguuuuguuuuugucuuuguuuucuaguguuuuuugcuugagcggguauugaaccuuugaauacaugcuaagcaagugcuauagcacugagcuacauccccacccuugcacauggacucuugagggacagauauugaagcuguagaaguacaugugcuuaugggcagagggagacuguugcaaccaucguacaacccccuagaucacaaucuacucuuagucacugugcccagccagccucucuuaauucuguuguuccagaguguuggggggcaagcauguuuuauuaaugguguguuguuguaguuagcuagguuaguuuguaguuagcuugguuuggguaugcacuucccauaguucuguggguuaaauaagauggcccuccuugggacacuuggauccuggccccgugugaugccuggacuugccuuuccuugucuuuccuccuccuccauggaaggaagaggucucuuugggcagaacucuuccgaggguagagaacagauccucugcagccugcauuuagaaucagcagaaggccugcauugcuguuauuuagcaguagcagaagggucugcaucgcugcuggguauuuuauuuuggugacucacuaagggcaacgugcuccauagaaaggggcuguacauuauaaacugauuccagguaauaauuggacaaaugaucagacuccauuuuuauuccccucuggggaagacaugugucaggacucgcuaaagcggaagcauccgaggggcuuugcugccagcuucucagccuuagugccgcagugcuugauuagagaggagagaagccaaauccggcaggaggcggccagcagaccugguaucuguuugccaccucuugcuccaaaaaagccuuacugcagaguugccauggcagcaggaggcaauuuaauggcaagggcucaucucuggauccgcacugcugugcccagcuuuucccccuggccuucaguuugaucagcugcuuacaccagggccuuacugugagguguccuuguagcuacacauugccuuauggagcaaagugugagauccccugaauucucaggacagccaccucucccccccaccccccaaacacuucuccucggcacauaucucuuugauguuccacccuagagucagcccuauccgaucauuugcaguuccuuaaauaugcucuuucaugcuucugcgcuuuuaggcaugcgguuuccucugcccgagugcucccuuccccaucugucuggaaaauuccuacucaauuucaaaaugcagcuuagacuccuccucccccucccucaugcucucucucacccucuuuccuccuugcagaucuguacagcuucuacagccaucucaaccucgucacgugggguugaaaugacucguuguacuccugccucuuuuucuguagucugagaguuauuugcauucaaaauuuguguuuuguagauuuuugcacugaaagggccuuuccugggaguaauauguaacaauguuuguggaauuacgggaugcuuuuuugugaauuaaguccugucuaaugcuaauccuuugagugcuguucccuacaaagguaaaccacugcauuguaaguagucagaguuccuucugcuacagaccugauggaccagccagccaucaaccugacacugguggcugugcccugucuuuccaguuaggaucagagagaauaacauuugugggucagacuuuacgucuaugcgaucuccaauuguuacccaccaucuggaucccuccgugggcuauugaauuguaguaugcugaggacacagccucugaggcuuugugagauacaguaacuccuugguaaaucucauuuucucuaccuucuucucuucuugguggggacaguaaaagccaaauagagguucaagccaccguuaaacauguagcagcaucuaacuggguuucaucaucucacucugagcacagcuuuucaaguuacuccuuuccuguggcucuuuuccuuuuccugaccgccugugauuuauggcuugcgccuucccuguugcccauucucauguuuggugccuauguccuguguacugugcagacacgcugcuuuuuguggguauucuaaccuuucuuuccuccuggaaagaauuugguauuuccagauuuccaaguuagaauagauuuugcuucauuucuucuucaaauaaccccagaacccaccugaacugagccugugcuuaaaccccucccccaccggucucuguacagcuuccucugcaggccagucugagcacuuugugguuugucuccugucgccauugcccuugucuguuuugagccuggcccuuaacagcugagccaucucuccagcccccaucacacuuucuuaaguucaaagcucaccuggguguuuggcaguucccuuugccagugucuuuucugcaccacccacccgagcaugccccgugcauacugugugugccagagccugcagguguccaggcuguucaguuucugaaaaguauucuugucauuguuuuucuucccccccauucucacgcaugguauucuagggucuauaacggaugugaaacuuaaacaaagcuguuucuaaguuauuaauagauuugagcuucuacaacauucuugugccucguccucauuccugacacaggcuggugacaguggaauuaggaugggcugugagacagauagauaguacuuuguugcuucuuaucccaugucugaaaaauacccucuguaagcugucgguuaacugcaaaugaguuccccuuaucuucauggaaagcauuccaagaggcagugcaguucuuuggggcuguggauuguacuaauuuuuuuuauuuguauuucauugugcuauugccgggagccauuuuuuucucuuaugaguacauaccuagaagaaaguuuaacuaauaaaucagauacaguaagaaacugacaacaacuaaccaugaaauugaguagucauaccaauaaguauaauaaaaaugacucaaaauguauuugucuauuuaugaaaauuuccauuugcuggucccugacuuuguggcuguuuccccagccacagguagcugaauccaugugaaaugaaacugcaaaagggaaacuacucaccugcugaugcuagccuaauuuguaaauagaguugauagcuucuuucacugucaaagggagagcaagccuucuuagaaccuagggccuauaaggagcucuucauaguguguuuuugugugaauuggauuuaauauguuuuuagguuggaacuaggguaugugugcaugcuaagcauaugccauuagcauauauuucuaaaagugcuuuuuguauuuuguauuaaguuguauuuugguuguauggguuauaguuuuucggaaacaugcucuuaugcuauaaucagcaguauuaguuugauagugcuaaauauauauuguaggauucuacucaccuucuuaacccauuucuguuuugccugaccugcucugagggcugcuugucuuaccaagccucuugacccaaugguaucuaugcagcuuuuccucccaaaugaaaaguaaaucuuaguauuguagucuuauuugugacuauuccagaccaaguugaguagaguggcuaacuaucaaaugcaggcuuuguaaagguuagguguuuucugugagaaaccaauaggaacugucaugcacauacugucuguuacauguguaccguuggugaccuuacaguagacuaaagaguaaaugguauaguguuuaaaauacagacauugaggauaaggagggaagauguuuuucuuuuucuuuuauuuuuuuuucaugguuuuagaacuuuauuguagaaaagcaaagagagagaagaguaaagaggcagaggguggccauggccacauggagagaggggagaauggagggguagagagaaagcaagagaaucaagagagcggaagauguuuuucuuaaguuaggcaaaagaaguauuguagggaggcuagaagcugaggagugugcauaccugugaucucagcugcuugagaggccaaagcagguaaaaaacaaacaaacaaacaaacccaacaggacacagguucagguugguauaacuaaggcacaguacaaguuaccauuuauucucaaguacaaacuaccacggccuuucagaggauaagguagggcuguaaaaauauaguuaggucaguuuuagcauugggagacacagaagcaggacaacagacgagcuaucuauucucaggaggucaucguucuuagagccuugucccagcugggaagccuggcagccucugccuuucuucacuugucucuaagucugauuucuccuggcauguaauuucuccagauacuucuuagggcaucgcuuaucauuaagaacuguguauucagugaguccccaacccacauuccacugccugcacagaaacaccacacuacuguguggaacugauguguacacagagguuuucugagugucugucacacgaguauucaauaaacacuggcugcauucauuaccgauaucauagaugguacuuacuauugccugugcuggcacugcuaguugauacacccucuuucagacccugaguguucccugcccagaaucuggcugugugcagucuauugucugugguccuaggaacagacaugcugagucacaugcgugggacagauggagggagaauuagugagagguugcuuguuccagccaacccagaacccauucucuuugugccugccuguacuaaccaccuccuuguuuucggcugugggcaccauccgugaacccugcuuccaaaucacaucuggcuucuuuguguuccuuuuaucuuuugggaacaucagugauuuuagagucucuaagagcuuguagauuuguagugcaucuugugcuucuccuugcugcugggcuccuggcuggucuucuggccgcacugucugugcaguguuaaugcuccaucugugagggccucucugguaccuucugcacuguuucucccgcucuggcauuucuagauagugccuguuucacccgugcauugacuuuagucuucugcuuuugagauuguguagcuaguucuguuuccucauuagauuauagccaaaggcugaggaaagugauuaccucauucuuacggucaguuguauuuggaauguagguuuaggugguuugugggaaaggacauugacuuuguaaaaugugccauggacucagaaaaaaaauguaccagggcugugguuaaagaacuuugugccaaauaagacauuucuccuuaugugcccuuuguggugcgaaacacuagucacuauuuaucuugucagaggaugugugggcuucauuuucucuuggacagguuaugauacauaccugcugucuuuagcuucucuuugauuuuauuuguuaaauccuacgauuuccaucuaagcuuugccuuuuaaaaauauuauuguauaaauauacauaggauauaauuuaggauauaugaauuauuuuuauauagcugcuaugggauuuuuaaaauauauaggaaauguacuguggcuauuccaauuaagauguaaccugcauaauuuguagaaaacaagaacccugagaaggaaggacagauuagagggcugugauguugcuguauauuuuucuaguuuucauucgaauguccacccauaucaguguguguucauuaauauacuuguuuccauuuugauaauaauauccauuaaccaaaguuuguaguuuccgugacaacuguaauguauguuaaaucacaacauugggauauucuaauaguauuugguacgaguuuaacaaagcaagaaaacgaugauuucugaugaugaaaucugcauauuauaaaguauaaauauuaggaaaagaaauugugaaaacuauuaauuucuucaauuacuccguucucuuuguaagcauuacaagucauuguuuucaaaccuuccacugaugguucuguuugaggauuggcaacuguguagcucagugaagucuguccuuugcuuuggggcuugguugaguaugcggcgagccauauguauuuugcaaaauaauaucuugguucuuuuuuccaugcuuuagguauguguucuuuuuggacccaugcaaccuggacuugauaaacaggaagaucaagucuauagcacugugcguagcagcauguccucgacaggaguugaaaaccuugagugacguccagaaguuugcagagaucaauggugagauuuuagacuguccacauugaucaccugggcuccugggcucaguuaaaugcuguauguuugcauuucaguauauacuuguccuccaacuaaauauguuauaaaacaaccuuaaggagaagaaagaagugguuugagauuuccuaguuuaguauuugagcaccaacugaggagauuauuaaaucuguagaagugcugggugcagugcugugacuguaaucccagcuacccgggaggcugaggcagaaggauugcuuagccuaagugcaggcucacuuagacagcguagcaagaucucuugucuuaaaaagacaagcagagauagauuauuucacaccuuuguugauaagaaagaaaaacagaauuuccccaggguggggugauucccagggaaauccucagaaggucuuugugauguacaaauggguauuuuuaaacuaaaugcuuuagguacuuucgauacacccuauuggauauuuucggguuuuauuacuuugagauagggccuuuccugagcugguugcaugagcugaugaucgucuugccuuagcgucuagagcugagugugugcuggaauuacagaugaaaucuaagcuugcuguuaauauacucuguauaaaguuuaguuuuccccuucuuuccaaguuuugcuuaaaucucacaaucuguguucacuccauccgcccauagucuauguuuaaucugcgguuaacaguauaauaugugcauauguaaagugauggcaaaaguuacaggaacgaauguaaagaacuauaaucaaauuucugcugucaguucuuuuucagugugcugguguacauauaauuuuauguucugcucuuaaauuuaauguugcaucaugaccuuuucucaaaauaguuuggaggaguuuugagguuaaaagacugggauuagccgcgaauaccagcagagccaguucccugcaaaucagcucugcucuuuggaaauucuucuuuccaggcgcuguccucaguccuacaugguuuacugcaguucucuuuagaguauuuuuaaaguucucuuuguagagcacugcaugcuaaaggccccucuggcccauguuuugaacucccugagcgagguuccauguuuguguuuugugugaagggcuucuuaugucuuccugcuugccuaaauccauggcuggugcuagguccuuucagcaacuuguugacucagguguuuaccccauguaacauguagcugacuaaaacaggcuuggagccauaaccaugccuaucccagccuggcuucagauccuuccagacaggaugcugguccucugaagggaggaagacgggugauguuccugacccaccaccucaugcccuuaguauagagagcgggaaaggcauggaccggugaggaucuggauucccguucagauuccaucacuggcuccauaagaagagauagaagagcuuucugagcccaggggucgucauccaaauaaacgugagggugugcgaggaguacugaauacgugaugggcacugaugaguucagcuucuguguucacuugugaccccaucuuugccuugcuaaguccugugccacaguugucagcccuguaacuucuuauacccugucuuagguaugggguacgguucuuuagacacguguaccacauaggcaguguaguucgcuggauaaaaguauaggcucucagauaaauuauuuagauucaacuguugauucuucaacuuaguagucuuaagacucugaacaaguuauuugaccucuugaagccucagccccaugacugucaugggacaguuucuguaccuaccucauugggauuuuuugcgacaaaucaauacaagaaaaauauuuuaaaaauauuuaaaacugguaaaaauguuguugacaguugguguuagcugccaccuguuccauuaucuuucuauuaguggaauguuagacucucuccacauccagucucccuaucaguuccuuagauacagcugcuauaaacaguuauuaucaguccucaggguuuucagucagcacuaacccauugcucagaacucaucagugguagaagucuguauguuuuauaugacacucagagcuauugucuaaucuuaaacuaucuuccgauguauccuuucaaacauacuggaugugaguuuuggugccuugaaccugacgugucuccaggaguaccaagugaaggcuaaaauugcccucugugugauuuguuugcucuugugauuucuugaagaggcauggccugugucuugaucuggcaugcuucauuucuaggccaguauccuuguaaguaaaugugauacugagugugguuuauucauaucuacccuaagaagacacuuccaguggaguugguagcuuuucauuccagaaguauuaauuaauaaauguuuuagcaaauagcaagcacccuugggcuugggagccgguugguauaaagaauaagaaagaaccugggcauguugauguaugccuguauucccaacccuugagagggaagggcggggggauggugaauuccaaggcaggguaggcuacauggugagcuccugguuccuaauacauaacagcaguaauggugagaacuuccacaugguagaagaugggcacaacaguaacuuuaguuggcaagcauaaaacuuuauuaaaauuccaagagaggaaacuuuggguauauauagccauaccugcuuuaauagcaaccccugaauuggaauuccuggauuucucuaaagagcuuacauuguucuucagauugguaacacaaaacuggagcugaccagcuguaauucauuguuaaauuaucaccgagauaguucuccugucuugcguuaguacccccucuuuggucuacuguaauuuauauucuuguugguaucugcuucuguacacaguugaucucuguuaggaaguaaaggcucuuuuagcucacguuuacagaccucaauauuacuuucagagaggagcuuucuguaagggaugauguaguuauaagugaaaaauguucagcuuucuaggaaauaauaauuaaagcccaugaaauagcuuaguuaaaacuguuagaacaaaauguaggcaaaggcuucgggauuggauuucuugaauggguccacauugcaccagaagcaaaagaaacaaaagaagaaaguauaacuguaugaugucagaguugaaaguuuuacacaaccaggccuggugaugugugucuguaaucugagcauuuaggaugcugaggaaggaggguggacauagucuagcacaggcuacguggcaaaaccuugucaaaaaaaaaggaaaaaaagaaucaacaaaucgcagacuuuuuaugcaagaagucacaaaaaucaacagaguugaaacaggagaaaauauuugcaagucuucuaucuggucagugguuccuaugcagaccacaucacagccgucucaguucucagguuucagucagcaccacucuggcccagaaauccuguaugucuuaucuggcacucagauuuaucgucuagucuugggacugccuuuuaauauggccucucaaauauccuggcugugugcguuugugcuuuuacgauccaccauuagaaagaagaucacagcacugauggacuuauagauggagaugcaauaccguguggcugcuauggagacccaggguuccuuaagucagcagugucacuucuacuugaaagaauugaaaccaggaucagaagaaacguuugcacggccacgacagucuguauguuauucaccagucaggaggcagaaacaacugcaaugcccaugggcagguuaacagaugaagacgauuucuaagcugagcauggugucccgugucucaaaaaacaaaugaagaaagagacgugcugauaggcauuugaugaaacucuugcuugaagaaagaaguaaauccagucacaggguucagcuguucauggcuggacugaggaugucacgccgagagaaguaagcuguccucaggacaaacacuuggaaaguccacauaugugaaaucccuagcguaggcaaguucaucaaggcaggaaguggaucgguugauggcagggccuguaguggggauaaaacgagggguuacuguuuaaugugcaaaggguuacaguuuuucaagaggaaguuguaggacuggauagugguacugguuguaaccacugugauuacauugaacaucacuggcuuuguagccacagagagcauucugacuuccauguuauguguauuuuauuguaauuuuaaaaaauauucuugauagaggaagaucuugugugaguuacauuuagaaugcuaauucuaagccuuauuuaaaauucagaguaagguuguauguuucuuuuuuguuuguuuguuuguuuguagacaucuaaauagauuuuuaauuuuuuuuugguuguauguuucuuaccaggaugaaaaauuaaauucuuuucaaagaauuucaaguuuaugugacauuuugaagguacuuucuagcacuuaaaaucacccauucacaugaacuuuuacuauauuuagaaauuauuuaaaauuuuuguaagaggaagcucuuagguccuguagcaguguuuauaagaaacacaaucauuagguaaaguguucucucuaggcaagaggagggguguuuucuuggguauuugugggaaacauuuguuaacuaugcuugacuuggguggugagguuagaagacaugucuggaaauagauuaguuaugcagcgguacugcuguauugcgaagaucuuuaaaagcuggcagagacaucuagauaccuguaaauuauacucugauacgugaauuggguaauaaaugcguaaauguaaauuucuuaugguccuuaauucguauaugacacaacucucagaaauauauaacgcuagguaagaaaacaauuuaaaaauggccuuuaaaaaaccgccauuaccaaaaccaauaagaacuccauauugaaccuuuguguuugguauaauguccugacaauccugugcgaguuucccagggacagcucuugcuauguuuaucucugaauacccaggccccaaugcuugcgaccacacuguagauaucagcuuuucuccuggcucucuugccacuuaauaacuucucagccucuauauccuuuauccucgguuccgcacccgugcgugcugccaccagcaggcagauuguuuagcuccagucuaaccaaaagugcugggaaaucuauuuuuuuuuuuuuaaauucacgucuaaauaauuccuuucauucauuuaucucucuucugcauccccuccaggugauuauccguccccuuucuucucuuaaucccucuuguuccuucucuuugccaaccuuaugcccuguagagaaaacugaaucugucuggugagagcccccuucugagcucuuauuucagcagggcgugugaauucuguccugccucugcucuucuucuagcuucucaugaauggguuucuuucuguccucaguaggauuuuugaaugcacaaauaccaucuaugucauagcgggaaugaaccgcccuccuucugaugcuagcaagcuuggguuuucuguaagguuuuuggcugaauccaagcaaagcaugacaggugacaaagaugccagugcaugcuauggaauucucccccucccucuucaccaggccggccuuccaucucuagccccauuguucagucggagcagcugagucuuagugauuagaaccaugagcuuugccucaacauucccuucucagugcucugugcuguaccugauguaucuacgagacguuaauuguuuccuagcucaguucuagcgaacaguuuagaaaugaacaucuuuucuagaagugacagcuggaccaugcaugcauccuugguugcugggaauauuuuacaugcaacauuaucauucuacuuuaugauauauaucauuuguauauguauguaggcuuguguuuauguacacacacagucuugccuaacauagcgaacuauggcuugauucuuuagaaagguaaagaaaguguauagucgauaauaaaauuuaaacuaauuccuucacaccaaguaugcaccagagauacauacguuagucccauauuuaagaggcuugcaguccaucagggucagacuucuuguccugacaagaccuagaagucuuggguauggauauuaaaacuucccuuagcagcugggaggugaugacgcacaccuuuuuuucuuguuugcaucucauuuauaguauguaaaaagugacacuacacuuuaaaagugcuucuuugauguacaguacaguuccuauaacucugagggugggcuacugacccacugcuugcaucagagacacaguuugagugcagcaggguugagggacucuuucaaaaugauuaucauuugcuauuaaaacuuuaacuaauuguaugacauuuagauaaaacucacugcucaugaauacuaauaagccuuugauugucauuggcuguuaaguuuauagucacuauuauaucaguaugcuuucccuucauucaguaacagcauaauuuaaagcauacaguuaguauagacuuuuguuuuuacauagugguacagaaggcuggacuugauaauguauguaaaugaacacagugaucuauucuagcaaaugauuuaguugcuuucaagucagggaccaggaugcuugauuuuuuuuauuuuuauuuuuagaaaguuuauaguugauaauaaaauuuaaacuaauuccuucacaaauaauuacuauucaccgaguaugcaccagagauacauauacuagucccacauugaagaagcuugcuguuaggauuaaaccuucccuuagcagcugggaggugguggcacaugucuuugaucccaguccuaguagguagaagcagguggaucucuaaguuugaagccagccuggucuauagagagaguuccaggauagccaaggcuauacagagaaacccuugucucaaaaaacaaacaaacaaaaguggugauguauuuagggaguuggagagauagcuuagugguuaagagcacuggcugcucuuccagaagaccuggguucaacucccagcacccacauggcagcacccacauggcagcacugucuguaucuccuguuccagggagccaacacccucacacagacauauacacagacaagaccccauuguacagaaaauaaaauaaguaaauuaagaaaagauucacucagcaaauauucacugagcaccugccaugcugacaagguaguaccaccuggcgaauuccugugcuucuugggaauuguaaauauguccacacauuucaggacuuagcagagcuuuaagccggaaaagugauuuuuauuuugccagauuauaaaugcacaauauuuuucaaauuagaaaaauaaaaguuaaauucauuagaugucacaaggcaauagaauuuaauuuuuguagugaaaacaugcccucauuugagauuuuuuucuauucaguacaaacuucuaaaucauauuucaggggugguucucuuuuucauauuuuaaugauuauaaagauugcuguaauggugaaugaaauacaaucuuuauuuccauaauucagguuuugguugucugcacuguaauggugcugccugacaaugguuggcaguguuuggacacauucugguuguuacuuuaacagcagcuuggagacgcuucuggaaacccgguggggagaagcuaagccugcugauaaagcccuaccucacauaagacaguucuucaucaccaccagugucugcugcaacgugucaugauaccaagaccgagaacuaguuugaucgcauguggugaaaagcauaugaacauuguuuguaaucugauggacuaaggacaugcaccaagaucaguuucaccuagccacuagaaagcuggucacgcuuggcaaaaagcccauauuuugaacguagaaauuauagacuggaaauauuaccaaguaagaugcccugcucuguaaugacgcuaagcgggugagucagagaagacuugacagggugugcuguuugcaguucugcucagacuuucaggaccuuacucagauccuagucugcacaggacagcuugagcaggaggaugggugcacuuaacagcaaggguugaaagucauguggaaggguaggugauggacccugcuagaauaucucucugguuaugauugugacgaauaaagccaaaacagauggcguaagaacauagaauuguaucuauaaacagcucaccaauucuuuuucucucuuucucccucccccuccuucccucaucucucuguuucucaucuguaacuucuacaguguaguaauagaguagaccucguaggguugguauaaccaaaauugaaccaaagaauaaauaauugaauauuuuaagacauuugaaauagccuagaaguuaaauauucuggggugagagcaaguguuuuaccaugauaaauguuuguauacccaaguuaggcuucucagauugcucacuuugauagcuuuugaauaacacugccugaguugcauggauugccucuggugugcuuuagauuagcuuuuguuuuuaguuuuugacuucucauuauucaaguguggguguuuuuuuuuuuuuaaccugcuuuugcauuuaaacagcccuguaugucuaaguccuugggugcaaaccucuuguggcaggcauuguuuauaauacugcuguaaagaaagggaguaucaggcgcugcuuuuaaauugaccacugaaaacgcauucaugaauaacgugaaaauaugacaacugugaaauguuugccuugcaaguuuuuuccuguggcuugauugagccuccuccacccaucaacucugagcaggcagcaguggaaaguuccuuacgcuugauuguugccacuaacuuauuaugaaggucuuuuccccucaguugaauacaggauccacucagaacuggcccaagucccagaagaccauugcagauaaagcuauuauccuuucacugugcauuauucugggaaaguauuuauaaaauugagccuuguugcaccugcugaccuccuucucugagggagggaaggcuuggagcaguagagacuguguucauugaauucagauggagcagugaguuuaacagcagggacacaacucucaguacuuuaguuagcgccuuucauuuuuuugcacauugauuccaucuuggucugggaaagucaugcugacaguuuagcucaagaaggcuguagucacauugggugcucugugcuuguuggcaugguugcuuuuuuuuuuuuuuuuccuuucuuuuaaauggauauuucucaacagaacuugcuauuuuuagggcuaaucuaaaauauuugguuggugucagguuucuuccaaaguugcuaugaauauagcuugguggcauuaucuuaacacaugauagacaauacuuuccagggaguuacauacuuaauauucauuuuuuacucuuuuccccccuuaaguauucaggaucaaaccuagaacuacaaacauuuuaccacacaauguagcauuaguucaugugcuuuuuaaagaauuuuuuucaaaaugaaaaagaauagcuaaaagucauuuaaaaaacguaguccccuaacuaagucuaccaaaaaugggaaacccuugggagaagaguguuguaugacuaacguuucuuuaacaacaguuuugcauuaucuuugcaugaaauauguacuauuuauguuuuggugaauauguuauugcaaucaucauauuuaaaugcuuaccagauaguuuucugguuucagauauuuucugauaugcuguuuuucagaaauuucugaaaacuaguuugcuugaucaaacaagauaaaaguaaacaaacuuacucccaguuuuuucccaagcaaaccaagauauguuuauuuuuuuaauuuuccucuccauuucucugagauaugaucaagagucuuuauuaacuuuauuaaccgaguguugaaguuggccacucugaccucacaguauauuuugagcccguuucauagugguacaguuuaagagcucaguauuguucauugugccaacaaaagcucuucuauuuauauuaagaaugcaguauuuugcuaacuuagaaaucuuguaggaauuucaguuaguuggaugguuucuguguauaaugugguaagugcucugcaaaaccaaagcagcaccagccugcugcuugcacagacgcuucuguuguuggagcaguaaaccucccuguguggaagucacuaugucagaaagcuugcagcucaauaaaauaaacuaaacucaguggagugugucauucugacuucucagugguauuuaguauuagucauaugauuagaguacccuuucuauaccaaucaaaaguugaauuugagcuacuauaagcugucugaaaauuggagaacacuuaccaguuuaugaauuuguucagugauuuaauaguugaaaauaguuccugccuuuuaaauaagaaaaaugugauaccccaccuucgugcaaugcugugugcaguauauucaguucucaguaauggaaaauacaugaaucagagacaguuauagaguggugugcaggguuuauaguaauaguugggugccugaugaaucccaggcuuucuaccaacugcuugcuuaucuccuaguuugugaguguccuagugcccauuuuauaagcuuacaguaagugauguauauaucucugucaucuggcaaaaaucagacaugacagucaguagagauuuuaguaauuuaaauuugugccuaaaguccauuaaauuguggaucauuucagagaaaaguguuuuaaaugauucauaguauacauuaagucucguuuuuacagaaucgauaacaacugcaaauguacauuaguauuaccaaguuaaggagaaacaguuggauacuuuguucagagucuuccaccagcuaaccugugcccuucuuccaacaggcucagcacuauguagcuacaacauaaagccuucugaauauacucugacuucaaaauccucuggcuuuugccccaagcuaccaguaccagccagguaaauuuuauuguaaaguuguuaacuuguagccuuuguuuucauagcuaaacuuaacaccaugauguucugagaaaacugucauuugaugaugccugucacuggggcauccuugauaaccauauuuuagaaguuugacuaaacuuaauagcucuuuguuuuuguuuuuuaaaucuuuauaaaaauuuacucacagacaacuucucuuguucucagauauuucaaguuucccucggggcucugguguuuuauuaauuuuacaguuuuuaaguauauaaaacucugaaucauuguccagucuacaacaaaguuggguccaauucccacuguccccacaggugccuugagguugauccuaguagcaccaacggagguuauuuuuuauuuacuccauaguuccaaaggauauaaaugacccagcuguuguucaggucauauccuucagguguauucucaguguuaggcuauuugccaagguugauccaaauuuuauuuauagcaaacauuuauuauuaaauacugacuguauguaauagaccaaagaucaagaaauauucuuuagcagugguucccaguacuuagaaguaaagcaaacauuaacaugacacauacauuuuuaaacauacagacacucaagcauuauagaguauauucucaaaauuauauauauauauauauauauauauauauauauauauauauguauaugugugugugugugugcgugcgugugugucuauaugugcacacacuuugaaguacuuuagcuuucuaacagugugacaugggaaaccuauaaagugacuauguuauagggggcuauuaagugaaaacuuugagauuugaaaacacgaaagcacauuaugucaacuuuaggauuacuuguggcuauaaaacuugugcuuaacuucaauuuuaaauuuucuuuugcaaaguacaaaacagacacauuacuuaaauugauuucuaguucuuuuaaaucagaauuuaaagccuguaggcauaaagggacuguuuuagaagaaacucaggaagaauuuaaaaauuacagccuuaaauccaggacucaggagauugcacuaauagaagugaagacugcuaggcaugccucagccgcagagcaaaggugcucuggauccagucauuguagaaaauguauugauaauaacaagccagagcugggccuggaaguauagggcuauaaacccaaaugcuuaagaugcugaggcaggaggaucucaacuucaaggucugagguaaauaacaaguuugaggcuagccuaggcaacucggucaacccugucuuggaaauguggcucaauggagaagagaagaagaauuugauaugcauaucuauccaacuguuaaaguguuuuuaaauguauauuuugaguaucgacuaauuuuuucuaggcuaaagcauacuauuuaaaaacaaaaaaaaccaaaaacacuagaaagcccugggcaugggagugagguugcuuugcuccuucauaauuguggguggguguggguauagcucacaucacaacccuaucucacaaccugugauccuuccauaugggccagcuuuguuauuuacucauuucuuuuauucauuuauucauucauccauucauucauuuugaaauuuagacaagagucucacuauguagcucuggcuggcuuggaacuuagaaagaguauacugcaugugccuuacaaguacuggaauuaaaaguguguaccgcaauuccuagcccucauuucaauacacguguagguguggguaggugccuacagaggucagaagaccaagucugagucccuggaacugagcacucugugaugugagugugguccuuguuucccucuccuuucacaucuucucuucauccccuuccccuaggaacauagcguccacugggacagagcagcaaggacuugaguucaaacaagucaugacuucuaaacuugaauuugaaauauuucuguggggaaauagaaaagggcacaucggucauauugauuuccaguucuuucagucuuguuaggcugcuacuaaaaaucaaaauguaacgucuguagacaugaaaauagacucuuuucagugaugcucaguaagaaaaaccuaaaauuuauagucugugggggacuugucccauuguucuucuuaccagcuggaauaaaucuguuaugcuguguguaaaccaaguuucuccaugaauaaauagaaauaugcauuuuuuuuuuuacguuaggguuuccauugcuguaaaaaaaacaccacgaccaaggcaacucuuauaaagggaaacauuuaauuggggcuggcuuacagguucagagguuuagugcauuauugucauggugggcagaauggcagagugcaggcagacauggugcaggagaagaagcugagaguucuacaucuugguuugcaggcagcagauggagacuuuuucuacacaggguguagcuugagaauauauaagacuucaagacccaccuccacagugacauacuuccuucaacaaggccaccuacuccaauaaggucauaccuucuaauagugccaaucccuguggaucaaggauucaaacacaugagucuaugaggaccaaacuuacucaaacuaccacaauucacauugacaaaauuauuucagggcuuaagauaauagaugauaaauguccauucuuuuuuuuuuuuaagauuuauuuauuauuauauauaaguacacuguagcugucuucggacauaccaaaagagggugucaugucucauuacggaugguugcugggauuugaacucaggaccuucggaagagcagucagugcucuuacacacugagccaucucuccagccccaaaauguccguccuugauacccagcuugagaaguauucucucugccuccugggugcccagaggcacacagcugaugguaacuguacccagcuuagggagagcggcugcagacugcuuuguaguaaacacuaauacacauuaaaggugggauaaccugugagcuuuggaguuuucagagaaaaugccuacaaaaggcaacaguuuacccaaauucauaccucuguuggaugaaaugccaaguggagaagcaguguggggaagagccacccugaaugcuucuaguggugucacggacagcgagggauaacaacaaggacagaacagucucucgguugguucucuuauuuagguuccuccugauaccgggacugccuggguaccaggcaguuaacauaauacugaggcaagaaaugaauaauugagacacgguauucccauucuuauuuucaaguggaagauagauggauggauugauuuacaaaucacuuccuaugucugaccaacaucccaucucucauauguauuauucucucauugaacccucacaaacccugugcagauuuugcccuuaauuuguugaugaaggaaaggggagaugagagaaaguaaguuacccaaggaugcacaguaauugcugugagucagaauuugagcauagcucuuacaggaccucuuuggcaguugcugcuguuucuagaguauauaaaaaugaaaggaaagagaaaaugaaauauacagagaguacuuuauaugacugcuagauucuucuugauuuaucuucagcuuuuuauacacugcagagaucuuucuagaauacuuuauuauuauucuuuucucaaaacuucgagcuagaaauaaugugugguuguuuaguuuuagcuugggguucugaaguagcaauugaggugcucaucucugccuccuuacgugaaggaaggcaggugaccagguuaucaggcacuguuggucauacacuagggaccuucuucacugucguagucaggacucagaagggaggugagcaguguguuugccuagguaauacacacuuuaccuaugaguggcucauuuuuaaaaguaucuucaaaagacuugaugcauauacauuuuauucuuguuggcuaauauuucaguuaugugaaaugccaggcccuacaggacacacacugacuucuucaagauucauuaguuugugcccuugaaagagagagaaacuuacuguaaagagaguucugugugcccuuuccauuaaguaaagacuauaucauauaggcuagacgauauuacagacaugaucucauauaccaggaucucagaaguguuuucucaggggaugugaaaugagagaauucauuauguuaaauaggacuuaagcaguaaaaccacaagcauuuccauguaagaaguauucaaaauaaaaaagaauucugugagaguaaccugauuaaaugcauuuuguccagguaugaacucacagacaauagauuuaaucgcuaaaaaaucuuaaauaaauuaagcuuuaaaacaaaagaaaagcuggacaauguuggcgcacgccuuuaauccagcacuugggaggcagaggcaggcggaucucugaaaucgaggccagccuggucuacaaagugaacuccaggacagccagggcugcgcagaaaaacccuaucucaaaaacaaaacaaaacaaaaagaaagaaaaauacaaaacugaauaugguaacuuauaaauaaccaauaaugucagcacuggggaaguugagacaggaggauugcuaugaguuugaggguagccuagacuacagagugagacugugaaucagaaacuaaacagcagcaacaggaaaguugaaggggcuaagaguguaguuacguggcagaaucauggcccugaguucagugggaaggaggggggaaagagggagggagaaagggaagggaaggaaaguaggcaggcagauaagaguuuuaacuucccaguuaaggauuucauuuuauuuuugaauaauggguccauaaauucuuuccuauuugcuuuuuauuuguccuaguucaaagcagauuuugaccauuuugacuauagacaaugcaauuaccaguuuuugguacuuuuauacuuuaaauuuuagagcuaccaaguauuuucuaacuaauauacaguaaauuauaagguaaaaggauacuguuguuucacccuaauucuuugaagggcauuuacaagaguuggccaagucagguccaagcagccugccgaggcauuucuuccuaaguagauaggaaggauugggauuuuaaagguacaguccuucccuucugauucugaauucauaaggaugccaacucugaccguccuggccgcgcugguucucaggauuggagucacagucuuaugagccagcucgcggguaacaaaggugaugcuggugcccugaaaagacuuacagaacaaaaccgagaagacaauggcuugugacugugcagugucaggagaauuagggcuuuaaucgauaucugguaggaaacaagaaaagcauaugcagggcaaaugaagaaggacuuuaggugggucccguucagguuaaagguggggaccaauguguucagccagagcuauaucggagaugacagaccaacacacacagaagguagaaaugcaggugacuauagaccagagaacauuuggguguguguguguguguguguguguaucuauagcuagacagagguacugacuugacagaaaagacaucucucuagauaacauagggaaaaauauaaccugccaguuauaacaguaucaguugaauaucuuuugccccaaaccagccucuguugacuuagaaauguauagcuaauccaguuuaaauuccuguaguguuucuaacugcaucuacuucacuuaaaaguauuagguaauuugauaccuuuucucauuuuuaaagacauaacacuguucaagaaacaauugcucagaauguucuagccuccuacaauuuaaaauaaaguguuaggaauuugacaugaacucucuagggagcucauucaaugccauuuuggaaguauacacauacagguacacagagaauggguuuuuaaaaaaaugaauauucauguuauauuguuacaucauuuuugaauacguuuuuacugaaauagaucuaagguaaggcuucaucuuuaaaguuacuuuguuuuuuguaaagucgucuuguggaugauguugcuuauuaccaauaguguucauuuaacggaaacagauacauaguucacuauucugaguucaaaaauauugguuuuuuuuuuuuuuugaggaaggaaacaaagacuguauuuugcuucaggucaguuauuguuucccugagauuaaaagccuugaaguuugauguccaaccauauaacuuuacaguaucaguuaguuacuaguuagauuaauauuaaagauuaaggacacaaaaacaggucuccaggccagccuaguauauuagaccugccacuugucacacaaacagcucuaaucauguuagguuugugguaggauggccaaauuuuaacuuaguuuauacauguauauuuauacauauguguuuauauguaugagcucuccaaaaagccuaguguucucuggugcacaguguuaucauugguuagauauguauauauguguuauacucucaguagcugaaguagauccauguuauuacaagccagauucaagucaugccucauacacaccuauguucucucaaaagucacagcuguaguacauggaagcuuggguuaaaugacuagaucaguuuucuuuuuuuuuuuuucuagacacaugucauauauaugauauauguauaccauauguaucauuuauaugccauauaaaaaguaaggacauuugcuggaguguaguugaggaguagagcaguuaucuagccugccugagaucuucccuggguucauugccaagcacugggaaagggaagaaaacacuccagcauugcaugacccuaacaagauguguauuuuucagucuuuacuagaguauucuguuguucccauauuuauguguaaucuuuuaaacagaaaugucaccacuaccuuauauguaauuuccccauguauuucuguguuauaaacauuucuguagauuaguaauaauggcuguuuuaaguuguugucuguuaaugucuuggcaugcuuuuguuuuaaugagguuauauaagcuugugcccuaaacaccuuuauuaauaugagguuuccugugaugauuugaaagaggaaacauucuauuaaugguggcccgucucaaguaaaagcauguguguaugcuuacuuuaaguuguguuuggcaagcguucccuucccaccgaaugaaguacaugcuuguaagcuucgccaucugccugcgguagaugugcagggugcaggaucucgugugcuugcguuugcuucugguaguucuccaugcguauguguauguguguauuucucuucggaaggggaggguaaugucuucuguuggaaugcgcacuccacccucucugauaaacugguaagauuggcaucuguacgcacagcagucaucuucauagcgcacagcacuuagcucccauaaugaaugcgcgggguggaguguaucgcagccauucucaccucucauuuguguguuugauguggcauuuauauuacguaggaguaauuuuuuuucugauuuuuuuuuucuugugucaccagugcaccuauuccauucuuccaucgcugugcuccugugaacauuuccugcuaugccaaguuugcagaggcccugaucaccuuugucagugacaauagugucuuacacaggcugauuaguggaguaaugaccagcaaagaaauuauauugggacuuugcuuguuaucacuagguaauuguuuuucucauuauuagcuguugcauaguacugcagaaggcuguucugguuuuagccaaaauaugcguacaauuggagauaacguguaaaauguuugacuacccauggccaaaauaacuguuucagauuacauauaacuauauacauaaaaguauguauggcauauaucugaaacucuuucuuguugcuucuuuuuuuuuucuuugauuaaagacuuguuuccccacugguuacuaagucaugguugauuaucuuuaauaauagcaggaggccccuucuaaugauuuaguaauccucuugguuuuagauaucauuccaaagguauauuuacacauaaaagaggcuauuuuauagagagggaauauauaaagaucuuauauauucuaagggcauagguuacucuugacguauguaauuuuacguuuaugcuauaguauuauaguauuauugccuuuuuggaaaagcuagguaaucuccacuuguuagccacagaauuauuuagucaauaauuagauucuaaaaauuaauuuuauuuuaaaaauaaaaaaccuacauuauucuaaaacuauagaagugcauaucagaguuuauaagacuucuuucuugagaauuagaagcuaguaggagccaaacaacuauuccauugcauaaguaaaauuaguauuuauguauguuuaauagcaguuguauucacugagaagauauaagcuguaucuccaccuuucuuaucauuagacaguguuuucuuuuugcauagugcuacuugacucaauuaaagaaaugcuguccacaugaaauuauaguucugugauaugugaaggcucacaucuguucucauuccugugcauuuacugcuaaacuaguacuuuaaaaucccuauacacagaccuaaacauuuauuuagcuuugcaaaugacccaaagaaaugugacaacuugguuuucugaaauaguugauuguauaaccaaaaaaaaaacauauauaaacuuuaagaauaauaaugugaauucauuggaauucuacuuuuauuagaauauuucucucuugaggcauaagaaaaagaauauaaauccaaaauaucuuuguuccuuucuuuguggaaugggcuuucagaucauuaaauguuuauaaaguauuauucaguauucuauuucucacacagugguuaagugccuccuuuucaagcauuuuaacugcaguuuuggcacacuggcauuuaguuugggguagauaagggaguuggcugaguaacucagccuaaucguugcucguuucugaggaacagcuuugcaguugguuaagaaaugagaucaguagggauuuggcuuuaguaguuuaagaauuuuauauuuuauaguaggcucauacccucucugaguuguagaguuaaauguaaaauauuagacaguguuaaaauaccaucuccuuugcugaauuagagaacuuugacccgagacaguacaggcuacucagggcaguauggaucugcagccacaugcuccgguuuuuuguguuuuuguuuuuguuuuggucaccaacaugacaugucaugcucuacaccucuugugcugaugucugugugcaugucugaugucucccugaugaugacugcacagcagcccugguuguugugcagucagcauuugcauuagcauguauucuuuucuguaguuuauaacccacacaguuaggaccuuugguuuucagagaugcuauuuaagugugugaaucauaauuucaaaagcagcccgucccuuuucaaaaucguggucaugaacuaagucaauagcaucgaauuauuccuguaggagaaagcaacacucguaagucucucucuuuguauuuucucgugguuuucaaaugauauuuguguucuguguuuucucugcaguucuguccaugauccugauggugauuaucagguauauaucaagagugcuaguguggauucuaacaguucuggucauacuggguucacuugguaagcaguuuccuccuccuuugcuuucauggucccuaauuaauuucaugguagaaacugaaauaaaaagaagaaaaugaaauuuuuaucuucccgugcuaguucuucuucauaaugcguguuuauuuuugccuuggggguguuauaauuauagucucguucccucauuucccucugguuagcacuugaagcacguacccuuuucugugcacaugcauaugggcacgcagcauuuaguuaacauuuugagcuccguugccugucucuccacguaugucuguaguccgacucaugcuuauccuucugcuguucacacccgcuuucccuucucuagcgcuucugcauagaauauuuucugacagucuucacuguaucugagauaguucuacuauaguugguagccuguguuuauuuguaagauacugcuucauccugugauuguuagaggcagagaugauacgugccguuccccagccuuugcagaauuagcauuuucugaccuuccugcguuacaggcucccuucuguucacucaugcuuccaagccuugucaaauaaucauagcuuuuaaauucaaguuauuauuacauuaaaauauuguuuuuacauacugugccuuaaggauuuaucuagccuugucuugagaggccuccggcuuacguuuacauuuaagguuagguuucuuggaccgaucuucuggauccuguguccaugagccuuucugagugcgucauuugguucaccuuuguauugaccgaauucagaugauuuauucaugagggacuuaauagaucccguauuuucccaaggucuagaugaucacauauugucuuuacuuuuacacgcacguucuggauucccuggguagaagcguguucggucgggcacauacgccccuuccugccugugcaucccgaauccucagacugaccacauugcagucgggcacauacgccccuuccugccugugcauccccagaaccucaggcugaccagacugcauuuuguuuccuucccugauucaccccuuagagguuuuuauguguuuuccagcagcccuuuaagauaaaggcuuuaaaaaaugagucugcuuccucuccuugccugucgucuuuugggaguggcucuuucccaccucagaagagcugcuuuuguuucugugguuggucauugguccugucccaguggcgguuuuucuuguuaaaggcauggcuuaguccacgauacgucauagucuucugaagagucuugcuguucuccuuuccaucgggaugaguuggccaggcugacucucuucccucuugguguuaauuuucccacugucaguccaugucuggcaaaaacagagggccugagaucugauacucaguuccgaucucugcucuuccugcucgcaucuggcuuuuccucuucucaucuguggcagccuuugagucugacucauguucagauaugucgcuuuaauaauaaaccucaauuuaccauuuacuguacaagguauuucguuacuuaacuugcccaauuucaguuuucuaauuugugaaaucaauaagaguguuuacuagccguaauggauaaacugggucacccucgguguuagcccggauucaggagcuucaugcacagcggcuacaguaagugugcuguaagcgucuacugugagcagccuuaacguagguguuuucacuccgcucuccgacagcuucagccccucucuggacugccugcuccuauuuguagagaguguaauucuguucauuuuccgauauguuaaacaguuuuccaagcagcuuucugguaccuugggacuucaaaggggaagaagaaucuuuauauacuuuuaguugauuuguuuuccacaaguuuucauuagaagaaaacuccacaguuuacuauucaccaacaaauaggauagggaacuuacagguggaggucggcuugauaaguguagaucuuagaccaacuuuuaucugccagauauuucuuauaguagucuccuuacuguagccaaucacugcuuugcaggauagucuggcaugcagguauccuucgacccauaccucccagcaucuuucuugcuggccugcuuuaggaugggucagugaucuuuaggauuagagaaggagcucuccuaguaugcagggucuugccucagccuccuagacuucucucuaggaugcuuucuccuuacguaguuucagaaguugaucuuucucagacguugcugucuugcccagacacaucaucucagugaggccuugcuuaucaguguuaaaaaacugcagcaccuuccucagccuaguauuguccugccuagauuuuccacuuagauuucacauucuccugugaguuacuucugcuaguuuacauuuccucauugcuguguaaacucagugagcagagagggugggcaucuguuuacuguccugucccuggugaagaggugcuaaauaaauucauuggguggaaauccagguauauguggaaguagguuugccuuguuauucagucuuuuuacgucugagcuaguauuagagauaaaagcucuuuagcccccaaacccagugcauucagagguuuccuacuuuuguucccaccuuuggggagaacuacuuuuuuugucuguuauuccuuuaucuaaucucuguucaaauauuuaaucaguugcauggccuucagcgcuaggccuuguuauuauaguuaaguggauugucaccgugucccaaauggucauaaaaaguguagguccagaaaguuaagcauauaugucacguauuuacuuguacugauauuugcaaaaccaaauugucguguaucuccagguggcacggguguauuaugguggcuguaugcaaagcaaagaaggucccccaaagaagcaguuauuccugagcagcuucagauagcugaggacaaucugcgggcgcuccucaucuaugccauuucagcgacaguguucacugugagugggaaugcaggcggggaucuuaguguugugugcauaugguccuaagugggacggagacucccuucagccccuggacagcuuccccauaguguacucccaguucaaaacugcuagaggccucucuaaucaaugaguguucuuuuuauccaacaguuccuucugcccugugugccuuuugagauaauuuucacuugggauguuuauauugucauuugcuaauaacacuuuucucauugucaaaauauaauuaacaucuugggaaacaauucuccauauugcugaauaauauauuaagaaauagaauaucauuccucuuacuuguucauuuguuauuuuugcuuguauuuaagacuuaccuuuuaacaaugcaugugguauugaaaauguaagugagacacacucuacuuagacauguguuagacagugacaaucucacugacuagccuguaguuaaaggagggaaucaucucaaguuuguuuuuuugagcauccaugagacuaauacuaacaauaauggcacuaaaacuauuggcuccaaagauauuuguuagccgugcuucuuuaacuagaguucucuaugcuagcuucuagaggaacgggguggagauugugaguagccaaugguuauucugccacagguccgaccuuaggagcuucagucaacaaaggagaugaaauacaaaggagcacuucccuugcuuugaggugguagcauauagcucucccaacauugcucagacugauaggcaugcugugcaauugaaagagucuuguccugacugacaguuugacugguaauuagugggcagagggaaggucuucauagacugaggaaguuccauuagaguugugcaccauugugcgguuuggguuuucaccacuuacagacucgaugcucuccucucuuccccuccucaggucauucucuuccugaucaugcugguuaugcgcaagcguguggcucucaccaucgccuuguuccacguggcuggcaaggucuucauacacuugccucuguuagucuuccagcccuucuggacguuuuuugcucucgucuuauuuugggcauacuggauaaugacacuucucuuccuuggcacuacugguaagaaaugcaguuucuucccccguucaugaaucuaauuuguacccguacauuuuaagucaucaaagagguuagggguguagcucaguauagaaugcuugcauccaugggugagagccuguuggucccuaguacaauacaccccccccccagagagauagaauucuucauaaauuuguugacagagaucuaguagccaucaaaucuuaacaagagggggcaucaauaacucaugcucacuucaugacuuuuagcagaucuuagcaauuuggaucuagaccagcuaagcccuaaaacaucuuaauuuugagagggucauggauuugaaguggauucucuauuuacucggauauuuggauccauuuugaaaugaauuaauaaauucauagccauugugccuugcuucacaguccagagucauccuggacuacuauugaguuccugauaguggagcacaggaccaaauauuaagauauggguguuaacugugagaggugaggguaaugacggugaccuugugugaagcaucucuguccagucagcucauacucaguaaaggaauaggacaguuauuucuaugcuuagagaauaguuuacaucuauaauuacuggguaaauaaaacccugggaaggaaggaaggaaggaaggaaggggaggggaggagaggggugaaggaaggagggagaaacaaacaacauucaggcccaaauaacugauaauggaauuagaacuauaucuaaauagauuaguuuaaacaccuuugacgaugccuuagaagaaaccaaauguguaauugugugauguuuaguuuugcaacuguuuaaaguuauaacaauugcgucccauagugaaaccgcacuaagagccagcauauugaguguugugugucgcaggaaacccuacugcuuguucacaguccguagccacgggucuuaguuucugcuauaugugaugugugaugcuucuuugcuuccuugacaucuucccaggcagugcuguucagaaugagcaaggcuucguggaguacaaaaucuccgggccuuugcaguacauguggugguaccacgugguuggccugauuuggaucagugaguucauucucgccugucagcagaugacuguggcaggagcugugguaacauacuacuuuacuaggugagacuuuuuaccuacaagaaaacccuaguucauugaguuagccauggcuacaggcaaagauaguggggcuaaggcaacaaccgucucuuuucuguuuuguuuuguuuuuuaaaaaagggaguuggaaaggaugugacaaauguaugguugguaacuuuguggaguggauauuccuccucucacacuuggcuguaauugccuccaaaccagcuuagcagaccauggugggaccuaaggaccuauaaagaaguaaacuugguugaguaucagguuaagagaccauuaaaaggcaagcuucauuuguuucucucagaagaacugucgugagaccccuuuugcuaccuucaggacugagaccuaaaggaauaaucuauucaguagucuguucugagcugcuggcuguagagauuuuguugguuuuguuuuggagacagcuggcuguccuacacuaggcuagccucaaacucacagaggcucgcuugccucugucugagcuaccaucgcaccuggccagcuauagacuguuucuuaaaauuccauuuucugaugauacaguuuauuccuuaaauagucacuaauaagaacuuucaaaaccaguuugaucuaaagucacagagcauaagaacugcucuguugguguuguagagaagugaagcugauuuuguaacauuuuuaccacaguuuugguuacuuugucaguuuguccuaaagcuagauaauauugcugugauuuuuuuuuacacuacaguagauuucagaccauauauaucuguauuuccuuccuguucuagauuuuguuuuaauuaucuucuugaucauuuuuaaaacagggauaaacggaauuugccuuucacaccuauucuggcaucagugaaucgccuuauucguuaccaccucgguacuguggcaaaaggauccuucauuaucacccucgucaaaauccccaggaugguccucauguauauccacagucagcucaaagggaaggugagagcaguguguuuagccaggcucucuuggggcgcauacaccagaccucaauucugcacauaguaggauaaacuucuagauguuuucuucagagucugaacaaagugggauccaguucuuccuccaugucucccauguacacauuccacaugcccugaacaaucaucugucuaaccacgagucaccaaguuuauugaaacagaagcacuucucuacccuuuuucuuaagaacccauaauaacuauauaugauguggguguggcauguucugauacaugcauaaguguggaauaaccaagccuccuagcuucacagcacuuaucauaucucugugcuaagaauauucauacccucauauccaggucagcucuguuagccaaguguccccaguaggagacagcagagggcagugagucuaacaguaagucucuaaccucugagcagaagcaggggaaguggccuuugacauugaucugggaaaggauuuuuucuuuguuaaacagaaagaacaggcaacaaaaaugagccugaagagucaagaaauccaccuaacccguaucucucauaaaggguugcugucuaacauauaugaauccccuacugacuuuggaaauaauuugugauuuucagcauggcugugcucacaaucuaccuuucccuggaaccugguccaagaauguucucuuccuguuccccacccucacaacacggugucaccaaccauacucugacuccaaccuuuggguguuugacauuuauuuugucuugcugguccugugucuuccucuaucauauauguagucguuaguauauaaauguugcuuugaagugauuugaaaauaauuggggaagacguagguauggaggccuuaacuuacauugugauuuuaaaauuuuuauguuucucgaauuugaaguuguuuucaugaugauuagauuuuugcuucuguguuuguuaauuauuuuugccuuuuccucucucaggaaaacgcuugugcacgaugcaugcugaaauccugcauuugcugccuuuggugucuugaaaagugccugagcuacuuaaaccagguaacacacacuacgagugacccacuuucaaauagacaggugccauuccuucuuccaagauaaauuaauugaacuuaauugaaaaaaaucuguguuuuucuucuggcauuauacauuguuuuuugacugaguauacucaaauuuuguuccuguuuuuaaacuaguguauuugcucacugacguuauuauguuaaucucaguuuugauacauggauaaacacaucauuggguucaucuuucuucaaaagucccuuuuuucuuaauucacaucuuuuuuuuguucuugcauuauguaaguacuguuugaaagcuuuauuuuaguggaaaucugcucuggguccuuuuuagaccuugacucuucugcacaguugcugcucuugguagagauagcuuguuucuuguuguuuuguuuuaaucaaaccgugagaucucuccaauauuggccugaggaauauuaucagaggaaguguuguuucuuuucuguuucugugugcauccacauguguggagcccugaggucuaugugugcaugucucugugugcauccacauguguggagccccgaggucuaugugugcauaucucuguuugcauccacauguucagagccccaaggucugauaccuuccucuaucauugaccaccuguuuuuugagucaggggcucucugaaccuggagccugcugaugugguuagccuugcuggccgucacacuuuggggagucuccugucuccucaguucugggauuacaggugcaugccccagugcucagauuuuacaugacuuuaagacucaguccucaugcacggcaagcacuuuaccgacugagccguugucccagcccuaggaagcagcacuuugaaggcugacugaaggaguugacacuuagggacacagguuaggccucccucuguguuucuauaucuaaacaagcagaacuuggcuguagagcuaucuuguccucauuuacuuuuuuuguugugcgugcgugugugugugugugugugugugugugugugugugugcgcgcgcgcgagugcgcuccauagcuagcauguuugccccugagcaucuuuuuuagugugugugguauguguguguauguguuguguauguguguauguguccuccauaacuagcuuguuugucccuugaccaucuuguuuaguguguguguguguguaugugugugcaugugugucuauguauguguauguguguguguauguguuuguguguguccugcauagcuaccguauuugucccugugcaucuugccagccauucuugucaucuaguuuuuguuuacuuucucauucccuaacaaucaauuuuaauguauugaugcccucauucaacaagccaaagcgaaauugacuuucuuaccauucaccucuaagugaucgacuuucccuccacuuacccauagcccugugcuccgccuucacuguauauuauccauaagguggauguucugugucacugguaucgggcaugccugcauuugcuuuauugagcgagcucuguggcuaauaugagcaaguggauauaaugcuucauuauauuuaauaagaauauauucaacaugcuuuuacaggucauauuauuaucugugaaugaacaaguguuuggaagcucauuuagaaauauuaauaauacccagaacaaccggaaaguuucuuuaaaauuuuaacugggaacauuugauagaccgacuaaaagucauuguccuuaaauggucuccuugcguaaguagcacauccucaggaugucaggcuuagauugcaucucugggcuccguuccccgcccugugccagaaacccauccuugguaacccuucuugcaauggcccagcccucugcugagcuucagggcuugccucaggaagaacauuaaggaguugaaacugucugucacuucuuuaucuuaagcuguagacugacagcuuaaaggcagaaaucuuauuugcuuugucuucucagaagguagcagagugucugauucacaggcacagguggucuucaggugccuuuagacugaauuauuaguuaugccaguauuauguagguucuaaagggccaaccaagugagagucaacuccauugaagccguguagcuguagugaagaggagggggaacccuacacgucaugccaaguagucaaugacaagugagaucaacaguguuucuaccauaccuaacaucuucaguaugguuacgucauuucaaauaaaguacuacagaugccugacagaaacagcuuaagaagaggaauuuggcucaugguucggucaucaugguagaguuuauggcaggaguccaugguggacgcuuuuaccacagcaggccaggaggcagagcacagggccagaagcagggacugagcagugaccuucagaggcucaaccuacuuuuuccagccuugcuuauugaagguuccacagccucuaaaacagaaccuccagcuagggggcaagccuccaaaacaugagccagugugggaccuuccagauucaaacauaaccauauccuaugucaguagcucacuuguaauugugugauguuagcgauucucauauaggaguuguccaauuuggcucuucauuuguagacacgauagcugaguuuucaggagaugcauucaaguaguaguaggucaaauaugagcaaagcuuugugaagaauucuagacucacacuuaguaguuguguuugggacaauggaguccugcucuguggggaccgauuauguguggugcuuuauuugaaauaauguaaccaaccauauugaagcuguuggaaagcuuccugccgugacagguagagccuaacgagcaguuuucuaacagcaguguauuucaaacuuccggggagaugguucacagcuuggucaguaccuauuugugugaaguguauaaaaugcugagagucauggcaguacugagaacugaucuccagacagccuucuccugcccccugaaacacugagguaugagagcauccagggcuagagucaccuuucuuagugacguagugcaugcuguauagauguuuggugccuugcuggagauugaacuguguuaaaaguuagcucacaucuuccgaugucaccuccgugaguaaucaggguucagauuguaaaguuuuuccuuccccugcuccuggaauugagcccauauuuuuagagcccuguugagguaguaugccguggagagaguucagagacagauaguguagcuuuuguguaagcucaguggagccuguaacucaguucccauccuuaguaaguagagaaagaaauauauaauagcugucaucaucaggauuaaauaggguaaaauucaguacagguaaauuaacuuguacuuggcucuucauggcugucugguacaugucacuugacuauugccucaauuuuccuccuccuccuccuguucuuccucuuccucuuccucuucuucuuccucuuccuccuccuccuccuccuccuccuucuccuccucuuccugauaauuguguguguguguguguguguguguuaguuugugugugaaugggagugcccacagaaccaugaauagcauauuggaucccuuagaguuggaguuauagguuuccuucuuucuucuuugauuaaugcucugacaugucagggauucguuugguuaguugccuuaggaucagugagaagucagugugucucccacuaugaagcgcccaguuaaucaccucuugaguucuucucugcuuuuuaugacauggaguuguauguaguccaggcuaaccucacacuuguaauaguucuuacguuacgcugcugcccucaagugcugggauuauuaaaucauuuauagcacacaagucuaugauaagacuuuguuuucucuacuauuaaucugccuacuuuuauaucaauacuauaauagugaauuguuacaguuuuuuauauauauauauguuaaaaucuuauaaugugguccucacuuuuauuuuuccuaggucacuugcuuacucucugaaagugucuuuagagcgcagggaagcugugguguggauuauacugcucugaugagcaccgcuuaccacacugcccgucacucugccccaugcuucccgugcagaagucccauuuaaaguccuguuuugcccagugcucuuuagaaggugucuguccucuccuugaguuggcucaucugagcuuuuuguuguuucuucugagguuugcaugcagccuuugaaagccuggagcagagccagaaaacugaagcaugcaaggggcaguuggggcaucucagacaagagacagugaugcagagugugaccuaaaggacacugugacaucgaaagcaggcaguugugauugggaucuucagucucccuguuuucugagaaaggaaaaauaaaaauaaaaacaaaaaccauacacacaccaaaauucuaaauguuuacauuuugucuucugcuauuaaaauugacaguuaauuuagaaaaccaaccccccccccccaaaaaaaaaccccaaacaagcaaaauccaaaugagccugaauaaauaguucuuaaggcuacacagugucagucaucccugggccaacaauuuguugcugcugcucuaaaggauuuacagagaauugaaacaccauuuauuauuuauagaguaggugcuagaacuguacagacaaacagugaccugugaacacuccuuguucauuagugcuggacaggacaugaaggugaugacacaucuaguugaacugaguuugcauucggugcagagauugcuacaagcaguccauguuuuccuuugggcauuggaucacacuggucugggucuccccuggcaucaucugggacgagcuauuugacaccgcuguucaccgaugagcucucagaagcagaaagcuuuuuucugugagcaggauucauagcaaguaauuuuuaauguauugcaaaauacaccauaguaauguaaauauaauguaaacaaggcauuauuuccugugcuuuagagacaagagaacugagguuggaguguuguagcagauugcuuguucuccagguagagggaguuuguaagccuaacuuuauccacccucuccaguagacagagugugugugugugugugugugugugugugugugguguguguguguaguuaacacaaaauacauuuuuacagacaguaugccaacaucucauguuuccauaugucagccuguagacuacagcaaguuuagcuagcaaggguuagguccucgcuggaggauggugacagcuggaaugaugauaacggaggagaugggguacauggagccucugacucggggaggucccugguggaacuggaagggagaacaucguagguaaacccaacuuguuccuaagaaccuaauugauuuuaauaggucuuccuauucaggcucuguggcucagccuguaaccccagcacuugagaggcuaaggcaggaugaccaaaaguucagagaugguugaucuuaggcuacagucugagcaauggggguaaauacacacacacacauauauacacacauauacacagacaugcagaggcaggugaaucucugugaguucaaagcaagccuaaucuacagaguaagauccaggacagcuagggcuacauggagaaaccuugucucaaaguuaauuaauuaauuaauuaauaauaaaugaauuauucagaguugcccacuuuccuuaauucuggacauuauaaugauuuuuaaauuaggaugaguuuuauuagacuuuuuaauucuauuuuauguguaggaauguuuugccuaaguauacauaugccuagugcccacaaaggugagaacagggcauggguccucugcaacuggaauuaacguaguuaugagguugugagcccucgcaugggugcugggaacugagucuucugagaguauguugcuguggagggguauuuucuccugaaaaugcauaacuaguaacuaguaacuaguuccuuagugugugguaccucacaguccaggagguuagggcugaggauguggcucaguggcaggcgugucccuuagaagcaccagcaccagacacaugaaauaaauaacagagcagcggagguuuucucgccaagggguuuacauccuacaucauugaagacugcuuccaguaaaucacugggcuaaagaacuggccaggcauggugugcaugccuguaauccacgcacgauggagggagaggcaggaggaucaggaguuuaaggccauucucaaauauccaucaaguuugagaccaguccagacaacauagcaacucuugucucaaaaacaaaauaaauaaaugaauaaaacaguuaugaaggccugggcugcagcuuguuagaucccuugcccagaacauuugaggucuagguuuccuuccuagcaccaaggugggaaauaaaaggaacaaagauuauaauaaaacaugcuaaaagacuggacgcugguaaagcuaggggugagcauugaaugagcauuguguuucuaaagcgacgaggaacgggucccuaccuuaguccucauccucugcaguacugcagaagagagcuuagucgcccuuuccuggaaagaaccagaaagcgucuuugccuuucucaugggccauguacucucagugacaaacacuuguuucagccaaaugagcagggcauugucccagcaaaacuuccuuuacgaaggcagccaucaggccaggcauagccagggcccuucggugguugcuugaccauccuugcucagggacaaauggcucgauggguauuuuuacgagugccagggagcuagggagccaggggaccauucugugcucuuuaaggauaggucuggcugccacggugccuuccacagucuuccagcaggguaacuguaacucaaguucaaaggaggguuuauuuuuacuuuacugaggcacuguguagaauguuucaaaaggaguuuuuguagaagacagggggaaaaaaguggaacacugcaguuagguuuguuaaucuuuuguuccugcuauggucuagccucauagaacaggugggcagaugaccauguaaggaagcaaggaugaaugaaugaaugaaugaaugaaugaaugaaugaauauuaucagaaaagcagugcucucguuuuuuuuuuuuuaaauacuguaucuuggcuuuugaaauaaacauauccagguaguaaauuauggccauuuuuaugaugaggaucucuaucggaguugugcuggauugcuggagucuucuggcuuccuacagaccccaugacucuggccugucguuucucaggugcagcuuuuuccucggcuuuggaacgcucagcauuuuguaccaagaaagcaaugguuagcaguguagccuggguccauugauucacacauuucagacauccaggaaaguuuaaauucugcguaacuuuuggaaggcagagaggaaguucauggaugucaaaacauucguguuuugucuccaugaggccccguuaagaggacuggaaagugacccguuuaccacagcaauuuccucccucccguccacccgguucuggcucguauguuccguuuccaggcuuacuuuacaccacgugaaagccaugggcuuuauugaagacuuuucacaagauguguuguaaacauacaugguuagugccuuucaaaauuacauuucuggugauuggugccccccccuucuuuucuagaaugcauacacagccacagcuaucaauagcaccaacuucugcaccucagcaaaggaugccuucgucauucuaguggagaacgcucugcgaguggcugccaucaacacagugggggacuucaugcuguuccuaggcaagguaaggccaccuguacugucacgcugaauaaagguacaaaauuuuguucuuuaauuuaaaaaacacaauguaaccuagcacaaaacuagaagccauuuacuauguagcaaacauucaugauaccuuaauaggcauuaacuacuucuuaauuuacuuuacagguauuauauucauuuaaucuuuaauaauuuuuuuugaguuaagcacuguuauucugaguuaacaggcaugcagguuuuuuguuuuuaaagaagagaucaggagugauauagcucacuaaaacacuugcuagcaugugcagaaacaugauuucaaucccuagaaccacacauacaaagaaaaaaagaauuauggaaacagucuaugcaaugaugaggguugucugaacaccugguuccugucaacuuggcacaaaccucgacacgucugugaagagggagucuucauugagaaaaugccucuguaauucuggacucuaggcaagucugcggaggcauuuuccugauagugauggaugugggagggcccagccccugggcagguguccuguguuguguaagaaagcagacuaacaaagcaugaggggcaagccagcaagcagcacucuccacaccuucagugccugcuuccaggcucugccuggagcuccuacccggacuuucagagauggcauguuauauuacauggaaguguaagaugagacgaacccuuuccuguccauguugcuucugguguuagcagcaggaaaguaacugggcagggaugguauugauccuggaggcuggggucuaagguucugguuaaauucaugcugcugauuguguggcuauuuguacacuugggauaauaauggggacacauuuuuaguguuguaagucuuagacugguuaaucacccaggguaucuaggacggugcuugacacauuguugauuuuuuuuuuuuuuuuuuuuuuuggugaauguuagcaguuaugguagaauguuagauguuauuauauaaaaauccuuuuaaaauagagcuguuagggaacaagaccuacuuuccuuagagcugagaaaagaguuuauuccaugcuaucaaaaccuucugaauuauaaauagcauuauacuuagauucauugcuccugcauuuaaaaccagaggcuauuuaggcaguuugaaaaaugaaagaauuaaacauguugcagcaccauuggaaugccacuccucaggccugugugccuccagugaagucucagcugcgugccucugugggggacggcauacauacuuggugaucgcacucuuucuguacacgcucuuauacaccuucucuguguugcguugaugaucuucacaauuacucacaaacaguaggguccguaccccauuagacacaguuauuauacacugggguggggcagcaacugugccuguaaaaugucuuugaaaagaacagaaacuuguuuugucuaguggaagcacagcuuuguguguuuugaaguguguaacuuccuagggaacugucaucugaaaacaauuaaggguaguuacuuugaauaucuguaaauaaguuuacauuauaacagauuugcuuguguuauguuuuuauaggagaggacauuucuauagugaaggugaaggcgucagugucuaagagucaagagcaggguuggcuggugguacugaguguguggaugauacaugcugacucagaaagggcuggagacucuguuuuguuuauacuguuuacaacuucauaacucuucccuagagcuaaaauagaaugagcacagagagagagagagagagagagagagagagagagcaagcauguguguguucacucgagcacacgugugugugugugugugugugugugagagagagagagagagagagagagagagagagaggugucacauccucuggcaggugaccuauuaguguuuuauauuccauagcagaggaaacuaaaguguagagagguaaucuacuagacacauuuugagaacuggaauguggcaaggcuggaguugauauccaugccuguccgaucuaaccauaauaguuaucucaacuaacauuaaauuuguccuuggacuuuuacagaaaagccuuuuuauuuaauaaucguguuaaugucagaacuaccccugaaaacaguucugaauacaacugaauguagcuuuauuuguaauagggaccuuuuguaaacaguguaaugccgagaacuagagaaauggcuggauuuaaaagccggccugguaaacccuguucucuugugaguuuagaauaugacaaagaaauguauauaauucagacagugaaaaggccgaguaaaaauacuggagacagacauguccugagcaugcacgaggcccuaggcaugaucuccaguacucccaaacagggacuaauacgucuucuucaucuccuucccccgagacaaaguuucuuuguauaacuuacugcccuggcuguccuagaacucacuuuguagggcuggccucaaacucagagagauccaacugccucugucucccaaguggugggauuaagguguguaccaccaugcccggcuugagaacuaagaauugaacuaaaaugugcauuauaagaaugaaagcuaguaucucagauguuaacaguggauaacccuacacaucucuuaaugaguucccuagcuagacaguguucccucuauucaguaugucccucuauaaggaacaauguauaacaucaaaaauguggcuuuuaaauuggcuuguggguuuuguuuuuaacaugcuaauguaaaaauaauguaaucugacugaaagcuuuucuuuagacuuaucauaucuuucuguucacuccacaaauauggacuguuuacuuucagaguacuacagacuguccuggguguccucugugugggagaggggacaucuguagccuuucuuuucauuugauacuauaagcacuuccaguuucaguaaacauuuucuaaacaugcuuauacacguguacacuugaccaauccucugguguguguguuuuuaaacacuugaacuauucucaaguuuuuacuaauauguuauauuaugaugaaacuuuuugcacaaguaugcccauaugaaauauugcuagcuuaguucagucuuagaagccuagaacuggaauugauuaguguucuuaaugugauuuccuaaauuaauauuuuaggaacaacauaaauggaggcuggagaguagcuuaggggcuaagagcauuugcugcucuuggagaggagugcaugucccagcacccagcagugguucacaacaucuguaacuccaauucaagggagaagccuucuucuggcucccacgggcccaggcauacaugcaguacacauaaauacauacauacauacauacaugucagcaaacagccauacucauaaaauuagaauaaaauguuuaauaauagcauuugugaaaguuaccuuuaaaacuguaagauuaugcucaguuugcaugucucuucugaugaauuuaauacaagguaaauacuaacuauaaaacacuugauagguuuuuuuagccuuuccaauaaacucuucucugccuuaaaauaauaacuccaaugauuuaaaaaaaaaaaaagaagaagaagaaaauaucuucucaguuucuaacacaguaaaauaagauucuuuauuuucuuuuuuagaaauauaguucugagcugguaguguagcucaguauuagaagauucaguccuuugcaccacacacacguauaugcaugcaugcacgcaugcauauauccucacacauacacacaugcacauguacacaaauauaaauucuauacauauauauguauauauauauaucuucauuuauuaaugauauauguauagauuuuacgaacucaaguauuaugagacacguuaaaaauuuugguauuuguuccaauaaaacaguaucccaucaaaacaauguguuuacauuucuccuguguaaaauuacuuucucuauauuuuauaauaccuuucuuauauugguuuuaucuuauaauugaugauuuauuuaagaagauguuuaaguauaaauacuauaaccaggaaucuaguuucuuacuauagccaauuguauacuauaacuaaaacccccaaauuuuuauacuauaaccaaaagucucucaacauauaguuuccaagaaaaaacaguaccuaagugcagaguuuacauuuggggugggggugaggcagggaggaacaguggccaggcuucccauggggggggggggggcuggggggguucagaauggauuuuaccaucauggaggguauguacugucaugucucuuccagagguuaaaugaccuuagagcacagcgccgagcugagcaguaacugucauucacaccucuguuucucucacuccaaagcugccauuccauccuuccgacuucucacagccugacucagcgaugaguuucuuucacuguggucagagaucuuauccucugcauuagaaguucagucagaaaagaagaugcuagagcacagugucuuauuauuuguuuuggggauugagcccggagccuuagacaugcuacacaaacagccuaccaccgagccauuucacauaccaggcccugcauuuaccuucauuuaugaauuacuuagcuaacauauguauuaugagccauauuuaagaaaaaaagauguuaacuuccugcaacauauaaaucgaaguugaauguucucuaaagcaagcaggugauaggcacacaagaugcuuccagagauggaggcuguguacuucaucaguaucugggauacuuuuaagaucuggggcuucaucuuugauucagucaguaggaucccuggagucaaagcccaggaacuuguauuccuagccucucugcagucugaaaaccaccaaaucagcucuguuuggaaacauacacgacuauccauccacuagacuucucugguccuauaggcaagagaaaguuuugaauguugucugucuucugugcuguuccuguaaguuugccauuaaauuuuuuuaaaaaaacuacaugauacucuuuagauauauuuuggcaucaguccuaaauuugucuguugaaagguacuauuacaugucccuggaguuauuucccacaagauguaaugugcagcuuucuauccggacugcuuugucucuaucugcuuugcuugagucacacuuuauuucuaauugaccucaacauuucaaauaugguuugccuuuuagggggguggcaagaacaugaggaaccccaaaucucacauggaacgugcagaauuuuaagauaguauaaaaaaaaaacucauucaaaauuugaaaucacuggaugauuguggugcacaccuuuaaucucagaacucaggagacagagacaggcuggucucugugaguucaaggccagccuggucuacagaaugaguuuuaggacauccagaacuacacagagaaacccuguacuggcuaguuuugugucaacuugacacagcuggaguuaucacagagaaaggagcuucaguugaggaaaugccuccaugagauccaacuguaaggcauuuucucaauuagugauuaagggggaaaggccccuugugggugggaccaucucagggcugguagucuugguucuauaagaaagcaggcugagcaagccaggggaggcaagccaguaaagaacaucccuccauggccucugcaucagcuccugcuuccugaccugcuugaguuccaguccugacuuccuuggugaugaacagcaguauggaaguguaagccgaauaaacccuuuccuccccagcuugcuucuuggucaugauguuugugcaggaauagaaacccugacuaagacaaacccucucucuaaaaccaaccaaccaaccaaacaaacaaacaaacaaauggaaaucacuugaauaauggaaauaauguaguuaaccacauauggaaaucacccaguaaagaggccaguguaugagaugguuaauaagucuauagccauaaacuugggagaccuagguuugcuccaugaaagcgucuaaaagugauugguuuauagcugagucaguguguugcaugcauuauaacucaaaguuaugauggaggcaaaggagaaaugcuuucauguugauagggaagacacugcaagauucuuccugccuguucucagccuugggcacaaagugaccccagagguuuuaugguuuuguuuaugcuuuuguuuuuguuuuaaagccugauauuaagcuaagagccagagaagaguaugucuuuaagauucagaaaguccauaccaaauguuugcugggguuuccccuguaaagaaucgugggguuggcaggcaccaugcagucauugaauagaaccuguuucuuacucugugaccuugggcagguuggcugacauuuccaaagguguuccccaaucuaaguaaugggcuagauaguguuugccaucaaguaucugcaggauuauuggcaagcugauauaaaauguguuaaaagaacuauaaaauacaugaagcgaggaagcaccugaguaggugguucuucacaauaagcaagccgacuguuuuauuuagcauggacgugguugcauuggguaacuuuugcaucacacauaauccagaccuaagccucacaaaaauuacauuauauuuaucauguauaccauaggaaauacaauaugaaacacaggaaaaguuuuaagacuaaagaugaauguuguagcaucauuuacaucugaaaacaaucuaaaucucaaauaguagaaaacuggcuaaauauaucuuaaacuacucauaagauaacauuguaaaguugaacaaguauuugcagaacauuuauaauaauccucuuaaauuaugaaguuucuauuguuuuauauaugauuucauauauguaggaauacuuagaaaaaaaacauaccaauuccaagcaucaacaauuuuaugaauucaaaccaacauuuaaauaauaggcauacauuuauuuuaaaguuuaucagcagauuaucaaugggugauuuuuuuucaggaaccauaugacauuuggaaaacuaaauuaucuuuacuguaaucaugaaucaucuaaucuguguucuugaauuuguaugauauccaugagcgauugauguuuuguguggguguauguggaguguacgccuuaguuugagauggacuagccuucuguaacgucauugaugaagagugugcuuaagucugcagcaaugaagaauuguggcuggcugccgugggaucucaagcaugcucucugcucucuccgcugcaggugcugauagucugcagcaccgguuuggcugggauuaugcugcucaacuaccagcaagauuacacaguaugggugcugccucugaucaucgucugccucuuugcuuuccuagucgcucauugcuuccuguccauuuacgaaaugguaguggauguauuguucuuguguuuugccauugauacaaaauacaaugaugggagcccuggccgagaauucuauauggacaaagugcugaugguaaguacuucaaaugucggccacaguguuuccaaaauacucuucgagguuaauucccacaaagugacacaguguuaaaauuguaguacugaaucaugaaugaaguuuaucuuggagaaauugagguaggucuuccugguacagaaacaaccauuucaaauacuacucuuuaguucuacccacucccuguaccauccugccugcccccuccuuugugcuauauggauuugaauagacuuugaaacaugucuucuagcuacugaucaaagugcccuuucccaaaguagaucuuaaagacaaaggccuuguucucagagccuuucugccucucuccagcaaccacuuauacaaggcuauuacugucaacccuagucaacccuaguuaaaauccauuauccuaaaucccacaagcuggauugaagguaaacgaaauacaggaaguagcccguagggucaaaguauuuuguacugacuauuuguaagcauuuuguauccauauuuuucugagaagcccccgagguuccucuguauuagaaauucaacuaaauuuugagaccauuuaaagaccauauuaaaaugcuuuuaggaacuggagagugggugugagcacuuguugcuguggcagagacucagguaucaguucccagcacucacauggcaccuccacaaccuucugucacuucagucccaggggcccacacccucuucuggcucacuuaaccagugcauauacauggugcacauauguacuauucaggcacuuacccauacguauacauaaaauaaaaaaauuaaauauagcuuuaucauuauuaaaugauacugaacuaaagauacuuaggauugaauguaauacauugaaauaaugagccauuuugugcgaguaugagguacccaguuuacucugaaguaaauauaugaauaaaagaaauacuuguuuuccuucaguagugaaaauugaagguaauuggacucaccuguuugauacugucucugauagcaucaucaccuaaauuuuggaugcuuucacaaguccuagaugaauucugucugguuggguucaucuggaauugaaucuuuauuucaguuuuuugugacuguagagcaguuugaggagaaauuuccauuuuuuaacacccugacugaucacauguacuuuuuaaaaaaauagauaaacugucacuguguagcccaugcugaccuugaacuugaccucgcucuuccugccucagccucugugguguugggaugggagguggggacuaugcucuguuagacggccgggaggaaguucucuggagcucagguagagcagcgcaggccccugggggcugccuccugcucuaaccacuucugaucaccaguuccagauuuccaaauuucuacuuugcugaauaauauguagagcaggauauaggugcuaugaaggaggaaacuuugaagcuagauaaauauuuuaagguagcugacaugugguuuggguuuggguuuuuuugacggguacuuuuuucugggucuuuguuguuagguacaggcugauauccaaggcuggugcaugaaaauugccacaaguguaaagcuagcugggacauauagugaguggcaagccuucaagaucuacauaguaaaauccugucuaaaauuuuuuuuaaauauuaaaaauauaauacaaacuagaagcguuugaaacaaacugguuuuggaucacuuagccuugauauggaaaaugaaacaaaggaaaaugauauccccagccuggggaaaagcagacucuuaaaaaacauugaauagaauucucuccuacagccauaaugagagugucagagugggugauggaaggaagguuuuauaucuacggauugcaauccaucccagccaaucuuccuucagaguacuguugaccacacuaagguuggauccuuaaaguucaccuacugacugaaaccuaagaagauccccaguuaaugccgugcacuccauguuuugcaggaguuuguggaaaacaguaggaaagcaaugaaagaagccggcaaaggaggcgcugcggacgcccgagagcuaaagccgaugguagguggugaggaggaggcggccgcccuccacgacuuucccuuucacuucuucucugucugugucuucacugacugcacauccucuggagaagccuugguugucuguaucacgcaggacaugcugcucuuucuguuugccugcuuacccaucacuuggauggcagagguccugucacagcugagacuaccaucugugaaagugagcugaaaggaacagcggccugcccagcacucgggcuggggggacacucgccuccgagucaaagcugguuuucuugcugucaguauuuaguucucgucccacgggacacgucggggugacuuugaacuggcaggucauuucgaucauucuagaaggugaucaugagaguuccuuucagcuugcugaaguucauauuccuccuuuuuuaaaaacaguauuguucuguuuacauugcuguccuguccugcggacuuucucuucucuugcucagacuguacuuucuuugcuguuguuauuucuguuuguuuauuugguuuuguuuugaguuguuuuuugccuacaaacaaggcgauuuccaucaauguccacaugccaucucgguaagacagucuuuucacacuuucauuguaaaaggaaucauguccuccaaccugucacagguaauagauuuagauagguagaugacuaauacuuagguagacagacagacagaaaauuaauauauggacagaugaauacauaggugagagaugauguuagacagauaggguuuuuuauuugggggagaaaaaugacuuaaucaauuuagcauccccuggguucuuucucuuacagauauucuccuguaguguaauggcacgagucagacccacacuggucuaauuaggaugaugcuaccaaaaucagcugugacaugagacaaugucacucguacuuccugguuguccucacucuuuaggaaauaaagaaucugagccuaaaacuuuaaagggacaaauauaaaaaccugggaggauacuagcuugccucucccuccuuuguggggguugaaacuuccgcugaaucauucuucaguaauaagcauuuuaagaaagguagaaauguuugaaguuaaagaccagccgauuugaccacgggcuugguauacauuuccauugugauucuuagcaagcaagcaguagaugaauggugguagaccagaauacaaguaucccuucccuaccaccuuuuccuaacuguggcccaucccacaugcaauguauuaacaucccccuuuagguuuugccuucacuuucugucacucaccaguucauagcaucccuacaaggucuguccucaagcacauuguuuguggguaguguccuucugaugugcugggcaccacagcguuugacccucaagaaugucauaagaaggcucuccacccugaagcaguagagaacaugacuuagacuacaaccaguuucuuaagcaugccauucagcauuucuuaucaugcccaguaaacauguggaguugaugccuccugucccccgcccuuugugacauaaagaaugaucugagagcgucagcacugaagcaagggugucagagaaaauaagccgccuguucucauucgcugugcuucucagaugagagcucuccacaagagcauccugucuguuuuguuauacauacagccgucugucucccuccaugugggcugugucugcacuuugguuuuguuuuuuuauuauuauagcuuguagaacuauuugggaaaaugugguuuuuaguuggccucuugauuggguauuguuaaacucaauaagaaacugccacuuuucuucuugaacuauuuaaaagaaccucacuaguuuaaaaccauuuuaagaaucaugaggucucuguacaguucucagaauaguuggcuguauaggaugacaugcuucuggggaggagggccgucugcuugcuguacaaggcuaaggucucucugggcugugggcuguaguaguauguugugugugucucacugguggcccugaaguauggccugcaguaucccagcaucauaggcucaagaggggagucucaaccuauuuuugcccuguugcuguugugaccguguguauauacuaauagcaucauucauaucuccuuucaaugguaauuuucuaagauuauacucuguauggcuuuguuuucuaggcuucgggagcaaguucugcuugaacauagccgacgguuauggacccccauugacauuccaaaacaauauauacacauaacuauguauuuguguguguggguguguguauauauguauauguauguguguauauauauguauauguauauacacacacacacauaaucagccaaaaucagagaaaaaggaacagggauuuaauaccuuuuuuaugcuuauuuuugucaaacauguacgccuuucauacggguggcuuuuacaaggcaacuuccgucauuuaauguuuucaauuguaauugucuuaauggaaauguuagauucauaucugauuaacguuuuuaauaacuagaggaaauuuuaacuuuaguuacuuaaccuagauaaaauuaucguaccaaauucuuguguaaguuuuugcaggggugauuucccuggugucuguuuaaaaucagugucuuauuuuacugaugcauaaguccuagugugucagacuaggcaugugcguucagauaaauaagagauuucuccagucuguuuucuccaaucaaagaagccaugccauuuuacuuugagaagcaucugagugggcccguuacgggaaauuucauaauagcucaugcauuugucagccgacauucaaaaguaaccaacuccucagguauuuguaguuuacccuaaugcuucuauagaaggaaguaggaacaauagagagaaagggguagauaaucuuuauuaugcaaaguuuuuucuuguauuuugucucuuuccucuucacuuuuuuuuuuuucuuuuuuuuuaguagcauccaccacacauucgugugccugaucugaaaggaagcuggggcacccagcaaguuuagccuuucuggguauugauuuccagcuuagguaauucuagaaagaauuaaagagagagaaacaagaagcaugaagcugagaguuucagcgcucugcuucuguuuccaaggcaagucgggagcuuaggguuaaacgaccaucuauucaaaugcuugcuauaaaucugaacacacgggcaggugccccacuccuugguauucguuguauccggaguucuacaauguguaacugaagaaucaguugguguuaacccucgagugugagugugcuuuauguuuggggguacguuugggauuucuuguuuugcuggguuguuggcuuuuuuuuuuuauuccuaaagcuuaccagauaugaauggcuaauauuccauuguucugcuuauuguaauggugaaugcuuuaagaaaaaaaaaguguaauuugcuaagaauaauucaugaucuguuuaugcgauaacuccuuuuuguuacaauuuuuuuaaaaaaagcuauuuuuguuaauguaaaguaaauauuucagagcaaauuuuuuaaacuuauugcacuaaauacaggcucuguaaaauaauaauaauaauaaugaaaaagccucagcauuuaucauuccauagaaggaaaaucuuuugaaagaaagcauugccuaucagaaguagaucgugaauuagacugguguuaugggauugcauacaauguucugagggcucaacgagcagcuauuugcuaaugugcuuccuuucaaaggguuggaccuuuaaauugcugcaaaagguaaauuguauuuucuuuuuuaaguacugguguucuuuaaucuagcuaggcuaaauuuugcuaaaugccuugguuucuuuucaaagcucaugaauauuucugagccuucagaguuuuugcaauaagagucuggauuaaaaacaacagcaaaccacacacacaaacacacacacacacacaagagugcauguguaagcaggaucugggaagccagcauugagagaguauagcuauugugaaauaaugauucaccagaaauuaacaucuaacaucuaguguugccaaauagugucacuguacuucucuaucauuugaaauggaauuuaauuauguaacuaacaacuguccuacuaggugagagaggaagauuaugugagaaagucaguauaccauguaacuuguagccacacagauuuucgacauugagaaacauugggaacuaaauugagaaugggccagagccuggaagaugggucucacaccagaagacauuccaggagcuagccauuuaggagaugucccuucaaagugacgugaugauggacuugcacuugggaaucagguucugcucacuuggacaucccugcaucauggacucuugcugccccuguuccaugugcucgcaauuccagcuacuggaagccaccaggaaugcuuucuaauuaucauuugcaacuagaacuguaaucagaaagaaaauuuguauuuuuguauaacuugauugugugccauuuuauauaacagguccuguuuuacaaauaaauuuuguuuuacuaacuuuguguuuagaaauuaugcucuauguguguaaccaugucauuugaguucaauuaauuuccaggcuguuuccccuaaguaaguuugugugccauauagucauaugcaaauaugccuaucuacuacacgggugcacacagagagauauuugauguauggaauaucacucugccuugagcuccauucuuugauuaauuugagaaagccuggcagaggcguuuuagugacccguaaguguuuccugcuuggguguuccugcugccucucccguucauuugcaaguccuuguccuggcuaugggcugccucccugccaucugcucacccccucaccgcuuccauccucugcccaagugagaagaauagaccaagaacaaaggugaucugugaaaucuggguaucugaauaacuucagaaaccacuugcucuugucuugugacuuccuccuuuuccugugaugguuuuccaauaccacacucaagagucuugucuccagaguuaggcuuggggucgccuuuuauaaaugguaaugguguccacagugccacaugguuucugccaccagaugauuaagagccugguacaugguuuagaccuccuagacuccugccucaagaauaaguuguccuguuacuguaauaagggaagaagaggguuaaauuuaugucagugagaacccaugagccccaucuucuagaacaggcuuacuggugcaauaauaaguaauuaacaauuucacgagggugcugaguuuguaugauccuugcauggaugagcagaacucaacacagguuguuuugugaacccauuuuaugggugguuaauguuuacauccuagccuacagacaauaaaguccuaacuggaugccaguugaguagccgagcuagcuugguucucucucggucugcuccaguggagguacuuacugagucuuuuuuaaaaauaugcuugaagucaguguuuccuuugguagaguugcucuucuaagaauuugcuuccuuccuuuuuuucuuucgaugaaaggcauuaagcugaugaguauaaccucuguccaacaucauggaccaugaugucugccuucuaagugcauucugaagauuccacccugguaagguguggauccccuuauccuggucccgggcagcuuuaagcuugaaucauaaauaccucucccuccucagaauaacaggcaaugcaugcuccagguaucugcaagccacacagugcuaccaucacacuccaucuccuggccucacucgacguucagagccacuuugugaaaucagcuucaaacccggaacuauugguuuuggugaccuauacauuuuauuuuauuucuuauuuuugccuucucauuugaauugggguuuccaguagccuuacuguaguuucugagacguuuccuuccaaagggucugugagcuuucaucuuuuaauaagcaaguucugggcugcgggggcauagagcagcugcuuagcauucacaaggcccacuaccacccuucuccccgaaaauaucaaugucagcucaguauugcuuuguuuuggccacuugaaaaacagacaaacaaacaaaccucagaggucuggaggcuucucagugcaggugacacaguuagucucugcauuccuuuuaugcacugcacgcugugugacagaagcacucgcuuacaguuguuaagaugugguccgugaauauauauuagagaauuaugagguccuaaguagaugcaggaagcagagguuuguguguucuauauucagagcauagacugccuuuugcuuuagaugcauauucauguagcuguguggauuauggaauucggguuagcccuuuugaaaaaguacacauuguccgucuacaguggcugcuugcagaauuugcuugucuucauuuaguggcauaggguccaguuuuagaaaaaucaggaucuuugaguaugucauaggaaaaagucuaaaguuaguaaacuuaaaaacaaaauuaaagcucaauguaguauauccagugaaaaguuugaaauaacacacuuuucccaucugaauuucauaaauuugagccaaucuuauacuucauauuuuaagaggacaauuucaauuagaaauuuaauacuuugaaaauaucuuucuuacugaaaacccuaaagcaggauuuuuaagauugugacuuucuguggaaacccuaucuuuucuacagagcuauuguguccuuucuuccuucccguuuuuugauuucuuuguauguguaacaauagaccaacaaggauugcauuucacucuugcaugaacaauugauccuuuuguaaauuacaaguacagauuucaaguuugguauuuucuagggguucaucauuagagaauuuguucaaaaaguaaaaaaugauuaggaaaaaaaugauuagggacccaaauauuacacugcccuucauuuuuaacacucaguuuuacaaccuaaauuauuuuauuccagaccaaaaagcucaaaaaaagcaaacaaaaacaacaacaaaaacaacaaaacccccuaagcauuuauuuauaauaugauaaagaucuaguugauuauguaaacauugauucauuuauacauguuccaaaugguuuuucacuuuauuugaugguauccaaauuuaacauuugaaacucagaagcagacuugaguaccauaguaucccuuugcucuuauggaagcugugaacugccucccagugcaucuuagugaacaucuaaaauguggucagagcucccacugaccguccacggggaugaugcuagucaucucuggccugaaucaauuuuauaacuagaaauaguauaugacuuacuucuagguuuggaaauagaaacuaaauaggcaacauuaaaucauuaccuaucuugauaaugauuuccuaccuuggaaguaugaggugggguguguccugagggaauuuuuggcaaugaaccacguuauuagcaguggggugggaugcucucuaaaacauaucaaaagggcauccuuacauuuauccaucuacgaagacccuuagcuauuuugauggagauaggacauggggcuuaguguaaccaguauauaacucuuaaaguguaucugucgacaugagggaaaacuugacguuaaugauaguggacuaacugaaguagaguggauacaugauuuaaaaacaacacuuaaugaacaguuggaggagcugaugcuugcaguagauguucagccucacccagcacacacacacaucaaccugggaaguauugucucuguaugacuuccccccucugccaccccaaccccccacaaccacucacacaggagagagcaggguuagagcacucuacugauggaucguuucucuauuucccauguccacuucuucaugcuuugaggaaaccugaggaguccuucacuccccaacucacuaguaggugugcaguggcucuccaggaaggcucuuuaggcccuugaaaacgcaggcaggagauuguugaagguuugacucuaguggaucucauuucauagauguuaaaccacucuauguugucuagcugaacaaaggaguagagaucuagcuggcaggucaaugaagaaauaacgaaagucagcucucuaugcacccuuaaggcuggaaugaaccuucuagaacugcacauggagaggccacugcuguaagucuguguaacagguaggaaaggcccaaauuuugucacuugacugguucacuuguaaucgaagccugugacuuagagggaacuuucagacuuugucuuugaacuuaccuacacaaccugcuuguuaggaauaucuuuggugcuaguuguugcuggagaaauggauguuugaauccaaaaguaaaaguaagcugugaaacgauuuggagauccuuguagagauagaagagaucccauggaccacgcuaucagccucugaaaauugugauggccagcuucauuuccugugugguugucuggccagggccuucuuugcccuagaaauuguguuugaaguauauagagauguagaggcuagagguuuuaagucagggacaacuuaacauucuccauggccuuuggggucuaguacuuugcuuagaaccucuucuugaauuguaguuuuaaugaacaaagucugcucuuuuacugugcagcucuguugguacacuucauugaugcuuucugaucccucccauuugcaauuggaguacugaaccccuauaaugagaagagauuucaguuagacagacuuagaauacuuagggccacuaaacacacaucuacuagaucuugcaccuaaucaagucaguccauuagguuguuagcugguuagaugaccggcacaagggagaacguccugacagccagggacgaacauggggccgucuaacaaagggacauaugguccggaaaacaaccaaagacgaaagccugucuuuugcagaucaguuuucuguacugucuggcccagccuuccugagcuugaguuuaggcuagcacuagaauaaaaacaacugagugcugaagacuggucgauacgggagggacuugcuguuauggucuaaggcagucugcacagcccauguccagccuagccuaggugaugagaacauaaacagagcauccuaaugcuuuucuguccuuuugggguuuuuuccccauuuguaucuauuuccagacuggugaaauaaguuuuuaugucccaucuugucucuuuucauuaaaaauagaagaacacaacuaagacaucccaguuugggaucaucuaacuucauguuauucuggauucuuucuuguuacgguaucacuacacuaugcaugugaggaaacaaacacguaggugcuugaacaugccccacagaugcacuuguagcccugguauuugugacugucgugaccaacgcagugcagacuuuacacguggaacguuacacucucacaggacuuaagaacuauguauauuaagcaauucacuuucuggagcgaucagcucuugcaggcaaaugaacugccuggagcgcugaaugggauggauuuccaucuggcuucacaguucaaugagcugauaugaaauggagcuuugaaauguuuuaucugugcagaaauaugaacuagaaaaaaaaagugcuggucucaugcuaaguuuucucuguguauagacucaguugccaaaauuauaaugaaaacuguauuuuagucuaacaaauguauagaauuuuuuaauguaauaaauaaaauuuuauaggaaagcaugucacuugucuacuguguccuaacccuuucccacacccgugguggugguugagagaaggugggucuagcuucagauguggucacuacuguguaagaguagcagagaaccuccuaauuaggccuucucaucuaucacgugagcaugccccagggucuuggauuaugaaguauuaauauacuaaaccacuuuucuaaagcacagacuaucuacugcccauccgggcuuuguugcuggaaucugagugaccgugaggcuggauaacugguaaaguuacaacugaguccacaaucuagguagagaagaggggccucccauguguaaucuuugccaugggcaggauucauuaugcaggugcaguggcgugggugacuccauuugcagggaguuagugggugugugcaguugaggucagccauuuuuaggcagcagcugugccucauugucauuuuuuuaaaaaacuaugguguguucaaaacuaaccguuuuacgugauauaagaacucaggaagggauaggcuuccuaagugggucaauggcaaaaccaguaaaucucucuuuguuuuauaagaugggguuugucuugaggccugagauuguugucuagaugguccuggugugugugccaagcugcuaaaaggagcuguuagcagagugugaggugucuuccaauacugcaguugcuugagauauugaagaacuaaccauucuagacuaaaauuuugggggggaggggaguauuauuuugauacaaaguuacacuauaucuccuacauaauccuccuaaugacuaaguagccaaugaaaagcuucauuuccugagcuguacccugaaguuauucugugcuuauggccaugaaaaggacacuuggaauagaacuugaaguuaaaaaaaaaaaaaaaaagaaauccaaggucacuuugacaagggucacugacaggaauauauucugagaaauggcaucauugggucaauaucauuauuguguaagcaucuuagaauauguguacacaaacuuugauggcuacaguaucaccggguaaaaugauuuuagaagagaccgccuuuguaaaugcaguccaucccugaccaaaauauuaugaguauauuaauggaucccaguguaaugcguacguagugauuaaaaucugagcuggucagagagcaggagagcucugagcccuuagaggcugagcaguucacaggaagccagugucuuauaaggcuuccuggcaucugccuuucaucagaugcccugggcauaacccacacagacaggauuauaccucuucacgucaucguuuuagauguagcgcauaggagugaggccuuuaaugugauccaugccuuguugguuguccagauucugagaaauauaacuuuuggaguuguacuucgguugaguuuagguuucuggaaaaaguagagauggcuaucaaacaaucacuuagccuuaucaaauucuuaauagaggucuuauuaaaguuucccaguucucaccaagauccuaggccagccugucagcuagagcagugagagguggagcaacugccucugagaugaaaugggggcauucagucuugucuccucacacugggaaacaugauacuacagauuuguggucaguuacuuucuccaucuuacaacaaauaauuuugaccaaggugucccugcccccaaaaaagcaacaaaagaaaaauaagaaaggaaaguaggcauguaguagaccuuggacuugggcucagaauaagcuaaacuuaaccuuuucucuuuuucauuaccagcaaagagaaaagucagaagucaaaacaaaggcauucauauuaaauguuaaguagaagggacagccacacugaagguuaauaggaagggccgagcagaacaggcuguaaaagauauaauaauagcuaauguacuagaauaacauucacaguuuagacagaaaaauucagggagggaaagaauguuuucagcauuacucaaguugguaaaguaaauauucuauacauuuuaaagguacagugaugcuuuauugauuauauugacauugauaacugauaggcuaauugaaacuugauaagauagaaaguuguucaggaugauuuuuuuucaggaugauuuuuuuaaaucuuauucauaaccaauguuugaguuauuuuguuuguuucuuuguguuuugagacaagguguuauguaguacagacuggccuugaauuaaggauccuauugcaucaaaccuccugagugaugaaauuauagauaugauacaugauuguuggcuacucuuuaauaauggucuauuaguuuuaugaguuuugaccuccuguagaguugugugcugacugauuuuugauuaauuaccaccaauggauagugucauucccaaaggguaaacaugaauauugaguuuuaaaauagaccaugaguuuaccaacugugguuucaaauauuuuuauaguuuucuuuccaguauuucucucccucacauccaugaauauuauuuuuaacauuuucccuucauugauucuuucccagguauuugguuuuucaaagccuuaguuuucauagaacuaacugcucuugucauguuuucauugguacacauaguguuuaaauaaugucugagcaaccaccucacccaguauaauguacgucaacaaguccacccgacuucugccaagaacaacacacuaacaugcuagaacaggcacagagcauaacuccuucugcagcagcacugagcauccugucauuagccagaguaguccacaaaaggccagagaaugucaggucaucuggcaagacaguuagauggaagucauugacuuaacaugauaauuaaacuugguaaaaaaacaauaauuaagcucuguguugggagcuuauggguaauuucaguuugguugcuuucuguuugcuugucuguuuccauuaaauaucucucuggguuguuuuuuuuaauaagaagacaucacgcuauauuaaaaacacaaagggcagguaagcuaauagaaugguaguaacuaaucuaauggacuagaagagaacauucccaaacaaauccuaguacagguaagaauuuaauagaagaugagcauaugccgcuacugaaucaaggagaggauuuuaaauagacaacauuuaaugcccaguuugaagauaaaccucagucaaugccgaugagucuccugcucaaugccccacuguaaaaccucuguaauauauaaagaaguaagucagagaagagauggagcucuuuaaccuaguucuccugucuggaacggguuuuccauggcuuucucucuguaaucucugggcuuuagucgagaguccccaaccuaaccugacuuaggugcugcagggagacacuccccugucuguccccuuagcugucuguuuauuuuuacauuaagcaggcauaauuuacuuuuaacauguauauuuacauguuuaugcuuuccccagaaagcauauagauuauuaaacucaaaaaaaaaaaacaaaaggcagacagaaccuaacagauaacccaaacucuagagcaaauauggacacacacagguacacugagacauuagauacagugagcuuucuagcuguguaaaacagaaaaaggaagcaccaauauuuguagaauuuugcucaguggcagaacgugugaaugcgaauguucccuuuuaaauacgugacuuggaacaaguuacuuagccugugcuugagccccauucuccucccgcccuucaucuuugagcaguaagugagauaacacacauaugggaaaaaaaacaaacaaaaacaucgugaauacaagaguagccugcucacagaugggucaguggaugaaguacuuccuuucugaaaccucaguuugauuccccagaacgcauguaaaagcagaauguggcauugagcgccuguaaccuuggugcuaggaguugggcuggagacaggugaauaggggaugcuugugucuaccaagucuagacuaaacagcaaguucagggagaggcccugguuuuaaauauauauauguauauacauguauauguuauguguguauauacuuaauauaauauuuaauauaauuauauauaauauguuauauauaacauauaauuauauauuacauauauuaaagagggguagacuauuuagcaucuacuucuagccuucauauaugcacucauggauaugcauaccuuuauacauguacuucuuuuuuuuuuaagcaagaagaaaaaagagcugccuagucuuuaccuuucacaaauucagucuguuuaaggcagcaaaggaauaagcagaugauugcauagagugugccaguugcucuaacagaguuagcucuugagugcaaggagaccuaccugaaagugggugggaugaggaggugggguacagugaguaaacaggccucggggacaagguguuucagcagaagcaagugcaugugugucugugugcacaugugcauggugugugugugugugugugugugugugugugugugugugugugugugugugguguauaauguaugugaagacaagaaacuggagaagucaaaagaggucagaucucaaaggucuggugggccauuccaagagacaugguuuuauggugaagacacuggggacuuagugagcaaagauaugcuugauauuugcauuugggucauggugggggguuggggguggauaucucucaguguaaggaguaaaguuagagaaaccaguaaggagcuuuuguaauacguuggaugagcaaagauuaagucuuuagccuggauccugguaacauaagggagguaugggcuauguuuaagaaugaaugagaugugaaaucaauaggcuuggauguucgauugggauaagggguccagauggagguaggaguagugugugaaucuccaggucuccauguaguaguccacuggaagagaaccauguuaagcugaaagaccuguuugcauuaguuagauacaggauaaaauaccagaauugaaacaucuggauccauccccaaucuuccaauuuaacugcagguuauuaucccuuucuaugccuaagucucuguaccagugagaagaaauauauucaucccaugcuguaggguuauuuugcuaguaaauguaguggauaggaauaaacuucaaaaccaguuacauauaauguaauugguaucuccuuauugucugauagcuaaaagagccagcaugcuauaaaaaagagggagcgggccuuggaguccuagauagggauugacugucuuucuuccccuuguauaaacucuguaaucucagggagggaggaaaucuuuuugagguucagugucuuccuuuguaaaacgagaauaauacugucuuaaagggauuucuauaaaauuuaaugauaauucuccauucacuuaaaccauuaccuaacgcauauucagaaucucuacagucuauuaugaacugagaaaacagaauagaacaaagcaagcuagagucucuguauagaaaagcuaauggugagugaggugcuaaaaugacagaccaggacaguugaagacucccuccuccugaaggaaugauuaaguuggcaaaaacugucaaaucaacuuuugucagacuccagaaucuuaacaauaguaagaacaaugaacaguagcaguaacagcaagagaauacuaaguggagaaaauuuaauaaaaaugcacugaggcauuuuagcuuaccaggguaauaucccuuggcagcugggggugugguagcauggccuaugcuccuggagugguuggcuggggccacagaccaguauggaucuugggugauagcacagguggguaggaagcagacaggcaggaaacaccugagaagagucuagggcuggacauggauuagacaaugaaaacuuugaaaugccccugaauaugaauccuuauaggcuagauguauccccuugguguagguggggaaaaacaugaggggaaagaggaaagaaagagaaaaaccaugagaccuugaagaguggccugugagugacuuugaugauucgagcaggaagugaggguaaagcagaggggaaacaaaugcccacacacaaaaggaaucugcaaacuggaaaauuauguguggggagucacgggcagggguggugggguggggaaccuagcguuaagagaagcuaucacaccacagaccaaguuuugaguugaaaaccauuuucagcaaaaaaaaaaaaaaaaacuaaacuaaacuauaguuuagagaagugagaacauaaauaacugcacgcacaacaagcaacaguuuagggaagaggagaaagaaaccuagggacaagagaugcagcucaguuagcagaguuuuuagccaggauguaggaaccccagcacuacauaaaaacagacaugguuuuacaggauauaagcccagcacucagggaggggaugggaaugaaccuggagaaucagaaauucaaggucauaguugguugcauggugaguucagggccagucuggaauaugugagaacccgucuuuaacacacaaacauauguacacaccaaauacaaaccacacacaucacaucccccaaacauacaccccaaacacacacauacacucacacagcauacaccacacuaaacacagacauaccaccccacacacacacccauacacaccaccccaacacagacacacuauacacacauacaucccaaacacacagaccccaaacacacacacacacacacacacacacacacacacacacacacacacaccuaccucuaccuggaagagguagagucugauuccagaguugacacguuauaauauuuaaaauuucugccuuuaacaacaaacugcaaggcacaaaaagaaauaaaguauaaccuauuaauagaaaacuaguagaaauucugauacagcccagcuauugaucuuacagagccuuuaaaugaauuaaaaauuuaaaaaccauaaaucuucauguucaugaaacucaaugagcuccauguagaauacauucaaagagccacuguaaucaagcuguugauaaagacaacagcgaagagagcauauugcaugcaaugcagugugaguuaacuuauuauacauaagcaguucuuaauaauaaaauuauuccuugauacuuaccaggaguuaggacaggcauaagacaaugagauaaaauauuuauagugauguaggcaaaaaaaaaaaaaucaauccaggguuguuuacccaauaauaauguucuuugagacuaaaggaaaaagaaggguacuccacaauagacaaaaucagagaaagucugugggcacucaaucuacccuuccaaaacaaaagucaaaggcaucuuucaggcagaaaugcaaacacaguagauguuuacuuuagccauauccaaaagaaaaaaacggaaggaaggagugagugaaggacugagggagggaagagaacaaaggggcaacauacaaauaguuccacggauaaaaauauaaaagcuaucgcugcgguuuuuugucuguauccuucuauuauaucugcuuacagcagaaaguauaaauuucucugaacaggcacccccaaugcauagagaugugacacauguucuucuuaagccagcguucagcaugaagucuguucuuugcuugaacaccaagauggugaaggugaauaguaauuaacuuugugaguccaagcucagcaccacucagaggcuaagggagcuggaggggaccuuguacggcaggucucagcuaaggguacugaacaucacagaagccaagggagcagagcugauggugguggaaaggcaaucaagcccuuuguugcacauccuuaacuucuagcuuauugggaaaauucaaguccagcuaguauggaauuuaaaaaaaagaagaagaucagcaggaaacauguguggucuuuauugcucagcaaagaguucugccuaaaagcaauuaaucgaggccacaggaaaacaagcaaacgugccuugggcacuacacucugagagccuugugcaagcaaucccagaaggcuugggccuuccaagggaacguacgagcaagagaaccugcaugaaaguauaggaggcucauaacagcaaaggcaccguagcauggucagggacaccauuccuggguaugugagaaugucaagaaaacaaaauauuggggguauuuccugaauuugacuacaguaugguucaguguauuuuuuuuaaguaauucacaaugguaauaccaaggggaggacgcagcggcaaggggacaguguguauauucuagaaacaaaagcgcugcgauuucagacuaagcucuugcuaacgugagauggucaugggaagcaccagagcagcauugcgaaaguguuuucaggaaaggagaugaaggaaucaaaauaauaauaugguagaggaacuaacuaacuagaaauagugaguggcaggaaucccaacacuuaggacccugaagcagggggauggcaaguuugaggucagccuaggguacacaagaaggccuuauaaaaauuauaaauuguuuauuauuuuugacaauuuuugacaugcauuuuaaugauuauuuucgcuccucauuacucucucucucucucucucucucucucucucucucucucucucccucccucccucccucccucccuuuuuccucccgcuccucaugaaacccuucucccuuccacugcccugucucuucuuaaaagaugacucacgagguuaauucagguugaacauaggcaugguggggucauuuacuggagcuuggguaacuuaccgguggcuacaccacugaagagaucacaucccucuccccaggaaccagcaacugccaggagcucucagggggagguggagccucgugagcccuugccaguccuugaugaaauguuagcagucucagucuuguaaagguuuugcaugggucucuauagcaugagugcaauggucaugucaugcucagaaaacauuucacagcauaccuccuuauccucaaguacuuccugucucuccaucucuucucccacaauguucccugagccgugugcauguacgugcaauauagauguccuauuuugguuuaaacacucagcagccacuucuuuuccucauuuuuaccaguuaugagucucugcauuaacccauaaccacugcaaauagaagcuacugugacccaggcugagugcagcacugaucuauggguuuaagcaagcaaacaaacaaacaacaaaacaauugcgguuuuugaauacacaugagagaaucuagcaacagggcauugaaagacaucacaguucagacauacagaaaacaacaaaacgggagaaggaagcccuuacucauuggugauuauuuugagugcaaacggauagagcuuucuagcuaaaagucagaaggauauguuaaaaaguaauacgacauccccaaaggacucagcuuagauucaaaggcacaucaauuaggcugaaaguaguaggcuaaaauuaaaaaaaaaaaaaaguauucugugcaaacaguggccaaaagcaaguuggcuguaccaacaccaggcacgcagauauuaagacauguuacagagaauauuuuaucaugauaaaaugaucuguugauagccuacagcaaugauaaacguauguacacucaauaagagaacccaaaacucaugccacaggccuggggagauagcuaacuuaguaaagugcuugcugugcaaacagaaggagcuggguccagaacccacaggacaauccaggugugauagcaugcacuuauaauaccagcauggggaggcagaggcagguagagccccagaacuuauagucuacccugcuuucaaguucuaagucagcgagagaaccugucucaaaaagacagguggaaggcaccagaggaacacauucaagacuuuugacuuccacacacaugugcauuuacauacuuauauguacacacaugugcaagcacacacacacacauacacacacauguauacacacacacacacacacaaguucaagaaucagaaacugacagaauuaaaggaagaaguaauggauuaagacuaauagcuggaacuucauucuuccauuuucucuccucuucuuuuuuccuuuuuuuuuuuuuuuuuuuuuuuugguuuguuuucagagacagggauucucuguguagcccuggauguccuggaacucacuccauaguccaggcuggccuuaaacucagagacccaccugccucuguuuccugagugcugggauuaaaggcauacaccaccacugcugggcucccauuuucaauguggauaaacaacuagaccaaagaucaaaaagaaaauagaagaguuaacaccauaagccaacuaacuaaccucugcaucuguagcaugcuccacuccacagcacuauccucaacaggaccuggaaugcuguuuaagucuuaaacuuaaaaugggccauacaaaaguaacaguaagucguaaacaauuuuauuauauaaaguauguuuuaggucaaaaaggaaugaaauuugaaacuauuaacaugaaacuuugguaagcacacuggucuguggcaaauaaacagacccccaccccagccaaaugaccacuuaggaucaagggaaauaagaaaauauccaaagauaaaggaaaaugauacaacauacuuuaacugaugcaagcccccuaagucaguacauacaggggaacacauagcuaacugccaacauuuaaaaagauguccaaacauuagucuuaacugccaccuucauaggcucuggacaaagugaauccaaagcaggcaacagaaugaacauaaaggucagaauggaagcaaugaaaggugugaguacgugaaagaacgcagugagagaucuuugaaaaagaugggaaaaaaaacccuaugaaaccuuuauauggcuugaccaagacaaaacacugauaguuuuaaaacucucucaaaauauagaugaggaacacguacuuugauaacaaagugagagacaucacaagaaaaaaaaaucuagagaucguuuuaaaaaauuauccuugugaauauagacagagacauuuccaguaauaagcaaaugaaguccacuggccuauccaaagaacucugugccgagccaggugacauuuauccagcaaaugcaagagugagcaaaacacacccagcagauggaggagaacccaaccuaaccagcucacuggguccagagaagacuguagaccgaacccaaaggccucccaugacugcauaagaaaccuucaacaagcugggaaccagaggggaucuccucagccuguuaugggauaucuacgaaaacaaaaagcaaauaaacaacaucauaguuaguggugaaagacuaaaagaucccuccagaucaagaagacaaaagaaugccaugucuauucagaauuguacugagugaucuaugcagggaaauuaaauaagaaaaauaauuaagagccuacaacuucaaaauaaugauuucagagcccuuuccuguauggccucaugcuguauaaagucauaaagaaugcauaaacacagaaaaacuuaaagcugauaaauuagacauuguuggaagauacuggguuaaaucacacacgaggcaccuuuguuucuguacaccagcagcgaacaaucugaagaagaagucaaaauagucucauuuacaauaacuucaaagggaauaaaacagugacagauaaauuuagccaaguugaugcaagacacuuacauagaagucuacgagcacaaaguaccacuggaagaagauacugguaaugagaugucugcgcuuaccaauuagaaaaaugugcauggccgggccaccuacaggaagcuacguaguuacugcagcuucugucaaugucccauuauucuuucagaaaugaaaguuaaugauuggaaaauuugugaggaacuacaacgaaguccaaagagcugaaagugucuccaauuccaauaguaagccuagaaaagcauccguuucugaugucaaagaccaucaacagccaacagaagacaaugguacugagaugagguuggaaaugggaggagucgaguuaaaggaugggaauaaaucuaugcgcuuauaaucaauugauggaaguaaggaccagcgcaugaaagaauaguuccuuucuuaaaagauuuauuuauuuauuuuauuaugugaguacacuguagcuguacagaugguugugagccuucaugugguuguugggaauugaaucuuaggaccucugcucacucuggucaacucuacucccucaggcccaaagauuuauuuauuauuauagauaaguacacuguugcugucuucagaugcaccagaggagggcaucagaucugauuacgggucguuguaagccaccaugugguugccggauuugaacucaggaccuucggaagagcagucagugcucuuacccgcugagccaucucaccagccugaaagaauaguuucuaaugucaauaagacaauccaaugccaguaagagauagguaaaccggacuccauggaaacugagaagcguaugcuucagaagucaguuaauaggacugaucuguggcucgguuacugaagccucugcugcacaagcgugagaaccuaaguugagauuccccagaauccuuggcaaaagccaggcauagugaguggcuggcacauggcuggaacuucagcucugggggauuagagacauguggaugccugacgccuaaugguuggccagcaucccugcauugauguguuucagguucaaagagagacugucucaaaauaaauaaaauguguguguguguguguguaaguggaguaugauugaggaaagacacccagcaucucuauguaggcucccaugugcacacagcauacaggugcacacacguccucaaauguaugugcacacuccugcacuaucaagaacauauacugugcacacagagagaagagacaaaguaggaaaacacaaccccaccaaacagaagaaaaauauuugcucaucauacgauguuagguguaucugacaugauucuaaaagcuaccuagauaacgaacuccuacaauuaacaacagaaagauaacaccagaugaacaagggacuugaauaaacauuucucuaaagauuuuuuuugaugacaugaagaacaugaaagaugcugaacuucauuacccaucaaaacagcaaugagagacaacuucauaccugugagauggcuauggucuccuccuggacaccagcaguacugacauggaacaaugaacccuucuccaaugcugcugauuuggcuguucucagucaguuaaacccaggauuacuuauaacccaccacuuauaccuaaguacauauccagaguaauuaacuacaugauaacacuauuuacacuaguguucaaaaaaugcaacucguuguccuccagcugacagaaaacaagauaaauuaccuccacgccgugaaggauggagccauagaaagggaucagaggccagugaguaggcucagcagauaagguccuuggaaugcaagguugauguccuggguucaguccccagaacccaugguggaaagaaggcgacaguggucuccuggaugugguccucucucuaaccucuacacccacacuguggcauacauugucgcuuccccuugucuuauacauacccacgacaguaagaagacaaaugugaguucaucauugacauguggcaugaugggaaugaacauugaaaauacacgaaagaaaccagacacaaaaugagacccauuguaugaauccauguacauuaagggucccaaauaugcccaguucauagaguagggaagcaugugagcacucgccaugaucuuugagggaucuccggggcuaugcgugaucauuacaggguuucuuacagggugauauucugaaaugagaugaugccauugguuguauaacuauacaaauguauugaaugccaccaaaugguacauuuuaaaauggugacauuuguguuauauaauuuuuuuucagaaaacauaaaagcuaauggcacuguuaguuauuuuuuuucaaauugucuugaaauacuuugagcuacagagauuuaggaugaaaguacaaagcauuauuccauuuuccucagguucccuggaugugucuuauuacgcaggcuuuuauuacauuauucucccgcucgcccuccucccuuccuguuuacagaccuucuauuaauuuuuauaaguuuuucaccaagguauuuuuuggugagagaaaaaaagacuguccuagucacuguuccaaucugagaucacacacugaauuagacuuuaguauuucauucgcaucuuuucauuuggacugguaccuuggucuuucuuugucacacucgacauuuuuuuuuuuuuuuggaagaaccaggccauuugcuuuauagcaucugcuucaauuugagucaucuuaaguuuccucauaauuagaucuugaggcaaagcaguucugccagccuugccgcauacuauguccccggggcuuccugucagggguaaccugccccugcuauuccaucuucaaguuagaauguugugaacuuugaucacacuguuuagguagauggauauaaaauguuacuccuuugccauuggugcuuuagugggagcuguuuugaaccuauguaaagucuuguuucuuguuguccuaauuaggaucucuauugcugugauaaacaccaugaccaaaaaaggacuuaggggaaggcuaguuggcucacaguuuacaguccaacauccagggaagacaaggcaggaacuccaaggagcucaagcagaacccacaggggaaugcuauuuacuggcucacuuccucuggcuugcucaacuuccuuucugaugcagcccaggacuacuugccuagggauagugcuacccacaguggacuagguccucccacaacaauuagcaaucaagaaaauaucccacagacaauuccucaauugagaucuccucuucccagcuaugucuaggucugugucuagcugacaaaaacuaugaaucucaucuucuuucaccugcuggcaccagcaucuaaagcauccauucagauaguucuuaaucgggggccaggggggagugugacaguggcucucaccagaggguagcuuuccaguucccuugucuuuccugagcuuauucuguggugcccuguucagcauccccugaucaccaacuuguuauuuguucaccccaugauacagcaaacaaacacauguuaguauuauacaacuguaaaauuugguggggaauaaauaucaaaucuuugauuucuuucauuaccgucacuuuuugugcccaaaucaucuuacaucugacuaaucagagcucauucaugccgacucucauccuucugaccucucucuccugucacucauuaaguucuuccuuauuuguuggccaugagaugcugcacuccucugugcguccccugucucaccucugucaucacccaagucuucagggaguccaaguucccuugaauagaagccuguguuuaaccucaccuuaacuguuguagcucuuacugagaaaucaaaacacugacuuucugccugauggaauguugaagccucuuauuaaauaaacccuucacuaguuucccuuguuuguugguucguuuuugcccugugaaugggacuuagggccuucaccaggcaaguaagugcucuaccauugaguugaacuugaccccuuuaauuaucuagacaauucauggaagucaccagaaauucuggaaacaccagaaaggugccuuuuccuacuuuaguaccaaaucuguuugacuauuuuuuacauuuucugucuucauccagucuguguuacucugacagauuccugaaagugucaaagaaaagagacauuucuuauaguuccaaaggcagagagguccaaggucaggccucugccuauagugauggccuucacugcuacaucaucuggugacaggagggagauggcaagaaugaacucaucuuuucugucuguuuucuuaguuuuuuguuuuuucaagagcguuucucuguguaguuccaguugucuuggaacuggcucugcagucuaggcuggccucaaacucagagauucccuuacccagcuucccugagugcagggauuaaagguguaaaccaccaccaccuggccacaagcuucuuuuuauaaggaauccauucacucaguaaaugacuucacucccacaguaaugacauuaaucuaugccuggacuaauaacccaagagucccaccucuuuaacacuacugcagugaaaguuauguuuucaggacauuuuuaggguacccauuaagccuuuccccucuaguccugcauaggaaugaacauguaugaugaucacuaacauauaguuuauagcuuaugucuuccuuuugucaccaauacuaaaucauaacugucucacaugcugcugcaagagcucccuuauugucucuacaggacuggcuggggucugccuggguuucugagcccugggcaccaagucccgcuuccucuuccauacauacaguggacggaugcucugguuucguuccuguuccugcaggaaaguauacugacaaaaggcaguuuggcuuggccugugcaguuagucaugccacaccugcaguuuagagaaaagagaaggauugaagccuugugugcuugcuuuugucuagcucugcccucuuucaucuuguucaggacuaggagaugguaccacacacaaugggcugggucuuccugugucauuuaacaguccccacagacuugcccgcauuccaauuugcucuagauaauucccucauuaaacuuucucuccaggugagucuacuagauugugucaaguucucgguuaagacaaagccaucagguuuuaggaacagggacagccguaaaacucuggaauugguguuguuguuguuguuguuguuuuuauuccuucaguugcauuuguucauucagcuaccuuacuaauagcaaaaugaaaauauuaaaaaaaaagauguauuuuuccucaccuuucuuccacccucuaagcguucacguuucuuuccuguuugcauacagcuggaagucuuaaugaagucccacgggccagcagcaagauaguaaaguaacacaggccugucagaugcucucuguugccuggugcuuguauucguggugggcacauguacgcucacauuugaguccucauaucaaacauuccaagucuuagccuagcaaacagcagguaaaggguguuguccuggggugagugguggauccagggcuuaucuuucuugccacagagcuuuggaaccuguccuuuggagcucugccaggucaggcucauuugcugggcucuccagcacggacagauuucccauucuucuccaaauuaaggcucauucugacccuuuuuauccuauuuauaaaggacaagacuccaaaacagacauaagaagaaauguggacaaaauaguuguuaauucaaagacccaaccagagcuccagagaagacggacucuuuauauguguaaugaaaaauuccaaaggaacagcagccaaagacaagaaaguucuccccccacccaccaccaccaccaccaccacauuguccaaaggcgcacaaaguuaauuaagaacuuauccuccaagugaggcuaugcuucuugugaacucuaugaccuuggccgcugggcucuguuuucugacauaugugguaggauaauagugucuucagagagccuugugaguauuaacuacaauauugcucguaaauuaccuaagaucaugcacaguccguaugagcaauaggcaugcacaagaagcaugaacucuuggccuuggccuugaagaguuaaauauuuauucuacuaauguggauaaggaauuggaguugccaagaugaccuugcucccaguauccuuuuccucagucuuugaggguaaugaucaccugacuucuuaaacaaaacaaaacaaaaaccacuacagucaccccauacaagccugaucuguacguaaauugugacccugugacucaguucuaguggaacuguaucagugacaagugacugcuaggaaaugccuuucaagagccauugacuucugcuuuccagacgguugggauucaaauaugguggcuagaaggccuacagccuuccuggguagugacauaaccuugaaacuagacugcauacaagaugaagcagugugaaagugaggcaccugggugcuggcuuacaaugucaacugcggucugcugaccucugucuauggaaaccaacuauuauuuggggaguuuccauuguggaugaacccagcgcucacccaucucccaaauauaacuuaauauuaaggugacuuagcaguaugaaugcugauuauauaguucauucaauaacagagcacaggugcaguggacuaaaucugacaagccuggaguuuaauggugauaaugcauuugcuuccaugggcccauaaagccaggucacaauggacaaaugaggcgggugugcccuggggaccuucugaauggcaucagucuuauuaagaaaauggcggaguuccuaucacagaguagggacucucgguugugcguccccagcacucccuaugccuucccauuacgcaucugaauucaaggcgcacucugugugagcugaugguggguguucgagcuugggcgauucuucggcucuauuaucagcacggcagacagcaggaggagggagaugagucugcauuacuuuuuguaggucagccuguaccugaacauaaacaaauggaacacuuucagagaacgccuggaaaagauaucugcuugaaaaagagacaggcuaguuauucauaucucaugggaugauguaggaaaauaagccguuucuauaaucucaucccagaccccugaaagagccuagugauuacaaagacauauuucuguuccaucugccaauuaacauguuagucaugcguuucuauccggcugcuguagugacugcuaauugucuuacccaguguggaugauaccggccuuccucauggauagaacccagaugccacgucgaugggccaagugcaacaccuuaucauaguucccagaggcuugcaguggcccucugacuagugagaugcaagcugcgguauuacgauauucccaguucugcccaccugacauagcugcuuccugucuugauuuccugguuuuuuguuuguuuguuuuuguuuuguuuuguugcaguuguuguuguuuuuugguuuuuggcuaccagagggacaacuguaauggcuguaaucucccaagccuacgugacacccagacacugacaacgacaguacuggaagauggagcaucuucgaagaguuccccagaucuggccuugcugacuuugggcuggcuccaggagaacugaucccuuuucucuuuuguuuuguuuugcacaguugacaccauguccuaacuuaggcgcugugcucggucucgaggggcagaaggcuuuccugucggauacucaggcauuucccauuuaucaaacaggaugugaggaaaacucagaacugaagcaggcccgagacugacuuaauucuggggaggaagugaaggcccaggcucuggagagagcugcagaagcuggugacacuggcugcagcugggacauuacaguauugaacgcauaguguaaggucgcuucagggaccacaaacuccauucuaguguaagacauuuucuaauggucaggaaaauguuaaaauguagagagcaccuucuuggagacaggggguaggaagaauaggaagaggaacugugggaggggagaccagaaggggacaauggcuggauuauaaagaaauaaaauaauaagaagaagaaaaaaaugaagguggacucagggcaugcugaguucguucacugagcagugguuucugcccauggguggcauucagaugcaugccuuucauuaaagucucuuacucugugcucucugucauccucccuggauagccacagaauggaaacuuuaaauuucccauggaauuuuuguuuguauuucauuuguagcaauguaacuuaccucccucucccucucccucucccucucccuuccccucucccuccccccuccccccagucuguggauguggaugugccagaagucaacuucagaugugauaccucagaaugcuuuccaucuguguuuugagacagacucucacuggccuggaacugaucaacugaaccuaggaucagacaggccagagauuccuagugaucauaggcagaucugccucccagugcaccgacaaccacacccuucucucugacucggucucucccacuuccgguugugucuuauuuagguuuaccauugcuaugaugaaacaccaugaccaaaagcgaguugaggacaaaagggauaauuugguuauguucccaccuccauagucuaagccaucgcccccugugguucuggggguucaacucagaaccccauacuuaugcaacaagcaucuccccagcucaccccagcucauuuuagacuaucagaguuguuauuuaacuuggauuuaucauguuaauguggcaguaaaacacagcaacauuuugauuuucagauacuaauggguauauuucuuuuaaucuguguuuaaagccauaguaauaagauccauucccaacuacacuguuacuuuuauguccaguaaacuagccauuaagaccauuuuuggcagcaauuucuguaaauacaugaauauucuuuguggaaaaggggucuuuuucuuuccuugguggagaccaggcucuuugauggguagauuugagaaaagcugagucuuuauuggaucuaaugaaugaucccuugaugaagucuaaauucacaggaugagcuucaugacuuuguagaagugccccauaggaacuggcaacugguaagggcucaacagaugcuuggugaauggauaaaagaacaaacaaguccccugguagcccaacugacucaugaguugagacuacaagacaacaauguucaguauauacaaggagcaaaucaguacuuauaagcccacaccauaacagggaaugcagggagcauaaaggugaugcauauaauggaaauugcugaggcccccucuagaccugcugagucagaaccucugcaacuagaggcacaagaaucuacauuuuaacggccucugcugcaggcacaccagaggugugcacgcacaguaaacuuugagaacucugggcauccaugcuggcuguucagcugaagccuccacacucaaugugaccuuagaaugaggcuggaauugcagccagagcuggguuuucaggccauccuuuugcaaaugugcuuuugucuggugacaccugcugguagagagggauaaauggacaaauucagccaaccaaauugcaacucaacuguccccguguaucugagaaagcuagaauucagaucugcuuucacuauuuacuagcuugggaauggccucaauucguucauacuugggugguauccuucuauugccuuaggcucggcuaguucauucaauuaccuucccugguuuuguaggggguggggguuguuguuguuuguuuguuuguuguuuuguuuuuuacauuagcuauuccuauucuuucugugcuccuugggaauauuaccaaccuuugguuuuccacuaaaaaaaaugcacucaacuuuuuaaccaaaggauucauucccagacuuuguuuuagggaaauaucaagucaaucuuuauuucuuauuaaagauuccaaaugagauaaggaaaaacaaaaaggaguccuuugaauuuuuagggguggaaauguguguggugguggcaacaggucauccuucaugacagcagcugaauccagcugaacuggguaagauuguauuugauacuugguuguugagaauuucacauagauucaacaugaaaauuaccaguccauuuagcaagucucuugcuuugggguaauuagauguauuguuuguuguuuguauguuuaaauacuaauuggugagaggcauguuugcacaacagggugacuugcuccauguauacaaucaagaccuccuuucaggaggaugaacaagcuguuccauuuucucuccuccuucccauccugcauggucuucagcaauaucuuauguaucuuucccuugucauggcugggcagcagcaucauaggaaucuaacaaacuugaacuuggauccggccaacccugucacuugggcaagucacuccccucuuuaucgggcaccagggauccagugaugcucugaggauucagugcggaagggugaugaaaugccaagugugagaagcuagcugagcuuggcuaucaggucucccuucuucuccccucccuugauacaaugagucuucagaaggccagucagcgcacacuggggccugcaacaguguuacuaucacauaguucaugcugcucccccugccccccccccaccgcuguccugauaggcguacuuuuagaacagauggauuaaguaauaacgcuccucuagggcagaugcucugucccagucucucuguaaacguuugaaggucuuucuggaauggagucugacagucauuaaccagccccacuacacacccaagaggacuccagacugucaguauuuacccaaccugggccauggcucuaguguaauuccccaaagcuaggguuuccugcccuaugggccaggcuguuccgucuacacagauaagcagcuuaugucugacuggcccagccccaaaucgggagagggucucucugcuucuccuucccaagcgugaccuuuuuauuggcagauauugccuaacaggguggcuuccugcucauuagcuaagccuacaugagcuaauguacagacuacacuacauuagugacagagcuaguucaaaguuaaucuuugacuuaaagagaucacauuuugaguaacaccccaucauagcaccucuucuguucaaguuaucgacccccaaauuucuugcaaaugccaacauauuggcagagugugacugaacgcauuuuggcagugaaccuggcgaugaaaauagagccaggaaacaaaagacuacaagacacaaaagaaaaggcaggcacggaacuccaguguuaguauaaaggcgcgaggcgggaagcaugccggccuggagagagugccgauucugaacaacaauaauaauagaaacuccuguccgagggagcggcuagacagagagcgguguggcuaacaacaggccuggaauaaagaaagccccaauuuaucuguccuugaaggauuuuaagguauguucaaaguuuaauaagcuuuauggggucagaaggaggauuauaccuuccucaggaaauacaggcaucaggaaagagagccuucggauaaguccacugucccaagcugcuauuuagaacauuugaacacccuguauguuccagaaggcuucuuguuugcuuggaagucuaaguguacuacacgcagagaugaguuaauuauuaauaacaauuaguuuaguaauuccugccuucuuggaaguccucuuggauggcaguauguugcuggagaccugggcccacugccuggacccuuaccccuguacuuauugcuguccccuagcaguagcugccuaggggucccuccuucagccauucagacacugaccggagggcucuuuugccuaccaucauuuagaacaaauacauggucuguagagcgcuccccauccauagccccagagucaggguguucugcaggaagccaggguuguguaagagaggaaagggaucaaauggccuacuuuacuuuauauuagacuccgggaagagaaaggaaguugaaaccguugauugaauacaagucaagaacauucguaacuuguguuauuugcaaaagacuggccuccgacugggcaugaaauacaaaaccacagcguuuccuuugucccagagacauaggguggcagaguaugaggcaguuaagaagacacacuccuuucacugggacucccacaucucuuucuuccacaucgauuucucuuauuuccaagaaggaugucugcaaagugccagggggcugggugucuugagucggcgggugcuuaucacuaggguagucuagacaacggcauggauuuguuucugagcaaaguauggccagcaucuguuuggaaugacauaggcauguaggagaaagcacaguucugugaauaagcaagcagaugccugcaguuccuaagguuuagccacauccucucuggguugaauaucccuugucuggaauccuugggaccaugaguuuuggcaguugugagcuacuagauacaggugcugggcaugaaacccagguccucugagaaaucaauacaugcucuuaaccacuggaccagcucuccagccucuuucuuucuggaauauuuaccuauacauaaugaaauaucuugaacacaaggccaaaaucucaacacaaaaguccuccacaguucauguacacuuuguauaugugcccccccaacaccaauuuuuguacagucuuuuuaaugugcccagaguuuaagacccaucacaugaugucaagugagaaauuuuccucucuguggcauuauguugcuacuuccaaaauuucagguuuuagagcauugcauagucaaucuuuucagaaaaaagucagugcucaugcuggacuuuauugcaagucagauguugggccuuaaaaaguaauuucaccuuaaauuuucuuacuuuuuguuaugaaacaacaccuagaaaugguuacccuuugcuucgaauaugcagccuguuaaaugaaaucuacuaguauuuuaugaacuagguuugugagacuggugggcauugcuuuaggaacugcugggaaguacugagcucguggggucaguuaacguugcugugcugagugcuuuauggaugcugucucuuuugauccuuauguuuuugguugugguccuaaccuuuaacagcugagccaucucuucagccccuuuuguuccuuauaaaaauugugaggugucaggagguuguguuguaugucuuuaauccuagcaguguuuguuguagggaauauaaacuuguggacccagguacccacagaguauauauaagggaugggaagacuauggggucaaggucuuauauuugucauccugccacagacugcgugcauauuagcaguucuugccaucagaacuaaccaauguuuuguuccuguauaagauaugacuccuuuacaucuuaaacccagucguuagaccuacccucaccaacccuccauuucaucuuuggaauauggaagauucuuucccaacuuguuccucaaauacuagccuccugaucuauuugccaaaacaaagcaggcaucaugagcuuuguaagauuuuauuuuuguuugugggacucuguguguguguguguguguguguguguguguguguguguaaaugugggcacaugugugugggugcucucagaaaccaguacaagguguuggauacccuagaguugaaauuacaggcauuugugagccaccagauauggaugcuggccacugcauuaagguccucugguacagcagggagugcucuuaaccacugagccaucuuugcagccgcaucagggucauucuaaaauaugaguccuguuaugagugcacagaucaugagugcaguacacuuuacaggucauagaaagccccuacuucaucaucaaaugcauagugacugacuuucuguuuccuguacagcacuuaagaauuuuccuaucugaaggcuaucaaaaaugggcaccuaccuucccaugcacauacauggaauauacauauaagcgaaguacugugugagaaaacaguauaaauaugcauuaauuaauugauacaauguaauguuauuaauucaauagaaacuauuugauguguauuaguaacaaagacaguugcauuggauauaaguuuuaauuaaagaagugggcucuauaauaauauaaccucauguuuauuuaaaauaucaacauaugcuccauauaucccgcaaauauguguguaaaagacugcucaaaguauuauaguaauugucuauuuucagacacugcagccauaguucauuuucuugacuuugcucaucucuucagguacuaauuauggaagcuggaaagauggcccaguagcuuagaacacuuacugcucuuacagaggacuugaguucuguucucaacacugaugugucagcucacaacucuaguuccaggggauccagugcugucuucuggcuuagacuggcuccugcaggcacgugguguaccauucucacacaggcacacccaaacacacagauaaacuuaaaaaugauaaaucuuuuaaaaacaauuaauuguacauuccaugaagcucaagaagaaggaagaccaaacugugggugcuuccauccuucuuagaaagagaauaaaauacucauggagcaaauauggagauaaaguguagagcagagacugaaggaaaugccauccagagacugucccaccuggggauccaucccauauacaguuaccaaacccagacacuauuguggaugccaagaagugcauacugaaaggagccugauauggcugucuccugagaggcccugccagagccuuaaaauacagagaaggaugucaguagccaaccauuggacugagcauagggucuccaauagaggaguuugagaaagaacugaaggaguugaagggaugcaacguuacaggaaguacaguaucaaacaaccagucccagagcuuccagggacuaagccaucaacaaaggaguacacauggcuccagcugcauacauugcagaggauggccuugucaugcaucaaugggaggggagguccuugguccuuugaaggcucgauagaugccccaguguaggggaacugagggaagggaggugggaguggguggguggguggaggaacacccucauagaagcagggggagggaggaugggaguuuugguggaggggagguaaacuaggaaaggggaaaacauuugaaaugcaaauaaaaaaaauacccccccaaaaaaaaauucagcccggcaugguggagcacaccuuuaaucccagcacucaggaggcagaggcaggcggauuucugaguucaagaccagccuggucuacaaagugaguuccaggacagccagggcuauacagagaaacccugucucaaaaaaccaaaaaaaaaaaaaaaaaaaaaaaaaaaaucacauacuaucucacuucacugaaugcuuauguauuuuucauuuuaaaauugcauuuauuuauuugugugugugugugugugugugugugugugugugugugugugugugagugauggcucucgugucgugauggucagagacugucuugugggagucgguucucucaucucacuggguagguucuggggauugaacucagguugucaaccuuggcuucugcaguaaaucuucucaccugcuuaauaagugagcuucuaaaucaacuguccucuuccacuggacgugugaugugucacuaaucccuguagguggcguccacuggaugugugaugugucucuaauuccucuagguggcggugucaguuaucaaacaguguucucauaguccugcuuucugugcgaugucauuccuaacgaacauguacauaguuuuauuuugccuuugaccuacaacaacauugauacccacuuuaauuccagagaaagcaauguauuuuuauagcucuuuuugaauauuguacuuagacaauuccccugacagggacagugugaaggucucugccuggacauuuucagugccuugcugcuuugcuuccuaagucauuucccaccuuuacgacuaacaacaaccacaugacacugagugcuaguucuugaacccauuccaugaguuggccacacuccgugucuucaaacgcgucacucacauacucguguggaacugccauucuucccaguuuauacaugagaacacagaagcgaggaaagcagacagcuugccaaagaguaguuacucaccauaagcugaguucacaggcacccuuucuucacagaauccuacauggauaaguugggggacaaauaaacagcuaugcauaaguaaacgaauggguuaaagaaauuguuuuguucguuuauacaauaaacauaagaauuacaauaauaaagauguaauugaaugaguauaaaaauaauuuuaaaguagugucauugaauugugaugacagaauauagucauuaccucccuuuuccuccuccucuuccuucuccucucccuccuccucuuccauuuacacacucuacccaguuacuggaaaaucucauuuacaggugacuaauauuuuaguguguauaugagccauauauucaucaccuguccauccacugauggccaucuagguuguuuccacuuccuugcucuugugaauugggcagcaucgagcauggaugagcagggaucucuauagcaggaucuggaacccuucaggaauacacccaggagugguauacgugugucuauuucuagguuuuugaggaaugcugaguuccauaguagcuacacccauugucauuucccccaacaguguaguaagcauucuccuuuccccacccccaugccugcauuuguugucuuuuuguuuuaaucuuugucauucugacuggaauaacaucaaauuuuuaagcaguuuuauuuuccauaauggcuacagauguuaaauuuaagaaagaaagaaagcccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggccuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauuaaaaaaaaaugaaaaaaaaaaaagaaaaaaaaaaaagaaagaaagaaagaaagaaagaaaggaaggaagaacggaagaaaggaaggaaggaaaaaagaaagaggcagagagagagagagagagauugagaucucuuggugcuuugcucuccucuugagaaugcuguuuaauuccuuacccaggcugauuuuguuguuuugggccuuaccaccucagucgcuaaccaagaacuguccccaucaaaugcuccccgccaaucugauggaggccauuccucaagugagggucccucuucccaggugacucuaguuguguucuuacugaguguggggugguuguuuguuuguuuguuuauuauuuggauauucugaacacuagacucuuuucagacacaugauccucucaaucuguggacuauauuuuuacccuuuuaauaauguucuuugaagcauacacaucaucuuuaauuuugauaaagucaauaacaucauuucccugguuucuuguacuuuguuguuacauaaauaaacaaauauuucacccaauccaaagucaugaagauuuggcucuaaguuuucaucugagaauuuacaauuuuauucccguuuucaucuuuaaacuguuugaguuagcuucuguuuggggcauaggaggcagauauccagcugucuucuuucccacauagagguccagcuguucugucacucucuguugaaagaguauucuuuucuccguugaaugguucuuggcacccugucauagucaaagucaaauggcuguauggcuacauugcuagguucacagcagucucgcccugcuucauguuucagggcuggucuacccauaugaugcagcggagugaguagguuuuauucuccagagaguacccagaguccagugguacccaugcuucuuacugucagcuguccugaguaggugacuggcauccucugcugagauguaagagucacaagaaggauguuugcacagcaaggauuauaguucagguuaucuucaacaggauccaugagacagauggacagauaaagccuagaugcuuagcucagcuaaaagaauuuaaaucccagauauguguaacugucuaugugcaccucagcaccuucaaaugcaucugaaacguguuuaucaaggccuguucuggugcauacuguaaagcagcuugaauuagaaggguuuuacuuccuagcaugcaccuagcguaaacugcggcaaauuaucaacgacaucaagguaacuguagaauuguuaacuaguuaaaagucaagacaguuggcucugguuuuuaaacaguugacuuuucagucuuuuucuuuguaacuaguuagcuaauaugccaauuagcucuccaggccacuccuuguuaaaggugguaaaccuuauucuuuguguacauuguaugcaaugcccugguugaucugcuugguugaaggggacaucuacaggguuacagaaucuuacuuccaaugacauuagauuauucacacacuagcucuaauguugcaagggggcauaaagacauugauuucauggcuaggaagcuguuuuucaaucuuuugaggcuaaagcuuuguugugauaugaccugucacaacaccuaagguugggucgcucucuucaucucucuuccuguuuacuggugcugaagaccauagaguaucaugguaucccuuguguguggcaauguccaguguugacgacgguggcacgaggggcccaauacugaauuugggaacugauuuuuuguuuuuguuuuguuuuuuuggcuuuuuucgagacaggguuucucuguauagcccuggcuguccuggaacucacuuuguagaccaggcuggccucgaacucagaaauccaccugccccugccuccugaguggugggauuaaaaacaugcaccaccacgcccugcgggaacagauguuuacuaaacccaagucuuauacagcccgaucuuauacaagaucagaaagguagacuucuagaucaaaguuuuucucuugaaauugcuuugagacuuacauuugauacaauuaaaacuaaacuuucuaagaaggggcaaaguguccacacuuuggucuucguucuucuugaguuucauguguuuugcaaauuguaucguauauccuggguauucuaaguuucugggcuaauaucuacuuaucagcgaguacauuucauuugaguucuuuugugauuggguuaccucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauauggcugcuaugaacauaguggagcauguguccuucuuaccaguuggaacaucuucuggauauaugcccaggagagguauugcgggauccuccgguaguacuauguccaauuuucugaggaacugccagacugauuuccagagugguuguaccagcuugcaaucccaccagcaguguuccucuuucuccacauccucgacagcaucugcugucaccugaauuuuugaucuuagccauucugacuggugugagguagaaucucaggguuguuuugauuugcauuucccugaugauuaaggaugcugaacauuuuugcaauugcuucucagccauucaguauuccucagcugagaauuccuuguuuagcucugagccccauuuuuaauggcguuauuugauuuucugggguccaccuacuugaguucuuuaaauauauuggauauuaguccccuaucugauuuaggauagguaaagauccuuucccaaucuguugguggucuuuuugucuuauugacggugucuuuugccuugcagaagcuuuggaguuucaugagaucccauuuaucgauucuugaucuuacagcacaagccauugcuguucuauucaggauuuuuuccccugugcccauaucuucgaggcuuuuccccacuuucuccucuauaaguuucagugucucugguuuuauguggaguuccuugauccacuuagauuugaccuuaguacaaggaaauaggaauggauugauucgcauucuucuaccugauaaccgccaguugugccagcaccauuuguugaaaaugcuguuuuuuuuuccacuggaugguuuuagcucccuugucaaagaucaagugaccauagguguguggguucaucucagggucuucaauucuguuccauuggccuacuugucugucgcuauaccaguaccaugcaguuuuuuuaucacaauugcucuguaguauagcuuuaggucaggcauggugauuccaccagagguucuuuuaucauugagaaaaguuuuugauauucuagguuuuuuguuauuccagaugaauuugcaaauugcccuuucuaauucguugaagaauugaguuggaauuuugauugggauugcauugaaucuguagauugcuuuugaggaguuacagagacaaaguuuggagcugagacaaaaggauggaccaucuagagacugccauacccggggauccaucccauaaucagccuucaaacgcugacaccauugcauacacuagcaagauuuugcugaaaggacccugauauagcugucucuuguguggcuaugccagggccuagcaaacacagaaguggaugcucacagucagcuauuggauggaucauagggcccccaauggaggacuagagaaaguacccaaggagcuaaagggaucugcaacccuauagguagaacaacaauaugaacuaaccaguaccccccagagcucaugucucuagcugcauauguagcaaaagauggccuuguuggcccacuggacuugcaaacuuuauaugccccaauacaggagaaugccagggccaagaagugggaauggguggguaggggggugggggggggaggguaugggggacuuuugggacagcauuggaaauguaaaugaagaaaauaccuaauuaaaaaaaacaaaacuaaacuuucuaaugauaucuauuaaaagaaaccaugaaagugagguaggauacaggaaaauacuuagaaaaaaaauguauccuugguaaaaggcucauugaagaugaauagggaauaugugcagcuggauaagaaaaaggacgcgaacccaaauugauggaagcuuugaccaggcacuucaucaagggaaaucaugcccagcgaguguagaaagugaucuuaguagcuuccuucacagggagaccagcaagggggaccugccucacucugggcacuggacaguguuaagaauucuuacaucaggggcugaagggguagcuuggucugcugagugcccugucuaucaagcaugaagcccagaguucaauccccagcauuguuuaaaagggguaggaugacacaugauaaccuaggauauaugaacccuuaucucaaaaaaaaguguuuuuuuuuuuuuuucuuaaaaugugucuacauuguguuaaagguggagaguacucuuaaugaucagcaccuucgguaugcacuccaauauucauuucugugacuaggcaaagacacugaggggcaacuugacuccauaauuaucaucuaucagacccucucuugcugcucaaacuugcuugacaaaaaggcugagagcacaaagcaggcagccaaaaauacgcacaacacuaggcauuuacaaugaugaugccucaguaccagaagggaagcacuuucccugguagagcaacuaugcugauggguggcaaggccuuagucccuucuguggcuauaugagcaggcuccuuggguuuacuagggaguaggcuugggagcacucuacugugaugccuccucuaauguugugacaugaggugcuaggaagguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcaaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcauccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucccgaccaccauggccacuuuguucaugugcccauugagcaaugacagggauggcuggggagagaggcugacuguccacagaacgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggucuuuucugugauucaccuauaggggccugccagaggcuccaaacagcaucucuaucagucacagacaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauaggcccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuaccaccugauuuaguuuucgauaaucaacugucauucuccaugauccaucuguuuucugcacuggccagauaggagaguuaaacggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucaguggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcaaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacagaaggcuucuccaguggucuuugucuugccuacuuucaauacuucaggcuaaguugaaaagauugcagagagacugggccaggguugggaggguauugguaucuugaucucauaggcaccaaccaaucccaguggguacucuguauacuauccacaugccugauaugaacacguucucagcucagguuguagcacuaaucccagggguggcuugcuccuuucuggaucauagcaugcaucuguacuuggagguugcucaccuccuucuggcaguugcccugugcacugcucugcagcagacucauggcuaaauagucccaggggagcagagggaagcugguacugcccagcacagcacacuugugaucuugucuacaacugcaugauaguuggccucucaaaccaucccagcagcuggcaccguuuccaauacucaguauuggguucuaaugacccuacuuguggucaguauccaguucccgucuuagauccugcuugacuguagaaaaaaccacaagguagaagcuguggagcagcugcucagcaguagccauugacaacugacagagcagagagcagccaaggugggaaggaaggaagagagugaaaacagacaagaaagcugagacagagcugugaggagccggagaagagaaccugcagcucuggacuccacagagcucgcucacagccaagagacucagaccaagcugggaggcauaacacaggccacugacaaggacccagggucccccugucugaggccuucacugggcugugacagauugcugcuugcugcccuguacaucugccaacugcuaggacugguguggccaaacacugagggagacauaaacuucuagagaccaguagugaggaacguccaccagcccaugauuuccacccauuuaaaucaagagagccauuaaccaucuuauuggugacaucuggagacauauaugcuaacgguaucugagauaugaugccccuaauguuaaaaaauaaaacauugacgugguuuugaagaaacuagaacuccugcauauaacgugugggaaaauaagucaacagaaauuugcuggaaacuguuuccuucuauucauuaagguuggaaauaaauacagauccaacaguuucccuccuaggaacggaaagacccacacaucugugcaccaagugacuugcucaggaaugcucaugggauagaggagugaugcugaaagccuugugaugccagcacaagggugacugagguagaaggaucauggguugaggccccauagagagacgcucaaaaaagcaaaucaaacaaggcccccaccaugguuauugaaggauuauuugcaguacccucacauuguaaacaacucaggugucuaaaacaguaggauugucaugcauugacacgcuauagugcuacacagaaguggggauagaaugagcuauagcugacuuugaauaagauucuagcaugcagguuuucauacaacaaauggcaaucugggugauuauucucuaggucucuaggacaaagcuuagaaacugaaaauagaagaaagaugcaaauccuaguaauguguguagguugugaugaauuugaggaugucuuuuagaaagcaagacugaaacucaaggcgggggggggggggaauaaagaggugauuccaaggccuucaacacuaaaacaaugcacaauguggguugugggguaagauguggauagggggaggagaaagggaggggggagaggaggagagggagggugagggagagagagagacagagacagagauggaaagagagaugagaaaaugacuuccaaauuaggaggaaacguguuugcacugcagaauucuaucuuugggaguuccgugagggucggacaacgccaguucagacaugcuugggauuuuuaggccaucacaccagucauuccaaggucauaaucaaagaaagaccuucacccucucuccccuuuguucaaaauaaucauaaaagccaccuuuauuuaaaggugguugaguuagaggagaaaacaacuaccuaagagaaagcugaaguguggugcuacaagcgcauaaccucagcacuugggugcagggggcucacaaguucaaggccaguuugaacuacacugagaacuuugaaaaaauuaaaacauggaaauacgugucauaaacaauaaacgagaauaagaacuuggaaccacuuacuuuuaaacuuuuuuuuuuuuuuuaucaaacuacuguauucugaauaugugcuucuugccggcacuguuauaaguucuggagguacaguagaaacaaaauagauacauaccuuugccuucaugcacaugcuaauuugcuuaaauaaggauuuuacagcuacuucauuagauacauaacaaaauauaucgcacaauagaagugggguaugucuguaacgcaaugagaggcaaaaagaacagagcgcaugccugagucagucacagcgcaugcccgugaucccagagugggggugggggccgggguguuggggaaauggaggcuagagcaucaggaccaagugcuggccacucaggcaugagacccuagguuggucccagaacaucuagaaaggcucugggcagugcacgcuugucacccaggugcugcugugauggaggcagaaggaucccaggggugugcuggugagcuucugcuuuggggggagaccuucucucugaagcuaaaguggagaucaaccgaagcagauaaccaacacucucagccuccgaccucacuuucagguauacacauuuguauaugcaccugaucauguacauggaucccccuacacacaugcgcagaaagggaagucauaaacuugaaaauaaaaugugcuagggugguuaaacuacaauuguguuuuucuuugguagaggucuuuaguuuucuaucggggacucagacaaaggaagaauaaaauacgggauuaguaaaauuguucagauucuacuuuaaagcaaguguuucaucuggaaaaaguugccuucauuuuaaaacaccuuuguccuuguuuuguuuuuagacaaaguuucacucagcagcccaggccaccagcccuugaccuguuugucucaaaucuccugaaugcuuguacuaaugauauacaccuccaggccugauauagaacuuagucaagugaaaccuucuuuguuuuaaaaauggggucucauguagaucaggcuagaaaacagggucccauguagcccaggcuggucuccaacuugcuguguagucaaugaugaccuuaaacuucugcugcugcugcugcugcugcugcugcugcugcugcugcugcugcugcugcugcugcugcugcugcuccuccuccuccuccuccuccuccuccuccuccuccuccuccuccuccuccuccuccuccuccuuuuacuggaauugcagacaggugucacuauuccuaguuuaugugguucugggauugaaucaggcuacaugucgggaaaggcauucuaagaacugaaucacaccucagcacugaaaccuuuaucugcucuacagcagacuaauguauuauauuuaaacucaaauucuuaaaaucacgcauauuguccgaggcugcccacaccacaauauagcagaggccugcuuggucuggccucagugggaggagaggaugagccuaauccuguagagacuugaugccccagggaagggggauggggcacucucucaguggcaagggggaggggaaauggguuggggaacugugggagggggccugggaaugagggugcaaaaucuggaauauaaauaaacuuaaaaaaaaggcauauuguuuuucuucugcaagaggugugggagaaagauugcucacugcugacagaaaagaaaaagaaaagaaaaaccaggcuucugguggggaacuuauucuuucuauugcagucagucagggaaaguugaaggugccaggagaaauguggaucugcccauguggggaagcuaaagaacucguguuucagguaguuauaccugcuauugacacaguauaggaccagccuugccugcugcucagcagccucugagcaggguacauaggcuguuccuccaucacuggaucagaugaaagucccuggcagaauccaggcaguugauaucaggguuuuuaaaaagccacuuuaguaucccugaccugagaggaagcaauaugagcagugacauucugagguauuuuccucucagguuggugaaaauucccuuucgauacauucuguguaaccgaccuugaacucacuacagagcuccggaugaccuccuuuuucuuuucguuuuucuuucuuuagacagggucacucuuacuauguagcccuggcugauuuggaacacacuauguaggacaggcuagccucagacacacagagaccagccucuccagagugcuuagauuaaaggcauguggccugugccuuauuuagucaccaauuagcuuuucccucucucauuuauuuaaucaaaauuuuuauacaauguauuuuuuaaaaaauuaauuuuuuaauguguucuaaucauguuuuccuuccccucccccaacuccucccagauccucccaaccccccuucccagccaauuuuauguuuuuucuucuucuuuuaaaaaaguccacaaaaugaaaaucaaaacaaacaaaaaaagugagacaaaaaagucgaauaaaacaaaagccaccuccaccccucacacacacaaaugggguucauuuuguguugguuaacuacucaugggcgaggacuugcccugggauuugauugacaauccagccccacuccauuggacaaagcugauuuucccuuucucagcagguaucauugugaauagcuucugguuuaggggugggagcuuaggagugccuguucucauucauccuugggaagaacuagacuauguuagauauuuuuucauguucaaggauaugggaaagauaacauccaagugucaucaaaucauaaucagauuauauaguauuuuaagggugguauauggcuuuuuaauuaguuuaaauauaaagaaggcaaucuguauaugauauaguuuccuggauagccucugggacuagaaaaggacauuaggaaaaugaauggaucugaauaaaguaugcugugcaguuaguagcuaucucucagugcuggcucaggaguugugacaaaugugccacagaguucugagaugugacaauggagagauuaggugacaaguaaugagaacacuucauuacuuuuaugaauuuuaaaaaauauauauucuuaaaacuucuaaaaugaaaguuuaaacuuaaaauaguaguaaaauaguuuuuucucaaucuuagacaaaucacagguuuagcuaagccuacugucugugcugugugaccuuaacuaaacaccaucaguauuggaugucagucuaauuauaggaaguguuacucucagcaguaggaaaagaucacgaacauugaagcugugcaucccaaccuagaagacugcgagcaugggacccagaacagaaagcuuagaggaggcgcuggaggacacaaggagcccugcgguuucuugggagaguaacuggggucguagaagcagugcuccagggguuauuugauuuuucaucugccaaauacauugaaagugggaagacaucugagauggaugcaugagcaaagaggcagccaccagaaugggacgcugccaucuccagacugcaacccccaagugaaucagugaugcuguugucaguagugcuuccugcugccugggucgggaccuggugagaagcagagccuagcuagcguagagauguagagaggccagugcagccggggaucuuagacuccguuaaauggcuguaucuuagagcuauuuucugucuucuugauccaagccuaaucucccugcaugaugaggucaggacuaacucucucuuccacuuguccucccuuaacccugaacuugcauaagagucaagccgaguccacaauucucaauuaggucuccuucauugauuuguccuaauggauuuuuaagacuuuuuuccuccaacacuagggauagaaccccauuucuugaauaugcuaggccagcauuccaccagaaucacaugcccaacccuaaguacugcaagaaauuaucucaaacuuguagagugagacucuaagaauaagaaugcuacacagaacaccgcguuccccauugucacuuacugugccuucugcgaaccauuccuccacccgcaggauugcucuuuauccauauauauauauauauauauauauauauauauauauauauauauauauauguacacccucauacacacacuacagauauacacacucaccacacagaaaaugcacacacacaacauauacacccccuucacacacacaucacagucaauacauucaaaacaucacauacaccacaauauguauaaaccacacacacacacacacacacacacacuccacuucgugcaucuguuuucugaauaucuugugcacaccgcuaggcccgcccaucccccauccuucaaugaguauucccuaaggagaaggucauuccuuucggcacggugguggguuuccucuuuucagcgcauuuacucauucccugucugacggacucuggugaacuguggucacacucauuuuuugggucuggacugcuccucuguuaguggauuuccaggcuugaaaaggccacauuuuuauuugagauucagguuugagucuuugagggcaccauaaacccagguuugucaguuuagcuuugaguuugacucagauuuuucucaguucugcuuuccucagggaaauauaagcacagagguuaaggaguuugcucauagaucacagcugauaaagggguacaaguagaaucugaacccaggcugcugcagccauucguuuuauuuauuguuuccugugugauuaucagccccuuuaauaguuccuaacaucuacggauucucccacauuguuuaucuuggauuguugguugcuucuucuugugguuccuucuccaaguagagaaacgcucauaaacgcucauucucuugauguguuuacuuuccagcucaggaaaaggugaccugucucugcagauuggaagaauggacucuaaggaggcuguuugcacaaggcucuccacucaccagcuguugagucugugcggaagacaggaucuuauuacuucaauggcagcagcgaucaagaaaguucuccaaccuugaacagccaaauggauugacuacagugggggcagcuaauuaaugauuaaucagaagcauuugauaauaaucugccuugcagccacgccuucaaacuucauuguugcuuucucuucuggccuuguaauguuugagucaagcccugcuucucagcuagugagcaucagcccaaagucagaacucacaggggauucucugcauucaucccgggucuguccucucugacucugcuacauacaggguccaugugggcugauaacuaguaccaggggccugcugcaugcuacgcauugggaugggugcccgacauaauacugaauccucaagaagccuugucaaguuuguagguaucauugacguuuugacgaugaggaaaggagaugcucagagagagagagaucauguguugugagucagaucacacagucgauaggaucaguauuucaauuccagagccccuccacucuaacgcuaugcuuugcuuauuauugcuacagagauaacugcccuguaguaucccaauggauaucacucccagucucaaauugggcuggguauggcgguguauaugcaugggaagcgucuuggggagggugguagaagcacaaaagaaucacagaauuauuuucuaagcaaaauaacacuuguuuguuuauggcccauggaucauagcuuccuguccccaccuauuuuuguaaauaaaguuuuaugggaacacaaccacauccauu

SEQ ID NO: 1903 - RNA, 28210 nt, Mus musculus
cggacgggcgggaucucugcgggacgggacaaggcugacggcggcagagguagcgggucucuaaggcuccuccagcuucucacucagcuccggugacaaguucggcccggagggcuuagucccuagccauggacucgcagaaaguaagcgggggcgcagcgcggggccgagagggugggcggggcgcgcggggcugggcgcggaggacgaggccgggccugggacccacccgacccgacccgacccgacccgacgggaccugagagcccgcagggagcgauggccgcgcccgggaccccggacgaccucuguccugcucuuggcuccgggaaggcacugcggggaggaaaccgcgagccgcacccgggucucugccgcccucugcgggcgcuaggccccuuucuucccgcugcccgcggcgugcuccgagggugggucccuccucgguuggagugaggaccaaggcucggccucgcguggggggauccccgcccgcgcggaagcuggugucucuuuucuuccaccgugucuucagcauggucucugcgcuguagguccggggacugaaucuccuuuguacaucugcccacugccuugcuagugguuuauuuauaagcagaucucaguguuugccuaauugaggaaaaaggcaguugucagggccgcugccccacccucguccuucaguuggugaggcuggccaguagucuuguuucggaauguuuaguacuuugagaacaaguuuaaggaaagaguuacacaauagccuuuuuuaauuaagcaaauagugcacugaauacaauugcaacugaauuuuuaauauucaguaguaauuccuguauuaaaaaaguaagccaccuugcuaucuuuguuauguuauaguguaauugcaauacauugcgguauaggaaagaaaaacacaaguguuauuaauaauacaucagggaaaacaagggcauuucuaagaggccauucuuuuuuuauuauugcauagaaagugccagaaagaguuagagaaaaacugcaauucuuaccuggauucaucuuucugagcuugccuugagacccauucauuuggguauauccaauuauuauuuccacaacuauacuauaguaucuuuuaaagagauuacuaguaugucuaagaauguguauuuugaguguguauaaauuuaaaggauucucuguuaggcugauaaaacauugcaugacuuauuagaggaaaggcaucaugugauauuuaagugggcauuagcaaaggucaaaaggaagaagagcaagugccuggagaauccggaaagaugaguuucagggugcaguguguuugcuaccuguaugcagcgcacauuccucucuuucaucuucuguucuguagaaauaagaaaagaauauacuauuagaaagucuggauaaaauacuccauucggaaaacaguauuuucaaguuuaugaauaauuaguacuaaaauagucugugcaugguaaaaugcuaaaagugcuucaauguagaucaucuuaucaggggacacugaggaaucaaguguuugacguugugaguucuauaaggacaaacaugguuucaaccagguuuuucucauuuuagacaauguauuugugcacccacaggaucccauaaguaguuuccccagagguagugaagaguuagcuguucuuuuacugguguugauguacuggauaauucugaaaagucaacuuuucaauauuaaaauuuugguggagguaucaagcaaucuucuagcgaggagagcuugugcuauggcuucugauggauaucuaggucuaauguuuguaauuagcacucgugcugucaaccugagcuucauuuucuuacgguuugcugcagagucaguuaguuacuagcuacaaauaguaaugaacuaauuggguauucuugucuauuaucuaagacaguagugcaccuguagcaugagguuuccagacuauuuccuguuguagaauguucacauaaaaaugguagcagaaaugguccccaggucuauaaagaaaguagcgacaugcuguaaguggcaaggaaggccuagggauuuggguugugaguuauuaagaggagccagcucucuggucauacuguuuaugggccaucauagcuuagaugauuugccaugagucuccauuucuucaucuauaaaauagaauauccacugcagucucuuuaagaguuaugaggauuguguccauuucuggaaaaccacccaacaguauuaucugugagcucuuguuaaucgcagacgcucaaccucaaaaucacguuuuucuuuucagagccacuccuagacuuccuuaagguguguucucuccuuguuuaucuuuaagaaauuauuucaguugguggugccaagagacaguuguuaagucccaauacaaagaggauuaagaguugugagucaggcaaucuaugauaaagacauuaacugggugucuuacagaagcuugcugcuggcugcucaguacaugggugcugcuggcuggucagcacaugggguggcuuccccagaugccuuuuuuuuuucucuuuugucuguggaaacgacuucaguguuuuguuagcaacaaaugcucuauuucaguagaggaggaagacgaaguugcuguggguguguaaggcauacuguaggauacagaagcaguauuaucuccuagaaauggacagagggauuuuguuuauguagaguuucugggacacuuuugugagcaggauguguuauggauagguggcuuuguuugauccccagaccuuuugaauauguccuuaagugguucuaagauaaaaucuggaagguuucuuuacccgaugaaauaaaugugcacauucagagaaaacacugaaacaaauaagacagcugagccucuuggguacuucuuuugaaguugguagugcaagguaaauuuccgugcagaucacugguauucauggggcuuucuguuucuaggaaaggugcuuguuacagcagugggggugagagggugggcagagggaggaugcuguuaggagcuggcuuuguuaaaugcuuuccccauuguuuuucugaguguucuuccuagcuggguagggacucaaaggucuccuuuauacuacaggguaaagcucgacuggggacaucugcauuugucuuaccuguuuccucuuaaauccugauacuugcuguacuccauauccaauuggguauccauagcuauccaauugacccauccgugucccuuacuugcuuucaauuuaaaaaagaaaaaguuucucaagggaagugaagaagacuggaaguuggguguugugcauacaguaccaugucacacuacacucucacagcagaauucucucaugguucacacagucacucggcuagcaaguggcagucuggauucaaaccagguugauauuuuuguuuuuguuuuuuccauauuccacacuuuuucauuaccucucuccaggccuguauucuuggcuucuaaauacuaaaacaauuaagguuauuaaaauuuaaaauauuaggucccaacaguuaggagcuggggagauggcucaucaguuaagagcccuuccugcucuugcaagagggccagaguuugauucuacgacccacaucggaugacucacaagcaccugcaugcaugugcgccuccccacacacauacacauaauuaaaaagaaaauagaucuuuuagacaaauaaaauguuauuagggacaaaccccaguacaguggucagguuuguugguuuguuuuagacacuugucaaguguagugaaguguugauacgugguauagaguacaagugagaggaaagucuggcaugcaggucagguaagaucucuguccugcaucagcgucuccucuuccuuccuuucuuucucuucuuggagggaggggugggaaucuuaccucucucaauagagcuguagaccaugaagugccacagaaaugaacaccaugugagugcccaugcacucuauacucacauauuaguaccuucguguuuuuaauugaacuuggcaguuucuaaauaucaguaaugaagcaggcuuuuuuuuuuuuuuuaaguuuuaacacaaugccucuuugcaaugcuuggcugaaugucaacaggauuauucaugcagcaagcacauacuggauguuggcuguagugguggcuauuccacacggaccauacuuggaagcagguggacuugccagcggccuucacuguguucucaccucagcugauuuucccagccucauucagauguaaucacugauguuuguugauugguagcaguuuaaauuugguauauaauuauuuauuuuuuaaauauaauuuuuagcauagccagucuauguaccucugcuagauuacaaauacaaauaauacaaguucuauugcaggaaauguuagugauaaauacauuagcaaaaucuccuuuaauucugaaccuugacgauaaccacagucagcauuugauuugcuggucaccuuuuaugaagaguaggcagcauacuacauguacuucuuuacaauuugccuuccuguaauauuucaugagcauucccccaguuuaucaucauuccacaacacuucauauccagucagcauagugcuuucauaugaaugugauucuugaauacgcuugauggcuauccuucuguuagauguuuauguuggucccagguuuuaagauaauaaauaaugcugaaagaagcauucuuguagcuaagucccugccuucguucuuaauaaacuacuuggcauacauuggagaaggggaauugccaguuucuucaaauucuugagauguauugcugcucauuuguccuucaaaaaggcuguaggggucagugcuacuauccacaguguuugagcaucuccaucuagguucuccuugugccucccugaccccugguuuacuuguuggguaagugguuuguuauuguaggugguggguuuuguuuuguuuuguuuuguuugccaguagggguguuacugcucuacucauguggccauggggagugggugaguacuuagucuguugucaggccugggauggugaaugcccaaggcuugcuuauacagggcaaucagacucaggggcuuauagcuccaaaccuugaaaacuagagcuuuauagccccaggccuuagaagcuagagccaccuagcugaguauggucagguaagaagcuuacugccccauggcuccaauugccaguggcccgaccaaggugagaacagcagucaccaguagucagggacagccacuuucacaggucuagugcuuuggauauuagacuccauaguggcaugaguuagcucuugagcuacuggugucaaagcccuagccuucaagguuuagaggcucucaggcaugccuaagagaauuguguuuguggucuuggcaaccaccuaccucuuuacuuucuuuguauuucuaucaccgguuaucaucuacugccuuuacuucugccacugcuguuccugcugcugucuggacucaucacuaucuucuugaugucgcugcugagguggcagccacucuaccuccacuucgagggccaucgcuuguuuuucaugcuaccauuucagcccauucuacuucagauucaucgggagagaaggagaauguacggggccuagaguuacaggauuggagguagcacaggaggaugcuggacagcuugguuauucugaagagaggaggaugugacauacaaaugaagggaaguguucaugccagucauuauaccagcuuccagccucaucggucacugccuuguucgguaaacucaggaggugcuugcuuguccuucaccuagcaagguuuugcucuccuggcacaaagcuuuccaaggccaggccaggccggguugucugaagugguugugacuggagaaaaaggcuccuggagcaagaguccuggcuuuagguguauugacccuugcagccgaacauucucacaguaauuguaaaguauccaagacagccaagcuaccaugagggccgucuggccaguugccacggaaggggugccuggaauaagggaaggcugugugcugcuauucaaagaccugaacagcugcuccugguagcuuaacucauugacaaagaaagaaaacaaaacguuaugggacauuuacaauaaagacuuaaagagagcucaccauaagcuuauguuugcuuagccucucccccagugcucuagggaguguuggcuccaucucaccucuaacaccacugaguggaacaguucucugcauggcuaaaaccgcuucagugucucacaugcuuacauccccucacuccuagaggggaaacuaccuccuccuccuccucugacucccugucuuacccaguucagaauagaaaggcaugcaccauccugccaguucauuuuagugucugccgauucucccaguugguaaguuagaugaccaggauugauccgugguucaaacaagccaaucuuacauuuacacuuaguacuacucacagcugcucaccgagcuuccccaccaguuaguuauuguaugauugucagauuccugacaucuuaguucuccuuucuuaucuucuugcaucaugccuggaccaaacacucuuguuaauguuugcaguagcuauacucaccugguaagacuuacugucuuagcuuaccugcuagaugaggccuucuaauagucaagucuuuuuaccuaaugcagaugagaaccaagguaugaagugauacaagaggugccaucugacagcagcuggauucacuggccccccaagguuacuacacccuugucuuccagccccaauggaggcaguaguugccacuaguguaaaagcugauguuccucaaacaagggccuggauuugaauuggggcuguugauugauagcugcaugaccuaaaccaaguuaacuuugaaaucuuuaugcaaccauaaauuguugacagcccuuauaaugauuuuuaaaaaaugcucuugacauuggaagugcuaacuaauaauuugucugaaguaaggauuagccucuuuaaacugcagggguguaaguaguacucgcagugauucuaguuuuguauauccuaacuguuauaaauaugaauguagaauuugucccagaagucucuuggucugagaugcugguggaagagcccaugugucaguaguucuuagucaugccacauggaugaucaaugauagaagagaguuuggaccugaugguuugaggucauugguucuaaaacaggaaguuaaugcaucaucauguugggcuuguuacacucgguaggguuuagauaaguagcccaaguuggcggaguuuuguuguuguuguuguuguugcuauuggcugcagcuaaauuaagacucugcauuggaguuaucagauguugcuggagcacauuagucagaacaaugccauuucaaaguggugaccgguagcauuguagauuccaguuuacaaaugauugacaugcagggugcuguggccugggucugggaagucguccaaagccccguguuaaagacuauuccccagugcuuagcacgguagaugagagccuugcgggaggucuucaggucagugggcuugcacacuucucucucuggcuuccuggucauggccaugagcaguccucuguucagccuuucugccauaaugauguccugcuuuagacugaaagcucuggcacauaucagccaugugugagacagaaggcacugucccucuguaggugguaccugcaguaccugcuuggcagcuccagggguuuuucuuguaauuuugaagcacaaucuuaguaacauuugugaugcaugaaucucugaucauuuccuuaucggacagcagugucauaguuaauauuaacuguuuucaucugaauccugccuuguggcauauuaauucugagcuucuagaagagcuacuugaacuucuucaugccaucuuuagaaaauuaagauauuaguaucuuauaagauucuucauuuaaaauguguauggcugcuuuguuugaauguauguuugugcuccauauguaucccugcugccugaggaggccagaagagcauggugauucccugggacuuggguggcagaccccucugcgcagucauaugggugcugggaauugaaccuggguccucugaaagagcauccagugcuccuaaccaaugaauccaauaccauuuauaagaaucuugaaaagaccaacugaauuaagauguaaagaguuuaagcuggccuuggcucugacaguaugaaaguguuacuguacacugccuagucuguugaauguacuuuuaccucacaauucauucugauuauaaauauaaguugugcuaccucaaaggaaguguuugaggcuugaacaucccagauuacagugauacagucuggaaaugguggcaauguauuuggccagaguguacaaaacccccuuuuuauugcuggcuuagcaguuguguuauucuaaauuuacagucaaauaauugguaucuugauucuuaugacauagacuuuuguguuuuggugacuaugcugcgugaccaugcacagcagcuaagagcacaucucuggagacauuugcucuguguguuuugucaugaccugacauaauuggcacuugucagucucuuuuucagccuauuuagaacuuucacuuauuacugccugaagcuuuauaaagcacaguuaucuaaauaagcuccagggauucuauauggccuuuaucuauuacuauuuaucuugauacccauuaauauuuggaagguaaguggaggcuugagaucugacgugaauuuccagguccuuguaggcaucuuugaugcagacagauuuccaugguacagaugaacaguuuucauugugaguaccuuccuucaccaggagccuggauacuaucacagacaccgcaaugcucauccuauaaccuuuguuuaacuaguacauuguguaugucuuagaaucguaguuaggaaugugagggcuccaagguggaaagggaccuuauuggagaaacucaaaacagucugcacagcugagaggagagcaaaaaaguuguuauaaauugaagcagucaagguaggccguggaaccgucagguggcuuuggauguuguguugaggguguuuuacuuuauacaggaagcacugagaaguggcugagagguguguuggugucuuauugcuuuaacugaaaagcaaaaacauugggaagaaaguugaucaugggcuuugcuauagauugagacgugauagugacuuguacuaggguuguuaguaacuaucuagaacuauuuaggacauaaaaauaguagaacuugguggcugucugcagcuuauauauaaaucagaggggaggaaauguuggaagaugaaguuuuuggauuuuuggauugccuuguccuuuauggaaguagaacacaagaauggccaugggucagugagggaagauuaugaucauggguugacuuuugaagggcuuuugccacauccaagugagauuucaaguagggagugcauugaaugcacuggggcucagaggaaaggcuccugccugaaagcuccaggucuccuacugcccugcauggugucuaccacacugguggaaacaucaggcuuugacuucugcccaccagcaucaguucauuuauguucucauuauggaaacuauuugcaggcuuagguuuucaaaaaccuacuuuaauaaggguuuuuaaacgcuuuaaccucaguucuagcccaccacccaccagagagaguggaaaggaaagguuguuagggcaaagggggguguggaccugccuagaaauaguucuuuugggcaauuccagucuucacugucaggcuaucagcagcucaguucacacagaucagcagcgguagcucaguccacucacacuguuggugaaucagcaauagcaguuugauccagaaaagacagcaaggcucugccaggcgguccaagucuguggaagugguaagaagcugcuggaaugagaagugccuuggugcauuuucucucuaccaagucauaacagugaucagugaagaaggcaaggcgaaccaaugccacagcaucaccagcaaagaccaacaagaaccagcaaagaggggcaaggugaaccagugcaacauagugucccacugucugcugggaaauaauuacauccuugccuaacaccaugugucuguucucaacaaaccauccucccacaugucugucucagcagagcauccucucagacaguuuccagaaaaacaucacguaacacaaccgagucuccaaagaaaccaaaacuuuccacuuaacuguugaugaaauuugaaauucuggggggauuaacugagguaguuggauacagaacauauuuauauauacccugacauguugccuguuguauuuagaaaucacuuaaaaacaaacaagcaagcaaacaaacaaaugaagacccugcugcuuuggcaccuauucagccuguugucacccagcacauucccagaguagucacaugccaucucuguauacaccucuucccugagcccugucacccuagagagaacucuugucugauauacguguuaaagucaaguuuccagaugcagaucacauucuuauccuugaggcauuuuucaaguucaucuuaaacgcuguacuugaaacuugucuucuguucuguugugcuccaggcucuucugugguucugccuucccaaccugggcugggggucccauccuuggagcagaaugguugacgccacuggugcucuucauauuuaguucucaguacuucucguggauccuggacuuguuuauuacacuaaguauaagcuauugaccagaguccuuugcagucgcuuggccucuccauaacauagauuaaaggucaaguggauucagagaugcugggcccuuuuucucaguagucuguccuugggggacuuugagguuauuaaauauagaacauuguaucugcauuagcugccagugucacauugguuucuuuggguuucuguuauugaucuaguaguuugcuucuucugcaguauauaauguacucaauagcuguauuggauuccuuucucguugcugugauaaaaauuccuugacaaaagcaucuugagacagguuuauuuaacuacggcucuagaccuuacagucccugauuauggggaagucaagguagcaggagcuugcagcagcugucacaugacauccauagucaagaucagagagcagugaguuaauguagcauguauucuaauggucagcuugcucucucggcuacuaacccugcccaggcaguugugccacccacaguggguaagucucauuaaugucaauuaauauagucaguguacuccucuauagacccucucaugggccaaguuaaucuagacaguccuucagauuccuuuccaggugauucuagauugugucaaauugacaauuaaaguucaccaucacagagcuggagaagugacucagugguuaagaacacauagugcucuuacagaggacuguagcuggucucuagcaccuacaugcuagcuuacagcuaacuguaauucuaguuccgaggaauucaacaaccucuucuacccuccaugggcaugugaccucuguggucaggcgaaccucucagauucauaaaaaauaaauaaaucuuuaaaaaauugucacaguaguauugaaaaucgaugugaacuucuuuccagaacagcugcuguaguacuuccuggaccaauacaguuugaaaaggggucucugauuuuugccuugauaauggcaagaauuucaggugaauuaaauggaaaugguaaaaauaagauuaauuguaaucuaaagguggcuauuuuggaguaauuaacaguaucauacaaaauagacacuaugcugguggggcguuggguuugauaacucacaugaaggcugucccugagucuuauuuggucaguuucuauuuuuacuuugugaucuccccaaauucugcuccaaugagaaguauuggugaucaguguguguuuuccccacagcguacauuuauuucccccuuguuguugugguuucuaagagucuuuaggcucugagaguaaugcugccucugcaccauuucuuauuuuucuuuuucugagaguugauaacuuuauaggauuuuauauguucuagugcuaguaauuacacaaauaaaaacuuagaaauuagugaaacucugguaaagaaacuuaguuugaccauuuccacuuauauccacauacggcacuuagaauucaagaauccugcaugcuauaaacauauaaggaaaaucuacuuuguguagcacaugcaugcuuagccccugcugaggucagaagauggcaucagaucccuucaaauuggaguuagagaugcucaugagcuaccauguggugcucugaaucaaacagagcaacaaggucaauuaacugacucuccagccccuuguaaugugcuccuaaaaccaggagcauucauaauugguaaaccuuuuuaaauuuguuuuuaaaauugguaucuuacuauguuguucuaugcaggcuggccuugaacucuuggacucaagcaauccuccugcuucugcuuccuauguagcagggacuacaaguguuuuguuaccauaccaggcuauguaauggcugacuauuuacuauaaguuagaaugcuauuuuagacauacuauguuaaguaaagucccacagugacuucaucuuuuucucuuuucuuuugugaugugguugcgauuggcucacaccguuucuguuggccagcacuacccuacgaaugagaacucggcagcugguaaaggcugcacucugauacuauuaugauacgaaagucuauuuucagcagguggguuacucauaaugauguagaagaguaauuaugaagacauaauaaaaauuggaguauuuagguauguuugacuguagaagcauaacagaagaauaacagaagcuuuaaaaaaacgagcaagcuuuucauugaaaaaguccaugugacucauagcuuauauagccaaggcaauacacauuuguccccagcguucuuacaguugccuccuaacuguguuggaguguccuugcucagagagauuugcucuucugugaacauugauuugcauuuguacuuuaguuuuuauugagcaugcacagaucgcgaucauuguaacuuugcuguugggcugcaucccuugggaccuggcgauucauuuccauagacuaacacagcuucuugaagauucuucugacucugcucuggugcagugucagcaucuuuaaaucacccuugacuuugguacaugaacuugacagugagcagagcuuaaguuuaauugugagucucuacuguggaauuucuagaaauuaucuaugccauuaaaaacuuaacaagcaaacuacuaagguauauuaaagucaucauaugguuauacuaaaugacacaaauuaauuggguuuagagacuguauuccaaagugguugaggacaugggcuuuggacugugacuaaacccaucuguaucucucuaacaauauaacuucggcagcuaguuaagucuccacuuucuugucuuguguaagauggaugaaugcagcuucucuuacuguaguaacuaagaggaggguuaauuugagcucacaguuuuaugggguuuagucccuggucgucuuugacccuuuugccuuagguccuguggggaggaccaucaugacauggaucaugugaugauacagaacucacuccauagcugaggagaugagagagaggaagagauugggguccucccuccaagagcacaccccuaugaucuacuagccuccacuuaaugauuccacucucuuccaguaaugcuacucuggggagcagcuuuuaagucaauuuuuaagcuuuuaaggucuuuaaggaccauugcaggacuaagcacuugcccuuaugagcaucagaagcugucuguuaaccagaaugaaccggaucauaugauuuggcaccuccuguaaaagccagagggugguguaguucuguucauaugccugacuguauugcuguacauaccuagagggccugacuuugauacguacauggaagacuagggucuccuuuuuacaucucuucagaagcacuguggccccucugacugugccugccccucuucagaguccucacugcaugaugccauucugaucuguauacuuauuucugggaagagcacagacaggucaaagcuagcucuugguaccuguaguccuuuuccuagcauaacuucauugcauuguuuuuaaauagcacaaggaugagggugggaagcuguggugugggugaaugaagaaaguagagagcccuuggguugagcucagggaugacuaugccuccuuagcuccagggauugggagaauuagaugauauuugcugugauuguuuuuaauuugcacuaauguugcaucgauuguccucuucguuuccugaguacuuauauauaaccccuuuauccauguccaagauguugaaaagaaccuugguccugggaaguuuuauaggcuuuaccaauaguuaaccaugaaggugcucaaagguagcggcuucugggaaguguuauacaggaaaaguacuuacauuugauuuuuacugaguuuucccucauuauuacuugugaaguuauuaagcaauuagagcuaugcuguccacuaugucaauacaggucacacacaccucuauacguuaaaauuaacuaauggaaagaugucaucaaauuauaucauauacauaucugaaaaugacaugcugacgcccauuauuuuguacaauuaauguacugcaauaagaaaacccugagccgugagcaguaacuugauuuccucgcuguggucccacauuucuggacagugauuauuaguguuaggcagugaguggccauccuggagagcuucauguggucaaguaauuaauaccacucuaguugcagauuugcagcuuagcccuucauauuucuaaaauuucuauuuuuauguuuguaaacaaauauauuggcuuucaaucuucucaccuuuauucuucaugcccugauagaguauuaaaagcuccuauuugcuuuagcaucauggcuguguuugguuuaaaaugauacuguugauaugaaauaaagccaugccugguggcacacgccuuuacuccuagcugcugggaggcagaggcaggcagguuucuuugagauggaggccagccuggucuacagagugaguucuaggccagccaagguuacauugauuauuuucaguguaaccuguauugaggggaugacguugugcacuagagauuacaugguuuaaaagaggacaggugcauaacccauccugugcacucgagggcuuugagaggacaaagaggagcuuuccacugacccugugucuuacgcaaugugcuugucuguaggucucucuagagggugcuuguuaggggacuuaaaguuuucuuuucuaagaagauaauacuuuguuuuaaauccuaggaagcucuacaaagaaucauuucaacucuggcaaauaagagugaugagauucagaacuucauugauacacuaaaucacacacugaaaggaguucagguauggauauuuuuaucaaaaauuguauagucgaauaauuguuaaguaauaucuaucuaaauaacacugucgacuucagaguaugauguauugcagcugugucuuaaagggacagaauaguaaacuagcuuccugugucaucccugcauccuacacaaggaaagcaaggguugcggccaggacaucugacaucguguuuauaagcaagcaguaaagucuugcucauuucuguuuaccaacgccaauuaaaagcaaaguaguggaggacaaacuauuucuuuuccuguacaugugaggcagaugccaaugauagggcuugcuuaaagaaauagaugaauaucagacauuuacauuacuauuaauaucaguaacacaguuacagauauggaguagcaacaaaauaauuuaugauuccagaucaccaugagacacuguauuaaagggucacagcauuaggaagguugagaaccacuccguuaggguaagguaguuuaugauaugaaucuauucuuucauuugcuuacguauuuagauuuuauaugcuguaugacucugcaauaaaauauucauuuuguuuuuaaaaacaggaaaauucuuccaacauccuuucagaguuggaugaagaauuugauagcuuguacucuauauuggaugauguaaaggaaagcaugauuagcaccaucaagcaggagcaagugcgcaagucccaggaguuacaggugaggcgugcagcugcgugacgguggcuucgacuucaggcuugagguuuugaggcagagauaagucuugucaggguggcguuuaccuuggcuugggucacaaauaucuuuuaauauuuuuaaaaguuaugguuaaaaauaacagaaauuuacuguuugcucuuuucaggcguagcuuguugagcagaacucggcaucuuuuuugucuuuaucacaaagcugaaacucuucaccccuaaaauaacaguccuuacuugucccuuuuggcuccuggcaacugugccauuuguuccauuauuuugauuccauagaugucucaugcaaguggaauugugcggcguuuguccuuagccgccauugcagcuguagcauaauguuuccaaggucuguccuuguucuugcacaagcuggggcuuccuuauggcugaguaacauuuguauaagccacaccaucacugccuguucucuguguggccucugagccaugccaccgcugcccguucuccauaugcauugugaguagugcugugcugaguguggacaggcagauacaccugaagacgcacuccuuuccauucuuucagcuggcagugugcugaccacguggcagccacacuuuucauuuucugaggugccucacccuccgauccucacugcccacacuauuugauaucccaccagcugugcacaacaauuccagucgcucauccuuaucagcauuugccuccugcuguuuuguuuuguuuugguggcagacaucauaaaggcuaugaaucauuuuuuguuguuguuuauuugguuguuuuuuuuuuuccuuuuggagacagggucuugcuauguagaucuagcuauacuggauuucacuuguagaccaggcuggccuugaacuaacagagauccauuugccucugccuccugagugcugguauuaaaggcauguacaacugugcuuagauauaaaucuauauuuuugauaugguuuugauuuccauuucucuaguccagagagagauggaacaguuuuuaugcacuuguuaaugucuauauauuuucuuugaagaaacuuuuacucauuuuucuguuuguuaaauaacuuauuuauuguuuuaaaguuacaggcuuucuuuaugcauuuuagcuguauuuuuauuuuuguuuuuagcauggcuguaccgggauuuugaauccagccagggucauguauauguuaagcacaugcucugcuuagcuucacaccuaaucuugagcucuggauaguaaccuuugacagauaugacuuggcaauauuuucuccuauucuguauuuugccuuuucacucuugguuguuuucauuguucucuaacuauaaauuaugauuuaagauaauuuuuaauacucgagucauguguaaguggauucugacugcuaacuugauucacaagcuuaaguuaaauaaacauuaucaagaauuucagucuuuauuacagaaaguugcuuucugcaaguagauauuuuaguacauacuauaguuuucugucuacucuaagaaccuuuaaguuaauuucaucucacuuacuuauaauugcuuuauuuuuccuuuuguacucauuuuuucauguaauuaaguuuuaaaaauauuuacaugugaacauauguaagaugggugcagguugugugugugugugugugugugugugugugugugcacacguggaucagauggcaacuuuuucaagucacuucuuuccuuucacugugggacacacucacagcaugagacuuggaccacaauuccaccucgccauccugccagcccugguggagcuguugaugauaaauuauaggaaaagaggcaguuuugucauguauauaacuaauggcaauuaucuuucuucaguagcuccauggcuugcauauucauccaauuauuuaaauuuauuauggcauauauuuaagauuggcuguaggaaagugcauugugauaaccugggucuugugcuucuccccuagagucagcucagucaauguaacaaugcccuggagaacucugaggaacuacuagaauuugcaacaaggucauuagauauuaaagaaccggaagaauuuucaaagguaaacaaaacaaaaaguaaacgaacagacaaaucaaaaacccaauucuaguauacugaaggaguauuuuaaaaaguauuuugucaaaaaaaaaaaaaguauuuugucauuucugaugcuguaaagagcuugugguguuugauaaauaaaauacaauauguucacuuauuuaaagcaucuacuugugguuggggucaggaauugauuauuuuaauucuguuuuucuuuaauguucaguuuaaauaagcuacauuuucacaugcuuaugggcaguuuguuuuagcugcucuucaguaucugagccaggucauaaguuucuauaggccuacuucaaaugcuugcuuacugacaaaauaauguggauaaccuugaaguauaauuuagguaguaaaguauuuaguagguaguggugaauuuuuauaaaucuggggaaaacaauucuuuuagucacacuauuuuuaaacauaccauauuaaaguccuuaaguugggcuaauauaauuggaaacaacaacaacaaaauagcccuugguaaaaccauacagugauucuugucacacuucuuuaucuucaaauucuucuauuuaaauugucacguuccuguucuagcaugagaucuggauuugaagggccuccauuuaucagaucauaugaucugaaagugaacaguaaaaacagcacaagugugguagaauucuagaauauacuucaccugauuuuuuggauauuagaagugugguugauaguaaauauaugugaaaaguccaggugagauaaagauaaauuagccagguaaauaucagguaugugaaaucauuagggaaauagccaggauucuaccaacucugguuacuccaucacuaauauuggcuugcaaaacagugcuuguauccucugucaaaauucaaauuccucuucuuacccugaauucaaaccuugaacucuuccagugaaaagaacuggccagaacaauuccaagucaguauauaauuauccaguuccuucaaucaguugucagauuaaaaggaaaagagugauuuccuacccaugaguacucucaauggaaugauagcuccaggguacugugaaaggggaacaaugucuucugcauuugauagcaggugaaaagagaaaauggggcuuauuuccuuuuucucacucacaauagcuugccccuggaauacugcucagggugcgacagugucuugagcauugagaagagcaaaugagacagggagcucagucaauacccugcagacugagguugggagaaaguccuucuuuaggcuggucaggaauaccggggacuuuaacagaagcaaacuuuacuucugacaacuacaaauaaaugaaguacucacuaaccauaccuuacaguagaccuguaccuuuuauuugugaguguuggugucucacagaaauguagucucuuacuguccagauguguuuggcuguaaagaagcgguaaggaguacuguacuuacauuaguuucaggcuauuugcuuuuaggugagcaugcauuuguuuuaaguguaugaagguuuugcuugcauauauguauguguacguguccuguacccucagaggcuagaagagggcaucagaugucuggacuggaguuacagggguuguaaaacaccugugggugcugggaacugaacccagguccucugaagaaagagcaagugcucuuuauuuaccauugagccaucucuuccagcccugaucauauguuuugaaaaauaauacuuuuaugaaaaagauugaauacacaagcauauauauauauauauauauauauauauacauacauacauacauacacauacauacauacacacauauauauugagaaagagagagagaauauguaacuaguucuuuuccaaaugucuuuaaaaaaaaaaaaaaaaaagacaagcuuuuuccuaugcagcucagacuggccugggacuucgcucuguaaaccagggcggccuaaagcucacagaaauucgcuugccucugcuucuuacauggcaagguuaguauuuuugccuaaaggaaaaagaacauuuugagauuuugagauaccucuuuuuuuuucuucauuuuuuucauccuguaaggggaggggauauuaggaagaaaaugucuuugucagagauaguaggucccggauauucaagcauuagggaccucacauccuggagucuguaucuugugacguaugaugccacaugccacaaaaugaauacuuugaguuauaccauaaaagguauggguuauauuuuggauuuacauaaaaaaaaaccccagguucaugaacauuuaaagaagaaaaaauaaagauugaucugaccugaguggccaggcgggaaaauacaaaggaaguugacuaccaggauauguggaaagcagagcagcaaagggcagagcaguuagaaggcucugccgggagcagggcccaccucugagacaaggaagcccacgugcccacaguccaagcucagagggaagcagaaggauuaagaguuauuugaacuggcacaaggaaaagcauugaagggagaggccgacuacauacagggcacauccgcacacauccgcacacauccgcaccgagcugagaaccacccuuugcuuuccaggcucguugagaaagcaucaguucuuccuaccacagacaacucugguguccuuagcaaaggcacugccgugaaaguggguuugacaugggccuuguggcucaggaagcaaaauuauuugggaaaaguacuccagguuaccuacaguccugacaaugaagcguguguaaauguaaucuugguuugacgguaguuccauauugacaaccacagucaggaaauccagcauuacugugauguuucugaaugcuuccaaacagccuaacauuaucucagccaucaaaagaacuguucuguaaauucuuaggaagacagccuagucuuacuguuguucauguuugccuguuuugagacaggguuuuauguguaucccgaaguaucuuuaauuuacuccauaccugaagcuggccuugaccucccaauccuucugacuccgcugccugagggcugggauuacagacacacaccaucaugcucaguuuaagcugcuggagcgcagauguagggcaguaugcaugcuagcaagcacuguaccaacugagcaacacccacagccccgagguguuuaaaguauagaagcaauaagguagucaaaaugcuggguaaauuuacaaugguuucuguaucuuuucauugcagauuaagaacagguuaggcaaagauccaguuuguuuuuguuuauacuuaguugguaauuaugaauaauuauuuauaaucacuccucuacucucguaguucuacuuauguaauuuuggccuagggugacaaguucauaaaucugauauauaaaggauugugauuauuaauuuaaaaaucagaggcuaggugugcuagucugggccugucgucccaguacuugagaagcugaagcaagaggauuguuguggguuugaggccagucuugauauaguaugaaacugugucucagaaaacaaaacaaaguuaacugaugaagggaagagagaaugagacacauuagaggaaggagaggccaucuccaacccaaacacagagaugccauguuggcaagugggauuuaguuaauagaaauaucaaugcuuccuggaggcuuuccaguacugcacugcaccauagccccagaggaagccaagcucucacccggcagagucauacagaugcagguacauauaauagagcagaauucuggaaaauucuaggcuuaguauuucagagauacaaauuuuuaaaauuaucacuuuugaacuuuaagcagaggaaugaaaguauaugguaaaguguauuuuuuagauggcuaucuuugggaaaagaauuucucaaaaaauauaauuuauucucuauuugaagauacuucauaaagucgggccauucuagauucuuguugaggauaauuucucaucuucuacaucuacaggugcauguaaaauaaaaugugaaucuaaaucagaggacagaauguucaauguguacugucugugaacacuugggguagcgguuuuuccuaggcugucugcuuucucaucuguuccuuuuguguuguccucacacacaguaugguaucugacaugaugcacagaagcugagucagcagcggccucccuaucgauggcucaugugaaggaggcugggaguucagagccaucagaaaauacgauaaaacaggaaagcugagaagaucccaaauccugcuuuguacugcagaguuugguugucgguaggcagacugacuaagccuggaguuaauuuaccuacccaggucugcucagcagagguuucagaucacuggggguggagaaggcuguuuuagugacacuuaacagcacagaggaagaagaacacaauauauauucucuguagacaagcaaacuucugagaaaaguacgaggcacugaguuaaugccucuaaaacucauaaucuggcaucacgcucugcgaagugaaggaaggaagaagugacgcgguaaugacagaagcuuccucugaauguagagaaguguuggguacagaggagaguccucuuccuuuccgaauuucacaucuauaugaaaaccauuucaguuccagcugccauggcaguguuuuucaaaaccaguguaauagcugacuaauguaacauuccuuauaaaagggacugugccagacaagguuuaugaccuaaggagaucagaaagcuaccacauuggguuggcuguaguaugaggaccuugaaagaggcuuuuuuguucuuaaaagcauuaagaacccaaaucccauaguagagaagcaaaauaauuaauacccaaggucaaagcguugauuccuuguaaugcuggagcuggagcauguugcaaucuauuucacaccucuguucuuuuauuuagaaugacacucaggccugaauaguugaggcuggguauaaaaauggccacuaggaaguagagacaaugcuaggauugaaaguagaaacagaagcaauguuuuauacauuuaauuuauauucaaccauguaccaggauguaugcuagcaaaaccgccauuuuugugggcuguaauugcaaacugcuuguuagcauggaagaaaaucuuucguuguauauauuacauuuaauucauauauaaagaggcaacagcuuuguguguuuucauuguuguucuaugacuguacaguaccagguaaugaucuugaacccuuucuaaacuuguauuuucauuuucuaaaaacaaaaacagaagauauguacagaauguguaaguuuauagcuucugugaaccuucccuuuaagagauguuugucucauuuauccuugucugcaucucuacuguuagaacucauucuugggagcacaggcuucuagaguuguagucuaguuuuguaugcuagaaaggaaacuuucauaugcaugagaacuauuggguuguguggaaaucuacuugaagaauauaucagacugaauaaaagugaaggcauauuugauaaucuuguguuuaaaaaacacaguuauaguuccaugaaacugguucaaacauuaaauuuucuuacuuuugcagugauugauaugggggucuggauucuacuguggcccuaacauuacuuuaucaagcuuacauggacuauauagguuucuuguaauuuauguuuuugaugaauaugaacuaaucuauugcaggguuuauauccuaacuuuucuugcaugucacugccauugaacuugcaugaaaagcacuaacuaccuucuuucucuucucccugauuugcuccaaggcugccagacagaucaaggauagguaugguauaaaaccuacuuuuuuuuuuuuaagugucaauauuggagucagaaaugaaauucagaaaccauuuuucuuagaauucuguugauuaacauaacaauauaauaauaauaauaauaauaauaauaauaauaauaauaauguguaaaguaaagaaaaugggcacuguauaucauagaauaacugguaaucuuuuuaaagucacauuuuaaguuguggaaauuacauauuuuuaagagaauuucauuucugguuuaauauaauaguuagcuuuaguuuuuagaauaguucuuaauuaguuuaguauugaauauugaucuguuuuugaaugacuuaaaaauguacccugcugggaugcaguuuugcggcuguucuucaaucuaagcggaucuuguuggcagagaaggccggugcugcuggugucuuccauugcuggagcucuucgcugcuguccugguuaacaccuucgaguucuccugugcuguucuggugccaccucuuucucuccuccugccuccacgaucuuguuuuuauacugaggaaaacacuuaaggaaauuguuauguaguuugguguuucucauuggcagagucaggaacauaauagggcauuuggcacuugcuggaacaaauguguguguuaaaagaggcugagguaacacugggaacuguguucacugacuugacgaauacucacugagcguugucuguaguuuguaacuugaggcucuuuaucucaggaucgugagguucucugagaggcacaaccuuugagucucuucgagucuagaucacuuuauucuuuaucaggaaauucacagaaaugcucauuauggauggugugaaaaccagagucuauuguuaauuuggagaauuucuuuacuguguuucuuugugguuauuugauggugggagucuggggcagggcauggaacaaauuuacauaguaucaaagcaaagcuauugugcauguuuguagauuuuauauuacgacgugauuaaaggugugguccauucuuagacgugcuggauauuggaagcucacuagaguuuccuuguuguaagagauggcuucucaccccguuuccuaggcuggccuugagucccgaguucuuccugccucgggucucaagcagccagaucugugggaacucagugaauggaguccgaggagaggaguggguaagaggaaagucuuugacaagguagaugugucugcugagauuugccagaaacaacucucucuuacccaggcuagguuauucuccuuacagcucuucuguuacauucugcugugcuuccuggauuuucuggccuagaaaucaaacccuaaccagguuuugggcuguccaaaaaaucuuaagagagaucucuccuugguuucaagguucuguuucuggucuuucccagcucucaucuuuacuucugaugcccucuguucagguuuguuagucaggauuuaauuuuaaugccaguuuuuauggcuucucuccuccucagucagccuccacgugaucccaucaguguccccgcaucacgggaaacagagucccuguuucuucuuuguuuuguuugaagccuacacuguugccuuuguucauuugacuaccagagcauuuguuccuugucugaagaguauuucuaggucuuagccuauauuuuaacuugauuaaaugugcucaucuguuuugugauuauuuucuggugaccaugacaacacucggaagaaauggucuuuuaauucagcugcuaguauaagagauaaucuaggaaaaucaaaugaauaaaaauauaacaaauagcaugguuugagacuaucuuaucaauuuuagauuuuuaguuugggcuguaaggcuaacuugucuaaauauaaucaguuuaaaauaaauuuaaguuuuuugaaaauauuguuauacauaugaauugauuuuauucauguaccuuuuuuguuuguuuguuugcuugcuuguucucuugguuucuuuuuuuuuuuuuuuuuuuuuuuccugagacaggguuucucuguguagcccuggcuguuuugguacuagaucuauagagcagacuguccucacucuaagacaucagccugcgucuaccuccuaaaugcugggauagaggugugugccaccacugccuggaagauucauauaaguuuucacuuugacuagaaauuguuguuauuuuuucuauugugagugauauuucuacugaauuaggaggaggacauuauuuucuuuguguuccuuuuugauuaugucaaguuuuuguagauuuacugguuuuagauuuuaaauuuccaaauccuuagcuuuucucauuaagcaauuaguucacuagguuuaaagaaaccagugaggcugaaacccguuuauugucugugaauugucucaucucagcauagugcuuuaggaacucauaaaucagaaaauacugagggcugugcauguacagcugagccuucguccugacuguuuaucaguacagucgagcucuuauuccaugagaacuaacagcuugugcuguauauauggagugugcagugcauauuugguuucuaaagcauccagacauguaagcugccuuccccaugaacugauuuacaguguaccacuuucuucuugcuaaaguaacuucugcuuguucaugauauuauagggauuacuucacuuuuuuuaaugaaguaaaauaacuaaauauagcaacaguuuuacaucagcaaguuugccaucuuucauccgguugaccucuugauagcagguccaguugacuaguccuggugucccuuuguuccuguagcucuauuuauauugucucucacacuguguccuaggaagagaacauugaugaauagacaucuguaucuuucuuucuccaaggauguuacaaaacugaaugugacauuuauagaaauuuacucuaacaugaaaauauugaaauugauuaacaaguuauuuaaauacauuuauuuucuuuuuuugugugugagaaaaccauucauuugguuagcugaggggaagcaauuacaaacaggggcacgauuaaauggauuuucuuuuuaugucagcauaugaguuucuuuuaauuuucagauuuugcuaagaacuucccccauacuuuugauaaaguaacaucugauuugguuagaucuuuauuuuguauuuuacuucacauuuaucugagugcuuauugaacacuucuuuuucuaugacacauagguccacuaggcuguuucucaucguagcaucuuuccaugcagaugaugcugauaggugggaguggcaucuuggugguguggcacucacuguucaggaucuccguucucuccuuuguuguccguggucuucagcagauugcaguaugugaugccaggugccugccuuuguugagaggacaugcuguaccaguaucuaggagaaggcuuaaaacaggcucaugcuuugguggaaaugaguaaggcuagguacugggaagugagaguacacagagcuucagaugaauugggaucuuguagagguuaauuguauuagauauugguuauugugauagcuaugaaauuuuagaaaacuggcuggaguuucagcauuugauucaguuuccaaaagacaaagcaaguuuguuuaacugccugcauuagaguuucuauagucguaguaaaauaacuuuuaucuuaauguuuuauaaauuguauaaaauguguuacuuugcauucauuuauuuuaaaaaguaugucuguguuuaccauagagucacaauggcuucagccuuucgucuuucuuugaaaccaaaagucagugacaacaugacccauuuaaugguggacuucucucaggaaaggcagaugcugcaaacuuugaaguuuuugccagguaaaugcauuguuacaugggaacuuucaaauaaaaaaucuugca

SEQ ID NO: 1904 - RNA, 1639 nt, Mus musculus
guauugagugggagcugcucucgcacaagcauguacagcaaaggcagcaguuaacagcagugcgccccgugcagcagccaggccagggggagucagcacugcguguauggaugucugcuucauguaggcacucagaaauaggcucagacauuuuuaucagagauaagaugggaaaaaaacaucacauugggggggagggcaggauucuuacauucuuggugguguguguuuugggauuucuacugugcagcuccagagagacgggaacacucaaagcaaaagccuuccaugauuauagugcugcagcagcucccagccccaugcuaggaagcaugcccccaggagauggcaugccaauaggucccaugccaccaggguucuuuuagccuuuuaugucaucucaguaccuuggaggcccaaggcccccauugaggauaccuaaucaggcacuuggagguaucccaggaagucagccauuacaccccaguggaauggauccaucaugacaacaaggucauccaaauauggguggaccaaugcagagaaugacucccccaagagguacggugcccuuaggaccacagaacuauggaggugcaaugagacccccacugaaugcuuuagguggcucuggaaugccuggaaugaacauggguccagguggugguagaccuuggccaaacccaacaaaugccaauucaauacccuacugggaauuauguagguccuucaggagguggaggaccaccaggaacacccaucaugccuaguccagcauauucaacuaauucugaagauaacauguauacuuuaaugaaugcaguaccuccugggccuaacagaacuaauuuuccagugggcccuggaucagaugguggauuaggaggaauggagucccaucacaugaacggcucuucaggcucaggagauauggacaguauuuccaagaauucucccaauaaucugagccugaguaaccagccgggcacuccaagggaugaugaugaaauggggggggaaaugucuuaaauccuuuucagagugacaguuacucccccagcaugaccaugagugugugauccauugccgcgucucucaugaaaaccaucguaagucagcccaucacagaacuacuacggaagaaaacuacuugucguguacaguuagacaaaggaaucucagacaaccagacuaccuuuuaguuccugcucucuccccuauuuugagaauaaagcggguccaauugugauucaggcaacuguacagaguagcacauuagcauugcccccaacugaacugcgaugacuaucuguguguauguguggggaagagagugcgccguauaugcagaucuguaugcacauauacgcauacaugcauugacccacaggacauuguaagauaguaucacaugacaucuuaaguagaaguaaguaaggacuuuuaugccauccuuuucuucacguuuacacuuuaauuauuaaagguugcuccugcccuuccccaacuguuugugcuguguacaucacugcuuuauauaaguuguuuuuuaaggugaacucagauguuaugguuuuguaaaugucugcaaucauggauaggaauaaaauugcuuauuugaaaaaaaaccaaaaauaaa

SEQ ID NO: 1905 - RNA, 32497 nt, Mus musculus
ugcgccagagaaccugacagcuucuggaacaggcggaagcacagaggcgcugaggcagcacccugugugggccggggacagccggccaccuuccggaccagaggacaggugcccgcccggcuggggaggcggccuaagccacagcagcagcggucgccaucuugguccgagacccgccgaacuuaagaaauuagucugaacaggugagagggugcgccagagaaccugacagcuucuggaacaggcggaagcacagaggcgcugaggcagcacccugugugggccggggacagccggccaccuuccggaccagaggacaggugcccgcccggcuggggaggcgaccuaagccacagcagcagcggucgccaucuugguccgggacccgccgaacuuaggaaauuagucugaacaggugagagggugcgccagagaaccugacagccucuggaacaggcggaagcacagaggggcugaggcagcacccugugugggccggggacagccggccaccuuccggaccagaggacaggugcccgcccggcuggggaggcgaccuaagccacagcagcagcggucaccaucuugguccgggacccgccgaacuuaggaaauuagucugaacaggugagagggugcgccagagaaccugacagccucuggaacaggcagaagcacagaggggcugaggcagcacccugugugggccggggacagccggccaccuuccggaccagaggacaggugcccgcccggcuggggaggcgaccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccugcgugggccggggacagccggccaccuuccggaccagaggacaggugcccgcccggcuggggaggcgaccuaagccacagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcugugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuacccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagcggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacgaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaauacugaaguguggacacucugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaaaaaaaaagaaggaggaaaugaaaccuguucaaaacauuuuuuuaaaauggaagagugaagacaagaagaaacacaagagcuguaagacaaguagaaaacaggugaccaauuggcaauaguagauccuuccuaaucaauaauuaaauguaggggccagaggaaugaugcagcaguaaagagugcuuguucauuucucaaaggacuggauuugauuuuaugcauccucuaauaucccagcacacucuaucccugucuagggaaucugugcccuucauugaccucuguagauagguauugggguucucagcugguacugccccguucuccgggcuuugacagcuguuuguuguuacguugccauacagaauuuccaggaagaauagguucacuguuguuaaguucccucccacuccacguacucacaucccacgugguucuacugccacuugagauuuccaauauuuguuuuguucacuguuuuuccccuugguuauuuaucugcaaagaaaauuuuguuuccuuuggcuauguuucauuuuuauuauuuucuugucuugcuguauuuggauaagacuucuaguaaaaugcugacuugggaugaugauaaggaaaugucuucacccugguucugcagucuuaggguuagguauuguguuucucaccauuaaaugugauguuaacuccaggcuguuuugaaguuuuuuuuuuuccuuuuacuuaguuuuguguugauugauuguuugcuuuugagaauccucuagccucagacucccaaaagcugggguucaaggugugcaccauuaggugcauauaggucauggccagcuugggaaauauuuauuuuauuuauuuauuuauuauaugugugugagcguuuuuccugcauguguguaugugcaccaucuaugugccucaugccuacagaggccaaaagagagggugucagaugccugggacuggaguaacagacaacuguaagcuuccauguggagccugggaauagaacuaggaccucugcaagagcgguagcugcucuuaaccacugagccaucuuuucagcccauugaaaauauucuuuuuaaaguuaacuuuauuuuuuuaagaaauuaauuuagcuggucugugguggcacaugccuuuaaucccagcacuugggaggcaaaggcaggcagauuucugaguuugaggccagccuggucuacaaagugaguuccaggacagccagggcuauacagaaaaaaccugucucaaaaaaucgaaaaucaaaacaaacaaacaaaaauuuaucuuuuaaacuccauauuccauuccccgccccccuccaaccuuugacuguuccacaucccacaccuccuccucuacaccuccuccccccgucuccacguggauguccccauccccaccccaccugaccucuaaacucccuggggccuccagucucuugaggguuagaagcuucaucucugaaugaacagacccggaaguccucuacuguauguguguugggggccucauaucagcugguaugugcuguuuggugguccaguguuugagagaucuuggggguccagauuaauugagacugcuggucuuccuacaguguugcccuccuccuuagcuucuucuagcauuuccuuaauucagccacaggggucagcugcuucuguccacugguugggugcaaauaucugcaucugacucuuucagcuuauuguugggucuuucggagggcagucauaauaggucccuuuuggugagugcuccauagccucuguaauugugucaggccuugggaccuccccuugagcuagaucccacuuuggguuugucacuggaccuucuuuuccucaaucuccucuccauuuccaucucuguaauucuuucagacuggaaggaacaauuaugggucagagaugugacuguggaaugacaaccccaucccucacuugaugcccuauguacucacuaauagguggauauuagccaacccccccaaacaaaacaaaaccaaacaaaaagaaaauaaauuacagaauacccaagauacaguccacagaacucaaaaaaagucaauaagcugaagugcccaagugaggacaccucagucccaguugggagagagaagaaagcaaucacaaguggggagggagggaggggccugggagggaaaguggaugggaagagggaaguaaagggaagaggggacccugaucugguauugggagagggaaaaggacugaagccuugagggccagcggaaugaauggaaacaagcagccucaggaaauaggagguugaggugaccuuccagaaugcaggagagaccugggaggugagagacucucaggacucuaagggagggagcuuagauaaaguaaacuuucuuacuguuucugcuuugcuaaaaguucuugucaugauuuuuguaauauauuuucauuuauuguuauggucauaucuuuauuaauauuauugaauauauucaucaauuucaaauguugaucuagcuuuacaccccagaauuguuucuuuucuuuucuuuucuuuucuuuucuuuucuuuucuuuucuuuucuuuucuuuucuuuucuuuucuuuucuuuucuuuuuaaaauaaggacucaucauguagccuccucugccugugaaacucacugcagagcuggcucacuuuggucucauagagaucugacugcuucugcuucccaagugcuaggacugaaguaugcauggccauaagaggaguaaauauuuuuacauucccgauuaaacuuuauauauuuuauagauguaucuacauagcauaugcagagacucauacaguaagauucaucugagccacuuauccaguauugcaaagcuuugaaaucucuuuuauggaaaauaaauugauuuauacucauacauguuaauuguagcucauugaaucuguucauuuuaauguaucauaaagcucuagaaacacuuaaaaauucauaaguauuuuugggaaacaaggaaaucaguuuuguuuaguauguaaaauuguuuuuuaagguuuuugaaauuugauaaauuuauauauagucaaaucauaaagucaugaucaaauuauucaugaucacaucaucacccaaaacauuuaccauuuguguugggagcauuaaaaauauaacuauuuuaaaguauauaauaaauuauugccaacuauaaucauuuccuucugcuuuagaauaucagauuuaauuugauauauuuguaaccaauuguucucuuaucuucccacucccuauaaaccagaucuuuuuguuuuuguuguuguuuuuuuuguuuuguuuuuuguuuuuguuuguuuuuugagacaggguuucucuguauagcccuggcuguccuggaacuuacuuuguggaccaagcuggccucgaacucagaaacucaccugucucugccucccaagugcugggauuaaaggugugcaccaccacugccuggcuaaaccagaucuuaaaaauacacugaaaacaauuuuuacuuaauuuaauuauuauauuuaaaucuugucaauaccuauuuaauuuguaauaacauuuaaaauguaacaagccauucucaauuaucuuuagcaugauagauauuuggaauuuaccuguugccaucuaagauguuaauaaacccagaguguaugagaaagcguuggagugcaaacguuuauaaucuggcaauaugaggcuuugaaaaauaauuauuuugaauuccuagguuauccuuucucauaaccugacucccuuuugaauauuuaaaaagaaauagcagagguugagugccaaguauaauaaauguuugcuuaguuuuauaauaugugagaauugauagccccccucucuguuuuuuuccuucuuugcagucccaaaagcuccagagauugacccaguagaguguuugguagcugacaacucuguaacuguagcuuggagaaugccugaagaagauaauaaaaucgaccauuucauaauggaauacaggaaaacgaacuuugauggacucccacguguuaaggaugagcgauguugggaggugauugauaauaucaagggcacugaauauacauuaucagguaacacgacaccaucucaugaaucgaguccuuagaacguaaauugaaauaagaaaacaguuuguuauuuuaaaugauaaaauuaaguuuuaucaacaaaacugcuguuuuagauauguuaugugaaugaguuucuauuaaaauaucaguaaaacuuuuaauuacuuaauauuuacaaccuacuaacauaguguauguaaggcaaguguaaaaggaugcuguggaagcaauauuucagagcauucuuuuuuccuugcuuuucuuuguuguuguuguuguuuguuuguuuuuuuguuuguuuaggcagacucuuccacguagccccuggcuggccuggagcucacuaagcggcacaccaaucuugaccucugccuccagagugcuggaauuagggcaugugccaucaugcccagcuaaccuucauuuuaauuuuuccacuaaguaaagcaacuauuuauuuuuuagaucuacuuagaccuccacauuucagggguacuauaaccaccauuguuuucucuguguuaauugcuuagcuccacauuagcccagaauugggacuuugcuaagacuuuuuuggugucagccuacugaaugcuuuuuagaauguaucuuaguguauugaggucuuuugaugcuuuaaaccacaaaauauuagcagagcuuuucaguguguccugugcagcguggggugcguugugagcggucccgucuuguugagcacuaguuccuuuccuggagcaggcauucuguguaguggacaugaagugcaugcagcacaagagagucagucagcacagcacaugcacuuaaccccgaccggcuggaaauggcuguaaccguuacguuacagacagaaugguuggaaauggcuguaaccguuacguuacagacagaaugguuggaaauggcuguaaccguuacguuacagacagaaugguuggaaauggcuguaaucguuacuuuacagacagaaacagguccggcgaguuugaaagguuuauggcuagugaugggucaacugagacguuaguaucgguguaacugcacaagucauguuggucucugugccuuauuuccguucaucuuucauguaaaaugauauuucguauaaacauugcacugguugauucuagcugucagugugauauaagcuagagaagaaggagccucaguuuagggcgugccuccaugagcuccagcugugaggcaguuucucagugauaagugggggaggguccagcccaccauggguaguugcagcucugggcugaugguccuggauucugucaaggcaggcugagcaagccauggggagcaagccaauaagcagcaccccuccauggcaucugcaucaguucuugccuccagguuccugccccauuugaguuccugucccaacuuccuucagugaugaacagcaauguggaaguguaagcugaauaaacccuucccuccccaacuugcuguuugggcaugggguuuugccacaauaauaaaaauccugacuaagacaaacauacauuucauauacauauaaaaauuccuuagggguauuuauuuuucaaaaauauugaugaauaugcuuuguaaauugugaucucuuucuugaaugaaaugcuacagguuuugguuguuguugcugcuauugcugucuuuuguuauugguuuguugugauucauucuaucuaucuaucuaucuaucuaucuaucuaucuaucuauuuuguccuuuggugagagacucuugcuuuguaguucggguuaaauggaacuggugaucuuccuguguaugcuuuccaagggcuggcauuacaggugugugcaccacaccuagagugacgccaccucuacugaaaccugaagggugcugccuuauuagucaccagguugaauguugguaauuguguaaauuauguauuuucaagaaaauauuagguaagucauuauucuuauuuucaugcauuaccauucauuuaacauaaaucuguguucuucucaaguaaagggauuucuaagaaggaaaaaauauguuugauguacacucaaacuuuugggaaggaauccuuuuuaugacaaaaaacuuucauuuuauuucaggcuuaaaauuugauucaaaguauaugaauuuccgagugagagcaugcaacaaagcuguggcuggagacuacucugacccagugacccuagagaccagaggugagacccguagccguuaggacuucagcagcagacaaaacuuaucuucagaaaucauucgagacuuugucagagucauuuccugugggcuuggacuccuucccaccgccucccccuggccuuugcagugugagaaguguaaggcagggaggggaagcagggcuauggaagggagaauuuuccuuaggcucuucccuuacggaggugagaggacagcaugucggaguccuucucuccauuugugggucccagagauggaacucaggucagcgggccugguagcaggugccuuuccugcuaaaccaucucacuguucugagaugcugcaguugcauuuccuccgaggguuuaguucacauuuuagguuaguaaauacauaagcacugcccaaguuugucagagaauuaagaaucagcaacaaagaaguuccuuccaauucccccaaauguucuccugguuauuacugucucuauaguucauuaauaauuacauagcacucacaguuuuuuggucauggagaucaccuugagaggccagugguagauacuguuaucuguaauucgaaugaagacaggaaaguugaacagacuuguaucuguucuagaugaguaucagaaucuaguccgagguucuaggccagccuuuauuguagacuuccaacccaaguucuguucucugagaauugagauuuauaacugucaucucuuguaacacagaagcauuuuuagguauuuaccuauuugaaagucauucugcuagcuguccucccacuuacaaggcgguaauggucuguguuuacuucugaauuagaugugcauuguagucaauacuugaggcuugcaagcacuccgcugacuucuaguuuauuucucaugcauuuaaguagauacaaauucuagaauuugcuaugauccaggugauaacaaacauauaucagaguaagacugagcaaagcaagcacugaaacuugacccaggcccugugcauaguaggcacgugcuucagcauccaaggccugugagcuacugaugaacucagagugaugcugugguacaaaggccuagaaaaauucucauuugaaguaaucugaauuaguaaauaauuuuacuugagaauuauacauagcuuagugaagaaauguaauuacuuugaacuauuaucaaaccgagauauuaguuuuaaaaaauguuucuauuuucaaagccuugucagauuuccggcaggucaucuuuucgauguggcuagagccacuuuuggaccuugucaggaaagacugcauugcugucauuguucacccuaaggagcaucaggucuuugcguuguugcugucccuauuuguugucucuuuggugaacaagccugggcagcgcuguagauuuuaugaccguuaaguuagaaaauaaaugauuagcuauuguuucccagcacagcuacuccuuuagcgugucugaguguuacuaagcagacucuugauuggcccugggcuucagagagagagaauaagcugauucuggucuccaggauuucauggaaggaaccccugagguuagccuagaguaaaauauaacccaguaacagcaauucugaucaucagggagcuugagauaaaauuauuucucaggugacuaugggucguaaaauuucuggaauuauuuuguagcauugacaugacuauuaaugaagacauaggcacuguagaaaagguccagguuuuuaaaaagugaccauugaacaauuguuuacuaaguuauuuggcugguuccugcuauuuuugaccacccaguaccaaacaguaaacucacagagagcagagggaagaggcaguaaaaauuaaauaguucagauucauaacaauauaauacagcgagcauuguuuacuucugucccuuuaaucuauguagcauuauuucuucugguauaaaaauuguaaaagugaugaauaggauaaaucucaaguauauuuucccuuccuuuuugguaagauaaaugauguuacuaaauaacaacuuauuauuccaaccucaaaucauagugccuauaaugcagcuuuauacuauaagagacagggcuuauuuucaaggaagugagucauuucucagcuccugcucucuagucuuuuuugcuucuaguguuaucucugucaccuuaaagaaaaugugugacuuaacagaagccuaguaaagggauugugucuguuaaaagaaagagacuaaacauggcacacuuuuagaaaccaaugcccuuuugauuggauguuuugguauuuuguaaguuggcacacaaaugguuugagguggugccuuuuccugccaccaaaguggcuggcggcucuuaacuccauccuaaaaaauauuagggacagccuaggauucuucuuucuuuuggccuuaggguuuuaauaagcuaugggcaaauggugacacaaaagccaaguuuccuuuauuuccaaaguguaacugcucuaucuguaaagcuaauggcuggcaccuagaggauaccuguguuucuauaacacaguugauuguggaaaugucuaagugcaucucccuauuaaaaaauugugucuucauuuugcugaaaagcugcagucuuccucuguuuacuucugcuuggaugcagcuuuugaaagugauugacuuccuuguguagugugacauuuagcagagcugugcagucaguagauuuuuauucagauguuuuauaagugagacaauggacaauggcugugaugcauguuggaacugaaggauucuuuccagaaucaagggugagaggaugcuccauccacuggacccuaugugcuucucuuguuugaugaugaauaguucacaggcuuacaaaugucuuagcuaauuuuaaauaauauccuuaagcaaaguaguauacuguaaagggguauuucuuuuaaucuacaauuaccaaaaauuugaacuuuuagcaagagauguagcaggaacaaauuaacuuguaacuaagaacgugacaccuuguaaaguaguuugggaauugcguuacaaaauagaagaaacagcauuguacugcuguuaagucacuguuuuaaugauuuauuuucucaguuucuagauagggaagcuaauagcauauuucacuaauuuccucauuuauuacuucuaaggauuuuaaacaguuucagucuuagaguuucauuguugugaagagacacacaaccaagacaacuuuuauaaggaacaacaguuaauugggacuggcuuacagucucagaguucaguccauuauuauuaugguggaaagcauggcaguacccaggcaggcaugguguuggcgaaggaacugagaguucuacaucuugauccaaaggcaggcagaagaagacugacugucucacacuaggcagagcuuaagcauauauauuaccucagagcccugucuccacagugacauacucucaacaaggccacacuuccuccaauaaggcugcaccuccuaauagugucacuucccaugggccaagcauauucaaaccacuacaauauaauucccuaaaacaugaaauaaucugaaaaguauagguuguuucauauuuuguuuucuugccuuauuuucauuaaguagauucuuuuuucuucuacuguguggucaaacaaguuaucugucauccaguucaguuccuuugcuugaguuaccagggcuccaauauacccaugcauccagugauggcauggcgugcaguguaucauuggaacuaaugagaguuuaagugugaauguguuaauaguaaagcuucagagagaauacuugugcuguuuuuacguuaucaucuuuuauacuauauugcuuuuucuuccuccauaauucuacuaguuccuuccauuuagucaaaacaaucaaccaagaaccaaacugguaauuguaauaccaugaaauucugauuauugugugcuaguggaacgcucaguaucauuagagacacuauuggcacuugaaguucacuguacuugguuaguguauaguauguguagagaaaaaauaguuggauaggugggauuuauaaacuacaaccaaagauugagagguuuuugugcaagggcuagggauuggaacuuuuuucucuucgcacagaguuggcucacuugaauaagaaauaacaugacagguguguuucagacaguggagaugucuuacauuuguuacauguugucuugggcagcacuuaacuucagucuagauaacucaucaucccauuugaauuugaaaguugaagauuccuguguagaaugggaccccacuggaggaaaaggccaagaaaguaaaaucaaagggaaggagaacaagggcagguaagucggcucacuaaaucccuguugugaccaaacacuugcacauugaucgucuccaaccauaacugacacuaaccgucuuucuuacuuuauagacagguguuuguaugcuaauucuuauuugucaguaauuuaacauuuuuaaaguuuauucugcgugauaauaugauuucugauauguuaguaacucagaggugaagaauauaguaucaucugucaauacuugaauuuguguuuaacguuuuuuauauuuuccuuuauuucuuucauaauuguuucauauuuuauuucagcauucugauuuuuaauguuauagauacaccagucugaacuaguuaaagaaaaguuucuugacaucugucuaggcuuauaggucaucugucuuaccugaaagauggcugcacuaaaugacagcuuugagcguuucuacccaagccuuccugcugagagcaauccagugaacucaauccugagaaccucuuguuuuugucagaccuuuccuagauguaucagaauaugaaaaccauaaguuuuuagugguaaaguuuugcucagacugguggcaaaugucugugaguuaugacagugaagcagagccccucaggaagcauucaggcuaguucuguuguaagauguuacauagaagcuauaaaggagugucuuaacaguugccuguuuuuaucugacaguguccauguuacuucacugaagaaacacacaaggugacgaucugugucugucuaguucuaggacuuaguaucuggcuuggcugaauaauucuuuaaccaauaagcaggugccauugcucagcccuuauaaguuaaaacgcuccuuuguguagacugucucuauugguagcuuguguuuugaauuuacagcauuguaguguacugcauucuuuugaguuauauaugauaacaacaugugcucugcuuuaaaaagacuguuucucaucuguuuuuacccugcuuucacuuauacuuggcaucuuucucguuucucuuuauucaguaacguuauugauugcuuuuauaucuauuugauaggagguagacauggaguguuguauaauaguuauguaauuucaaaagugucaaaaauaaugaacaucauugauaaaaugauuuaaacagugccaaacauagggaucauuccagguugcucaaguaagaugauacuuaggugaagauaaucaugucuuuaccagguaccagccugcgcgcucuuuucagagcucuuuucuuuuuggcuuauuuacuugguauuggugaaagugacuguauguguuauaagaugcuauugaacuugauagacugcauaauguuuuauuuggcagcuagaaaaguuguaaguggaauuuagcauuuaaacuguguuaugucuuucuuuccuuuuaagauuauugcauauguugguuguuuauggaauaaguaucccuuaucugaaacacucaagauucaaaauuauuuugauuuugaaauauuuucacauauauauuguacauauauaaaguugagacucaacucuaaacucaaaauuauuuguuucauguguaccuuauauuaauagccugaaaguaauuuuguaaauuuuuuaguauacuaguguuuugacugucacuugcuacaggucagguauagaauuuucuauucauaacauuuaucagugcucagaguuuucaguauugaaauacuucagauuuuugaguagggcuuuaucauuuucauaaguauuuguuguagaacguaugauagauauuauggggcuuauagaaauaaacacugcccuugcuuucaauaaucuuggucuaagucauauagaugagcuauguacacaugagacaaugauacaagauggcgauuauguauagugaugaacuagaagaaagauguucagagcugccagauguugagguggucaguuagaacuaugugccaaauuacuguaacgggcaagucuuuacugacuugcugugcuaguauaaggaagaggucacccagugaagggugcucacucacggugugguccauuuuccccaguugaauggcaucagaugaaagucaggugaguuaagacacaucauaggcagaggagcucauuggcagaaagccccaaacaggugguuugaguuggcuuuugcaguagagugcuaaagguguaaggaguaagcaaagaucaaaagaggaaagagcaccaaaacaggugacaaaaacuggcuccuuaguacacacaccuuuaaaaaccucucugcauggugcuucucuuccauaagaacagucucuaagucagugcuuuccaaccuuccuaaugccgugacccuuuaauacaguuccucguuuugugcugacuccaaccauaaaauuauuuuuaucacuacuucauaacuguaauuuugcuacuguuaugaaucauaauguaagcaucuguguuuuccaguggucuuaggugaccccuguagaaaggacauuugacccccaaaggggucucaacccacagguugacaucuaaguguacaguaaauaaagcugaguagcccaagcauaauaugauugguacugagccugcuuagauaaucccucuagaaagugcugaggcacuugcuaugcacaugugguacgggcaggguacccacagugcugccugacaccaaggcuccccacuccugccuccuggaggccugccugguaaaguuaggauagcauauaugugucuaaguagccuuaucaccaaaaggcuaacgugcagauuggacuaaagcauaagcucguagcaauaagaaaaaugauuauuuuaucuuacaauagugaacauuugaaaagcggguaaaacaauuugcucuaugggcuacacaaauacuuaauccagcuaggucaccaagggcccuuuaaaauggguagaggagcccauucuguacacaacaugaugucugcuuacaaagaguggacugcagaggugggaggcugggcacuaaagagaaggcuuucucucacuuaaccuaauucugcagcuaaacugccaaccucagcaguuaucucuuuucuguuuuucaugcuuccuuguauuucuuuaccucugguaagucaaaauuuaauuuuaauuuuguuucuuugggauuuuagaugagcccuuuaauauguuuuugaagcaaggcucagugaaucauuucugcauguuucuauguauuauuacccucuaucuguuuauucuuccuaaguaacugguguauaguuuucagaaugaguuucuucuucccaguggacuguuggaccuaccaguggaggaaugaauggacuguggcuauuuuaggaagauguccuguuugguucugauucuauugugucuucuuuguugauaucgauacuuuguuacaaaaauccuaaagaccguauuuuuuugccaauuuuaagacucuaagaguauaguuaguucuuuaccacuaauaccauauuuuagugaagauacuguauaucucuugugugcugaggacacaggcaugagaugugguucuuguucacaauuacuuucuuccccuaagauacuacuucauagagaggcccuccaccuaccauauuaaccacguauugaaggcaccacauauuaggcuguaucugaguuaucuuuuuauuaucauuuuuuaguaugucugugguaagggaaucauuuacuuaacuucuucaguggcuucuuguuuuuuuuuuuucaacuuaaugcuaaguuuauugaguugaguuguaauccuuuuuuaaguugaaaaacaucuauguauucaauagaauagucuugacuuuccuuuuuuauuagauauuuucuuuauuuacauuucaaauguuaucccuuuucuaguuuccccucugaaaauccccuauucucucccccuccuccugcuccccaauccacccacuccugcuuccuggcccuggcauuccccuauacuggggcauagaaccuucacagaaccaagagccucuccucccauugaugaccuacuaggccauccucugcuauauaugcagcuagagccaugagucccaccauguguuuucuuugauuggugguuuaguuccagggagcucuggguguacugguuaguucauauuguuguuccuccuaugggcugcaaaccccuucagcuccuuggguccuuucucuagcuccuccauugguggcuucuuguuuugcccuucugugccacuaugauaauauguguuuuaggaguucuucaaaugggccugggguauacagcucaguggcagugcuuccguaauguguccacaucccugaucccaccaccagcaucggaacagcaggaaaccacacacugcccagccuuuguaauugugccuaccucaugguguccuggcuuagugguuuucacucuugcucacacuugguuacacauuuacucuuucucaucuccuuucacugaucauugaucuguuacucacaagauguuuuuuacauucuuugguccaucucucgcuaagaaacaaucccagccaugacugguaagcaugccagucuucccaagagcccuggggauccucagaguucaguucuguguagugaagggcuacuguccuaaaguacagaguccaagccgucucuaguuccaaauguauuuucuacaaauacacuuaggauuaguuaaaauuauguuuauuauauguaaauauaaauacauaagacuuaauuaacuugcaaagaggaaggcuaauguacagcaacauuuuggugacugaguuagguacucugaugagcucuccugagugcagucauuuuuuucugguggagaggcacauuucagauaugagcuucaaaugaguguccagggaauacucaucaaucacacagaaaucuuauauuguauagauguuucagagauuuaaacuuuuuuguuaaaaucuauaagccauguuaggccagucuuauuuuuuauuuuuaauccuguuucuuuuuuggcuucccugauguugcaccuaaaacagggcuuucuacacuucucaaguaacagaauggcuuccucaaaugaaauauacccagaaggcuaaucuaaaaagagaaaaaagacagguggcugaaauaaggagcccuggagcuggccucaucccagaguuccacagcagucuguggcauuguggguagccuggaguucagggcaugucuugaaaacugccaccccaagcugcuuuguccuucccaccacagaacaguggggauuggggcgugggggucuuucuccugucuguccucccucccucccucccuuccuccuucccaccuucucucccucccuuucauccauccaucugucugcuuuuucuauuuuuagaaaaauacaguguugucuuucccuuuuaguuuagaaaacacagaguauuuguaaucaggcuguuaacauaaaaagaaucagaaagaaaguagugauguagguuuuuuucuuuuugagcugccguauuugacagucuuuauacaauuucaguucuuacugcuuugugauucuugugcugcaugauaaggaccagcuuagaaaauuuggucaagcugaaauuuuuuauauacuaauuuguuuccuaauuuuauuugguaauuuauuaucuaauacaauuuuuaagcuucuuaaagaacuuaaaaauacauuucuucaaaauuuguuuuuucaguuucacuuuuccccccagcauuuugaagcagagacucugucugcagcucauucuagcuuuaaaccugcuccuagccuguccucaaacguguaguccuccugccucacgcccuugagugcugaagcuacugccauguguacccagggauuuauugccuugugucuucuguucugggcggcuucucagaagcacuuguagguauuuuuuucucccacucaguucuuuuuugcucuuucugacccaaccugugccccugauuuucacagaaaauuucaguugccagcccacacugacgucgguucauacucuuggaauacacauaaugcauaauuuauuuuaaaaugaccuuuuggguuuuuuuuucuaagacaugguuucucaguauagcccucgcuacccuggaacucacucuguagaccagaccaggcuggccuuugaaaaaggaugcuuuuuaaagaaaagaauauucuuuauuauucugacaugucaagugaucacuguuaauaguauuccacauaaaggacauuugaucuccuuuaggaaggauuaaacuaaaccaugcagauuuaauguucuauguaaucauguuacuuaauagcauucacuaagauguagauacuugaagcaguccaguuuaauuauuugaaacuaucuguucuuaacaacaagauaacauuuaaaugaagucauuggaucacaugaaaugacuguaacuaucuuuaugcuuguuuucuguuuauaaaggauuugaauauuaauuuuauuugguaauuuacuuucuacuacauuuuuucuuugggaagaaaaauccuaguacaacuauauuggaaaauuuaaauacuuauuauggugauaauaaaguauuucuauuuuuucuaaauaacauguagaaucucucaguaucucccuacuuugugugucacacaucauccaccuuguauuuugagacuagaucuuguguccacuugcccagggcuggguaacaagcgcucauccgucuccauggcuuuuuuaugugcauucuagggacugauguucaguucuuaugcuugcacacgaagcacuuuacccuugagcuguaucuacaccccaacuucaggaugaucuuaaccaaaaaagcaaauguuuuucaagugcaaauucaguauaaucaaagcacacuuucaaaaacaucuugggggaaaagcacaccauggaacuugagcacugucgugauagguccaguggacacauuuuggagauuucaucuuuuugagguuuuugaauuagugaugagucuaguguguccauuuugcuugucauauuauuugauaugaagggaucuuauucacugcaauaguggacauucuuugagauuugauauucuaaugcauaaauucagauaacuuccucuuuuuaagaaggaaagaucagagcuaauaaaaaggcuacuuaguugugguuauguaaggaaccuaguuugccauugcuuuuauuuaaauucaguuauaaaauacaagcaauaguccaagaucuuucuuaauuuuucccaucagcaagauuugucuuauuuugauguuuuauuuuauuucaguugugugcucuuuguauaaguguugcucagucugcaugacauuaguguuuucagccugcuuuguguggauggcuucuuacauauaagugcuaauaauugauaacucagaucaaaugaaauguugcaacauaaugagaaguauuuucaaagauuucugcuaugauuuguaauucuaauuuaugaaucauuuucaacauaauuuuuuuauuucugauuuuuuuuuuuuuuuuuagaagugguacuccauccccaaaacggacgucuguaggcuccaggccaccagcaguaagaggcagcagagaccguuuuacuggggagucauacacagugcuagguaggauaaagcauaauaguucucagauuaaaggccacagagcacacuggugggcuuccugcucgcaucuggaaggccugccuguagagugaugagucucuauggaaguuucuguacacugagacugaguuucaggcugacuugcugauucuuuaagucucugcuucagcucaugaaguaugccucaugaauauaacccuugaggggauucuaacaaagaaaggcuuucaaguauuuuauaugcauggaaacauaagcaauacguguaaauuuauaggauauguacucugcacucagcaucuguugaugaugugguuauuuucacagaaagaguaggugaauuuuguggguauggugggauaagccuguaggcccaguacguggaggcugagguggaagggucaugagccuguggcuagucugcgauacguagguugguuguuguuggagaucauaugauaaauaaacaucugugacucauaaguaggacaaaaugucaaaacuuuuuucguaucuuuuauaggagacacugcuauugaaaauggacaacauuauugggaaguaaaggcccagaaggauuguaaauccuauaguguggguguagcauauaaaacuuuaggaaaauuugaucaguuaggaaagacaaauacuaguuggugcguucacgucaacagcugguuacagaacacauuugcagccaagcauaauaauaaggugaaagcuuuggauguuccuguuccugagaaaauagguguguuuugugacuuugauggggguaaguguacuuauuuuucuaaaaaaaaaaauucucuauacuugcuuguauuuaaauauauuuuauguauacaaaauaauauuuuuacuucugugaaaauauaugggaauauugccuuuuucucuuccuauuugaugguaguugauuuuuuaggaacagcuuauagagaaaaugagaaacuggacaaagcagguauauuuagaauaguugaaaaacagacaaaugauaucaacacagauaggauacagaugaagaagagagccaucgagggccugcagaaggacagcaggcguuaggcugaacaguuagcaagugaguuguaaggacaagacgcuucugagagagacggugaagcgggcggacuucaaagcuggcagagcugaagcaguggacacugcccugggagcuuaguggaguggauaugggcuuaagcagguagaggacagauggaguaaauuuuaaaagcuaauagaauuuggcacagucguaaaaaggaagaacacuuggcgucuagugagcuaauaaagccuuuuguuugacgaugacgguguaagaagaagaauguuacugggugggugcaaugggaauucauuuucuggacuacgcauuuuaaaucauuauacauugaauacauuuuugcuaaucuaaauaggaaccauuaaaaucaauaacuuuugccaauaagaaguguuuguuuauucauguaguaugaaaaucugcacuucagggauuugaguaucuucauccugccaauugaagaauugcuucuauugcaaaaaguucucuagguucuugaacaaguacuagugagauguugaagcauuagcuguuugauguaagaucaagcaguguugccaagaauucccuuucacuuaaucagugucaguuucaggcacuguagucuuuaaugcaucucauggguuugcuaagcaugauucucagguguagugguuuugcuggacucaucagacccgcagcagacuggcaagcaguaaccaugagaggagcacacaugcaugcacaugcuuuagcucuuaugagcagcuuugguuuggccauaagcaaauugucaucaauugccaugugcacuccaguuuucuucagcugucaccaucagaaugagaaaugguuguuuacacagaauaagggaagacugcaguucaaaaugacuuuguuuccauuuuaggucagcuuaaguggcacccacuuaccaagucuuuccacuuuucacuugcuucaaaugcacaccaccaucgaaugcccauguugaggugcucugcaucucaacagcauugcucaucuucaaggcccuuucuucugcacaauuucuugcccaaccgcggucugcaaguccacuggcaguucccagaccagaugcauuauugaugagggcuguagcugcugcuuccaaccaguuugaacuugcaugagaaccuaguuugcuuuuugucuaacauuaacauaguauaaaauaaauauuaaacaaauagcaaauauuguuaguagcaaaaaauaacagaagaaaugugaauuaaagugguauauaacauaaucauaauuauuuuaagaauguauucuaaaaaugacaaauuucaacaguguacaaaccacaauuacuucugcaccaacuuaauagauuauggagauauuaguaagguuuugaugaccaggaaaaaaacaaauuuaagauuuuuauccuugcugggcaugguggcgcacgccuuuaaucccagcacuugggaggcagaggcaggcagauuucugaguucaaggccagccuggucuacagacuaaguuccaggacagacagggcuacacagagaaacccugucucgaaaaacaaaacacaagacaaaaaaacaaaaagauuuuauccguaauauguuuugauauuuuuauaagaacuguuaaguaugguucauauaguuuauaacaaaaauuaauguuaaaauaugucuuuuggcaugcucaucuguuuaacuuagauguuuuaacuuugaauaauaaauuagacuuuuuuaucauuuuaggucagcuuucauuuuaugaugcacacucaaagcaguugcuguauuccuucaagacaaaauuuacucagccaguaguaccugguuucaugguuaguaucuuguuucuauguaacggcuccgcaguuuugaggauaaccugugcuauacguuuugaugaagcucaguucguacucccuuugugcacaucuccuuuccccagccugcccuuuccagacgugauauuuuuuucuguauguuuucaguaugcuuuauuaaagucaguacuaacauuagaagggacagaaaucacaaugaauauuuacauuuacuuauaauuguaacuauuacucaagcaaggagugcagcccaugcccuguacccguguccauucccaggcggcucuucuggaaggguuagcccuugucuuggacuuuaaugcugccaauccauuuagccuccuguucugcuuuagggaguuguacaauaucuuuuuuggcucuaccauacguguguaagguuuuuccauggucugcauaguuuuaguuuauuuagauucacaucguuuuccaggcuaugaugcaucagucuauugagugccaguuagguugaguauucuauguggugucuuccauuugaggguaugacacacaugcaugacuucaggacugcucaguugcaugcugaucuauuaguauuucuucacaugaaaugaaacaugucuuuaacuuuguaauaaaauguuauuguugcuucuaccaccaugccuaucugcuuuucuugguuaaaauuagguugauguagggaauucugagauccauuaauggcuuccuugguuugaauaaaacuuuucuaagugugugggaaggggggcuaccucucuagucuggaugguacauuucguggggucuuccacaugcguucucuuccaucuuuacugcaggcguagcccuccaucugagaagaaaguguucaggguguguguggauuuagaauguguauucacuuuuaaaacucacaaucagaauuuuauuccugacaccuuaaagucuuaggcuuaaaguaauccuccuaggcagugcucuccauauuucauuaaaacauaaggcgauuaaugaacaaaauugaugcucauagaaaauucuuagagauaguuguuucuuuuucacuuucugaacuuggccacagaccucuacuuuaauacguauuuugggcuguuucccaaugaauccguugaagacaaauuguuuacucaguuauauauaacucagagcuauacuuuuacaaaauauuuuuaauuuggcuuuaucuuacauagauauuuauugaguuuuccauuuuucauuucaaauaauuauaauuaugcaauaauauagauaacuugaggaaacuguuuuaaacguauuaaaccuguuuucuucccuucuuugggaaccuaguuuuauuaacucagugauggauguuguuuauacaugauguuaauuuuuaaaguuagguuuauuaaguuauaacuuacauaugcuacuguauauguaugaguuuugcuuggugcauacagauguauaaccacuaccauaaaucaugauuuggaucaguuggcacuguagggaguuccggcuuucucccauguaguaggccuaccccaucacaacaucccaaacaauaaguaaaacacuuucccuuccugugcuuuggccuguugaggcuguccuguagauggagguguguagcagaaucuucccuguucaaucacuuuaaauauugauacaacaagaagccugugguuggacagggaaaagggaggcagagcuaagaguuucugagauggggacaggggagaaggaaggacaagggacccagguuccgugugucuuuaaauagccacaggugguuaggguucuuacaggggcggaugaucacaggacaguuugucuaaccuaggugggcaauuuauaucauuaucaguuggcucugaaauuauuguuugggcacccugagaauaagaauuuauugauauagagaucugacugauuaauuuuaaguuucuagaguuuugauuuacuggguuaaggggaauugugaccaccgaccacaggggguggauggcugagaagggaagacugccagcuggggcuagccaauagguggugaagccccugggcagagaguagcugggugaagcgcgggaacuuggugucuuuuuuuacuauuucccugcaacagaggugaauggcauacagucuuugaugccgcagcagagcauaugugaauguuggucucacugcccuguaugccagucaggcuucuugccuacugaguagucugucguguuugugugugcuguggauuguagccaggaccugcacaugcugagcgagcacuccaacccgagcuuauuuucuaccccacauuauuuugagacaagaucucuuugucugguugcaggagaugucugguucagguuccauaucucccuuacuaggggucuuagcuagggucauccucauagauuccuggcgguuucuacuacccuaauucuaccugguccccaaaaugucccacaacuccaguugucucucaguaaucucucccuccaucuuccccaaccugauuccucuuguuccuguccccacuugcccaagucuaccugagauaucuauucuguuucccuuuccaggaagguuuaugcauucccccuugagucccgcuuguuacuuagccucucuggguuugugguuuauauaugguuauccuuuacagcuacuauccauuuauaagugaguacauaccauguuugucuuucugggucuggguuaccucacucaggaugguuuucuucuaguuccauccauuugccugcaaauuucaugaugucauuuuuggggguuuuguuuguuuuuugguuuuuugggacaggguuucucuguguagcccuggcuguccuggagcucacuuuguagaccaggcuuuccuugaacucaggaaucuaccugucucugccucccaagugcugguauuaaaggcgugcgcccccacugcccagcaugauucauuuuuuuuaacagcuaagucacaaauacuccguuauauaagugaaccacauuuucuuuauccauucuuaaguuaggggacaucuaaguuguuuccaguuucugccuauuaugaauaaaggugcuaugaacauaguugaacaagugucuuugugggaugguggagcaucuuuuggguauaugcccagaagugguauagcugggucuugagauagauugaugccaauuuuucugagaccaccauauugauuuccaaaguggcuguguaaguuuaugcuuccaacaacaguggaggaguauuauccuugcuccacaucccagccagcaugugcugucacuugcauuuuugaucuuaggcuucugacagguguaguggaaucucggagaaguuuuaauuugcguaucccugauggcuauggauguugaacauuuaagugcuucuugucuauuugagaguccucuacugagaauccuguuuaaaucuguaccccauuuuuaauaggauuauuugguuuguugaugucuaauuuuuugagcucuuuauauauuuuggaaacuagcccucuaucagauguggaguuguugaaaaucuuuuuccaguuuguaggccgccauuuuguucuaaugauggggccuuugcuuuacagacgguucucaucucaugggguccuauuuauuaauugagaucuuaggacaugagugauugguguucuguucagggcaagugucucaaaggaucauauguccugucuaaagcuaugucucaauauuaacgucauaaaugugauauaagcuucuuagggguacaguccccugguuauaaacauuagggaaguaccaauacucaguauugcuugcugagguuaaucugcuuuguucuccugaguuuccgcugcccuguguucccuuuccugggcacagauucgguggcuucuacgacacagccagccuuuggccgcugugagccuuuucaucucuccucagcucgagcacgaagcuuaucaguuugggauuuguugauguucaucccugugacauuuugccuuucaaauggaaaguuaaggauuacuggaguuauaauuggauuugaguuuaacugagacuuuguuuuuugucuucucuuagguguggugugguggacuuucuuugaguacuggaaugcagguuccaagugcugugagaacacuucagaaaagugaaaacggaaugacugguucaacuagcagccugaacaaugucacucaguaauggcaacucagacuguuucccuucccuuugacuguguggccuuucccacacaguuacuaacagauauuucugagugguggaaucagguuuucuauguucugcuuuaaagccuggagucuguuagauuaacuaccaaauaggaagcagccauggagguuauugccugcgucccagaaucaagcaguuggggugcaggaggcugacauagugauauugaguagugauuag

SEQ ID NO: 1906 - RNA, 8257 nt, Mus musculus
uggucgaauccacugucuccuguugugugagauacguuucgacccggagcuccgccauuaaaaaaccucuuguuguuacaucaagguguuguguucuauucgcgauucuugggugcacgccgaaucgggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuuucaguucugagauuguggguuugagccccaccuguguuaccaguucugguauucuguauucuggcagcugccacugcggaccguaaggacccuaguggcugugggaagacgacggucuauuuccccacaggcugcacccuuggaagacauuccgagggagacccuggagugcccgggguacggaacagucaggaggaccuggcuguugccuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuggacggacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaaggaccagggucgcauccagaccaacaaccguacaucaugguaugggaggacuuggcacgcuacccacccccguggguucgcccauuccucccgccucucugcccuggcaccaagauucuagccauccgagaaaauggugagaaagagaaaccgaaaccaccgcucgggagagaugaugaucgcagcacaccagugacgaaaccccccaagaucuauccagagauugaagaacccccugaguggcccgauaccccucaacccccaccguaugcuccccagccccaaccuucagcucccucgggaccccugccucaggccccggccggaggagggggucccuccacaggaacaaggagccggcgaggagucaccccugaggggccugcagauucaacuguggcgcucccccucagggcuauuggggcucccccugccgauccaaauagucuacagccccuacaguauuggccuuuuuccucuucugaccuuuacaacuggaaagcucaucaccccccuuuuucagaaaacccugcaggacucacuggguugguugaaucauuaauguauucacaccagccgaccugggaugacugccagcagcuucugcagacucuauucacaaccgaggagagagagaggauucuccucgaggcucggaaaaacguccgagaugaggcugggcgcccuguccaaacuccagcugagauagaugaaggauuuccgcuaacccggccccgaugggauuauaauacggcaucagguagggaacgacuguccaauuaucgccggguccuaguggcgggucucagaggugcugcccggcagcccacgaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguuagagaggcagagaaaguguaucauaggagagaaacagaagaugaaaaguuagagagagagaaaagagagaaaagagaagaggaggauaggagagacaggaggcaagaaaagguuuugacuaggauccuggccgcaguaggagaaagagauaauggaagaagagguagacagucagggaaccugggagacaaaaggcagcagggaccaaggagacccagagaaggcgggcagcgccuggagaggaaccaaugcgcguauugcaaggaaaugggccacuggaagagcgacuguccgaaaaaaaaacaagagguaaaggugcuuucucuuggagaagaugaagacuagggggaacggggcucggccccccuccccgagccuaggguaacuuuagaaguggaggggaccccuguggacuuucuaguugacacgggagccgaauuuucaguacucaaaacaccucuaggaaaaguaaagaaaaaugaaaaaaccuuggugaucggggccacgggacaaaaaucguauccauggaccacaucccgaguaguagacauagggcgaaaucgaguaacucauucguuucuagucauuccagaguguccuaugccuuuauuggggagagacuuacuaaccaaguuaaaagcacaaauaacuuucaccucucaucgaccggagguuuucuggggaauaaaagcgccccagacucuagagcugucuuuacaacuaggggaggaauaucgacuuuaccaaaauaaaguaaagcccccugagggauuacaggacugguugaaucaauacccucaggcgugggcagagacgggaggaguggggauggcaaaacuggucccccccguggugauugaacuuaaguccggggccaccccuauagggguccgacaauaucccaugagcagagaagcucaagaggguauacgcccccaaauuaacaaacugcuccaacaagggauuuuggucccaugcaaauccccuuggaacacuccucuacuuccaguaaaaaaaccagggaccagggacuuccguccaguacaggaccuuagagaagucaacaagagaguucaggacauacaccccacggugccaaauccuuauaaccuccucagcaccuugccaccuggucgaacaugguacacaguccuggaucucaaagaugcuuuuuucuguuugagguuacaccccaacagccagcccuuguucgcuuucgaauggcgagacuccgagaguggacaagccggacagcucacaugaacgaggcugccucagggauucaagaacucgcccacuuuguucgaugaagcccuacaccgagaucuugcucuuuuccgagccaauaacccacaggugacucuucugcaauauguagaugaucugcuccuagcugcagaaacacgcgaggacugugaaauugggacccaaaaccuccugggcgaguuagguaagcugggguaucgggccucugcuaaaaaggcucaguuaugccagauagaagugaccuaccuaggauaugucuugagagauggacaacgguggcucacagaagccagaaaacaagcuguuaugcagaucccggccccaaccacugcucgccagguaagagaguuccuggggaccgccggguuuugcagacucuggauucccggauuugccacacuggcagcucccuuguauccacuaaccaaagagaaaggggaauucaccuggaccagagaacaucagcuagccuuugaaacucucaaaaaggcacugcugcaggcuccagcauuggcccugccagauuuaaacaaaccuuucacccuauacauugaugaaagaaauggaguggcaaggggaguccuuacccagguuuugggaccauggaagcgcccgguagccuacuuaucaaagaaacuggacgcuguggccaguggauggcccuccugccugcgagcgauagcagccacggcugugcuaguaaaagaugcugacaaacugacuaugggccagaauguuacuauaguggccccacacucucuugagagcaucaucaggcaaccaccggaccgcuggaugaccaacgcccgaaugacgcacuaccagagccuauugcugacagagcgaguaaguuuugcacccccagccauucucaaccccgccuccuuacuaccugaggcugacgaggccccugcacauaagugugaagaaauacuggcagaagagacuggaauccggccagaccucacagaccaaccuuggccaggggcgaugacuugguucacggacggaagcagcuuugugguagaagguaagcggaaggcuggggcggcaguaguggauggaaaggcugucauaugggccagcagucugccggaggguacaucagcucaaaaagcggaacuaaucgcauuaauucaagccuuaaggcuggcagaaggaagggcucuuaaugucuauaccgacagccgguacgcuuuugccacggcucauguacacggagcaauauaccgacaccguggacugcugacgucugccggcaaagauaucaaaaauaaagaagaaauucucagcuuauuagaagcuguucauuugccccguaggguggcaauuauccauugcccaggacaccagaagggaacugggcccguugaaaagggaaaucaaauggcagaccaagaagcuaaaaaagcagcccaagggccaaugacucugguggugagaacccaacagcccgcugcugaggaaauaaauaaaagaacccucacagaagaagaggggcgagauuacuuagcuaacauacaccaucugacucauuuaggaacuaaaaaauuacuaaaauugguuaguaagucccccuauuacauuccuggauuaaaaggaauuguggaagagauaguaaaaaacugccgugcuugugcacuuaccaacgcugggucuagcaggcuccaggaaggaaaacgacugcgaggagacagaccuggagccuacugggaaacugacuucacugaggugaaaccggcuagguauggaaauaaauaucuccuaguuuuuauagacaccuuuucaggaugggucgaagcguuccccaccaagaaagaaacggcuaauguaguggucaagaagauacuugaagaaauccuuccccgcuucgggauaccuaagguaauggggucagacaacggaccugccuucgucucccagguaagucagggauuggccagacaacuggggacaaauuggaaauuacauugugcauacagaccccagaguucaggacagguagaaaggaugaacagaacgcuaaaggagacucugacuaaaauagccuuagaauccggcggaagcgauuggacagccguucucccuuaugccuuguucaggguucggaauacaccuggaccccuuggccuaacuccauuugaauuaauguauggggcgcccccacccauuuuuaugaccguaggggauaagaaucgcccggaugugucuuucucuccuucuucuagucuuuuggcucgauuaaaagcucucgaaauaguaagaaaagaggucugggaacagcuaaaagaaaccuauguugcuggugacacacaggugccgcaucaguuugaaguaggagacgcaguccuggugaggagacaccgagcgggaaaccuagaaccgagguggaagggacccuacuuggugcuacugacaaugcccaccgcggucaaaguggaaggaauccccacuuggguccacgcaucccacguuaagagagcacccccuggagucagccaugaugaguggacuuuggagaagacuacuaauccuuuuaaguugcgccugcuucguaggagcgaucccaaaagacuucaacccccacaguccuguucaacaaacgugggagguacucaaugagggggguagggcuguauggacaaucgccgagguacacccucuguggacuugguggccugaucuuuucccugacaucuguaaguuggcuauaggagccccuccuggaugggacuuggagggguacucugacauucagagggcaccuuuaacacccccuccguacguagaaaaacauucgagagacccauggggugguugcucuaaccaaagggauagaaguaugcuucgaacccaucccuucuaugucugccccgggccccaccgaagucagucccucaauccaacguguggagguaaggcugacuucuuuuguaagagcugggguugcgagacuucagguacagcccgcuggaagcccuccuccaguugggacuauauuagaguaacagccaacuauucccuagcgucuuauguaccuggaggauuugaccuagacgaguguacugacuggugccauccgcuccgugucaccuucacugaaccagggaagagagcucugggauggacaaaaggguauaccuggggucuuaggauuuacaaggaaagauaugaugagggauuauuguucacuaucagauuaaaaauagagacacccuacaauccuuuaggccccccaaccaaguucacaccccucacccauacaauuacucagccuacuccagugauugcggacccccuuaauauggccgcuaucacccaaccucccacuccucagguaccucuaacuauuacccccgcgauuccuucaagacagaggauguuuaaccuggugagaggagccuuuuaugcccuuaacagaacugauccaagcgcuacugaggacugcuggcuaugccuguccucggguccgccuuauuaugaaggaaucgccuucaauggagauuucaacagaaccagcagccauacuuccugcucuugggguacaggacaaaaacugacccugacugaaguauccgcgaggaauccaggucucuguauagguaccccaccuuccacucacaaacaccuaugcggacaaauucaguccguguccagaacggaagcugauuacuaucuuguaccuuccccgguuggauggugggcuugcaauacaggacuuacucccuguguaucaacuaagguuuuuaauucaucucaugauuuuugugucaugauccagcuguuaccccguguauauuaucacccugcauccaguuuagaagaaagcuaugcgggccggcggucaaaaagagaaccaauuacuuuaacccuggcugcauucaugggaauagguauggcaguaggaguggggacgggagugucagcuuugauagaaggaagacagggaauucagucuuugagggaugcugucaaugaagaccuagcggcaauagagaaguccauugacgcuuuagaaaaaucuuugaccucccugucugagguaguuuuacagaacaggagaggucuugauuuguuguuccuaaaggaaggaggacugugugcugcccuuaaagaagagugcugcuucuaugcagaucauacaggaauaguuagagacucuaugcagaaacugagagaaagauuagagcgaaggaaacgggaacgggaugcucaaugggggugguuugagucgugguuugaaucacgaccaucuuggauaacuucuuuaauuuccgcuguagccggaccaauccuuaugauaugcuuagcuuuaguuuucggcccuuguauaauaaauagaggaauggcuuucauccagaguaaaauugauacaguaaaacucaugguucuugccgggcgugguggcgcacgccuuuaaucccagcacucgggaggcagaggcaggcggauuucugaguucgaggccagccuggucuacaaagugagcuccaggacagccagggcuauacagagaaacccugucucgaaaaaccaaaaaaaaaaaaaaaaaaaaaaaaaaaaaaacucaugguucuucaaaggcaauaucaaccuauaguucagguagaugaagaguuaggggacaccaaucucuaagauucuaugauuagaauuagucuaaacagaagaagaggggaaugaaaggaaauaaaacuguaauucauguaauguauguuaaauagcccaaagaguuguuugugagcuuugaaaccuggggcugagaacacagcagaacagaccaggacaugcccgggcaagcccaucgccucccuaguucccaccccucugaccuaaguuaaauguuacaggcugcugauguuuaaaugaaccaaucaugugaaaccgcgccaauuccucccccagccccacuccuuuucuauaaaacccccuagcuuccaagccucguggucgaauccacugucuccuguugugugagauacguuucgacccggagcuccgccauuaaaaaaaccucuuguuguuacaucaag

SEQ ID NO: 1907 - RNA, 1392 nt, Mus musculus
cagugcaagggagccgggagucaaagaaagcagaggaagaaaggaaagaucugcgaggcugcucagcagugaaauccuacuggcuuugugcaaaggggaaagacucccuucuuuccaggugccagagggaccugagcaagucuaccggcccggcgcuccuccccaccaggaccccaagggugucugagugcugaccgccgcucccccaucaauuccucguggccaagagaggaagcgcgccaggucugcacugucccgacugauaauuuaccucuuugucuuuaauaaaaagcugacuuuuuugcugucaaaagcucugcaaccgggcaaaauaaugaugaugauaauaauaauaaacguauuucagauugaaagcuccuaucaacugcuagcuuuccgaggcugcuauaaauaucuuccucgacgugaagguaccuugugggcuggcgugguucggaagagcggggacgaggaccgcccuccccucccccuugcucccuccccaggcgcggagacgcagcggcaaggaaggagcggaggucagaggaaaccugggguuuccaggguuuucgcggucgggggaaugagcccuggggaggagccuugcgccagcgccagcgcgccccaacacgccuccgaccucguaaacccacuuggcacaggccggggaagccgcuggcggagcggcugcggugaacuccagaaaugaaccugcggcacggcgcgacgccacgggcuaccacccuggccaacacucaccucgagcgaccgacauugagagagcuccggacgcggccgcaggggaccuugcuccgcccucucgucccaggagaagaggacaaaaaagggggggugggggagauggacuuggagauggccccgcccuucaaacgcuccaauccuuggaaaccaaaccuccucuccaagcuaccacgucuagaagggacaaagacugccaggagauccuggcgcugauggggagaugauggcuccucgcgcuucuagggaggguugcuuuggggugcuuuugacuuuacaucccaaauaggucaccaaagaaggaauggaugaucuguagaggacaaacugaaccuucugguaaagaagcaagcugacuuuccaaagcugagaagcaaacaauuguaaaacuccggcguagacuacaauuucuauucaugaugcuacugucucuuuuggcuuuacuacuuuuagaaguuccaaguucccuaacuccccaccuaaaauaaaugaaggacauaaagccuaaagugggggaaauugcacuguuugggguggggguggggcgaaggugggacauugaggggaagccccguggcuggaggauuuggugaaugccuuaauaaacuugguacuuaaguaacuguaauuagg

SEQ ID NO: 1908 - RNA, 1719 nt, Mus musculus
ugguacuguagcccccccccccaaccauccuaaauuugauuaaagccuuaggagaucuuuaaccugguaaacggggcggggguggaaacccauuucuuggggaaagaauuguccuaaacagacaguucuugggggggggguuacacuaaauaaaaauucaaggugugaugcugcuguuuggcucucuuguuuucaacaccauggcaccuuaucauuaggagcgaugauuguuacuuucuaagccuuuggaggaucagccggaaagugcaaacaaugugcaaacaacgcgggauguggggguggaaaguuauuuaaguacgacccccagcacccccagccuuggugcaccggucaaaacauuucccaaguucggaaaagaaagugguggcuucuagaucagaaugaucuucuccuuuccauaacaggagagacauaaaacgcacaaugagccuuuagagggcgaaggcuuaaaaauacgugccagcaauggacaacuugagcccuucacugaagauacacugcaagcuggaaaggaauuaaaaagccccacgugguugaucuggguuuagacuugcaaccuucaguucuuugcaaagauuggccucuagauggauacauuugagggacccucuggagccaggguugggcgccuggggcagagcugauggugcgagcauuuagagcagcggggcaggguccccacuaggggcuuguuucucuggccagggaggccgggcgccuccuggacgcgagagcgcacgccugggacccggcggucgcgcuucucgcaccgccuuuuccgcaggucuuuauucaucucaucucucucucucuuucccuucuccaccuccuuugccuccuucuccuccucuuccuccuccuccuucaccaccaccuccuccuccgccgccgccgccaccuccuccucuuacaucucacuggccuggcucuguguuguucagagugacaaagacaaugucccagccuuaacuuugcaaccaccuugccuccuucugggguucagcgcgggaggggggcgggcaacagacgcagcuucagcaucuccuccagcuucuccugcgcuucuucagcucuuggauaauucuuccuauuuucucccagcccuuuucucauuucuuucuuucuuucccuuccuuucuccugcacguuguuguuauuagaaaggcuucgcgcacccccuggugcuccggcguuuuguguggcaggagaagauugucuucucucuuucugucuugcuuucucucucccucugguugcucauuauucagagagagacauagagggagggagggagagagagagcgcgcgcgagggagaggagaggagagagagagagagagagagagagagagagagagagagagagagagagagagagagagagagagagaagaggggagggagggagaggggagagagacggauaucucaggucaucugcagcugcagcgagucugaggagccgaggaaggcagggaagauggcgauccuccauugcugagacccggcagaagcacaugagacucccaaacaacuuccacaacaauaacccgagcaggaagaggagaaagagaaagaggauaaggaggcgguggggcuggagaacccgaagcaccucccggcgccgggacgcuucuucuguaaguuacugcaauuaaccaccaccucugggguggucugagugcuccggggaggaga

SEQ ID NO: 1909 - RNA, 1719 nt, Mus musculus
ucuccuccccggagcacucagaccaccccagagguggugguuaauugcaguaacuuacagaagaagcgucccggcgccgggaggugcuucggguucuccagccccaccgccuccuuauccucuuucucuuucuccucuuccugcucggguuauuguuguggaaguuguuugggagucucaugugcuucugccgggucucagcaauggaggaucgccaucuucccugccuuccucggcuccucagacucgcugcagcugcagaugaccugagauauccgucucucuccccucucccucccuccccucuucucucucucucucucucucucucucucucucucucucucucucucucucucucucucucucucucuccucuccucucccucgcgcgcgcucucucucucccucccucccucuaugucucucucugaauaaugagcaaccagagggagagagaaagcaagacagaaagagagaagacaaucuucuccugccacacaaaacgccggagcaccagggggugcgcgaagccuuucuaauaacaacaacgugcaggagaaaggaagggaaagaaagaaagaaaugagaaaagggcugggagaaaauaggaagaauuauccaagagcugaagaagcgcaggagaagcuggaggagaugcugaagcugcgucuguugcccgccccccucccgcgcugaaccccagaaggaggcaaggugguugcaaaguuaaggcugggacauugucuuugucacucugaacaacacagagccaggccagugagauguaagaggaggagguggcggcggcggcggaggaggaggugguggugaaggaggaggaggaagaggaggagaaggaggcaaaggagguggagaagggaaagagagagagagaugagaugaauaaagaccugcggaaaaggcggugcgagaagcgcgaccgccgggucccaggcgugcgcucucgcguccaggaggcgcccggccucccuggccagagaaacaagccccuaguggggacccugccccgcugcucuaaaugcucgcaccaucagcucugccccaggcgcccaacccuggcuccagagggucccucaaauguauccaucuagaggccaaucuuugcaaagaacugaagguugcaagucuaaacccagaucaaccacguggggcuuuuuaauuccuuuccagcuugcaguguaucuucagugaagggcucaaguuguccauugcuggcacguauuuuuaagccuucgcccucuaaaggcucauugugcguuuuaugucucuccuguuauggaaaggagaagaucauucugaucuagaagccaccacuuucuuuuccgaacuugggaaauguuuugaccggugcaccaaggcugggggugcugggggucguacuuaaauaacuuuccacccccacaucccgcguuguuugcacauuguuugcacuuuccggcugauccuccaaaggcuuagaaaguaacaaucaucgcuccuaaugauaaggugccaugguguugaaaacaagagagccaaacagcagcaucacaccuugaauuuuuauuuaguguaaccccccccccaagaacugucuguuuaggacaauucuuuccccaagaaauggguuuccacccccgccccguuuaccagguuaaagaucuccuaaggcuuuaaucaaauuuaggaugguugggggggggggcuacaguacca

SEQ ID NO: 1910 - RNA, 135621 nt, Mus musculus
auacaugugaaaaaaauucuuuauuaauuucucacaucucauuacaaaauguauguugcaaacaacuugaauaaccuacuuguguuuuuuauuuuuauuuauuuuuuuauuuuauuuuuuuuguguuuaaacccuuggcuucaaggagucaggaucccccuaucuuucaucaaguuucaggaaacacugauuauuggagucaauagguuaucauuuugcuauuuauuuucuucucucaagcucuggaaaaaaaaauguccucuguauaaauuaaacaacaacaacaaaaaauuuuguaaauucuaugucauuacagucaacagaaaacagaaugcguccaaaaugugcggccacaaaauaucagguauauguuugaaaaauaaaacaaaaaaaugacauccuagccuuguuaaaaggauaauggucccauauuuuuauuaucagguuagcaaaacaaaauccaauggauuacaauauuuacauguuauuugaaaaauaaaguagugauagaagcaugucacaauuauuuucucuuuuccuuucguuguuuuguuuguuuuugguaaccaucacagacauccaguccagguaugaaacuguuuaguacauuugaaaugaggccaaucaaaagcgaguaaggacacagaagaaucugucuagauauuucacacuucccccuguucugguuuccacaugacggccccaucccuaaaaacaaaauuaaauuaaacauccuacaaauaaaaauucuuaauagcaaaaacuaaaaaucaaaaauaaaaacaaaaauaaaaaauaaaaacaaagcaaaaccaagaucaugcuuuucaaguacguacuuacuucacaaaugcgauaucuuuccauggauuuucucugaagcugugugggacacugacaccucaguuuacccucuuucccuucuggcccgccccccaccccaucaacccuuccaaguuaaaaaaaacaaacaaacaaaaacccaaacaaggacaacaaaagaaacaaaaccuaggacucauauuugcccacacacauacauccaaacaccagcacacguaugugcgcacgcgcacacacccacccacccacacacacacgccccuaagcuucaagaauguuccuuuccacuuuuuggaacaaaaccccauuuucacaaucauaaugugcuauaaauguagacuugcuuucagucuaagcugcucuuggaaaaaaauaaaauaaaauaaacgaagccacuguggggaaacagagcagcuagaugcgcagacaaagcacuuuuccaggcucccugcaggaugcggcaucuccuguccaagcucacggaagggauggcuccccaaagaaaugagacagccucacaauacacaaagcaaacaaaacagaguucacagcacacacgaaggccagcccaauguaacagaaaucguuggggagacgaaauguguugcuuugagaaaaaaaaaaaacaaacaaacccaaaagggugacgggaccuccuugucuggccccccccacugcauagcugugcucggaguuugguucuuuaguuaaauuaaaaagcaaacaaacacaaaaacaaauuuaaaaggaaguuaaccucuuuguuauguucauguuuaaaauuauaaaaauucacacacacacacauacauacacacacacacccuacacccucuaacucucccuugaccucaaauuaaacaaacacacagagaacaacucauaugaagaaagaacaacugaauuugugcuguguuuguaacacucaaaucgagaaaaaaauaaacauguggccaacgaaaucccacgaucaccauaaaauuaguucacaugaaccuaccaaauucuaaauuauagcugaacacuaauaaacagcuuaccuggaauacaagaugacaauucacacacaguuaucuaguaauuaaagucuguuucuuuuuuuuuuguuuuguuuuuuacuaaaauaauuaaaaaaaucacaguauuuuaagaaauaaaacccacguggggauuuuaagcacaauuuguguuccuuucuuuaaaacucuuuuuuuuucuccauucaccauccuguccagcaguucucucuacauuuaaccacaagggccacagguaguacagacaaaugcagagaauucccuugguuaagucugagguacuaggaaacaggugacuguuuuaugcaaagcaguuuuuuuuuguuuguuuucuguuuuguuauuuuuuuuucucccaaagcggcugcaguuaggucuugaaaaagcuuaagguauuaaaacuagaaaaacgcacagaaaguugugcgcccaaaaguuguuccccuaggagaagucuucuguguccgggagccucgguuuccacacacuguccgagagggucacggagaccaccgugcccacgggagguacuucccaaaccgcagcagaugaaaaucuccguggugaagauccggaaggaaggaugucgugacaggaaaggagccacauauuccaaccauuuaaauaacuuuaauuuacauacucacucacacagguaccagugcuuugaaaauagauuguucaguccuaaaagcagcuuuguucugucuucuucucuccucugucuguccccucccuucucagcccacgccggcccgcccacauuuucaucacgguucaaguaagguuugauaagaauuucaccaaacucuuauucguuuuuggccucugcauccuccaggagagauuugucggcagccacuacacagaugguuacuguuucgcucuuuaagggaaagucuaucccaauuggcucaucgucuuccuuggccucuauggagggcagcugcauacucuccuccaccaucuccuuuguauggauuucguuccugcucacuugguugguaucaugcaaugaccuggaaaagcaaaccagcagacaugcugauaagccaggugugguggcacaaggcucucauucccgcaauuaagugguggaggcgggaggcucaggaguggugagcaugcgcuccuguaggcccagccuaaguucagacaucgucaucuuuucugugugugauuucagacagaguaucucaggacauuccaaacacgcuaggcuagcgucccuacuaagcacaacucucucugccuccccagagcugggauuacagacacacggcaucaugcccagcuuacuaaccugcacucugggcauggagcugaaacccuaagcauuuuaugaucuuccuggcuucucaugcuuuuucuaaucaaauuaaacacucaucucucuuuccucucugauccugaaagugcacugaaguuuccugugaaugaauucuguguguauauuacuaaauugcuggugacuuucuauuuguuauguguagagcucuuucugaugacugggaccccuaaaaauauccaguguuuguccugugcuuugauuaugccauguuuuguuuccaaauuaauauaacugucucacacucagaucugucagcugaacucagaagcuaagguauuggccaauaaggauuaagacaaaaggaacaacucugauauugaaguuuuuuuuuuagucaagucuauuuuaauaaaucauucaaacacacaaaagcuaaaaaccugcaggcaucaacugugacuugagaaacuuaguuauguucucagaggugugggcacugcauggccauuaucucauacaaaccacacauucguucucuugucugguggacuaaggaaggguucuuugugcaaacggacaauucgauuuucacagugguuaggucagaaccugacaggcaugcucucaguuacugggaggcggguauggaauggcgcugugucucugagguaagucuuggcaugcccagggccauucacagaagugggcacacacagaagccagagauucagaccaccauccacauuucucucagagaacgagauccaauugcaaagaaaagggacacacuaccuuucagucugggggcuuugaaugugacaggauggucauuuuaaaaauuaacaaagaaggaggaaucugcuuucucagucuucacugccugcccuccaugcucaguaaggugauaccaggugguggggguaggagcucuuuguacuauuaggggacucuugccuuccucccacccucucgcuugggacaaaggucuucuuggugcccaacuuacaugccgugucucaacacgugucuuucccacucagagcccugugagaacgcccguccacagaauucacauggaaaucgcuucucuguguucacaccaggcccccggucugcaaaucucaucagcucugcaaacagagagaaaagaccagcauuuccuuuguguuucuggaaaucuagagaggaucagucagcauucacuggaaaauauuucccgacuuaccugggaagcuaaaccggaagccauuggcagguacugccagacuccccacugacucugggcuucucugaaggacacuuccagaguagagcugaauaggagcuguccugcuucagucacuuauuaugcaacaagucuccuuauuuaugcaacuucugcuaucaucaacaacccagguuccuucuggccagaaaaggcuccuuggcuuacucuaagacccuuuacaucucuuuucuaauuaacucaucccuucugcagggucugaccaagggcuugacagcucggcagcuacucagugugaauuugaaacagggcuaucugcucacuaagaagaaaauagaccacagaaagcgcccaaccugguucuacagaguaggccacaggacuucuucguauuucaaguuaggccaaagcaucacaacauguguaccuccuuugucggauggauaggagcccugcagagacccuccugggugguacccuaagcaacgcugagguugggccgccgggagcuuauauaaaagcaugucugggacauugagaugucucaguagauuaauguugccugcucccaggcuccaugaccggaguuugaucccuggagcccacauagugggagacaaaaaccaccaacuccugcaaauugugcuuggaccuccacguguacaacucucucacacauacgauaaauaaacacauguaauaauaacuaaugauaagaaaagcaagcauguccccagccacugacagauccuggccaaccgcccaguauuuauuucucaaccggugauauucacaaguacugggauacgcagacauuucugaaugggucugguguacacagcaaauauuggucuagcuguuuucuucacuccugugaugcugccacaugugaggggccuuauacacauggauuggcuagcgaauuguuuauaagccacaccuccuggcaagcucaaagaugaggguuuacguggccuuugugcuguccuuaguccuaagcccagaugucuuucauuagcccacugagggccaagucuucacacggauaguaaguagcagacuacacaguucugaaaaaaggguggagcuuggggaaacgugaucauuuucaucucugauuaccgugggccccucagcagauuagacgucacaggaagacaacuucugauugaaaugccccauauuucaugaaaucuuccagacauuagcuaggacucugggaugccuucauccacuucacaagaaagcuacgugaacagggccaguucucacaaaagacaaggcauucucucacaaauuaagaagaucaccacacaagccauuaaaaauaauugcacagacuaucuuccuugauucuuuucacuggaaaugacacagcgccaucuggucugcgcauuaauuccuuagcagggauuaucuugggcaagaaaucaacagaaugccuuccugacuccuccuaguugcauaaugagagggggcagggugggcggcguucugcuuggguuccuuucaauuucuucgugcgugcguggcuucucucugaaauucccaggcugaucuugcugugugucuauucugaguacaguccucagcucucaugucugggaaggaacuggggaacaggaaggccaugaacuccccaaccaaaggugucuauaugaacguccaaaugauucacaaggagaauggagcugguacuugauccucugcccucaggaaacaugaagccggucaucuauugucuccaagggcacaugcuaagcuucauccucacagaagaagccagucuaccugucacaucucaaaucacucucccucagccugagagcugagcuaauagccccucgugcacucugccagaagccaggaugucuggcaaaaacaccccaggcuauuguuggcccugucuucuuggcaacaaucuacugaggugguggaagauugauucuagguuguuuccaaagagaaggagauaggacaaagggaaccguucuugcaaggaugugugacagggaagggacaguuucagcuugcaauucccaagguacucaagucagucccucauacacaacuugucuacccaaggaggaguuuuucuucuuuuguuuaggucucuggauguagacaugacacuuucagagggaaguagaagccaggcuguucgcccuaauuccaucucgugugaagccgaaagcccaguggauagacugagaucaagcuggacaagcaggaagaugugcuugcuaccucacauauuucagacgcgguguuuucucauggccuaagcuuguuuuauuuguuuugggggagagcauugggaaauggagggcucuggaaugcugauggcuucagaaauagccuaggcguagccuuagacaugaagaaagucaaaauauccaagaaggaaucuuuuaucucaucaagagggacaagcagagcccgaguaccaggaagaaaaagaagcuuuuguagacucacucagaagcauccugucucccucucccugaggacagccaaaacagugaagagauguuaaggauuuguugugaagaacauauuuguuaaaagguuaaaaaaaaaagaaggaaagaaggaaggaaggaaggaaggaaggaaggaaggaaggaaggaaggaaggaaggaaggaaggaaggaaggaaggaaaagaaauaaggcauacuucugagaucacaagcauuucccuuauaagaaauggcccugagucaaccuacaggagaggcuuuuguuuuaugcagucuugcagguugaccacagcaagcagcuuuugacaaguuagcacguuuuggcuguaagccuuggcucucuauguuaguuggagauugaaggacccaacuagaucccuugauuaucacagugggaggguagggacaaaaaaaaccacagaagaaaauggccucaggaagaccugcucaggucugcuagauauucugccauggggccuuagucuagcccaagggcuagugcauuucaugacuagcgucucuuuaaaaaaagaacacguuagcacucuaagggguugaagauguguguaguguuaagagaucugcucuggaacaacaagacugagauuuacccuucaguggguuuauuaucuaucuucuuaccuuacuuuagauagguuuuaaguuugucagaacucuuauuuauuagguccaugucuuggaugccaugccauuuaauuaauguuuuuggcacucuuaaaauccacggccucucacaccacaggcaagaauuuuaucacugaguuacaucuacccuucgcuuuccauuguaacgucaagguaacuagaaaagaccccauauagccauaacaaccuagagugaacacgauaagaaguucgaggcacuccauuccgugacuuuaagauacuuaaggaaagacaaggucaccaaaacagcuugacaguaaccuagaaucaguuucauggagcaauggaauaggaacacucucucagucaauugagcuuugagaaaguugccaauaucacuaucaggcaccacaggcagaagaaagaaacuagauccugaccucccagauggaaaaacaaucaacuccaaaucaguaagagauugaaacauagguccuaaaaccacaaaaguugcuggaggaaaacucgggggaaaucuccaggacaccgguuguccaugauuuucucuuuaaaguuuuuuacaugaccccccaaaucacauguaacggaagaaaaaaauaggcaaaugcuagcugaauccagcuggaaaguuucuguucugccaaggaaacgucagaaagaaaaggcaagccacagaagaggaggagaaucuguagaccacacacuggucacagggucagcauccggguccuaugaagaagucaaccaacucagucaauaauugagugaacaauuuccccaauuaagaaauggacacaggcucuguauaagcaugucucagaagauaagcaaacagacaucagcaauauaauggcacuccacauccugaacaaggggggaaugcaaauuccaaccuuaaguacugccccauagcaguuagaguguccauuaccuaaaggaggaaagagaacaaguguuggggaagguaaagaaagaacaaugcuguggacuaguagcaaauuugggcagccauuauggaauacuguauguaaguuucucagcaaucucacugcugagucaacacacaaagacaaugaaaugaaugaagggaauaucaccaagagauguccaggguucaucucagcauuauucacaacagcaaagacauagaacucauuugaguggccaguugucgaugaagggauacagaaaacaugacaugaugcccacuggcauaucauuuauaccauuccacuuuaagacaagaacuccugucauuugugacaacauggaugaggauuauauguugaaggaaaugaaccaggcauaaaugcaaauaccaauuuauuucacuccaugugaagccucagucaaauucagugauucagacuguggaauggacauuuuuguuggaguggacauuuccaaagcccaagguugggguccuggggacauacugcucaaaggacauuaaauuucaggcagauaggaagaaugagugaguuuaggagaucaauuguguggcgugaugacuauaaccaauaaugcuacugcaguuuuaaauugcucaguugauuaagaucuuauucccuaagauaagugaggaaaaaauguuaacuaacuucauuuggccauucugcaaugugcaccuauuuuaaaucauaaauacacacauuuuuuuaaaccugucaacuaaaacuaaagaaaauaccaaaguuuuacgccagaagcuuuuaaguuaaaaaucuauacauugaucacccuaggagacagacacugcuauuaucauugucacugucacuauuauuugagagcuggugaacucacaaagacagaaagcaaaguccugggggccaagauccagugggguagcuucagaacccuucguauuacaggacuaaagaaacgaggcucggcaguggccgcuaauacuauucuucucaucccuacaaugguaguggcuauuaugcguuucgcucauauuuacaguaucaaugcgugaacuauuuugcucaaccugcaguaacuuaaggaacauauaccaacuuauauucuuucuuuuuaauuuugaguaugugugugggugugggcaugccagaggaaagagucugaucucucagaacuggaguuacaggugguugugagcugacggaaaugggugccggggacggagcucagguucuuaagaggagcaagcacucugagcugcugggcccuccucucuccagcccuuccacuccccaucucaaccugugcuuuuauauacucugagaugcccacaguauucuauaaagaauaaacaaggauaagucucuagaucacacacacaugcuuucugcaauuaaacacauuuuggagucuucuuaucuuagaauaaugggagagaggcaggguuggagcaauaguucaaaaugucgauaaaaccuucgcugguguuuuuugcaaauacaggagagggugagacacugucucuuccucuuggcagagugaaaacagagcccuaaggggcuaaggaaauggcccugcaggggggacauguauaauguccaaguucauuaccggcucucacuaugaccccagcagcaauccaaguucaaacucauuccucgauagcacuaccaugccauucaucuugcuccuugcugucugcauccugaaggcuccucagacacuaguuuuccuugcuaggaaccauauauauauauauauuuuuucuuagcacacauacaucuauaauuggaaaggaaauaucuguuuuccuuggaguuucuauagcugguaauaguuuguaaagacagggccccugauggugccuaagccagucuguucugcugcuuaaccaagaaggauccuuccuucuguucuucccacagcagccuccugccucccccuucugucucacuguggacauucugggugccaucugggacucggagagcaggguaagacuaaccucuguccucagccuugcugcucauuucgucguccuuguccucguccucgcugcuggaacucucaaucuucuccuucaucuguuccagcugauccaaguucacccggccaaccagcucaaaguuccggcucaccugaaaaagggccaagcagaugauggagagaugaaccacagacugcacggccacucauggaggagaucuuuccagcacaaucuccccuauauguuuuuuuuuuuuuuuuuuuuuuuuugcauccggguccagacaagcuaggaaucugagagaucguuucuucauucugacuuugagagacagaccuguccuuggcuucccauuccaacacuggaccuccucaccaaacuugugagacucagguacaaaaaaaccagagagaucccagagcaucacaaaacauaucgcacugcaucaacacugaauugaaaauguaacauguccaucguuaacuacccaagcuuucaauacuucugcaugcaaagagacuccuccuuccuacgcacguccugacuaccugucaaucaugcuccugggcuguaucagugagagccgcaagacuuuuaaccgcuaguuuaaauggaagaccauacuauugcuacuaguuuggcuacauguuugaaacugacuauauccuauuuacaagacaggauauaacacagguaacuaaccuuaagagcuacugaaauguguugaccgugagugaggcugucgagaugguuaagugggagaagaacuuaaacugcucaguaagugcccgagugaggagcuucagugucagagacagaacagucucaaaacaggcaggagaugggacaggagaugaaagacauuuagaucuguucuuugacacacacacacacacacacauauacaaagagugggugguuuuuauuuaucuaaaauauaguuagaauaaugugagaaccugagcuucccucaaaguaucauucaaaggaagcaauaauccaaacuauuaugucuuaacgagcucugguuugggguuaucagaucaacaacagcacaaacugugccuucuccgaacacagaguuguuaguggugacaggugaggccgcuagaacaagccauagcuuaugcucuguaugaggugugugcucugauccuucuuuugaaggccagggcaggggggauaucaagacaaaugccacccggucccagccuccagaggcucccaguauaguuagcgaaagaaggcagacaucauuaauuagguaggcaugguccacagcugccacaguagacagugcaaugagagcacaagggaggaaagagggcuuacaagacaauucagaguacucucuggggccaggcugggacaaagaugugcugagcaccaccaauuccauaugcccggcagaugggaucgucaucauuggcugugacaaaugagagggaucucaacucaggguaccagggccaacuuggcguuaugaugagacuuaauacugcucuggcaaccuugcauaggagacugguauagccuggaggaggcaggaaacaccuuugagauaauacacugcucuaccuaagaggauggaacccgugaagccaguugauucugcucuuuccccgccaggccuggacuuccucuuggaagucacuaguucucuccuuuugucccuuuccuuucucaugggcuucuggagaacuaacuaugcuuaucucuauuuuuccuugcucgaaaacuguucacauuucagauucugcacaauuuugaaacaguauguggcauuuccaugguagacguucaucccaggacaacccaggauuuaucuguccugaagauaucuauaaucucugcaaggcaauuaagacuuaaaacuauuucuaauuuuuugcuauguaaugagaagauuucuaaaauuaaaaaaaaaucuuuauagugcuggguuauucuaacauuuaaaacccccaaacuagccaucuaaaugcuaauccgaacacagagggaggacuccuuuuuuuucuucugccccuauuagccuaucaugucuccugacuggaucaccaccguaagccccauuccaaaacugggucgcagcauccauuuccccucuuccuguaucuauuccccagugugggcaaagucaucuuuuaagaaaauauuaagaggccggggagauggcucagucaguaagagcuuccuguagaagcgugaggagcaacgucuggauuccccaggacccacaugaaaagucgggugcagcugugugcucugcaguccuaacucagaggaguuggaggagaaaaaugcccugggucuaacuggccggccaguggagcugagugggugagcuccaggguugguaagaauuccugugaagagugauuaagaaagaugcucaauggccuccauacauacagcccccucuacauauacauggacgcguagaaaaugccaaucuuugcccugagggucaaauuccaauuuugugcuguggcuuauaggcuuuccccaagcucuccuguucccaucaucuccacuuacugagcuucccgacaugccgcuucuaagcuuaugccugccacaugccuugcacacauucacucagucccccagcccagacgagggucuucaucaggaagccuuccuguuguugcuccgccauuaaucacgcugcuucucccucccacagcauccagacuugcucaccucacacacaccacguucccuaaauaacccuccuggucugccucucugccuccaagcugcaagcccuaaggacagacuuucuguccucuucuaguuccaucucuucucaacagcagucucuaccucagggugggcacugcucggacagccuggcuaccaucuagcuucauuuugacaagaaucuccaaugucuuccgcccuguguaacacacacaguguuccaugagugaaugucaucuugaaucaccuuaucauauuucauaagaggauaugaucuccuaguccucuauguauuuaucugggguuauguuauuccuggcucucgcuuucuuucguguuaagguuucauuucauaacugaaauuuccagauguaaaguuaaagagucugagccaaaggguauagaguugauuaugguuccaauguaccucucaguuagcuuuggaggagaccaaaggucuucccuggaccagaugacugauggcuaaguggcuaauaucuugaugguccacgagaucaauugaaagccauucaccucccccaccucccaggaccagaaguaauaucgcaucauccuguuuccauaaaaggugacaaccaagggagaaagagcgggucuaggagcguuucaucuagaacccuuccccgaguuucacagaugaaaaaagccccacgugucugaagcccacguuguucaaauuauaacacuauaugcugacccacauguucugugaaagucacacaugaauuuaccccaacccaacauccccaucaaaagucacuaacccagugugggugaaaacggcagugaagagggacaugagaaaugguguccacaggcugaugagcaaacacugaccccugagcucugaugucaugaccccaggaauccccuuucccagauaauggcaauuuucacaaccuuuccuauuuguugguuuucaaccauucaggagaugggggagaggagaugaaagagauuuagaucuguucucugacuauaccccaucccugccaugccagcuugcuuuaagaauuauacaauugauuaagauuaccaaauugaaagccgggaaugguggcgcacaccuuuaaucccagcacucggggaggcagaggcagguggauuucugaguucgaggccauccugaucuacagagugaguuccaggacagccaggacuacacagagaaacccugucuuggaaaaaaaaaagauuaccaaauugaacacgcauuuucgugcugcacccagauagguacagaagagauugauauagucacacuugcuggagacagaauggaacuugccacauucuccgucaggugaugucacagacaucaaguaggacagacugugacgcagcaaguccaaccuaugcuuccagguuuucaggggacagaguucagccuccuauuggcuguacauacuuaucuucaugugagacacccagccaagacucucguauuccccacgguuuauuaucacuacgaggaagaacagccagaguaaacuugccuuucuagaaaaaguaacagcagagaacauggcgccaugaccugcgguguggucguuaaccggcacugagaaggugggaaugacuuacauacaggcugagacacuuguuuuguaaagggccauagaagugacuauuagaagcuuuccggaccacaaaaacguaauugcucaaaacccaucaggaacaauauguagagaugcauacaaauauacacauauaaacacccauguacagacagcgaacuuuggaaucuguaggcuuuugaguuugucaacucuuuaaaaacuuuccuuucuuggaugguuggcccuguaaacucacgguguacuggaauuggcccacuggccacccuuugcuaguccaugucauaagcagauccuugacugucuuugaaagucagauggauauguaggaagggagucagugugaaaaacaaaauauuaucugaaggauugcccacgggagaauggucagggaggcagaugagaaauuaugcugaaggggcuggugaaggagcaguuaaaagcacuggcugcucuuccaaaggaccaagguucaaugcccagcacccacauggaagcucccaagcaucuguaacucuacuuucagucucuucugauuucugugggcaacagguaugcauguggugcauagacaccugcagccaaagcacucauauacauaacaaauaauaagauaauaauuuuaaaaguagguugcauucucagcuagcagcacucuugcuaagaguuagaggaaaacuuuaaagaacagacauuaauauucacuaauguuguccugaagggcaggauucuuuuccuuuuucugguuuaauacuauucuacaugcaguuguccacacacguaguuuacaugugguauuauuuacuucuauuggugacaugaugacccacacgagccacgcaucccagcagucaggaggcagagguagguggaucucugugaguuccaggccagccugguguacagaaugauuuccaagacagccagagcuguuacacagaaaacaaacaaacaaacaaacaaaaacaacaacaacaacaacaacaacaaaaaacaaaaaaccugucucaaaaaauccaaaaaggggaauacaaaaaccaaaaaguaaaaacccaaccaagaucacaacauagaaagaauucaugacauucacaucccaaaaauucaguugcugcggugagaauaaaauuggauacucucuaguuaaaagauuaaacaaaauacuuggugaauaucuguuucauacuauaaauauaucuauccaguggucuuuacaugcaccccauuuuccuuaaacugcuguguacaguaugcuacaguuaucuugcacaucagaagaugagaauacaacaggaaaugagggcuaaagucaugaugugacucucuuaucuucaggaggauagcucagaccuuuucugcuauaacaaacuaucuguaagaaugcaaaggcacucucaggaugcagaaaaaaaugcccacuaagguggauaacccagguaaaaacaaacaaacaaacaagcaaguaaacaaacacccaguagguauugauaccacuauugugguggaaacuugauggguaggugguaucccuugacaaguuuucuucaaaauaaaagacuuuuaacaguacaaagagauaauccugaaguagcuagagggguaaggaacacagaagacaaaguccagauccaauuucuugaaacugaauucagcuucugaccaacuuaacuuggccaaaguucagaagaagucuacuuauuuggagacccugguauaauucuagacacaagcugugaggaaagccaggagaagcacagcaucaagagagucugaucuggucaggggagcugcugccaaucgucuggauccagaggacaaacgcuggcaaggccgccaagguuugauaaguucaaccaacaggcuuccucaaauuucaucuuugaaaagugauuucguuucacucaacgauucguuucauugcguuucugcagcagacacgguuaagauuguagaagaaaauagagaaaugucugaagaggaguagguuaggagugagagcaccagguuugaccagggaagacugaauacuuucaaagguuaugggcaaauaaugucuuugucuaauguugacuugauaaauauugcccagggcucguggaaguacacgccucuggaaaacagucacaugucucacuugucugauuccggguuuaucugucuucucaaccccaugaaagagacagauguccagcugacauaucaacaaacaaagccaacaggagggagaucaguacugaaaggaaacgagccuccggagaggccuggagcccugcacacguccucagaagcccugggacugcucacugggacuuaguucagaaacugaacacaauaaaagaaauguggcuaaagguuggucuggugguuuggagagaaggaagaucuacaguacaaauuucauuuucugaaauuuuucacuacggcguauuuuauggauuuagaaaacugauuuaagaggcgagagcuuguuagaccuuguugcuugcuucuggguugaagguucuuuuguuuccuggaaauuggcgcacacacacacacacacacacacacacacacacacacacacacacacacacaaagauacacauuucuuagaguucaguugccugagacucuauuuguauaaaaaauuaaaaacauuucaaaguaaauucaauuaguaaauguauacugccugaauagacuauccuaaauguaauauacugaacaugagaauuuuaggagaaaaccaaacuagagauaauauauuuuuauguuccuuuaaguagcaaagagacuuaagacccaugaaacagcauuaacaagguacugaaauauacuuaaaauuuucuucaaaauaaaaauguuuuuuguuuuuguguuaaauguaagacauauaaggucuuuuuuagcaagacuuuaaggcuccuagaaguguuaagccugcaucuuucacgggaacuguggagaaguggcgucacuagcuaacauuuuauuguauaagugcagggguaggggagaaggaggagggagugacagagaguaaagugcagccuucuagaggaucgagugagaucagaaaaagacagugagucaaaggaugagaaaaauggaacagccuacaugguuuacuuuagaucccgggagauuacacgggauuccuugcucgcuggcacagagaaaggucuagaaggacaggauucuguuugucaccucuaaaaugaggguucugaucgccacccuuucuccucugcacucugacuucugaggguaaacauggcagccuacagcaaguacacuugacauuuugguucuuaaaugcaaugauguauuugacuucaagaacccuuucugcuauuaccagcuuucuguccacagcacaugauaucaguaucuuuagagaugugccucagguuuacagccuuggcaaugagaacucagauguccaggguugguaugcuuaggucuguuuaauaaaauccuuugauggaaaaacacauucuacauagccuuauagauucuuuuagauucucuccaccauacaaaaaucaccuaaagugauuugugccaggauauaaaaggcaauauauucaacauuaucuuauugaaaacaaagcagcaaucuccaucucaaaaauuuuuuuugacaacuuaugcauuagucuggcucaauuaguucaaugauuaauuuggcagaaaguacuucugaaacuuagcaccuacuaaggagauugcugugugccagaauuuggggacugaaguauaauucaauggcuaucuaauuuaucuauuuuaagugaacaauucaaguuguucuuucuuccuuucuuucuuucuuucuuucuuucuuucuuucuuucuuucuuucuuucuuucuuucuuucuuucuuucuuucuuuuucuuucuuccuuccuuccuuccuuccuuccuuccuuccuuccuuccuuccuuccuuccuuccuuccuuccuuccuuccuuccuuccuuucuauuuuaaguaaagugacugauuuagaccuucacccaggucaguuuagaauaucuucaccuuugaggcgaucccucaaauucuuaaccuuauucccaagacucagcccuaggcaacuucugagcuacuucuuguugcuacagugcugcaguuucuagaagcucacauaaagcugaagucugauuucuguccauuuaauaugaucugagacccauccaugcuacuaaacaucaguaauuauuccuuacucacaagcaguuuuccacuggauacaaagucuguauuucaguucuauuuuaagccagugugguggugucaguaggaagggucggcacagguucacagauuuaaaugcuuggucaucagggaguggcccuacuuggcaggcauuaagagguaaagccuuguugaaauagguaugcccuuguuggaggaaauaugucacuggggaugggcuuugagguuucaaggucccaagcuagacccagagucucaauuccuguugccuaauacuccagauguaaaacuauuagcaaauucucuagccccaugucuguuugugggcugccaugcuucccacaaugacaguaauggauuaaaccucuuaauguaagcaaauuccaacuaaaugccuucuuuauaagagcugcugcagccauggugucucuucacagcaauaaaaccuugacuaagauagccaaagcagaauuguugggucuuacaguaaugcaguacuuaacauuuaaacagccugccaaacugcuccaaagaggcugugucccuuuuugcuuccaccagaacucccaggauaacuucaacuuucuccacauccucaauaacaccuugguauugacaggcuggaaucaaccaucuugguagauaaggaaaacuuaauguuccuuuagucucuacauugccagugguaaaucuugucaagcaucuuugaauggacaucuuuaccacugucuaugcuuucauucugagucaaguuaaaagaguucuguguaucuguugguuccauggccugguacauaauaaauacuugacaaauauuuguuucaggcuguuuguuggucuuuugcuuucuuaaugggaucuucuaaaggugucuuaguuuggguuuuacugcugugaacagacaccaugaccaaggcaacuuuuauaaaaacauuuaauuggggcuggcguacagguucagagguucaguccacgaucaucaaggugggagcauggcagcauccaggcaggcauggugcaggaggagcuguguguucuacaucuucaucugaaggcugcuagcagaauacuggcuuccaggcacuaggaugagggucuuaaaguccacaccaacagagacauaccuaguccaacaaggccacaccuaguccaacaaggccacaccuaguccaagagagcuacaccuucuaauagugccaagcauauacaucacagaaggacacuuaguuuugaugacauucaacuuaucuuuugucucaaugcucacagcuuuuguuucuuaucuaagcauuauuccgacacccaacauuucauuucuuauuucuagcaaaauucauguuucacuaaaauguucauagguuagcccaaauacuuaugaccauuuuuuuuaaacugcuuuuaauguagaguugauuagggaccaagggccaaaacauauaugugcaaaucuaauuguuucagagcucccuuuggaagaacacccucucucuauugugcugacaugcuugaaagagaucaacugaccacacucacaagacagucuacucguggacuuguucuucugcuccuuuaaacugagcaaugccacacucucuuaacuacuacagcuuuacuuuaagcccugaaagcaagaagaguugagucucucaacuuugcuucucuuuauuguuuagauaaauccacaucauuugcauugccacauaaguuuuagauuuaguuuaucaucaucuauaaaaaauacuucccaaaguuuagaugaagauuauaugagaucuauagaucugauuagaaaaaaaugaucaauacugaauuaguuaccuauuucaugaaugugguacauagggcaacaauauaggucuuuguuucucucaguaggacuauguagcucucagugacuagaucuuacagcucuuagguuaauuucauacuaaacuauuuuauuccuuuugauguuaauacauguaaucaaucuuuguuuucagcauuuagcaauuuauuuuuguaccugugucauauccuguaaccaccaucauuuccugaguguucuaguagcuuuuuuauaccauuaucaggauuuuguagcuauuacgaucugggaguaaaacaaguucuauuuccuucuaauuuucuuaggccuuuaacuccugguuuuugccuugagucauuaagguuuccauuugaaucagcagucagucuagaacacaccaacagcccccacagccuuucuaugaagucugacauuuguaugccacucgcugaugaacaaccacacuuugcuaguacauacugccagugcucaucugcugaaaaccaguuucaaccacacugaauuguauuaugugaucaucauuuaggaggggggaaaaagagaauagaaaagaaaugugcugcuaucuaauaagcaugaaucucauaaacuuaauaacaacccugaccaaauagaauccacggggggcgugcucaaaguggcgaguccucagcugaaggugggcaggcaaucuuuggacucaacacacucaucaaccauaagaaagggcaaaauugaaaaccauagcaugacacgguaaaaccaucacaaaacuuacguaaaauacaagcuaucauuacucguuucauauuucaggccuuugagagcaugguugccuuuaugauaaauacaguucuugcuauauucgagcacaauucuacucacacacaaucuaugggacauagacuaagugccaacaugcaggaagaacaagggcuccaucuacucuuaaaaggcuuucugcccuuagaauaacaaucccuacugauaagccagaaaacaggccuucauauacgagcagcuuccuaaugcacacacaauaagcaauggagcaaaagcaauuacucgaguuucuuuguucgaaaacuccugaauucgguucccucuuucuggagagcacacuucucagcccaaagucccgagccccaaccuucaauugacugcucaggaugccugguauuugguuugguuucugucugucccuggauuuucuaguaguuuagaauccacugcaccaaugaaggaagaauuucucuuccugauuuguuuuguucccaaauaggagcccgaaggcuugcacgccauaauagaaggaugacugugcauaaauaaggugcacaugaaugaaugaauacaaggagcuuggucugggauacauuuccccccgaguuaggaugaaaaacucccaggaagacagaggaagaaaggauaugaagauuucugagugcggcaaucuagauuuuucuuuucuuuuacuucaggggcugucacgggcagcagagaaguugcaagcaagcuguuaaauuguggacccagagcaaagaaagcccuagaaguccuuaccagagaugauucagacugaaauauuuauaacguggguucagaaggcuaagaacgaguggccauguuucugcugaaaaggauucagagugagaaaaauggaaaugggaucaaaaaugcuuuucauuaugucuugaguaaaugcuuaauagauguuuuggauuugguuaauuagaaaggauugcaguaggcuauuuucagaaacaaauacuaaucauaacucuuucugugcuuggggcaauaugcaaaaccuguaacuacaguaagcaaaauaaucccuauaccgaggaacauagccaucauguauggcucuaauucucagcaaaacuacagaagagaaucccccccccccacauacacacacaaaaucuccuuccuauaccauuaaagaaacaucaauuucuuaaauugaucacauauguauaguaaugccuuucaaaguuguaauuagcaaaaccuuagaaacaacuuacaugaccgagagucaaggcauugccaacuaagugcccagagacuguuaucuuuuauuggauaaaguuuuauucaaacaccacugugucugugccugcuuucuugcuauauacuaacgguggguuuaagcaacugccacugaaauuacauauggcccaaaaaacaaaagaucuacugauugcucuuuacaggaagucugccaacacuauaauaauuaagcacauuuaagauaagacaaaauuuuagacaggguuuaaaaaaaagcaagauauguuguuuuauauacaauauaaacaaaauuauguaaaacaagugaaaaguauagaaaggauucccccaagguuuuucccacguucuaaaguggucuuacauuucuuuuauucuaagaaaaugaaguuuuacuauaauuaccacuuuaacucgucucucuggcuugcacacaguagaggugaccacacuaaccugucuccccgacaggagugcugagguggggggggggcggggggaggguggugcagaaaguccuggguaaguaccuugugcucaucccgaaggugaguguccaguuccuccgugugcuuggucucauaguagcagagcuggcauuuguacgguuucaguucauugugcuuuucuauguguugcuggagacucucgucacuggagcaggugaagguacacuuaucacagcggaaaacuacucccugcaaguauuuugacaguuuggaacggcacacuucaauggggacaacucgcucuucuguggaaacaaaucgaauggagagaugggcauuuuuacugauggaaaacagauguucucucuuuggaacguaagaggaaauggacccauucaauucugauacuucccucccugacguucccaaaugacacacaacccuccagcacaacuggguauguggaagaccaaaagcuuuugugcacucaauaccaggcguggugagugauuagauuggggcagguggaaaggcguuagguaguuuccgaaugaagguugguuaagcacggaaguggcugccaucuuuaccaacauuaauaaccacugacgagaucauuuuaauguccuucagcaagugcuaugacggcuggaugccaggugccuuucagggaaggaaauauuaaccuggaaccuguggacuaccacugcguuucacucuccaaugauaccaaggcuagaguuuacucccauuuucagaauaaauaaaaaugaggaacagcauccuacuucuagacuagggauuaaagccagggucccacaaaugaucagcaagcgcgcugucacugagcuaaaucucuagcgaggaacaacccuugaaaauguucuggaguuuuagacagugcaacugacagagccgagaugugaaggcaggcugagcuuguugcuacuuccauuccuguuccccccuugaagacauuuuccaggauguuauucuccaguccugaaagcagggcaucucuacagaacucaauuaaccaguauacuuaacuuacaagugaaagguguuguggguaacauugagggggagguggggguggcuuggaaccauugaagauuugugucuuucuagagaaaucuguaaucugauugccacaagaggagaaaauuccuagcuguaaagagaggacgugggugccuuccccacucccacaccaaaugcuguagggcuggaaaugcaugcguuuguguaguuugcacucucucgcccuuguguuuaacugcucaaauugaauuucacaccagucugcccagaguacuggugcacgugccagauauccauaacugggauaaaauuaaaaucugugcuauauaugcaagaaucaaaaauagcguguguuuucaugcugagucuggauuucagaagacccggaaaguuuacaaauggacgcacaaaacauauacuuauauuauuuagagacagcaauguauuauuaagucaggaaagcaugauuuucuucccagagacacugaguagcggcguuagucuuuugcaugcggaugcugcugccucuuccagccuucccuuuguuauuggcugcacucggacccaagggaacuccccccacccaacaucaugucuucaucugaaccacaacauucuaacugcagggcacucacugccuuggagcccugaauguagcgccucaucggccagcaagaugcugggcacagaaagcguuaaggguggugucuggaacauacuccccagagaucuaaugcauauguuauuuucccuauacaaagagucaguugcuuauuuagaaauauaaauauuuuuaaaaccaaaguacagcagacagcuaagaaacacaugauuaugaaguaaucugcacauuuucuuagaauagcaaauguuuaacagccuucuaagccauucaguuccaugguuugguguaaacggagggggaaaugccuuggcaugaauuaguuagccugaaggaguccauucuagaacguucuacuacucucuacgccuggauuucucaaaacaguagcaugacugacaucuggaggcuagacaguucuuuguugcaggcacuguccugugaacuguagcaugcuuaacaacuucuuuggucuucacucaccagauucuucuagcacucauuccuaugacaccccagaaugcuugcaggguagugcacucuggggaggcuggaagaaccgguugagaacaaucacauucagcaaugguaggcaugaacuacaguggcucagacuagguaaaccuaagagccuaaucugcugcccggcuuggagugguagccguagucccagggacacugcacacugagguuguccuucauggaaagggcugccaugaucacuuuuggcacuuccaugaggcuauggcccuccgcucuccuccucacuugucccugauuuauuuugucaucuuuacugcuucucuuuuauucucuggcucuggccuggcccaucugcccuagaucugucaaccucagcggagaugaagaacagcugggcacacuuuuccaagcaacaaugccucaaaugccacgaggacagcuauucagcugcucaacagucuguugcccgaagucaauaaaugguucuccccaaccccccuuucuaugcauucaccacuuccauuccucuaccacauugguuagcuuucuuugcaguuucuaauuucaugaugcaucauuaagaauuuuacccaaagaucuaaggccucaaagucauggccugaaguucaaaugcuaauagcaauaauagcuaauacauggcuuuacaauugauuaaaagcuugcuaugaggugaggucuauuaacuguuauaguucuguauauugagacaucagugauuauuauuauuaucauuugaagaugucuguacaaucuuccacacacaauaaauaaauguaauuuuaaaaauuaaaaaaaaauucaagauuuuucauuuccagucuaauauaugagcuaagguagaccaaaucucuucuuuauuuaaauguauacuaucauuaccuaccaaguuagacuggaaugcuccaggcaugaacugaauccugccuuggcuauaaaaguucacauuuauaugagcacccuaguagcaugggucuuuccugauuuuacaccucucaaaauuacccuggguaagaaguguuugugacucagcacgcagggaagguaaaaaaaaaaaaaaagggaucaccaguucacaaccaacugaugguuuaucaguuucaucuccuccuacucaacugguacucacugcuacaggggaacaugacacuggaggggcaggacuucagagucaucacugaagcaccugugcccuaagguguauugaaagcagugcuggguaugcugcuguguuagcauggaacccauuagaaaaggcugcagcagugccaacuacuaagggucauuucuuagcaagaagccacaugacuguggagccccgagucaccagauaagaacuccucuggaaaggaaacugcaacauacuagaguuuccuuccaagaauaccaagucuuaaaugaggcagcagaagaacuggaauuccuugaccccagcaaucuuugcuugcaaggcaucaacccagaaggcugagcucaaagacccauuuacuacuugcuguuggauaacugagugauaaagguuaaagacuggagaaaaccauuaaggaaaccacauuaguccaauaugggggcacuugggaaauagaggcaggagaguuugagacuagccuaggcaagguaguauguuuuaggucagguuggguuacauaagacccuaucucaaaaugcucuguugaggaagaggagaaauuggaggaauaggaagaggguaagaaggaaaagaaaaaggcauuauuaucuuucaaaccccccuaacauaaaacuauaaauagauauguaagcacaagcaaccaucuccugguaagagcuauuaaguuuugacauuagcagguuucuagggagagcugagaacaggcagucccucucucacagguaaggguacugaugggauuucacaaaaucaaaauaagucagucuuauugauuuucucuccugaaaucaaacugccccuaaccagacacauuagggggaaugucuuccauucaggaugcccuccuucaagacuuagccucagucaggauuugucuacuaaagcaggaaacagacccuugaaguuaacaugccaacuggagagcaaccacagugguuacacagcuacauaaucacaauguaaauauuuaucgaaaaggcuucagcccugcgauucaaucugcacccaaauuuucaggcguguuguauaggaacaaggcccaguugggcaagcuguaugugagcucuacgcuuccaaugguuguauacucacagucacaaucgagaagcuuccauuaaugcucaacuucccucagagaacaaacuuuucugucucuucauggcugaacugcacuauaucuucaaacaccagcaggcaugcugcacauccauugcucaaaugaaaacuuacccaaaguccuaccaaaugaguucaggaaacaaacguccaaguuagacuuauuauaucuuaccagauguugacaucuaaacccauaagaaagagauagaucuaaugauccuuugcuucaaccuugguuaaauucuuauuuaguaggugucuuaccuguagucugauuuaauuuuuuccccuuggcuuucuauguauuuacuaaggaaaggucaaauuucugaaucgucucuaaaaacacacauucuuugcagguaccuggaauagucugaugucaugcugcaaauaggucuugccuccaguggccucaguuguuuacuaagagauuacucccacucugcagugguugauagugucccccaauuuauguccacuuggaacuucauuaugugacgauugggauacaguuugggggauguaauuaaaaugagcaaggucauauuagauuacagcuggccuaaaauucaaugccugguauuuuuguaagagaaaucacaaaaaggaacacagauaacuggcaacgaggcugcaagaaggcggcagagguuggauggcugccacuauaagcuaaggauaucaaagcaugcccagagucuaggauaugagaagaaaucaaaggguaaguagguaggugaucuaccacugaauucuauuccccucuccccaucaagcguggguuuucuugaaguuuuagaugauacacaggcaucaucugaagaggcugacaauucuagccucuagagcucacaucauuuaaagccaaugaguugguagauguggauuucaguaaacuuagaaagagacuaaaguccaucugaagucuucuuugucugcugccagggcucaguuugagagccaccuuucugaauaggacuccuagacacccaucacgcacugucuuggauauacucugcauguguucaucuugaggaggucaaguauggguuuccuauaccucaucauacauaaugcugucauaacagagugcagcaaguuacaaacaaaugacggguguuuucggaacucaggaaccaauaguaugcucccuuugccaugggaguucauacccuugacuaauucucaucagacuuccaugggauggauucuucuccccucauuccuuccuuaaacacaucacucugucccaacaaagagauggcaacuguccuugccaggagcagcucuguuucagggccaguucagaguuguuuuucuugucuuucaucccaagguuuuuaauuaacugaggccucagaaacaucucaugcucuagacucuggagaccaaagauguuuauucaucugaagcaggcagugcacaggugcagaagccucaucucauuacgcugggaucagccccagugcugaucugcaaggcagacauuugaccacaucgauaagaccaggcuuucucuguccugccuugaaguggcgauggccaucagaggcagaagucuguagaaacuuagggcccucuggcaccuguggauugggguccucaucuuugaucuccagcccuacaaaaacuucucuccuuacacccaacauucacagacucuggaacacugagcaggguggcggcagcuuccccaggguaagagagugaugccagggauucaaagcaugggcugugggucacacacaccuggguuccaauccuagccuguuacccaagaguccuuggaccguagggaaguacucaguuuuucugaaccuguuuuuguuguuugucaucaggaaugauagucauaccuaccaugcuggauuuaguacauuuauuguaaagcacucacgccaguaaacacuaauaaugguagcuacaguuaguagugucgccacugaucuuuaacugcacauauuuggaucauauuucuagguuggugaguacaauauucacauauccacagaacaaguggauggaagaggauugccauaugaccaaugacacaugaugggaucagaccaaacaacagaauacugggcugacucaucaucacccgaugacucugguuaaguuacuacagcucuccaugaccccauggaauagacugaacaccucuucaucuauacaaccggaaacccaaaacuuuaccagcaucaaugugauuggcuaaaggauauucguuugauggucuacaucaauauuucaaaaucugaacacuuuggaacucugaaacacuucuggucuccaucauuucauguuaugggauggucaauauacacuguagcaucccugucugauucauuguagagauuccuucuagacuucagugucugaauugugggaaauugcuuaauaaauaccccaaagccaauugauucuguuuucuucucucucucucacggaaggcaaagauuccaagaccuaaucugagggcauggcuaugaaagacggagaucuuguggauucaaggcaucuccacacuggugcugagaucauugcaauuguuggcugcucuuucuaccggccucacuuucuuucaccuuugccuccaauucuucauuuguuuuuaauguaacagugcugcaggaaugacacugagcuacguuaaauccuucgugaaaugaagcagagcuccaauaaauuaaauacgcugaauuaaaaaagcagaaaggauacagacaagcaaccccaccccccauagucuuucucagcuuugggcuuccuauucacaaaacaggaggccaugggauggggcuguugcuugugugcugcgggugaggcgacuggcugcaggcaacuagcugcagggagcucuuugucaaggguuccuggccucugugcagaaucacucuaccucucucuuccucaagucucagcccagacaaggaaagucauugagcuugucagccgucaaagcucugaucccaccgggcgucaauauggggaaugacugcagccaguguggauuugccacagccagagaugacucgccauugauguuuucugggcaccggcuccacugauggccuccacccaagcugggauggggcgcacagcuuuggcaacacacgggcuaggggaucagaagccaggugagagaggcaaaacaccaggcaggaagccgagggccaagaaccccugccuacauacugcugcuccgcuuuugccuggcucacaggugguuggcuuagccagcuaccaucaucucucaucucauuagauugccacgggagaaggaaacagagcacugugaauguuggguuuucugugagauuugggcagacauaggcacaucacaggcaugcuggcgaaagauaguaguucuggggaaggguaagcuacuuuauaaaugccuccacacuggcgucuaagggacaccucagcaggacaggagaugacacacuggcaucuaagggacaccucagcaggacagaagaugauacaugcuguuuugcgcauauguggcaaauccucgaaagcuuuccaagguuagaggcaaaaaaaaaaaaaaagaugaugagaaaaaaaaagaggaagaaaggaagaaugggaaggagggagaugcaaagaacagcagaccgcacugcaaccaagacuggcagugggcgugccgggaaccuuucuccacccaccugcaggagggucuuuuggacaaaaugguuaucaacaugcuuucuuccgauacgaagauguuuuaauuggacaaaaguaagcuauaauaauaauaauaauaguucaagcaggccaauccaggacugucuauaaucccagcaacuucaagaaauuacugaggcagguggauuuugaguuuaaagccaacuugagcuugagagauccugacucaaaaaaaaaaacaaaaacaaaaaaaaacccaaagugaaacaaacaacaaauggaaacaaacaaguguucucacggggaucccugcauaucagugggggugcacauucaaggacucgccauuguguaucccuaaugggaccccaccagcuacuaucucacaugaacguccuauucuuguauuacagagcacgauccaaaccagaacaauccagagccuaaucuacagguauucuguccagcaguccacuucugccugucgcaacucuuucuccuuguccauuucaaagcaaauccuacuuugugcuuugggaaucacaauuucugucuuuguuucucccgccauccugccccaggcucacccuauauaucucuaggguggcaagggauucaaaaugggaaauuccugacucuccacgcccucuuggccuccuccugggaggaauucuacugacaggaaggugucuuauccaugggauaucaauggcugucacugugaccuuugccuacaggaacagaggucaaggaagagagcaauccugcugugggacccagggaacagccucaaaaugcugaggcacuaaccaacucccagcagcagcagcagcacuacgaaccucccucccaccaggaccccaaaaaagggagucagucugaagauuaccucggugcagcacuauguggucgaucauguugcguuuguauuuggugugauagaggcagagaggacagcggagaucuuuggggccuuccuccgggaccgccgaaugcccagcuuccacgugcauaguaaaagcagaucuaagagagaagagacagagaccaugacagucacugagauguccucuccugcugcacgccccucacagguggcucuccugcuugacaagcauaaacuaaagcugcugucagucauauuugcugacugcaugcuccuuggccaucaaggaacagagaggggagauacagaggcaacuacucagaaccuuugccacucggcuaggauuauguaaaaagaaauaaauauccuacauacuucauuuuugacaauuagaaauugccuauuaagccaaguacggucuagaaacaucagcuacuccuaaggcugagguuggaggaucgcgugauuaaacgguagaucuuuucuuuuuuuuuuaaagugaaaaggaacugguuagagaaauguugucaaagggaacauguuuuuaucucagagaauauucccuucuugugugugugugaucugaaauaaaaacacaccccaucagggcauuccuuugcuacaaucucacacuguuucgaagaccacacgcucugacuuuuaagauaauuuguucuuauguaacucuucacccccccuuccagaguccccagcuaguuuuucugaaacuagcuucauucugugaagacugaccccacccuucuuauucuacacuggcagagaauuucuggagcugaaggcagggaagagagaguggugaaggcuggagcacgggcagccauuuagguuuuaggaaggccuuccucacaccacuuacuuaaagccgguguaaaaggagcagucuuugcauuugaaaagcuucuucccaccgugcuugucccgguaauggcgccugaugcucuggauguagccagaggagaauucacagaauucgcagugaagaacggcuucugccuucuguuccgugccagcagcagucccagaaggaggcacagggcuaacgcggcucuuguuucuugccagggcggcugacugguagugauucagcugcugcugaacaucggggggcuccgaguaagaggagucuguggaaagacagggacagugaagugagcuggaccacagagggcacaggagugugugugugucugcaggggaugggggcggguggaggggugaugcuugccuggaagcccuuuacugcacagucuccccugccacuucuauuaagacauuaucggcaaaauagaacaaaaacaacccacuggagcugaggagcuggcucaguuggcagcguguuuccaucccagcaccugcccacagcauagcaggcugaugaucccggugcuggggaagugaggcaggaggauaccuggagcuacugaccagccagucuagucaaauccugucucaaaaaaaucaagguggacagcaacugaggaagauaagagaugcugaccauguaaugugcacaugaugcaauguagcaucaugugcacauuuacauauguacacagcucacaccaugugugaaacuaucugugaucaaauucaucaacucacccucucugucagucacauggcuaguguucucuggugugcggugggcacacuuaagaucuuagaucccaagagcauuauccagcacuaauguugguaccuguuguguacagaaccucuccuccccucaccacuugcuaccuuccaccugaagguuugucuccaucaucuggucaguuuuuaagggggaaauacaucacucaccaucauuccacuacuuaaccaagagcugaggaacacauggagagugagaacagacuaccacagaacacccauccgcauagagugcaacaaaugaaccagcaugguccauacagacgucuacacgggaaggggcuaggugaugccacagcccccucccccucccugcauccuagaauucuucacaccauuauuuaaaaaaaagaagucagucuuuaacaugagugcucuggcacacgguacacccacacauacaaaaauguuuuauggcuuuggagucaagagauuuaaauuuuaaaauauaaaaauccgauaguguucuccuggaagagccguuuaaagcuuagcauuaagauggagauuuauucacaaaucccauuaaaaugaaauuccaaacaaguuucucggaaagguauuuuuaagugugcaguuucagaggggacaugauggaauggauggcaggaacuauaaacccaggaacuuucauggcaaguccuggugaaaugggauggggagugggcaggggggaggcaccuuugcaugcuccuugggcuuugguggcccaaauucagcaacauaguccuaucuaagcuggcacugccugugaagcuaggaagccugugaacgacccuguagaauuucagaguaacuuuccuugggauaaaaacaccuccuccguaagcaaacagggguggggugggggugggaccagacauuguacaagccuucucuagauuugacagacaccucauuuucuaaagcgcggcucccccaggcggggcacggacuuaauguuguaaaacuaauacuugaucaaaccaguaucaaucaucuucccguuggaaaugcagugagggagauucccugacugcaagggauguaaccagcaccccaucccaugcccaucaaaauacuaaguaaggugccuucacuucagcuccugguugcccugccuguccaaugcauauucuuuacuaaaacaaaaggaaaggugaucaaucucugcaagccucccuggguucaucaccagguguacaugggagacaaaggaagaaaggaaagacacagcgggugggugcauucucacuuucuguaucuccauccucucuucuguuccucuaccuucugcugaggagcccacccaggacggcaauccugccuuugucuacuucuccuucuuuccuucacuagcaggguugguuaucaucucuaauuguuuaagauggucucuguugaggcucaaagacccaguuauaccacacacucacagagaagcaacacuccaccucuccugggaacagaguuccaguguccccagaacugcuguccucuugauagaggugcccuccucugcacucucagcguuguggcauagcuuuucugaaaguaacaggucaaagccaagccuugcugaaggagaacuguuccucacccacaaauccacgcagagaacaaagcaaauguccuaaaggaagguccauacccuucuacuaagugguuuguagcucccucaagaaauggcgcucaucuaguuaaaucccuccccagcaaagcuguaaagcaauacauauuccuagaugggcauuaagcagggcaaccccuuuccuccccugccacucacccaacccagacucacguaccugcggauuagguagaacccuguagaaacauggccccuuuuggugaacccucuuuguuguuguuucuagacucuacugcagguuaucccagccaucauaaaaacaaaccaaaagcaaaauaaaacccagcccaaauucuaaaacguaaguuuguguguuauaugaaacucaaaggaaaaaugcaagacgucucagcagaacauuucaagaaacuagacucaacaaugcaaaagaaacagcugccgcuacccauucucgcgcucagcaccuucucucccguccugguuaaaauuagggcaaguaaacucacacaaaaaaaagcaaaucccagcagcuaugacacaucuguaacaguucccagggcagcaacccacuuugugggaccuuucagagcuuggcuuucucccaggugccggcagccacccccguguuuguaaauaauguaacucucugagcacuguccucuaauccacugaucucggaaaggaaggcuugcuaagcaagagaagauuccagugagcuaauggauugcagcccugagaccaagaagagcugcuugcaccaguuaagaggcagggacaggcuaugaguucaaaguuagccuaguuuacacagugaauuccaggguagccagacuaaguagugagauucugccuuaaaauaaugagguacaugauagagcacucucacacaacaaucuaaaauuccucucucugaagagaaaggcacacauauucaaauggagggcuagugcuuggaagcaggugagguucuaggacagcaggagaauucaaagcaggaaaagaccaccuucuuucuaaagguuccuucccagcccuuucugguuuacuggguucuuagcaauaaaccacuuggagauuucuuguucauucuagauccucuggaaugcuagccaggugugucagucuucuggauuuucaguuuucuuuacccuccaaacauuaaccauugcagaaacaacgacgagaaacuuuucacaagggccaagagaagaaagguaaacucaagaacaaugucccuggaagaaggagccuuuugauggauccacggugcugagcaugcauguguuagcacuaucuuggggccaggaucuguugcuggcucuggggacucaagaccaaggaagucauaaaguguaucuucuagcaccucagaucuguuaaagaagggugcuggcagucgauuguuaggaaaacacagaccuucacagcuccaaaacucauucuacugacugaagcauuaaaaggggcaaagaaaacaaauggagagucacagagagcggggaggcugaggcuagagaagagcaggaauuaguggggcaggcagaggacgguccuccuguggcugcugagugacacagaauagugccaauggaaggcaagucucaauuuucuccaacuccacgaagaagcugggagggacaggcuaggguagugugcaaccacauucaguuauaauguaaguuggguuuguaugcagacuuggaagacaggcucaacgguuagugggaaucaaauaucaggaaaaauaaggacaaaagaauuuuuagguaaguccauuucuacaguggacagagggcaaaggauuauucaucagcaaauauuuacugagcauccaaguaaacaggagacuuguuccgggacaguaagacuugauccuuguguucaagcaacucauugucuaagaaaauacauauaagugauugauuaugauacaaugcaaacaauuggacacuuuucagagacaacugcaaaaaggcagaggggaagagggacagucagcaucauuuagugauugauugugagagcaagggagauggagcaggccugucgagagugccccaaguauccauuaauaaauaugacugguauuaauuacugugcuaauuaaugagaucaagauaagaccagcagaugcugaguguuucgugcaccccagcucuaucuaauuuacaucauacguuuggagauaaguaaagagaacuuuagacaacuacacucuuacaauggaaaaaagccaacaugacgggcuugagagaaagcuuggggguaaagaguaugaacugcuacagcagaggagccaagucugguucccaguacccacgucuaacuccuagacaccuagcucccugaaauccaguacccucuucuggccucucaaguacaaguacucaauuucacauaaccacagagaagcacgcgcacacacacacacacacacacacacacacacacacaccauacacacacacagauaugcaauuaaaaauaaaaacaugggguuggaaauggagagauggaucaccagucaagagcccuugguuguucuuacagagagaggaucugagugcaugucccaggacucagaguggguagcucccaacacacacauaaagucacagaugcacauaaauagaaauaaauauuagaaauaagucuuuuuuuuuaauguggaugagaacaaggagaguggaucuagacagagaagcccaagcagcagaaaggaggagguauauguugggaaaacaaaccgguaaaaccucgaaguucaacaacaguauaaaacuucccaacagccacgagugccaacguaccccuguaaccccaucuccacucaggaggcagaagcaugaggauugcuacaaguucagggccaaccuuguuuaugcacugaucacacagcaagaucaccuugcacaaaaccaaaaggagggcuugguuauaauaagacguggauuauaauuuucuucagaaaagcagaugauucaucagcaaaggguugguuaaacacagguguagauauccaaaacaggguggggaaugaaaagguaaaauugagauacacagaaacaugguuucacucucucuggcuaggaaaugauggaaauuuagaaaggcucacuaaagagagcagcuaaagacauaguguaguuggcaguauguguaugucaacaauguccuaggaaucuggagugaacagagaauucuguugccuugggaaagaaucacaaugcuccuuugggaugaugacaucagucuuucaucuacagcuggguccaggggaugccuccaaccacucaguauacuagaaaccagcuaccucaaauucuuccuccugcauuuugaacgucaguggacggcuccugcuuucuuucacacuggagguguaaccaugcacuagacaaaagucucauggucuaccaucagcacugcuuccucucuaucccaugccuucucacucacagaucucuugggucuuuauauucuacaaguacucccuguuccgauucccuccaagaccuagucauguaugucauugaugcugguccuuggucaggccaaguuacucgguguucugcaauuccacccagcguuccaaacucuguugggagucaccuccuuugugaaauccaaaugagacaaugggccaccuccaauccagauggacuuucuguucaacucuucccgacaacaccuacacaucuacaguucucuucaggaccacauugcacccuguauuacauuaagcccucuuaagcagcagcacacuugggaagaccaaggcuacaaaaaccugcaacugccccacuuuauggagguauuuccucaauugagguuucugacucucagaugacccaagcuuguaucaaguugacauaaaaacuagucagcacagucauguaaaacagaggccaagagauacacuguauagcauguaauguaguuaauaggaugauuaguauuuagaauuggguaggaggguguauguuuuaugucauguuauuuuguguuuugguuuccuguguagcccuggcugucuuggaacucagucuguagaccacgguggccuugaacucacagcgaccugccugccucugccuccagaaugcugggauuaagggcaugaaccacacuguccggcucuauggcugucuuuacaauguuccaguguguuugcacaggucaucuguuagauuuacuuaaucgcgguauuuaagaaaaaaaauuuuaauuaaaaaaaaaggaaaauauaugcuggguugauuuugugaacaacuguggcuauuaaagcacacagguguuucuauauuuauuuacaaugugauauauaccaugggggcaaggcuucuuauuugcucuuggcuccccagcaagaaggccaagcauacacaagugucuggaaaaguacauaagaaaauaguugcuagacugaauuuauaagaaaaaaaaucacauguauaaauacacacccagaauacccauacccucccccccacacacauuacuuagugucgugguaugaauaagaauggcacccauagguucagauauuugaaugcuuggucauuaaguaguggcgugacauuagaggacuuagaagguauggccugguuagaggaauucuguuauugugggcuuugagguuucaaaugcucaagccaggcccagugucucuauuuccugauguuugugaaucuggaugcagaacccucagguccuucuccagcaccuuguaugccugugggccacccugcuuccccccacacugauggugucucaugcuuacagucucucuccacaaucgaagacuggcuaagauacugaguauguagcuuagagcuaucaagaaaauccauggacuucaauacaucucauuauuuuaaaagauuucuggcccucugucuagguuccuuuguaccucaacucuacucucuuucucaagauacuugcuguacaagaaaacuggcaugcagacuuacaguaaaaacuacagguggucuguauaacuuuccacuuaauuccucugaagaugcuguuucuauaggacauugcaaaagaaaacuguguaggaaaugaagcuuucagacacaugccaucucaauucuggaucaugucugugguggagcauaaaucucuagggacgguuacauuauuuuauuuccuccuuuugauuuugucuugagaaucuccaggccaaggacucuggcaccucccugucuucuaucaucaguggaguucucuggccugggcgcauaagauuaugauacaauggccagaggaacaauggaugcuggaugacuauauauaggaauucuaggcuugguugucauggaaacaaacggaaaaacaaacaccucauccugaaaauaagucugaguccagacuuggaggaaacagacucugaaaacuuccugucauucugaugaguaaaaacaaaaccuugaaaucugaucagggaguggaugagggggaaaucacaaacaauauaaaacguccuagucuucaaauccacagaagccgacaaaacacgggcauuuucucucucugagaugcauuugccaucauacuuuagcccuuugaaagcgucuuucagaggcuuaacucugcaugagcuucaggcugucucucucucaguacaugggggaaucugggccaggcugagcuaagucaagaagacaucuuauuuuccuguucauuuggccuuaauuaaaaggcccacucgucuuccuguaucuuucaacccaauggcaucagcaaucaccaagucacggaggucagagaacucuugauugauucauuuucuucuuuuuugucuaugcauaagccaaacccucuggaagguucuuugcagucuacucaggagcccacggucgcugcccauguucacgcucucucaguuguucacauaauccuagcagaccuauucccccaugcuucccccacuuggggucauuucuauuauaauauacaagugugaccacaacagccaccccaugccagaaaacauccccacugcacauccucaugguucccauacuguauuuaacaccagccaccaaagcugcuuaggcauuucauccuggaaauacuuuaagucagucaaacugaacucaauucaaaucugcugucaccaggaagauucccuuugauucuucuggauucauccuuacuccauuccccucuggaucuuuucuaccaggacucaggaugccauacagagauuaacuuacuuagcccggcacaccuuucaaagcgcauccgugcaucaaucuaucugcuacucccauuuugcaaguugaccucccuuggaacuuugcucagggccuauccuaaaacaagagccuaauacaugugccauaaauauccggaguucaaacugcaaacauggaugggucugcaaaacugagauuuaaaaagcaaaauccaauuggccaaaugccacucccauuuuggaugccaguuuaauagagccuucccacugaaacacugaccuacuuucccugaaaugagcuuagaucuuaauuacaagaacaaugguuucuagacacuggaauuugaaugggaaggaauucagaagccacagccauucuaagaugccaaaggcacucauuuuuggcccuaccucgaaaucagcuguaagcuaccacuguaaaauagagggugcuggaacaucuggaagccacuugagguaaugccaugugcagcauccuugccuuccuuuuuaugcagccaguggcagacacagauguucaugagaucgaggucuucagcuguauacgagucacgcccauugaauacacagucaacacccacucacacacaguagaacacuuugcagcccaugacaaaguauccccgaucaccucuggacauuuccccugcauaacauuguccaccaucaggagugugcuuuccuccuagauggguaguaaacaggucauucaccuuacauaagggcuuagggcagcucggaaaagcuuggaggguuucaaguuaggcacacacucaguggagaagcagcaaccuaaccugcggcuucuguguggcccaguuuuuaaagugucuuuuucccccucccgccacagucauuuagauacacucuucacuagaugguauucacaacucaaagacucuauucuuuacagccuuccuugaaacaggcugggaauuugcaggaaagcaaaugaaugcuaggggaaugggacuuuuuccuaagcuucccccaacccccuuucuuuaaggaaacucuggguggcaucugccauuguuaauugagagguucuuacaauaccaaaugcauaauucaccugugacucuuuugaauugugugaugaggaaguaauguuuccugcuguucgguuagauccuauagaugucuuuaccacccugaauuauccaacaaaaagcccagaguacaaaggcuccuuucuagaaaugacuuggccugcucuacagagugcucccgaguaaccucagaagguauuuagagcucacaggccgugggugaaaccaugguucuuccucaagaccugccuugaggggagaugccuacugacuucaaggagcuggucacaguguauguaaggcuggcuccaagccgagcugugugagccagacaggaaacuauuguggagauugcuuaaaagaugaaucaggaagaaagcgcaucuggucuaagcacauauauuuagaggcauguagugcucuaaggauguauggaaaucaggugagaagggugacgucugaucaagaacagggaugagcagucacacuucaaagcacaaagcuauucuaaaaccguccccaagccggagucucugaaccaacgaacccaguggguuucuuacuccuuuauuccuuuauuuccacuuauucucaugcagugggaagaaaauccucacucuggguuaagcuauauuuuuaaucaccacuaaagcaguagguucuccccuuaggauaugacaguuccaccacccacuucaagcuuaccgagaggagcucacugcucagugaagcugccuaggguguguaauauaagcccccccccccaaaucuggagggcucagcgagugagacagagauucaccugguacuggcucuguccgguaugucugauagucucucgauaaacuucacuaugaccauauagaacuauuaccuuccauuuuauagaugagaaaacugaggggggaauaagagcuagacaauacucccuuauuuaaagcaugcuuguaagucucucauagcccaggagacuucaaccaagcagacuucuugaucuuccauuugucaaugggagauaauaucggucaaguuagugucauagcaugugaaggacagugucuauuacauaggaaugccucuaaaaccuuccacaucaauuaaaacccacaucauauaaacuuuucauugaauaagaguauuccagccaaguugggcuuggugacacacaccuuuaaucccagcacucaaaaggcccaggcaggggcaucucugugaguuugaggccagcaugcucuacagaguuccaggauagucaaggauguuaaagagauaaaccuuggaacuuggccacuuuaacugaacuacacugacugaguggcaaucucucacacugcaauaaugauaggacagggcagucauuccaucucuacacacaagguagaugcucacaguucccuuuugguugacuaucucuacacaagucuaaauucauggcuacugcuagcuucacuaauacguuggacguagagaugguuaaaguagagaggggucaacugugggaggggccugggucuagaucaaagguagagcucaaugcaaacaauacagauagagugguuacccucauacacacacagaauggucauauaccagcuugugaaaacaggcuuguccgagcacauacaucuaauucccaaauugcagugguuuuccuggcaaauauucugggauucauuuccucuugcucucuuucaaacuuauuugcauuuggaacagaguuguugauguccaguuuauagguguggcuugucacuuuguggacucuuucgcagucauuuugcuagguuucuuucaacagcauuuguguuccucccugaugucugugaggggcggugucauaaacgucuagguuugaauuuggacuuugggguuuuacucuaugacugaggagggcauccuugauccccugggaacaucuggcuuagccugaauugcuucccaggacuacuugucccgagaagucugucuagucuucuuuuaagcuguuuaaguccacaaagcaagugaaagagcaagcaaguaaagaaggccauccagaccgagcaacauggucacagucuacaaugugggucucaaauagacaaggcgauaggaguugucuguagcucaguauacaagcaugaagguaugauagagagugaccauauaagaacuuucuaugcugaccuggaaauuauuuugaaaacaaaguauacagucauuggaaggcuugaaacagggcaggcaagaauagaagucuuacguuuuaaccauuuccaugucuagaaguuguagcauagucaugcccaaacaagugaggaaggcagagcuugccuuaaauggacuccccaucccuacugauggcacaggcaaccccagacuccacgcucuguuaaguagaauccacuacuguuucucaucuggacuuuacuagcguguuagaccugcucauuugaaacucagucccuauugccaugcacaucuggaaucgauuacaggccuacgaagggaaagggaaaaaggcaacucacgugucugccucuucugcuuccuacucacccaucaugugcaaacaguaagaacucucucucagguuaacaggggaaaucacugaucacacaugcagugcgaaggaaacaaacacccugagccucugugaccugcuuuguugaaaaugucuggagcuuuggagacucaugagugugugugcgcgcgcuugcucgcgcgcgcgcacacacacgcgcacacacacacacacacacacacaaccuugauucaaugcuuuguacuuuuggauuguggaacauaaaugguuuuuauuuuauauucauaggaggauaucuacuccaggaagagguggcuuuaugucaguuauuuagaauagaaagaugauaaaaaccuuugcuacuaaugaguucccuucagguaauauuauagagauagcagaagaagccaaaaggaagggcaaagaaccgucagauuggagaggaagagaauggauuagaagacugaugcucauuccuguugauagaaggagaggcaugggcagccgacagaagaaagcagccuggaguuggagugagugggugaggaggguccuggguccuacagcuuuugauuaugccaugaagagcuuuaaugauuuauagaggaugacagaaaucagucuugcugagaagagacugaaucaaggugggauggugauggcugagguaagaagagaugaacugggauggucauaggggagguuagaagcgaugaugagguaggcaaccgauggaaaacaggucagaaaaugaugaccagagaugaagaagaacucuugaugauucccaaaaguucuggaccaguuugggaugugacugcuaugucagacucuagaacuuuggaggagagugaaucccacagguggagcaagugaggagugaacagcagagccugggccucacucugauaaaaccucacucugaggggagagaaaguugcauuauugagcgagcuugugacuggcaaaggcagagcacagccaggcucuguaaaugguggaggcagaaaugaugacgacaacaagaucaagggaagcucucauuugagagccagaggagagccugagacaggcaaaaacaaaacaaaacaaaaccaaaaacaaacugaggaaggaggguuugccuagaagaaagaucagugguuuuaaauggcauagaccaauaaggacuuggagagagcagaaacaagagacuuguuuguugggaccagugugcacccacugaaacagagggaugaaccaggagguaaacuguaagaggucagggcucuuucccuggugaauguugcuagagucagucaguuaaggaaagcuguuccauaaaacauugaaagaacaugggaugcuaguuuuaggcaagaaagacaaacuggcaaggaaugaagcgcaggaauagugcuccuuucaaaauacacggaugacagauacuauaguuacaagaacagacuugcagaagguagucuuaaaaauggcuuuaggaucucaaacacauaguaccuuucuagggcucauggugguagcuuuccuagacucuuuagggaaaacuggcacaucuacaaagagguuuaugaaaaugguacagcagggugugaugguccaugcauuuaauccuaccuagcacaugggaggcagaggcaggcaggucucugcuaguuagaggccagcauagucuacauauugaguucuuaagccuguuaggucuacauagucggacccugguuuuguuuguuuguuuuugcuuuuuguuuuuuaaagaaaacagagugaccuggacaaccagcugugguaucaccacacugccagcacuauacgcaacaaacacuauagguauuaacaacucaugcacacugguuuuauuaaauucuuucuuucaucaugaaauagcagggaccugguugaaauaguuccuguuucaugggacuguuguguagagaaacaauucccacuguuuguauggguaaauaauaauagguaugaauuacaauauguauuaauaacugaccagaauacuaggaauugaccagucagauauucggacuuaguauuccauugguccaucugugacacuaaaugcuaaagaguuucuaauagagguuuccauuaagccccaaagcucaaauuuauaucaacugggugccaguaucagggguacugaauuauuuuaaauucccaagaaaacaaaguaaagaaacuuuauuucagauuccaagguaagacauggguuuuggaggaaucucuccacacacacacacacacacacacacacacacacacacacacacacacacccuuuuauuaaaaaaaaucacuauucuuugaccaguguuaaauuaucaugaauuguuuaggauauuuacuucaacuauauacuaccuuaauaauaucuaguauuuuuacaaucauguuagauauuggagcauguccauccuaccucauuugauccucgaaaugaccuuaguggacaucauuauuucacauaguuuaggaaagcaaggcucagagauugaaggcuaacagugugugcuaaggaucuuggcaggacccccaccuaagagugcacauugcauuacagcaugaaugguauuuccuggacccaaaucugcagcagcccuccagcacugcccaaacccgguuaucugagucaauguggucuacacggagaacucauuucaaaauuaucauuugccuaauuuucaguagcucuaguagaaugagaaugaucuuuguuggcacuggcucuaucaaaaacaaauccagugacacacagugagggguauacuccacgccaguacugcuacaucacuccaaaauuccaccaaaaagcaacuguuaugaggcagggaccgaggcucuguuuggaugcuugagaaugaaugccugauuggcaccacagcaaccaagaaugaauaucugggguggaacuuuggaucgacaucagaugucuugauguaaugauccugaugaccuucacuucccuccuuuaggcaggaagcucagggguagcacgcaagcucccccaucccccgcagucugcgagugggcucugaggaacugcggcucugaacaguucuuuuacgugacguguucagucaccuccugaggcugagaaccuaaggaacucccaaaacuucucuuccuguuacuaugccuucucugaauuucaaaaaugacaaauacauaugcaaauagcccaucagucugaucgugcacacagucacuacuuuucuggccaacaguuuccaguccucuuuccuggcagguaacauguauguccucaacacaugccuggguaugugggggggucauacucacggcaagcaaaggucacaaaaguagagauaugcaagaaugaagccuuucaaaaauaauaaccaaaauacuuauuuuaaaauagcaaucuuuuauuugaauauugaauuggaucuuuuaacgaaucaguguuuuguagcuggggguguuggcucauaccuguaauccuagcaccugggaggcuaacgccagauuauauaaaauuacauccagcaugcauggacuauguauguacaaugaacacauauaauuaaacaauucaaggaugauuuuggcuauggaaggaacaccuauaucaaaaauuaaaacacagucauuaagaauaauaacagcaaaaagagcuauauucuuuucaggguuccauuaugcagguuauaaaccaaaccgcaaaacaauacugcagaugaauuaggaaaaaugaucuuauuuuguugccauaacaacauauagaacucacggauuuuaauguauguauggggaauuucauuuacaauucaacugucugccugugguuuaguuauagucagucaccaugauucuucuaagagaagugcuagugacguuagucuagcuugagcacaagguagacuuggauuccuucaucuuucguucuccauuuuccuaauuaaaaauuuaccccugggcaaaauuuuaaagcaguguaaaaaucagaauaauaauaaaaucacaacuuaaaaguaugguaauuugugauugccauagcuacuaaugacauagcugcgcacucuguuuuccuugggacaagaaagauagguugcagcuaucugccaugucaucaucucuacuccuaucuccuuucuagaaauuaccauggaauacuuaugaauacacugacauuauacagagauaaagcugaaggaucucacauuuauuuuuaaaagcaaaucggauuugugauuaacaaagauaaccuggaaaacagauuggauaagauugagguuagagccagaaagaugggcuaacaucagaggaugaugugagcaauggaagggguugguuauucaggguugagauuuggcaacuguacuggauacuuuuaugucaacuugaaacaagcuaaagucaucagagaggagaaagccucaacugagaaaacgccucuaucugaucagguuguaggcaaaacuguaggagauggugguccuggguucuauaagaaagaaggcggagcaagccaugagcaagccaguaagcagcacccuccugggcuucugcaucagcuccugccuccaggccccuugucuugcuugaguuccugcccugacaaccuuugaugaugaacugugauuuggaagccuaauccaaacaaagccuuucuuccuuccaaguuucuuuggccaugggguuucaucauagcaacaguauccuugacuaacauagcaagauugaagcuggaggaagacaagggagccagagaagccgguagcugggaaaagcucgcaugaguggcuacccuuaggaucugcgcagggcuugcggguggauguuuaguaaaggacggcucaaagcaguaguugcagagaauuugaguuucugaugcuggauguagaggauuguggucaauucagcuauaagugggcaauuggauauagguaagagaaaguaacucucacucgccagggagcccggguucagccaaguuacgugaaucuuccuuacuagaauucuagaauuugauggauacggguggaugagcaaagaaggcugugagccuagcaccugaguucacagaggaagaugaaagaacacucuggaauguaagaaaaaagauaaaaggggaaaaccaaauaaggaagcacauuccuaagcaaaaaaauaagcgggauuaagucacugaguugcagaaagugaaagaagagagaggcacacacacacacacacacacacacacacacacacacacacacacacacacacacagagagagagacagacagacagacagacagacagacaagcaggcaggcaggcaggcacacacacaggcuaaauaaacauaaugaugcugccaguggcggcagaagcuguagaagucaguuggcucagagguaggaggacuggagaaaucugcagcagcagaagcccuguuuccugggauacacacagccagaaccccaucagcucauccaaacgcuacccuuguucauggcagcuucugaacacaccggugagcuuguggaaaucuccaggccuuuuucagaagagagcuguugcuuccuugcuuccuugcuuccuugcucugugauucccuuugcaguucgaauucaggucaauuuaagaaauauuuauugaauggccugccaagugcgaggccucuggaaaaaauaggaagcaguccuugaccucgguagcacaguuuuucgucagacagauaugggagcugauaauuauacagauauuuggcaagucaaggaauggaagugaguccaggggucaaaagcuaucaaacauacuuugcacuuauccccuggcuaaaucucacuuucagccauuacucuaaacagucuagacagucuguaaucuugauuuugucauuuaacuuauagaccaauuugcuaggcuuuaaaaugcauuaagguucaagaaaauagccaagauacgggcccaauugaaguauugggggggggggagaugagucacccugaaaaugaaauuaacuuuugauagcaaacuucaaaggucuuauauaugauucugaaaagccugccauguacauauauauuagguauguauggaucacauguaaaaacaaagaaucugaccacucugcauuucucacuggggaagaauacuuucggcuugcuuaucuuuagaaguggauucucauauuuccaauaugcgugugcaugguucaucgggugauagaacccaucacgugagaacaaaaaucacaaaaaagggaaauguauuuguuaugguucuaguuuuguuuuguuuuuuuuaagaaaaugauuaaaauaauaaaauaaguccugaggguuaguguguuuugcccacucucggaacaaccguggcgauagcuccauaacgagcuauuaauagagcuucuauacugagaggugguguacaggugaccccaacauuuuaugcuaggcaugaccaugagauuggucuuuaaucaugaguagguaaaaauguugcaaaaaggggguggaaguuuuauauaaauugucguacaucauuauuaggaucugaacucugguucucuggaggaacagugagugaucuuaacaacugagcugucucuccgaccagccccguccugacuauuuugaaugcauccuuauuccugaagagccagaggcagacuguaacacaccaacuacuuggaaguacuacugagcaucuuccacuggagccaggcuccccugcuguugcugcucuuuccuagucuguguuuccuagggaauccauggccuuuccccaguguuagacgcucuccugugcgguguuucuauucucuucccacaccacacacccucccucccuuccuccagcuagacugguccugcaguucagugcuagcagaagcuccaacucuuccaucgaguuuucugagccaaucccuuuuucccauagcuacuaaccaauaaaagcuacaucuucaauuucucacuuugcauuucugguccuuuaauauacuacuaccuguaugccuagucacuuaggcuuuaaauaucagucaagaacaguaucucaucucuggcuuccuucagaagauuccagaaccccaagcaugcacggagaggcauguuauagcuaguccguauuacugccuagacauguaguuuugcuguuagaccuugauggcauaaaaagguaagcauaugggcuuuggauuuaaugugcaaaacacaacuccaccacaucuagguuuugugauuuucaacucaucaacucagcccucaggacuucaguuuccuucucauaaaaucaagugauccuguucugccucucacucgugacauguauauuaaggcagaugaucaauuuaaggcaaucagcaaaaauuaagucaauaaaaaugauuauuuauaaucacuaaggaagcaaacacggaggcauacaggguccuuauagaaaccacaauggaugaaguucucuguaguccagagggagaaaaucagcagcagcccuaaaagcuaagaccuagaugaagggcucggaaggucugagggcucagcguggcuuccgcugcacuugugauggaaaacuugccgggugugaaaauaaaagaugauguaaggggcuuggcuugugagauucaucuaagaauauuccaaggaagcuagagaagaaccuagugguggaacuggcuccccaggacagugugcugguacaugaaacuuaagcugggcccugccccccucaucccccccagccaaacagcucccugggcggagccuggaaaaggauuagagcccugaaggccugaacugauuccuuccugggccucugcagcaagggacagaccccagcugaaaauaaaugcauccuucauccuucaccugaauccacaccucucauaccacccgaccuuuccugaccuccccauucuuguugauccagcagcaucaccacugggauucuuccacaggguacgaugcaggauucugaaugacuuaggaaaaugcacacacugugaagacuugcuuuccaagucacaccaucaaaacuucgcuuuuuuuuuaagagucuuucucaggacacacacacauccuucacaccaguaaugcuuucucucucaaucaugauucauuccuacuguucucucaagagccuguauucuucuuguggaauggguaaauucucucauaaauggcaggguuuggaaaaaacgagaggacuuccaggucauauaggucuuaggacagcuggaaggacuuuugaucaaauuaaaucaaaguaaaacagaaagcacaagguaggcaaugauaugaaagggauuuuuuuccuuucaaaaaagaaucaagauuauuuuagaugauuggaguaaugacugaauguauuucuuuaaccuagcaugaaaaaguagguuucuuuucuuuuagacauuuccccuggggcucuggaagucagaagaaaaucuccaaguagcucagcagggcuacaaaagacagauguggaauuauguaccaaacuccaguguugcuaggaacuaguuuugauuguguuugguaauaugugauuuauauuucugaugaccaaguguuucuauuggcuuggggagaaggagaugggcuaguugacuaaguucccaggacauggaaggaaagucuacacaugaaaugucaucuaaucuuucacacacaaaaauguggcugccucauaaacacuaaaauaaaauucaguguaaauguacaaaacugucuaacaauuuuuauaaauguaaagucccaaaucccaggcaaguggguuucuugggaaggguccaucacacaaccaaguuuaagaugaccaucaauuuggaagguuccuguauucaccuaaugccagugcuaggagcuuauccucuugagaccagaguacaagcuagaaucuuugaugcuacuuuguuuccugggagccaaagauuucgaagacuuuacaguagaauugucauucuauaaauaagcauaaaauaaacuccagacugcauuuuaugaagaaauucugaugucaaagagggaagguuaguggugucuggucaggcagguaguuuugagaccacagaaccuauuaaaaauuauagucaagacauuaaaauuaugucuuauaucccauaugcuauaaacgguguaaaucuccgaaucucacaauuauucacccacaggucuccauuucauugcuguuuuuuuuuuaaagagaaaccaccucuuuuuuuucuuucacccccaagagagaucugauugcaauuggaaccuacguggaaggucugaugcccuaccaacuaauuggauccucucaaagguugaauuuuaugucugcccuauuuagagcucugaaaagcuucuccuccaaaagccagcaucccagaucucaauuuuuaggugucaaguaucgcagcagccaagguuaaaugaguugauaguuuagagauagccucaacacucuucuccuucaugcucacucauguguaacucaugcacugggguuuggaaggcuuuucccaaugucuugcacuugacaacuuggaauauuccauauauuaaacaugcuggccaagaugaaccucauacaaaauggguauccuauagccauaaugucauuuucuauuaauagccugcugacauaaugcuucggggagaauaaaaguucaacuugucaucaacagguuuuuauuagucuguuuuagucuaugcagaaucuuggagcuuggauuucauuuuucccccaaaacauugcaucuugaaaaacacaaaagaaacugcccacuguaggagcgacuauguacugacuccaagaagcaacucggcugccuggcaagcuucuagcaaugcccaucucucuucaguguugccacgcagccaccuucuuacgacacguuucuucaagcuugaguuccccuccuccacaaaggacaaugacaauauuucaaaugcuacgucaaggaagaucuguucacuguagcagaauaguugcaucagaugcuccgugggaacaucucccugugagaacagucccuagggcuucaucuucaaauuguugucuuuugaaacuuucucuuaaauggauaggaacgaacgcuaggucacacagcucuguggagugcgguaagcacugggacucaguaccguggaccgaauggaagauuaggaagcuuccaaggaggaaaccagaacauucauucacaagaauauucacaagugccuacacaacugucccacucagaacagggguggagccaugguggagcuacaagggcaaauacagaccucagaaaagggacaaaggaauaauccaaauguuaaaaagcagccuucaaagcaaggggggaaagucacaaacuuauagagagaagcagccagagagaaaauccuuccgccacauacucagggaaacuuacucaacaggaaaagucgcaaggaugaaguuagcagcuacagaaaggggaggaagcaucaggauugguuaucgaaacuuucugcaauggagaaagaaugacuaggaucaauuuugaauaaauaaauagaggggacugugauuuuuuuuuuuuagaugugagugguuuaugguuccucaggaagauaugccugcccugccccugcaaaacaguguuugucagaaacucuagaauucagaguuuucaaaaggcaacuaaagacauuguaauaacaacaagcaagucacagagcaucugggaacaguagcagacaccuguaaucccaauauucuggaagccugggccaccagguaucuguauguuugaggguggccugugguauacagugaguucaaggccagacguacuaaacaaacaaacaaaacaaaacaaacaaacaaaacaaacaaaucacauugcuccauacauuuucuuauugccucaaaauuaccaaaaccuaaaacauucccauaacucauuacauuuuuuuucuaacaauucacaaagucaaagaauugugcguaagaguucuuuguuuuucuuuggaaugauaacuaggugggagaguggggcgcucagcacuuuuuuuuuuaaguucauuuuacacuuagucuuagugacuaccucuugucucaacauucccgagguaaugaauuccuaaaggaaucaguuucauacagcugaacuagauaggcagaggcgaugguucauuugcuugcuugcuugcuucuggccaggggaaacucaaggaggaaaaaggcaggacacagcuggauuuccaacuacaaauucauugcucacaccucaagccacuccucagaccuacgcaacccucacggcugcccugcuugcuuugucauuuuauagcugugcccacacaugaguuucucuggguugaaagcagagacuuggaaaaaccaguccuguauuuuauauggcaggagaggaaacacagucaacacaagucccuuggcugacaaccuuccuugucuccccugaaugcacuguuuuaaauugcaacugagugucacuucccaucauuuaauacacaaaaccaauaccucacagccccuugcuuuucuucccaacaacugaucaugcaaaguauuuagacgauccaugauacuugucaaggcugacagcuucgagcccaagagcccugcugaggcucagaacagguguguggccaggcagcugggguugagaucugcccuauaccucucaucucugcucucucagcuuccuucuccacucccucagugcaucccucuggguuaggauugagaagagccuagacagaaccuccccucuggacuguuucccuccgccagaaagaacuggcuuguucucaagacagcaagcguuugccugcugcaaaacagcaaugagcaagucaacccauuuuacucucaucgcucacuagggauuucgauagccaaggacauacuggccauuucccccgguuuaugggucuccacuccccuaggccugcaacacauuuuugguucgugcguucacaguguccuggcgucugcagugugggaaacccuaagugagagccaauagccccagagcuucucccuauuaaaauguccaauuggauuucacauguguguuucaaacaccauucuaagcaugauuuacaggcuacugucuagccccacagcuguuuuuccguccuccagacugagcuguuucuaggaauccacccuggcaaauaguccuccuagcgugggccuccuaagucauuucuggccgaacuaaacaaugcaagaucuaaagcaaagcuuuaagaaaacacuucucgaaugcgcaaacuauuaauuauucuuuccacauaauuauuccuccgugagaacagccuauucgcugccucccuucuguucaccccaccuccuaaucaacuuuuuuuugucaucaaauuaaacuaaucguggccugguccuuggauauggguuauuuauauauguuaaaagccauauagguccaaagaguuuugugugggucuuaggaaaugguuaccaccuagaguuuuucagcaaauguguucuuucucaagauggugaauaauagucagcagugcauuuaggaauuuaccuuccuguggcugggugcuacagucucgcaauaucagacugugugcuauuaagcaacccuccccuuuucacaguuuagcuucuaagacucugaacccugacugcuucccccgacccccaccaccagaagaaaaggccaggcuucaggcuugggccuguaguaagcucauauguguaaggucuucuaagcauuucauuuucugguacuggagggccagagaggcacuguguuaaguuagggcuuuucugugccuagaccagcuuaggaccaacagguucagagagcugaaagagcucaagucuucucgcccugggucgagaagaaucaucuacaaagugaucgguccagaggguccccuuuaaagugaccgagauccaacuugcguggaagauaaaggaagaagguuuaauaucaagugaauugucccaggaaaagguuuuacugagaauaguaucuaaguggaucaguuuuacccaaauggucacaggaguauagcuuccauuucagauuuaaaaacaaacaaacaaacaaacaaacaauuaaguucacuuuaauaaaaaccuuacaauuuaggucaaauuagauuucacccucuggccacaauguacugccacccccagccacccagggagcaccaugugagggugagaggggguuauuuucuuuacucucucacaugaacgcuagaccacuguaguuuggagagucucacugaagacaaaccgcccugacucccuuuugcaguuuaaacuaccacagcuguagaggcugugugugcagucucuccuagggaucguaagaaaccuccuuguuagaaguucuuaacucugagggcugcccgacccucggggcuucuuauuucauuuuaauuuugcuuuucuguuccuccuguucacagacuucaugaccaaagauuacuaauuacuguugugauaaagugagacuuagacucuguugacaaguuaggcuaucgcauucucaagacaccuuggagaacucuugacuuaagcucuuccaugaaugagccaggaauccacaccugccagaaauggucccaacgaccacagcuguaaccagaagaugaaaaucacagaaagaaaauggccacucgcugacauuuccugugugucagacauuacagcaggcauuuuauauguguaccuugucucauuaaucucucaagacaaccagcugaggccuacauauaucaucaucauacaggaauagaaaccgagacugccuagggaaacaugacugucagagggagacggaugaaauccaggccuuuguuccacuuucugucuacugagcucaucccauggauagaacaguagauccuggaguggaccacagcaguuaccgucucagacaugcugcacaagguguccugcaucagaugcaaagggaggagcuucaagcucuccuaggcuacugcccacuucuccgcucgggaucugaacuuacauuccgagcaagcugauucgucaaccaggucuguucccagauguagucugaugaaaaugagaugcuaucucuucccucccaaagcccacugacuagcuccaaguugacacucuugucuucucaacaugcuuuugguggcagugccagagagcacaugucucuauaccuuccugccugucuuucaaagcuaugaagcaaagcauuucuaaaccuauuuccuaacuaaggcuuuaagaaaacacugucaaugcaauacaucaugugaccuccuccaauaugaguguccugcucacuugcucuucccuccuuccauucugagcuuugguuaauugacuccgcacaccucacagaacauuuucuuccaagacaagguauucauaaaaacaacagauaccuuccugcacuccauuccuguccuaguagacuccaccauaaaagaacccaacacuggcacauccugcccagcaugauacuuuaacgguauucauggacauuauaaacagggcaucaagcagaugcagaauacgcacuccuuccuacuccaugaucuagcgcuuucacauccuuuccuucauuugaaccaucauauuuucagauaagaaucuccuggggguggggaggaaucaauccuagcucagcccaacacuccccaguugauuccaucucaagaacgcauucuuaccauuggagucuuccacuucuucggcuggaguggccuucugggaggaggggugagcaugugaggagaggagacugacaauccguggccggggaagggucagggcuuugccauggaccuugagggaauguuccuucaacuggcugauugucaugguggaaaaugagcaccaagaacacuuguaggcauguucaccuagaaggagauguggugagguagacaggaaaggugggagucaggagaaagagggcuagaaagcaaaaccacacagugaaucggcucccucuagagugguguucuaaggauucuuggucuagaagaccuccaaggcuaacucccugcccauucucgaagccacaguccugggaaacagcacucacaagcuccaagauaaggucagcuggucacugacaaucauguuuuuuucacagcagugcagcuuuuggggugauccccacccaccuaauucaccuaauucagagagggugccucaaacguccucccccuucucuguauuaaaauugaucagggcagauuucuuucaguccacagaaaauauuagguuuaauucuuuuuuuucucaguggcuuuuucaaacauggcagcccuauuguauuaauugucaauauuuaauacugcuaaacuacauacccccucaucugacacauucuuaaccauuuccuccccacauguacuuggggcagaggggaaguucauaaugaaacuccauuuccuacauaaucagcacuauagaaaugcaacauuucuuuaggaggaagaauuaauuauaugugguaagcguaagugggaagggaaucaugcccacuguuuccagcauucaauaacacauuuaaacagaacuacagcacagaaagccauggccaaaccaagacaagaaagaguguggccuaccuuugcuauaacuuucaaguucaguacauuuuaggaaugaacuuaucagcgaguuugacuguuacugggcaaauauacacuacugugaucaaucaaucuuguuuucaguaacagcaggucaauuuggcccccaaucuaauaacccuaccacugauagucucuauuaugaaaacugcauacaagccaggcaugggggggggggucaagcacuaagcuaagcagaaagacugugaguuagaggacagccuggcugaaacagcaaaauaauuucacaaaaaucccaaugagcaaggaagggagacaaggagaaagggacagagggaggggaggagggagggagggauacacccuuaauacagaggagauuuuauuuggagauuaauauuauuuauagacuggcaagguggcucagggguaaaggcauaugcaggcaaggcucaugacccaaguuacaacccuggaacccauguuauagaaagaacugacuccugcaagguaucuucugacuuacacuuacacacacacacacacacacacacacacacacacacacacacacagggaauggaacaugggcacacacagagaauauaaacaaacaaacaaacugaugaaaaaauuauacuauuuacacgugaaaagcuacgaaacaauguggauuuugaaagaaaacaauuaggcaaauguagguauauccucuugaugaaccaugauuaaaauaaagucuugaagaacuuguaauaagacagaaaauuaagaaugaguuaaaacauaaaacauucuuuauagacaugauaauuacaacuguggaaaaauaauuauagagaaaacuguugacaggaaguaccaaauaguaacaguggccuuuauauaauaacauuauggaugacugaacauaauuuuuuucaaauuuuuacuaauaaauauaauauguacuuaggacccaacucagguccucuugaagagcaguaaguguuacuaacugugaaguuaccucucuagccccuaauaugaaugugaguuuggaugcaugaacucugcuaaguagcuaagagucugucucacagccuaagagucaaauccagcacugcuuagcucuaacucaacagucaggcaugagagcacgcgcccauaaucgcaggacuccacuggaugaggcacgagggcuacugccacuuugagaccaacuugggcuagacagugaguucaaggccagccugaguuacauagccagcccuaucugaggauacuaauaaaaaaauaaauaaaacacucagcugagaauaggcaaguugaaagaccuguagcaaacauacugcuuucuuuaaggugaggauuucucucagcagcucagagucacaucacauugccugagaucccacgguguagugauagcagaaugauauugcuuuucuuuucuuucuggauacuucucgccaaucgaguagaggcagcuagcuagucagucagcuccagggauauucgcucagccuacugcuaggaacgugaugacgcagcaucugguugguucagagaccuuugcugggccaaaaccauucacccagcuccccacugguaaaaaacgcuuuuuggacaaggccaaggcgacaagaaaagcucaccaggaugcugucccagcugaauaauauaugauauacaugaguacuaaaaaguaaggcgaaucccgaaagcuacuuacuccugggacuuuaggagaaguuucccacggacauuaaaauacuaucagaaacaagccuacauaacuaaucuccuagcugcaacccugauccccagcagggcuaagggcaguuguguggcauaaggaguuucacugugcuaaaauagaauagcucaacggguccagcgcucaugaagcagaggaaagauaugggugaugacuggcaaaauugaagggaccgcucagagugcugcaaagugcacaaggcacacgggaaaucacacaguacccaccguuuggaaugcuauagacauggguaagcugauggcccucgcggcuuagugcacggccugggcugaacaccauguagugaucaaaacagcacagcuccuggacacucgggacuugaguugaaaagacaugagcaucuccugagucaccccaugcuuccugaguuuuguguuaguguguguuaggucucauguagaaauuagcuuuaguggauuuuuuuuuaacaauucaaaaacagguuuuugucaucccaugauccagccaagguaauuuagaaauuucuuuuaaaaaccuaacagucuacuucuaagcuguuagugacaucagucacacaaagcacuggugguuacucugguuuuaugaauaaaauuucauuuugcuuuucucuuuaaaacuguacaugcaaccaucccaaguauaaauugcauuucguuccgguaggggaaacuuucaguuucauucaaggcugugagguaggcaaccugagagaguacugaaggacaccccaaggaccuacucaccagcaugggcuuugaggaugugugucuucaaccggcuguuguaggaggacuugaaagagcagaguuugcagcggaacgguuugugguguccgugaugggucugcauauggcgauccaagcuucagguggaaggaaaggaaagcaggauuaaaaaucacagacacuuucccaccacuauuccaaacacccaaauucuaagcugguccaagucuucccuguuguuuucuaauggugacaugcaccguuacuauaaauagggaggacagaguuuaauuuuuaauaggccauuuuuaauaggaggagaaucuggaggaagagcguaaugaucuuuuucaaagccuagagugguuuacguaacucugauccuagcacuuggaugguacaggcagaagcaucaggaguucaagaccagccuuggucacauggcaaauucuaggacagcuacaugaaacuauuucagaggaggaggagaagaaggaggaaguagaggaagaaggagaagacgaagaagaaggagaagaugaagaagaaggagaaagagaaagagaaagagaaagaagcucuuauugcauugagagauggauucauaguaacaguuauagcagaucaugaguuuucucuucgcagagcaugggucauggucauccaaaaccaugcucuaagaagguuuuucugcccagcucucuagugagagugccuaucuaauucacaucgagaaauggggugaggguggggagagaugguggaagguuaaagaaauguagcaagggcuuuccuuucuuacaucauuaauucuacuuuuugcaggaacaggaaggaaagaggaguucaaagagcaugaccugcucacacaggcugcgcuguuuccaaggucuauaccgauauggagcacaauacaacuguguuucaaggaaucaugugugcaagggcugggguggaaaccccuucugguaauuacaaccauaggugccauacaucacucuuccagaagcaauuuaugaggacauuacuuaauuagaaugaaccccuaguacgucuuaauaacuaugagucugagaaguaauaaaucuagccaacaaggugugggauguucucguucauacaggaccccagagacuugacauucuguccugagugacucacguguacucauccugugaacacagacucaaccccuuccuacuaagucaaugcuccucauuuccauaaguggcccugccauucauucucccaaccaagaagacucgaaacuggaugccacuucugcucugcuauuuggucuuuacugaugcauuccugaauccaaccccuaacuucuuaaaugagcuccuaggauuucuucuaacuugaucucccuggcugaggcauauagucagucagacugucugacacagaaucccagcuauuugcuuauaagcuauguggccucaggaaaacuauuuagucucuucagcccuuacuuuucccaucuauaauauggagguaauaaugggccaagcauagcucaugggguguuuuguaaauagcugaaaguacuuaagauagcacccgcuguaucagcaggugcaauaauuguuaguaauuaugaauguuauucaguccagacucuuccuuuugcuagugcaguaauuauaauauacuaauuccuggcauuauagacauccuaauaggacgacuacuuagguagccaggaguaaacucuacaauuccucuucauguaaguuuaggcuuauuuaaauugaaccaccagccaggccucaaccuaaguugccaccuucccaccuugggcccucucuucucccuacccugacuucuucucagucauuuucaaccuuccuguuuucaagacuugacuccaguuuccauaaucuauaaaacccucucauugagcccaaauauagggcgcauuuuccuuuguuaaauuuaucagcauuuucucagcaucuuuuuuuuuuaauguaccuuauuuuguccagucauuuuuuuuuaaguaaggcaauuauaccccaaccaucuucacauuuuuuccaaggcauaaugccaggcauaaauuauucuuuuauucaaaauaacuuacugagggucuauggguaucaugcagugugguuuaauacuuaaggaaccgagaaggccaguguuaaugccacaguauggacgcacgcaggcaaagacuaaauguuaggcucuguaucagaguaaaaagugugucaucucuccuacucucuaaagagaaacacggcuucuccugcuuuuagucauucugucugaacucugaagccaacaggccucacucguuuucaauuaccacagagauaagcaguaagcuaacuaccuucaauauucugccaggcuuacaggaagaauauuuauguaacaaaaaguuuccuucccuuagacccugacuccuuccuaucacccacuuuccuacuuucaaagcuguaaugagcauggggcauuccuacuucuuagacuccccaaacuuuuagcaauucuuaaguguguguguguguguguguguguguguguguguguguguuaccaugcacuugcaacaugaagaagguaccaugugcagaagucagcucuccugacuucuccaugugagugccaggaccugaacugagguugugaagcuuggcaaaagaugccuuccucaccccuccaccuugcugaucccgagcaaauccuuagcauccagaauccuuguuaccuuccaaugauucuccagucacaaggguuaacuggacuaaccugccaucuuuaaccccuugguuuuccaaacagaacuugacuucuucaaaugauuucuuuaacuuuuggcuauuuggugggucuaucaggaaaaacauuugcucgcagaaacugucuucucuugaguaaaucauaccgaguccugucucauuuuuuucaaaugcccacaacagauaaaucuaaugacaucuccucauggcuacucuuaguccacuuuauaggucaaggucacagcagguagaaaccaggaaaggagauuucagagucaucugaguaucuguuuccugcuacagcuuaguucccuucuuuaugguacgccuuccaaugacaaugagggacuacccaguaacacuuacuugugucugaaugcagaaacaaaggagcaauacuggcagcuguacuuguccucucugguaaacauggccaaggccagguggcuccucucaugagaacgcagccccugcauggacaucaggacccggucacauugacugcaaugguauccccccggccggguuucauccuccaacauugcaucaagcaagcaguguccaccauccacccggcccaccagugugccacuggcgucucuggcugcuuccaauccauccaggaacaggugggaagggucuucagccuccugcuaagagaaccacacacacacacaugccccaccaacaaaauaaauauccauuguuacuacuccagcuuucuucuuuucccuucauucucccaagcucgucagcaauuuccaucaauguuuucuccccugcaucucuggcucugcauacagaaaagaccagcuugagagucgcuucuuccacagugguguugauuuugaggcaacauaaauuuggaaauaagagagccugagacaugugacaugggcuuucccaaucugaaguucauucacuugcuaccaaacucagaaagaaaauguaaacugugaucucauggauuccaaaauaaagcuggguucggauuaugacucugagagaagaaaggaggagagcugaagggagagggaacggagggggagaggaagggaggguuggggagggaugagaaaggaagaaaacaacaaaaagcauaguacagcuguggugguuugaauggccuccauagguucauauacuuguaugcuuggucucuguuugggaccaaggaccguuugggaaggauuaggagguguguccguguuagagaaugugugucucuagggauggacuuugguguuucaaaagcccaugucagguccaaggucucucucuuucucugccugugccuaugaaucaggauauaaagcucucagcuacuucuccuguacuaugcccaguauuucagcacacuccccauacccacccuggugaugauggaguaacccccugacacuguaaccaagcccccaacugaauguuuucuucaucaugguauugccuuggucauagugucucuucacaacaauagaacagcaauuaagauacuggcugucuaaaaaccuugggccauuugacaagaaaacucaaucguucccugcuuccagacagaaaugccaccuucaaaugaauguuacuaugugguuaauuccaaaaaguaaggagcaguuugacuuuuaagcuaucaguuguugaagcagcuuccuggaauacugauuuuccucuugugugagucucggaagcaagccugggacugacuacagucaaguguggaagcuuucgcuucugucccuggguuaacaguguucucaaagccaaggguucaguguucaagaaaagauaagcuuuaccuucagaguaaacaggagacaaaggucaagaaagagcaaacauaaaaauauauuccaauauccagauggaaagggcagaagucugaauuaauuucuguguucagaagugguaaguacauucuagaagguaggaauggggaguuggcuauugaaacaguagcugcuauuuguacuguggaaucuaaaacagguagccuagcaaaggugaggggaaagaaggaagaugcuggcagcaucacauggaaagagacguacagcaagcaaaccaggucuuaaaggcaggcucuuagcuuucuaucugaucaaugccccuugcauaacucagugaaccuagaaagaagcaaaaugcagguucuccuggacugucccacgcucaggcacaugacaguaggagugaggcaggaggagaccuggaugaugggaacauaguccacuucauuccucccaugagcucugacagcucagaaugaccuagagacaaccagcaugaaaucaugugaccccaagccucuuagaugagaauguggggucaucuuucuccaccagacugucccucagaaucagaaacuagaucaaaccuuucccuaaauggaaugauguggaagguccaaccugcaaagaaaucagaacaagccaaagcaagccaagcauaacucaagaaugccggcaucccaagccacacucugccaggcaauggguuaauaaauaacucagauauuugcaagugcacaggcacacgcacgugcacguacacacacacacacacacacacacacacacacacacacacacacaccaggugccuggaccuuccccuucucaccuucacagcagccgacacagccgggacgcuaccauacuggacauguuuccggaggugguuacagauggcccgaagcguuggaugcacuuccacgcagaauuuacacuuguagcccaccacuuuccucuccuugaucuuuggcaccucuucuaagugaccaaaaggcugguaaaauacagugguagccaucaguacagcacgcccucccucaaaggcaggcauuuuacucuuacagauuacuggauacuguauuuuaaagaggaucagcagguuaaaguguuucauuauauauauauagacuucaucagucauggcacauugccuacuagucgccgucucuggaacccacuuagguuccagcuggugagaagagauuuaguagagauucgcggucucuaaguuaucuggcuuucagaccaguuuugauugcgcagguggcauguugcaacagcuauuccuuuaaugaaccucuugauuuaagaagaaagagagagagaggagagaggagagagagagagagagagagagagagagagagagagagagagagagagagagagagagagagaauuccuugagauguuagguucccgaagcaaacaccggagaccaugucauggcugagaagggcuaaggguaacaagagguagcccacaacugccuuaggaagagcaaccacugucuuuuuuuuuuuuuuuuuuuuaaaacgaggcuucagaaaacacuacuuggcaggaagacacacaucgaaaccaccccaacccucccccgggagccaucggaggagucagagggagaaggggaggaggacaggaccguggaguggggugagcauagaauggggaaugaucaagcucgaaauguuuaacugacuuauugagcucucuggcaagcuaagucaauaggaagccugcagcaguuuggcuggcaacgaaguacaugugggcaccagugaugagaggccuccugggggaagggaaaucaaaacauauccuuacccucucuuguuugaaaucugcaaaagcaccaucugcauauuucugcuugcucaaaagcuguuuccuccucuccuggcguuuggcacgcuucuggaauuccucauuguggauguucaagugugaggucagcucggcuaugcuuugcaauuugcuaucacagugcuuacacuggaagguggaguucuggaagcgggggccgcugccuaggaugacgaagucccucuuuaagucccugcugugguggucuguguaaugcaugcacagcaacuccgccgugcugaaggacagcuugaagcauuugaugcagcggaacgggagccacucgaugucuugagcuucgccuuccaccucggcccucucaaagcugcuucucuccucuucuuccaucaguggggguuucucguguucaucugcguagaccgcugugaaguagccccccaacuugcuggcaugcugcuucuuugggaacacccccggguggcgcuucauauaaugggacacaaugccuuucuugcugaaggacuggaaggaacauaaggagcacuuuuucuucuccacagcccgccggaguuccucgcucagcugaggagagucaucuuuggguggggaugggaugaucaccuuguugggcuugucacugaugguccuggaggccgcaaggcaguggguguaauaugcaucaaugucguggcgcuucugguagugggcugccagucccuugcggaugggguugguguaggcacacagggcacacuugaagagauuguuuuugcccucgggcugggcacggacauuauugugcuugauccgguagugccuggcaaugcccuuccuaguggaacagaaguacuugcagagcuggcaccggaacacagugugggagaccagaugcgagguagagaagugagcaguggacauaggauccucucccaccuccuccuccgucacggagaccugggaggggcucacuucagugguuaucucagguucaagggacacuggcagcuucggaggaggcggggaaaagacaucaaacucaggcugguugugguacuucucauaguggauuuugaguuucuccagagugccguguguguaaggacacagcuugcaccgguaggcaccauacccuuguuuaaaaauccuacuugucuccuccacgucauucugggauaugucagcagacugcuccacaucaugcacaaaguccucagcggucaccuugauggccgggugucgcuucugauagugggucaggacgccauggaugcgaguguugauguacggacaaugccugcauuuguagacggcaccuggguugaugucaauauccugggcaaaaucagcagccuucacuuucauaccaggaugcuucuucccguaaugggugaggaggccgugcaaguuguuguacucggacuggcacacuguacacugguaugggguggaagauauagcaggguuagcugaagccagaugaaugcuuuucucuggggaaagucuugcauccucugggcacucagcuuccugcucgggaaggggguuggguauacuauuuucacaauucacagggccuaucaacucuucaggugccaggagggccuugucuacaccgucuuucuccuugaugauauccagcaacacagacucaucaccauucauggcccagggguggaacgcuugguaaugguuugugaugucccagauggagacggcuucaaaaacgcagucccugcaucuguauguuuuggcuucagcugacaugguaagagugggagaggaugggucuggcccagcccagaguuugguagccauauaaguauaaucuacauaaugcucagggugucuccucugauaaugcaggagcaaaccacugggcuccaugugggaguagauacaccacucgcagugguagccagcuucuaucaagccaucuagaaaugcccaccgcaugauggacgugacuguggccuucagggcaggguggucuuucuugauaugcuuccucagugcauagaaauagggggagguauacgagcacugccuacauuugagcgcucgaaguuucguuuugucccgcuccauaccggaagcagggagaagcacacagcuggcaggcuucugguuccggucacagaggcuucggaugguggcugugugcugccugaucacaucggcauuggccuugaagucccggugcuucuucugauaaugaaugaggacgccuuugaccguccgguucccauaaucacagugcuggcaaaaaaacaucucagucuccacaggagggcaaucucucucagaacuguucagcugcaagggagcaggaggccgaggggaaucuuggagcccuucagccccucucaucauugcagcugugggaggagccugucugauauauuuggcagugaccuuuauuucugggugucuuuucugguagugaacaagcacccccacaacugaccgauugcuguaggagcaguguuugcaguaguaaagcucaauacugaggucugguggcgggggcugugggggggguggggaacccauguuggacauuuugggagacauuggagcacccaccucaaaugauaauugggaaagggcagagccucuguccacagacaccaugcgcaugguuuucuggauccuaaaguacgaggccuuuucuucaggguguuucuucugauagugaaccaagacagagugcauguuggggcucgcaaacgagcaaacgucacaaucguaaacgacaacgguguucacugaaggguccuucuggcuuucacauucuggaguaaaggucuugggaggaguguuuuuguuaaacguagcuggcaagccaccaccgcgagccacaggcguggacgucgccaugcucuugggagcugaauucaaaaucucccgcagggucugggacucagcauucagcccuuccugcugcucuacaacguagcuugaaaagaucauagcauuguugauuuucaccgugggaugcauucuuugguaaugcggcaucaggcuucugacauucgggcuaguguaagaacaaaaccgacaucgguagaucagguccgaauggucaaaguugaguacauucauggccucugggugguguucaccauaaugcuguuggaggucuucaaaguugguguagucaauauagcauuccaggcaccuguacacugcgcugugaucauugggguccaagauauaccuaaagcugaacuuaauguaugggugcauucgcugguagugggugcuaacacuccgggcagauuuauuauuaaagucacaguguuuacaauaguaaagccuuccagaguccccaaaaucgguauuuucauuacuggguuccgucccauagauagcgggcuggguguucagcagagccgcauuggacacuugaucuuucaugcuugcugaagagccguaguaauccucuucgucuucagaaagcgugagcucgaucuccgccccauugguggcaguguaaucaugagugauacuucuguaguugggcuccuucugggccucacuagcgucucuggcccagaucuguugggcugaaaaggcagugggcaccuccaugaugggguccguugccuccuccucccuguccaguucaaccucgaucucgacuucguugucauccucuuccuccucaucguccucgacguugaugaucgcgucuuccugcaguuuggucugguugauuuugcucugcaaauugcuggcuaucucgucaauccuuguucucuucuucacaggugauaagucaagaggaaagucacuagcaagcuuccuauuggccuuagcuacaaaguuauucuuggaggacaauccaagaauugaggucugacuuuucuucacaguguugcuggaagagggguggcuauccgucucauuuuccagugguaggcucgagggcugccccucgaauuuuggcaaguugucgcagaaugaauguuugugcugcugauggacucuuagcccuuucagagucaugguggaauaacuacacauggugcacuuguaagggugcaaagguggggccuguguggguggcuguggcugcuggguuggugguggcaccugguguggugacugcagcgguggagguggaggcugcggcaguggcugugaugguggugguggugguggugguaguggcggagguggcugugguggcugcugcugcuguaagggguccaacaugacucccgacuuucuaccauugaugcuggagcucucguaagauaccauuccuucauucaacgaggaagacaggcuuucgcuuugagaauucacaguaucccaauccgacguacccgugugacacuguuuaugagccccgaguuuuaaugagcucuuacaaguaaacggacacucgucacauuuguagacagcggucuuuccagauaaguggauauuuucuauguggcgggaaaugcuacggcggugcauggugaggaaaggacaaaagggacacuggaaucuauucaugaaccuucgaaauggaauccccuuggucucuaacagcuuguugccaucagagcccaugagcugcucugcagacaguccugacgccuggugauccagaacacuuaaaccauucucacugucuaccucauuuaaguccucaucagagcuagagucauuuagcaugcuguuaguguccaggucagcagaugaauucgucaugucagacauuccguaacgggaccucuccgucaaguucacaaggccagaauuaugaggugacuucggcuucaucugaggguaagacauagaagaagaaaacuuggaaguugaagaagaauuaggucucaugauggaguugcccauggagccccugaaauuggagacguuagcguugggcaucucccggcucgcagcauucauggacagguagguggaguuggagguggggcuggguucauuaucauucugcgcuucagagacauuaggcccuucuugcugccggaugcuagaaaggaucuugaccauacugcgguguuucuucaucaugugaucgcaccagcguucucugcggggggucugguagcuacaccacucacaacaaaaguugccccgagacuuggucaaaggcuugaccauagauucuaagaugcugcgcucaacaaccucugccggcaguuccuugcagggguccugcagugacacagguggaaccagagggucuggcaguggagcaggggcaggugguggcgcuguggacuccuucagacuguuuuugugguacaucuucugaugcuuaauuauccuugcccuccgaggugauuuguaugugcaaaacuggcaagaaaagaccuuuccaaauccuucgugcaucaugauauuauaauuuaaggauccugggacaggagguccugugggacucucuucagcuugagcuccauggaccuuccuaguauguucuaugaggagauuuuuugaccugaaguagcguacgcagaacuugcacugaaaaaauuuguugguugguuugggauuagggguaauaugcugaccguaauauccuggacuguggccauaguaaccuccgcuccccaacgcaguugcacuuugaccugcagagaauauguaagaagauugaaaugagaaaaguaaagcgaaagagaauaugaaauucaaacacacaaaacagcaccaucauuucaguuacucucgaauaagcaucacauucaacaggcaugaugacuggagaugcacugaaggcugcucacacagugcuaauaaugaagauaucauagacuguuuuggauacagaauaaagacuaguuucaucaacuguaagauuuguucuagaacuuucugagacauuuuguuuucaacauuagaagaggaacacacagggccacuaaaaggacaauagccuaagauaacuaagagaaaaaugaugccuaaguagggaaaaugccuugcagggaguaagaaaguucagaaaccuaacauaagaccuaugguuaaugauggugauggugaugaugaugaugauaugaugacaagcuuucucagacauaugaguuuaggguaggauuaccugguaaauccucugcaaucacaaacucauccuuuauagaagagaacuccaccucugucugauuacuagcauucauggacccagauaguggcucgucaucauuguccucggcaacaucaguuggcuguaagaaugccguguggacauccuggaugugugccuugagaucuucguaagauggggcucggaagucacagccaucgcacugaagcaccuccaugaucgggggcuacccucucacaucaggaaccugaggcagagauuagaacacagcauugugaggaucgcacucaccacaaacacaaagaggcaacagaucuucucauggaaugaacucaaacaucacuaccuuucgccugcuccucuuugccaacucgaacaccggacaaggagaggcaaucagacauaauagagacaaaguccuugacuuccuaacuucaaaggaaagaaaacucagauaaauguuuucugcuuugauagaucuucaaaugccaucugucaaggaaacauuaauacuucaaaaguugguaccguuuuugagugucuccaccacauucagaauucuagauaacuuacuauugauucugacuucuccuuagacuuuuucuuuuugaacuagagucuucuuagugggaaagaggacauccaucuucauugaagggcaagaacauuuuaauuucuuuuauccauuuccauauuauuacaugaguguuuuaacaccaaaugguagaauagaauugacucuuggaaauggcuguggcuuuugguauugcuuuuauuauuuuaauaucuuuauugauacuaggguucacauuuuuucuuuccccaaguagugugguuuccccucccccucccaaugaagugagugguuauuugcucuuuuacuaccuaccaauuaaaacuuaacagcuucuccagucuaauuaggucauaaaauauuucucaugagauuuccaagcaaccaacuuuuagaugacaauucaguuucugguuuaagauuguaccuuggcauguccauuuacaugaagaccacagaaucuaguaguucuguaaaggggcuccugagucagagcugucccucuccaucccucucacuuuuauaaccaugaaauuuagacuuggauauaaaacaacagcagccaaaaaucaaccugugaacuugguguggaacaaggcagagcagagcucaucucccuuacucuguaauucacugugagacugaaaccuacgggaagcuucacgcuagcucaaggcagagucucaccacaaagugacgagaauauugggaagguggaguccuuccuagcuuaguguauauccuguaaggagauacccaguuauuaucucagugaauaaguuacuucacagagaacaucacaagcccuacuaagucacuguacuguaaucuagaaccaaaugucuuaagaauucagguugcagccagaucuuuuuuaauggugcaguuuucuaugccucucuuacaaaagauaaugugauuucugcuggaggaacaaaguccagcaaugaugugucaguggagugcaagaagccauggcaggaggauuuucuaugaaagaaugcuccugcccggagccugcuaaaauaaguacuggccaaguccagcucuggacagggcuuugcagagugagacacagauauuuuaccuccucuucuuucacccaacaauuuauccuauuucaauaaacauugaacuggacaccagaguccuuucagcuaacuaagucucaauauuccagauacacaagcuuuuaugucagagcaccagcccaaauuguguggaagagguugcuaucagcucuggaucaaauuacagcagucacugagccccaccccacuucuccuuucgcacaguccauuagaccugaaaacaaauuuuuccauggugcagacgacuccugcauuuagaacacuucacagaaaaaagcagaucacccaaugcgcacuccccaucccccaagcuuaguccuuucaucucagccaagcaagccacagcccugccgaauguguuuaucacacuuucaggagauaggagcuccugcgucacugaagcucuaagacucacuaagcugcccuaguccucugagcuguaggagcagccauuuuagcucagagccucuccuccgugcacaacauggcuucgcuuggauuuugcuaggcugacaaucacaagugaacgcuacgagggcaggcugggcuccuccuaagcucugcucuucccaacaaagaauuaacuguuuucauuucuucucgaaaagcagcaccuuucuccuccucaaaugucauucaccaaagaucuccaaagguucuuuuaucccaugauugauaggcugguucguuagucccagcagaguacugguuaaaucaggacgccccuggaccagagccuguccugcagcaggauuuggggguguccuggagaggggaccuccagaaugccuugguuucuugggagucguccuuccacacacagaagacauaccauccgaggcugcuagccagauuccaaagucuaaugaccuuuguuaaucaccagccagucugucugcaucagcagacccugccaaaagacacacccuuccacacaaaggcuguagcuauuccuuuuaaaggagguucugugaaagcuccauuguguagcucagaggaaaacaaaaucccuucccuucaaaaccucaagccuuuagaaauaaugcaacaaaaggcuuucugcugugucucuuuuggagacuuugagccugguuugcacaaaacauccacaaaaauggccccgcuugcacaaggagagcagagcauugaggcaguccaccuggagauggaguccaucuuccauacacuucucuaauaucuuggugucuucugaaacuguucucuaugaaggaugcuaaccccaucacaugcaaacacuaacagucuccuuguucugcuacaaaggagauuaaaggguuaugagaucagaaggaggagggggaaagagccacugauuuggaaaaaggagagaugaugaaagugauuuucuaauggguucuagcuuuaauguuguugcagucuuuaccucaaaaauagcucagagccuuagaagagguuaaucuccaggcagcugauacaaccaguggcaggaagagcggaguggccuucaauuugaugucuguaccaauacugaaaugggaauggagacuuacuuugaaagccauuuugucuuuguguacacggcucuccugaagacgcugacggaagaaaacagaaauugcuggcauagcccaaacaauccaagaaacuugauauauuuaugagaccacaaaaguacacacagguaauaagcaagagcaggaaaauagggaguagaaaugauccccacuaagcaaacuggaccucagggugacccauucaucugucaaucagaaaguguuucuggagcacgguguaguccuccaagaagccaaaacacagggagggaaauaaaaaaaaaagauggggcauuaaacuuguauguuugacugcuucauugacgcagaggagcaacaguuguaaaaggcuaaccuagagagggucugcagugagauuaugauugaaagcgaacagccucguucucguauuuaccucauuuaauaacacccgugauuaggagauuuaaccaccuuuuccucacagaaucagcacaaccaagaggacaaaugcaaguuucugaacugaaaaagaaauguuauuucuaaaggucaggagaucaauguagaaaccaaacagacauccuucccucccacuaccugucccucccagggccauagcugcagguuccucaaggccagauaugcuuccuucagguaaaccccacuucuaacaccauggcugaugacaguugggaacugacuagacuucacucuaaacuaaccuucaccuuaagugagcagugcucugaacaggaaacucuuaaaccauccuaacucuuccucaaacuaugcuuaaugaagggcuucuuuccuucauauuuaaagucuaugaguucaaaguauaguguuugcaggaacagcucccaggcccauugucuauguuuagcaauggcuuaaagacauacuuagagagaguccacaguccaugcuagagaucugaaaacacaccggcugaggagaggggcagagugggcacaacugcaugcucucacucucaucaccaauuuccacuaagcucguugcccacacacuggugcugggaacuccaggguccauugcauccugaguuuccuuuuggggggaagaaagcaucaaaacaugucuuugcuguguauccucgcaagcucacgugacacuggagaggggagguguucuugucgcuucacagccuucucacaagccugcugcuuucaacccuuguccaggucagcuuggcaaacacuacucuucuagccugauggccuggagcagaaggggguccucgaggcaaaguccaagugucuccaggaagugaccaaacaaaaacacccaggcccugcccgucuaaucugugcucugaccacagggcugcagaucagaaaugaagcugugaaggcccacagccacgugauuaaguagcaacuaauuauaacuuuuaaagccucugagaacuagauccagauagagcagaaggugcuucuccucuguccacuccagaaaccuacuuucauuuauaagacaugaaagauccccagauguccucagucacaauucucaggaagggcuugaguuaucacgugcuguuuguucuucauguuugucuuacuuuccuuugagugggaauacgaauuauccaagaagaaggguaacagaaugaaugcauacauguuacaacugccugaccagaaauacacagaaaccuaaccaccauccugaaaaacuguauuuacaggucacgggcuauucauacaaugaggucaacagguuaggggauguauuaggcuguucuuucuaguaacaaauccagaaccucagaauacaauguagaagucaaauauuaacugauaaacuuauaaauucaggguuguuauucuuggcaaagaggaguguuuucuaucgcuacuaaucauuuguucuugucauggccaaagugaaaguucuacucauuuagaaucauuuaaagacucuuucucaacagcacuuaauugggaauaugaggugguaucccagaaccagcagugagaggaugcaacuacaaauauaaauauagaccaauuauguaagcacgauaucuacuauauauacauauguauacacacacauauauaaguuguguaugugagcaugaauaugugaacuagcuaauucuguugauuuaacuugauaucuuauagaguccuggauguccaagucuggcaagaccuaggacagucuuguucugagcauucucacguuaguuaaggaaacaacaacaaaggauuccuacaccaagcuaccuuuauugaucccacagcacuugguaguaguauagaucguggcucagcauguggugucuucaaauguccuaucaaauguuuauacaguuugcuacaugaucuaagcagggcugugugcucuuggcaauuuaccacauuaacaaaagguuuaacuuaucagggaggauaaauaauuaaggaauugagaagagagacacagcuguucuucaaaaacaauuuuucagaaaagaaaggauuaauuugcagucauguagguaacccggccauaugaaacucaauugaaauaguagcagggaaagccaugagaccaaagccuggcaaugcacgcagccuccguggugcagggucagucuuauccaucuccagggccuuagacacgagcacgaagucgaaagcaagccaucuguagacuaauaacucagucaucuuccagacagggaugcaagucuccgaguuagcucugauuuuaggaugguucugcugaacaaaguuuucaauguucuagagcaugccagaguaacauuucacagcaaauaucuguggaggucaugauucacaugagaugagcaucaagagcugucauuaaauaaguggcuaaaaaaauugucagcuauguaugcaagaaaugauucugacuggguaaccuguuaugaacgcgggaagugagugucuccuacaaaaagguacaacagaccuuguagagaauucaggcauuccuuugcaaugauauaaggcuaauugaggccaacuagccaauaggcagucugccaacacuccuguccuuagaaaaggaagccugugauuugaacaagaagauaaaaagagagaagggacaagaaagggaggaagcuggguggaaucucagcagcuuuaggcuucauugucuauggaggcaaaccuguaguuuaccagauaacucuuaauucugagacguguccagaccauuuucuugaaaugcugcuuugaaaccaaaugaagaugcuucuccaacacuaaaauucucuccaaaaaaauaaaauuaaaaaauaaaaaaaaaaucagagccuggcucaucauguucuuuaaaauaaugggaacguguucuuggugucaaauaaguaaauaaguaagaaguaaucagggcagaggauucccugaaaugccaugggcucacggggaagauuuuugaaaacuuugaacccauucuuacccccuguauuucaaacaagagagaacugauuucucucucccagagccaaauuucacccaaauggcagagacaggaaaucacuguguuccuuuacagacucuucaaaaugcuggcuggguuucuacaggcacuuuccacacuacaaggacucucauuauaaaaauuguaaaauuaaagggaaguugcagauacgcugccgggucuucauuacagaguugauugagacgcagaguaagcagaaccuacagugcaagccaccguccacaucaggaaagacgagaaacgagcucugccucuuuccucaugggcucagcagcccaacgggucucggacauuuaauguagcuucacagccgaaacuaccccuggcuauuaagacccagccacacacaaugacaucaacucuccauucagagucuggugaaugaaucagaaaucauccuaauguuuaucucuuauucaaaaacaaccaugaugauuggcugcugacuuggggaguaguuaagaaaguuuugucugaggaaccucuuuuaucuggggaaggccuacacucccaaucuaaucucuugggagauuuguccacucccuguuuguccaaaaaguuggacaaguucaugugugugacaugaauggaacagaggaccaugaacaauaaagaccacauuuuucucuuauaugugggaacgaaaguuuaucucaaagagacagagccugagaagaauaguauugggggggggcgguuaauggguagaauagaguugcauggauagaaugcuuuuauuuuggugcuaaggaucaaacacaggcucucauacaugcuaaacaugacuauuggagcaacuucaggcuuagaguagaaugccuuucaaccuuccauauagcacuguggaauaacuuuagcuuacaacaguuaacugacugauuauccuaauaggggagauucugaauauguauguaugcacacacacacacacacacacacacacacacacacacacacacacaccccacaaagauacaggugagacaaugauaucccaaugaccucaaucgaauaauuacccauuaugagaacauugaagaaucucucugcacacccaauaugugcaauuaucauauguugguugaaaacauauuaacuccuuaauacucacaguugaaaacauacuaauuucuugguacucacaguaacuccaguuacagagcaucugacaccuucacacagacauauaugcaggcaacacaccauuaagcauaaaaauaaguuauaugaauaagaucaaacugguuacugucuuuaccugagaauuggccugaaucuacuguaggccaucacauacuuauucuuucaaucaggcgucuucuaccagagaacacuaagcgugacaauccgcggcacucagaguuggaggagagaaaaaguauaagcaaccccacaacuggaucuacagggaaagcaaggugcagcccuuaugcaugaaggcuuuauaaaaugugggugucuuuuggauuuaucucuuuucuuggcugcuaccacaccggagcucuucaguaaaccauguuucuuccuuaccaaauuagcagacucccugaaaaaaaaccauucuaugcauuuacauaaggaagugaugggcaccuacaaauuuggguuugggaauuuuucucuugccuuuuuuuuuuuuuuuuuugagaaagggucucaggccagucuuaaacuuacugcauagcugagccugagccuuuugacccugcugccuccccagugcuaugaucagaguuaugcacuaccaugccuggcaaacaagcacucucucuaccaagggagcuacugccucacccacuacgagacuguuucugacagcuagggaaugguuacugucuuuuaauucucaaauauuuccugcucuaaaauauagucugcucuaagaagcugcugucccccaagaacuacucagaaaucuuagauauuugccuguaacacaacugcaugggcuuuauggcccugugaaaccaccaaggugcucagauacuuagccacgccccacgaccacucuuuaaaggauaaaaacucacuauugagccauuaaagagaaggagggaagggagggagggaggagggagagagggagagggagagggagagggagagggagagggagagggagagggagagggagagggagagggagagggagagggagagggagagggagagggagagagacugcagaaaugccuguccggacaauuaaagaauuuguccuguccucaggucacuaaaaccaaauagugacaguacacugccugccaucuuuacuugagcaagucuuuugaggcccuaacuuugguccuuuuacuaaaugaacaaaucagaucauaauguccaucauccaguuuugaacaaaaccccuguuuuacacgauuucuuucucauauuugagaaggcgcuuugccgacugaguucuuacuucucaucaucuucccacggcugccuucccaucauccaggccuacacucaaauccugucugucuuccaagguucuuuuccugacauccucaucuaacacuagucacuaucuucccacaacugcacaugcucaguuucucuccugcuucaucauuuucuucguuucuggcaugcucccugguuuuguuuuguuuuguuuuuugguuuucuuuuuuucugccccacuagaacacacaccuggagcagaguccuucaaacgguuuccuucauuaacaaaagaaccaacugagaacaggucuccgcuugcucuguucaucugucuugcucacgugguuaacuuuagucugagggagggggaggggcaguuacucagcacagauacacagcaaauacaagaugaacagaaaugagagcuuccaaacgacaggaggcuaacacaccacaagacuagacuggccaucagucaugcauaaaccccaugucacuaagcagugauuccaacuagagcugauucugcucccaucaucuccaacuuaaggagucuaccaaugucugcguauaguuuuaaugaccacaaaccauagggcugccacuggcauccagugggcagaggcagggaugcugcuaacaccccccaauguacaagacccaaagggaagaaucauccgauccuuggcguccauguuaagaguggaagucaugucagcauugagaguggaagccauuucacgagcucguuccaagcuauuuuaaggaucucuuuucuagcacuuccuggggucauagcuaguucaucucuggcccaaauaacuaacaacuucucuuccaacuucuugagugucguucuaauugaucuuaacagcccuuauaaaauauuuaguccuauuuucugauuuugguaauuucacugaaagucucucaagaaaguuucaagauggaggcacaugauuauccuacccuucgcugguguuaagauccuugcacuguucgucaucugaauuugguaaagggacaauauuguuuaaaaagggcaaguucuacacuaaguauauggucuccaaccaaaauuucuaugaaaaaugcaauacagaucuucuguugguguguaaaguuaucuuccuucaaggcgauaaggccucuggcuauucaaaagucaccuucaaaugacaauuuuuuuuucuuuuuauccccagggcccagccaggucugguucuggugaguuugaaugagugacuauaugcuugccuaauuuccaggagaaaaguacaaaaucaagauaaggucauuaaaaacagacaaauagaugaaaaauagaaagaugauucauagauagaaaaauagaaauaaagauagauagaaccaaauagggugcuauagaacaccacucccaucccagcuaagaaagcuucguuauagccauuagcugauuccuaacauucuaggaauuuggggcuucuuccauggagaugguauccccaguagccuuguuccauccaugcguguguauauauauauauauauauauauauuuuuuuuuugguuuuucgagacaggguuucucuguauagcccuggcuauccuggaacucacuuuguagaccaggcuggccucgaacucagagauccaccugccucugccuccugagugcugggauuaaaggcgugugccaccacgcccggccauccaugcagauauuacacugcuaaacuguccuaagcugauugacaaguguaguuacacuggagaccaugugaucaccuucccuccacaaaaucauugucguuguuaggguuuuacugcugugaacagacaucaugaccaaggcaagucuuauaaaggaccacaauuaauuggggcuggcuuacagguucagaggcucaguccauuaucaucaagguggaagcauggcagcauccaggcaggcaugaugcaggaggagcugagaguucuucaucugaaugcugcuaguggaagacucacuuccagccagcuagggucuuauaauagcccacacacacaguggaaguggcaccuacucaaaaaggccacaccuuuuaauagugccacucacugggccaagcauauacaaaccagcacauucuacuaccuggccuccauaggcuuguagacauagguucauagacaugagucuacgggggcccuaucuacucauagcacaacaaaaaguacauuuaauccaacuucucaacaauguuaaaagugcaaaguucaaugucucuugagauccauccaaucacuuaacuauaaucccuaaaucaagacaggaaaccaacugggcaaacuccaaacucugcaucuccaugucuaauguuaaagaggucuucagaucuccaacuccuuuuucaucuuuguugacugcaaugaacuucuuuuccugggcugguuccacacccuguuagcaacauuccucagcagauagcccacagcucuggcaucucgaaaaucuuaggaguauccgaggcaacuucaauguuacagcuucuuguuucaaugucugggauccacucaucuucugggcuccuccaaaaggcuagcaccacuucuccacuucugcccucuguagcauucuaagcucagacugaucuacuuacacugcugcugcuguccuuggugaucauuccaugguacuggcccccaauacacuggggucuucugcuguaacuagguuucaccaauagccucucauaggcucucuucacggugccaagucuuaaauccuuugcaugaccuguucgguccugggcugucaacuacaauugagacugcaccuucaccaaugguuuucccugacuucucucagugccaagcuucagcugcucuucaugaccccuucaugccuucaaaaccaguaccaccugggugauucuuacccauuaccaaguccagcugugcaggagguacaaccuugacuaucucuggaacacagauucuauaugcucucagaaaacacuucccagaagacuucaccucagugauacuagucucuucuuaaucaccacuaguuucuuagcuccagcugaccagcaucaauuuucccaguagucccuucucuucuugacucuaaagccagagcuacauggcugaagcugccaaguucugcugcucgcuggggcuggagcauacucccccuuauucuauuaccagcuuucuguuuucccacucccucucugccuaagcuuggcuuuccuggaacuugcucuguagauugaccuuugaacucaagagaucugcauggcucugucuccuguaaggcugggauuaaagguguguaccaccaugccuggaucuaaauuuaccuagauaggauguugcccccaaaucccuuaaucuguuagcuccuagaacauaggguucaguucuauuucaguuccuagugccccuuuaauaccugaaccauauauuuuauauguuuccuuucuaagcuugcuauccuuguucagaacgcucuucaugagacuuaaccagagaacaaagucucuguuggacuuuuuugagcuuccuuugucaauacaauuaauauaaaucucuuuaccuuagacucugcuagacucuucaaacaagggcuaaaagcagccccauucuccaccaaaauaccacaaaaacagucacuaggccacauucugaaauuccucuccacugaaaccucuugagccaggucugcacaguucagaucacacucagcaacgaaguuuuccaucuuccuacuacgauagcccauuaagcccaacuuaaagcaucccacugcuuuccaaaguccccaaauccacauuccucuaaacaaaagcaugguccaucaggcuuaucacagaagcaucccaguuccuaguacuaacuucugucuuagucagggcuuuauugcugugaauggaugccacgaccaaggcaacucucauaaggacaacauuuaguuggggcuggcuuacagguacagagguucaguccauuaucaucaaagcaggaacauggcagcauccgggcaggcauagugcagaaggagcugagaguucuacaucaucugaaggcugcuaguagaagacucacuuccauacagcuagggugagggucuuaacuaacagcccacacccacagugacacaccuacuccaacaaggucacaccugcucauagugccgcuccgugggucaagcacacacaaaccaucacgaccacuuaaugcucaucugaaaaacauucucaggaacccugagaagcaccuccccccuuauauaugggaaccaugcuuuuagaggagggaaacaucacacauuuccauaggagcagcuucucuuccuuagcuaaagugaugugugauuugaaccuuccugaagaaucuacucuaaaagcugauuaucuguaggcucaucacaucuacuagaucagaaaucuuaagaagacuagguagcacaauuuacaccaacaucuuuaucuuucagauaauaaaccaaaguaccucucugaagggguaaggggcgggggggugggggggagcuuaugaaacauaauuugagaaaggaagucaacagugaggacauacauguaauucaguuuauuaacagcucuucccacuucaaguccaaguuuaugcauuuccaguaaacuuuguuucuucccugggaggcaauagauugcauugcaccuccagugucuccucugcuaggaauucaaacucaggagaagaacacaaaaggagauaaagcuguggcguauucaaggaacuucucaggcgcccaagcgcuguguucauacuuuugcuaagugcauucgggagaacugaggaugcugacaaagguacgaagagaggaaagagagagcuguaacccugagugaucuuucuucagacuccccaaguuaugggggagcuuuacuguccccaaguccacucugugagaaacauccuuuugcuucuuaugaaaaauguacucugucaacaaagucacuaaagagcuugacugaaagagccucagggacaucuggaaaaaugagggucagacugaugggagaagaaagcagagcagucagaaacaccuagcaaugaagucagcuucccuguggucuacccacugagccaugcagacugacaucaugucagaacaccgucgauggcaugugucaagcaaagcacugguagguuauuucuccaaugaggugaaaugacacaauguaaaccagggagugaguuuacuggccccaaggaccaaggccaggcaagucaccacggggguggggugggggguggggugugggauaagggggagagggggagagggggagauggggagagggagagggagagagggagagggagagagggagagagagggagagagagggggagagagagaggggaagagagagagagagagagagagagagagagagagagagagagagagagagagugcaaaaugucugaauuauauagggaagagacucaggaggaggggaaguccagcuccugagcuagaaaauucaagguugggggcaggguaugccagguagggacugaaggaugcugggagaaccuggaggccaggucugcuuugguauguaaaauaggcaccucagucccuugaccuggggaugaaaccaaacacaucuauuuucuccuuaaacucacagcaauaugaaauuauuuuuuuucuucucuuuguuuuuaugaagcacaguuucucuguguagcccuggccauccuggaacucacucuguagaccaggcuggacagauucagggaugugccugccucugccuccagaguccugggauuaaaggcuuguuccaccaagucuuuuuuauauauugacuaacauacuaacuuaucuuucuuucucguuuuaaguuuuguuauuauaacagggucuggauauaaggagcccugacuguacucucuauagcccauacugaucuugaacucauagccaucacacugucacagccucccuacuggcuuaucuuuacccuuuauucuuugagcucucuacuuuaauuacuaggggauaauuuucagauuuuuuuuuaauaguuaaauaccuucagaaagcuaggaaugauccucaaccauaaaaguauauuuucauaaacggcuuuaacagcaguguccaguaugagugaugagaagauccugacaugcccauggcuccuccugguuuucuucuacauaagacuauuucuacugagguuccagguaacucccaucccuuaggacaaugauucucaaagaccacaggcaguagcagcugcaggaacucaaacuaauugggaugcaaauucucagguaauacagaaucaacuaguuaggcaacaucagaguaaggcccaguuuuaagaucaaguucugcuuuucucugcaguaggaugcccugagaccacucgcuaggcuucaaagcaacgacauuuuuugcuacacugcaauccugcuucagaugcauuuacguuaucccaagucccucggggcauagcauggccaaagcaucaaagaacugagauuuucaggguaaccagaaggaacaccuuaggccaaggaaaaucucaggcaacuccuguuccccagcacaauaaauuuagcaagacaauauagcaauggcuggguccuuggaaaugggaaagaggcuguuaacauucccuccacggaaggguguuuagaccagaaccuccccagagauuuucccugccacuuccuccaaccuccaacuucacagggauuuagggggugcuaugaaggagguuggccaagaguaggggucuagugacccagaagacuuugauucacucuacuucuuguaaaugucccucaauaaacacacugguucacccagcuggccuggucaguacgguggucaaugucuuuccuaucuggaauaaauagacauuuuuuuagaauuaucccaagaagauucacaagaaaaugcaauugaugaaaugaauauuaauuauauaguuuuaagaagacgcaugucugccaauauuuaacuucuuugcagacccagcaugauaaggguugaugaagcaucuuuuaagggcaaugcuuauccuuaaaauugcuaugaugggaugcaguucauguuccuugcaaacuucagaauggcccaugacaugguacccuuggcauuucuaaaguaggacauggcaacccauaacggguaggggagucagaguauuucuuagaauugaggaaagccucaggacuuuagaaucuuccauaagaaaagcuuuugugaggaauaugacaucuccaccagaccagcagguaguuggguuuuuguuuguuuguuuguuuguuuguuuguuuuugccccacccccccucacuguaaugcaaagcuaaauggucaacgagaaacugcagaaaccacaaagguguuuggaaauucaucaugagaaggaagguccuaugcuucaagccagccaaggacuuuagggguggagggggcagggcuugcaucugcaaacaaagacuugaccaagauuuaaagaaaaaaaaaaggaacaaggcuuaaacuuuaaaaucaagaguuuagagacaaauuucauuagccauguccugcuccaaacacagccaaggucccuaagacugaaggauuuccaaaaaaaaaaaaaaaccccaaaaagcacccaaucucaaccucacacuuaggugagaagugaguugagcuuaaggaaauuuuaucacccacaaaauuuaggggugagucuaaaaaaguucucaaaguuuuaucucaaucagcaaguuaggggaaaauauccugaaggaggaugacaagaaaaaauggccuggagaagaccaaugagcaaucucuuuggaaaaccaggacacagaagaaaaugauauacagcaauuaacggagagucgauggagggcgagaucaaagaugggugauaagacaugcgugagaugaaagggagcuggcagcuaaagaaagaaaccgacgacacaaauaauaccacuguagagcuaauaaauauauuaaaguuauaagaggaauaauccacaaaccaaaaacaaaguugaugauguggagaacagucuucagaacacuccucggaaggcagagagggacgagcagaugaaagcagguaggacaagaugacagauaagggcugaacacaaagauccaacacacagaugaaaguaugcgagaagccgacagcaaagcaaaacaaaauacacucagaucugggauagaaaauaguuaggaugacagaguggcugaugcucccgggaagaggaagagagaauccucacauugagacaugcuaugaccaggauuucaaagggugagcuaauaacauugggacauauagggaaaacgcuaaguggccuuuguguuuuucacagagggauuuagcaauggccaacaucaaggcagugucuaugaaggguuaagaaagagaguuaagacucaaucaucaguccuaacaguuccuauaaucucagugcccaguaaguggaauaaggaaaaucagaaggucaaguucauuuuccacucuauagcaagucugaggucagccugggauaaugagguccuagaauuaaaaaauaaaaaggaaaauaaauaagcaauuacaugaaacuucaaauugaaguacagguaccuuagucaagguuaacuucuaauugguaauaaaauaaaaacaauuacauaacuuucaauugcuggagggagcaaaucgaagaccauguggaugaucuguaaaugcagaagacaaaggagacccagcagaaacaugagaaugccgaugacugaucaagagcaaaugcgcaugcucuauggauaugaggaaacuggaucaccccuccuuuggaaaaugucccuggguagauggaaaacuaaaucuuuaauuguguuuugcuuacagaaggcaugcacauaggcaaaugacacagaguuugagugugaugacaugaucgcaaagauacuaagcaaaauaaaauaaggagagagcuccuccuuaguauuagucauggcuaaauucaagacagaagcucucuggauggcaaagacaaacacuugauaacauaagagaacaauccacagugaagauuuauaaugaauaucuguguccacuuaacagcaccaagagacaccaaaacaauggcaacagacaagacagaggcccgagcauugaauagacuaaauggagacagacaacuaaggauauaauuaauaucauuaacaaaauugaguuaagagauacauuuuacauuuuagaucccagaaauagaaaucguacuuuuguguuuuucgaguaucuguggaauauuuacagagguuuucaagugcccaccgauguuucccaagguccuuaaugcccaaauugagagauaaugaauuacaaauagaaaagagucuauuguuucuauucagaguacaauaaagcuggaggggugggggguggggggaaagaaggcagauuucuaagcacuuggggaauuuuuuuaaaauauucuacugaauaauuucucagauaaucacaaaaucugaacagcagacucuaacuuguaaaaggguacauaccuaaauguggaauuuggcaaagaacaguuauaacuuaagaggacauuuuguaguuauaucaaaauuauaaauuaaacuauaacagggcugggggguguguggcucaguuaacagaauacaggccuaggaugcaugaagcccuggguucaagucccaauaccacagaaauggauuugguggcauccgccuguauccccaaaaccuagugguaaagaaagaaggauggacaguucaagaucuuccuuggcuacaaaaggcucaaaacguaauaugaauaaauaaguuuaaaaaauagaaauaaaauuucuuaaagcaaaacuacuacuaaaaugaucuaaagacuuagcauguauaaaaggcaggggguggggggccagaagucaaaauacaaccaggugugguggcauacaucuuuaaucccugcaccugagcagcaaauggccuucuguaagcuagaggccaggcaggacuacauagugaauuccugccucuaaaacaaaacaucaaaaaaagcaaauacugacaagacuuaguaaguguauuauucaaacucauauaaaacgaauuaaaaugaaauuaaaacaaaggagagccuaauuaaaauuaaaaaggagcagagcaaaacacaaauucacaagauuaagguaguagguacaaacauucauuuaaguuacaaugcuuaaguuaugacaauuuaccuaauauaauuaauaauuaucuagcaacucagagauuaucaaaauuaauugacaaagggauacccuacucugucccuacacacacacauacacacacacacacacacacacacacacacacacacacacacacacacacacaguaagacuaagaaagaguugaaaagcuuauccaacaagauuuaagaaacaauagaauuaguaaaccagaugcuugucaaacugccuggccuauuuccaggauccuuaccaaagugacuuccagagccagugugaagaagcccucaaaacucaguuucaacugacaauaguggcuugauuaggacugggugugguggcuccagaccaguaauccuaguacaggagaggcugagguagguggaucuuggugguuugaggcuggucucaucuucauuagugaauuucaggccagccagagauauaaugacaucuugucucacaaauacaaaaggucagccaaugccuucuccagauauugaggaaaauauuguuauuuuaaaauaauccccggcaacccauuacaggacugucacuccaugcugaaguggggugcuguaauaaagaagcuaguauuuuaauauagggaguccaucaaggcuauuugaaaugaagagacaauuuguucaauacagaaaaggcugacgacaccugauaaacuuuaaacucagcaccauacuuaauaauuaaaguaggaaaagucccagcuuaagaauaaaauuugaaaaaaaauucaggucaaaacccagacaaguagacuaucguggccuaugccagaacuagggagguagaagcugugggaucaggaggucaaggucagcuccuagcaaggcagugauuuuugagguuauugagagcuccaggagauccuuucuccagcaaacaagaguagauaaaagaaagcagaacaaauuccacagcacauuuguuuaagaaaacagaaaguuaggugggggaaggacagagagcuaccuguguuuagucccaggaaaugaugcuuccauucaaagaagugaguucaagauuuacugcuuaagauaaagugaaauaaaaagacaauacagaguaauuugguaggaagauugaccaccaaagaauuucaacuccucuuuuagaguuucuccuccgccuacauucuuuugacaacucuaccuccgggucuuuaauggcuucauuaucucggguaaucuguauucaggaauuuucuaacgcuagccuuagguccuggagaugauuuccaauggauaccuguucagccucaagucucaaucagcggguugcuacaguucauugaaaagccuuuggcuucugggagaaaaauagcuagauucuaguuucaucuuccagagacuucagagaguagaaggaaaacuggccaaaguucaaccucauuuguuuuccuuuagugacaggguaaaaguuugagacuucuucaaaggugcuuugcacaaccuucaaugggugccucccccagcaguccagauguuugaagagcugcuucugucuuccacucugcacugucuaauucugaaaaagguguccauuuuccaugggucuuugucaggaccucccggcacuccuccuuucccuauucccuuccugccaccguggaaaguacacucccauuucccaucggagauugaucaccggaugugggcucuuguuccaugacugcuucaucuggaagcucccaagagaagauagccucagaauccuuggcuugguucucaccuccauagccuaucaacucuuugcaaccuugaaauucuccaagccucuauauccucacuuaugcaaagugacgccuguauuacagggcuguuguaugucaugaccuagauaacaaacauaugaccuggauaacaacuauaaggccuuuagcaucauucucugccauggguaaagacuuaaaacaguuggcaugauugcgauuaacucuuuuuauaaggcugcuuucgugcuccuuggguuccaaaucucgacaucugccagggucaggaacgaccaaccuucuuaagaagaaugguaagauaguccgacuucaaauccuuguuaaaccacugucuaugagguacacuccacgaaagcccacguuuuccuuuaacuaguuuccuuccucggacaccugcaacucuccauauuuagcagcugccccagcaccuucaguuuacgaguuuccuucagacccaguuuagagcagaaccucucaaccucagcacugccuugacaccagaaaccagaucacuuccuuugaggguucccggggcacugaggaccuugagcaacauuccagaagcuauguacccaucagaagcuacgagugucuaccugccaaucaggaauaauaaccaucauuacucuucuggucuucccuaaaacaugacaaaaugaccccuauuagggccaaaucaguuccaguugaguauugguuuugaguaacauuuucucccacagaacuuuuccugguaccccaaagcuaggugaaccccgagucgcagaagcauuucccacacagcaccaugugccugucuccccacacaagcacauuaggaguuccuagaaccugcaugcugguccucuacuauguggaaauagguaaaauguuagccggaucuaaagaaccucaugcacacuaaacauaaacaugggcuccaagggaacuucuuccccaaagaugcuuauguguuggggaaggcucccggcaccuuaaaacugacaaacuguguuuuguauguguguggaagggaggugcggggugagggcaugguggagacacaaggguaaggucccaucuggccacgaaucagaggccugguggcucggggcuauuccagggcagaucagcaaagccuuucugaggccuuguucccuguucucaaggacaagucaugucccucccucaucucaaugccacccuugucucaagacuugagacacauuuggcagugugggacuuaaugauauguuucuaccucuguccuccuuuuuuuuuucuuucuauccuugugcacauuacucucugcuccugccucuagcaaugacauuucagacaaaggguauccacacaaaauguaucuuucacuaauaaaacaggacugcauuccaggagacuaguguauuuggaggaugagaauuaucggggcugaaaagaacuaguaacaguuucuuucuauggaaucacucaagacacacuaaguccuuaaaagauucacauauuaaauuaagaaugaggucacugauggccaaggcucaaucuaggcaaagcucuggucaccauagcccaagcaccuagcuccuucauuccacaaucuuuuccuucaagaauuuguaauuuggaaaauacaaaauauagucuucuacuauuuaaacuacaacaauauaugcuaguggauaaaaacuuggaagacacgggccccgaacccugaacagcaaggucuucugcauggaguugaaaagcacuuucccuuugucugaauuccagcuucuauaauguuuguaaguuuuuauuaguguguggguuuuacaagcuggaaaacguuuuuaaaguuuaaguguuuccacuaagaacuaggaaagcaagcuaacucaucucucuauuaaaaaaaaccaaauaaacaaaagaaccaaccaacuuccuccagguccacacauggcugucggcccacacuuuagagaauguggggguaugugaucacuuuggugcuuaaauacuuuaugaguucacacaauaauaaggucaugugaccaaaauggcacagccaagacugaccacagaacacuaacugccuauuagcagauggaccaaccucaauguucugcuagccaacuucauaacccacaucagaugcgucuccuaaggagaucaggggguggaaaaggaacacuuauuuagcuucuguuguuuacaaucuguuguuuacuccaguaacugaccuuguauuucacacucuuauugcguaugggagggcacagucucccacaguucuugugggaccguauacuuuaacccucccucaaaacacauggaaacacuuuaaaugucucuccaggaaaucugaaaggcaguacuacccucaaaagauaggugagauagcagacacgcucaccucauuccacaagugagguccugaaaccaagaugggaaaaucugagacucagugagguaaagucugacuuugaagugucuugucauggccaaggccuaacccaucucacauuuagauggugaagagggaaucuuugacccagaguucucugcuuucauuaaaaauaaaaauuaaaaaaauuuuaaaaaaucauuuugaauugagcccagacaaaugaacuauugauugguugcuaagugccaacaccauucccuuauggaauauuugcgugccuaccagaaugauucuaggcauagaauuuuucucuaaaagaagugugaugagggagacaaagacggguuuaaggugugccuuuucugauaaguuaaaaauauaaugacgcuaugguuaacauacaaaaauuagcaaaugaagaaauccgaggacucuaaaaugaaauauagauuauucuuguaauacaaagacagagagaggugccaauccaggaacuugggaaaagaagcaacgugaguuaagguaggaaggguggguuuaauacugaguacccuggaggcuggguaugaguacacaccuauagugccagcaaaugagagauggagguaagagaaucaaaaccaaccuugugagucaaagccagaugcuauccaaaaauaacaacagggcuggugagauggcucaguggguaagagcacccgacugcucuuccgaagguccgaaguucaaaucccagcaaccacaugguggcucacaaccacuuguaaugagaucugaugcccucuucuggugcgucugaagacagcuacaguguacuuacauauaauaaauaaauaaaucuuaaaaaaaaaaaaaaaaaaaaaaaaaaaaaaaaaaaaaaaaaacaaaaaaacaaaaauaacaacaaaaaccuaaaaccaaacaccaccaccagcaggauguucugaaaaggcagaaagaagauccugguagccugugguacugcaugccuuuaaucacagcacuuggaaggcacaggcaagucgaucuccgaguucaagaccagccugaucuacagagugaguuccaggauagccaaaguuacccagugaaagucugucuagaauaaccaaaaacuaaaccaaaccaaacaaacaaaaacccccaaagauucuagcuaggacuuuagcaaagaagacuaauagaaucucauccuagcuucaccuaccaucuugacuucaggcaagguacaaaagagcuguuuccucgccuguagagcaggacugaagaagauaucgucuauguagucucaaaugucagucuccucugccacccucgcuuuggagagcaacagggaacacuuagcagucuucaucagaggaacauaauauaaugucaccuguauccuggagauuaaaggacacauuauggaggacuucuacaggaagggaggguggugugacacagccgaaaaggcagcugcugagaccagugucuaucgaugagauaaaauaagucugggcugggaaggugcacuagggugaagaagagaggucacgccugcaggauauuuagaagggaggauagacagaagcuaacacuggaugaacuccaucugacaaccaggucaccacuuucugaccgguccagaguaacuaaugaaacguggccgggcuugaguuuuuaaaaacacaugucaagcauaguauguucuuugugauagaaggaaaugaauuuuaaaagauaguuuaaaauaauucagacaguuagucaaaagugcacuggccuaugaaaacuacauucucguguauuuccuauuuaacuagagagcaaaagacauaagccagccuugccucacagaagcaguauaagguacaacacacacacacacacacacacacacacacacacacacacacacacacacacacacacacacacucuuuuaaauuuucuaggagccagaaacaggugcaauuauccaaagauauuauuucaucaaucaauauaaaaacguauaaagauauuuucuuuuccuaguagguuucacacuucaguguauuucagacuuagaacagcacaucuacucagacccggcacauuucaagugccuaacagacaccagcaggaugcagcucagggcuaccauaaugacuaucauagacugacagccuuaaaggauccucuugaacaugguacuuauucuagaauuuucaugggcacucaccuguggucgucaccucaggcagcuaaacaucuggagagaauuaaaauguuaaucuaaucacaucuggugauagaauaacagcccuggaaaacuuuuucguucuccuuaagaaugagcaaauaauugggauccugucuacuaagaaaagaaugguauuucaucuuauggacauucaccucuuacuuuuauguauccucuguaaccacaauacaacggucuuuuccgauguguaauguacacgaccauugcguugccuagucggguauuuucaaaaggugccaaacccuaaugcccauccgacugaaaacaaucuuccgccaacaggaguugccuugauuaacaccuggcaggacgagucugagggcccgccugucgccugaguuugaauacagucauucccacauaacugcuugaguuuuuauuauuauugauugagggcagagauggggaugggguugagaccagcucucacuuuauaacccuacucuucucuuccucuguuucccaaaugcugagauuacagguuugagccugcaugcccucccugccagcuuccuugauaaaacagguuaagugcucugugcuuccguuuccucgcccggaaacacugaugaauggcgcagucuuucacgagguccucggaaggauuaaacaaaguaauauaugaaaauucuuuggacacauaaucuucaucuuuaauuucagggacuuguuaaaugcuccagaaaugccagggccacaugucucaaacucaaguagguuuucgggcagcuuuccacagaguauacaacuagccuggcuacacaugcccaucuugaccuauaaucacacauuuguccccacgugcaggcuacucaaccugucugagccuccgcuuucucucaagcuacaugggagggacaucucucauaggcuaagaacaacaacacagcuggcugggaucauuacaaaauacagggaaaauuacacuaggcaaccaggacgacagguaaccuggccaguagaaaucuaagcuaggccugaaaggugucccaugucuguuaucccagcauucagguggcagaggcuagagaagagcugugggauugaauucgccucccuggguuacauagcaaagccaugcauccaaagaagaaacaaagggaggagggagggaaggaggaagggaggagaggagggaggggacacauuucuggucucuccuaagcaucagcagcacauucucuuucuugugaguacgcuguagcugucuucagacacgcaguaagagggcaucaguucccauaacagaugguugugagccacgaugugguugcugggaaucaaacucgggaccucuggaagaggucucaaccucuucagugcucucaaccucugagccaccucuccagcccgcacauucucuuucuuuucuccaccuaggcucacuuguugcuuuaagcacaucaguuugggaguaaccugauagacaccacuucugagaagacuaaagguacagggaaacaguuaugacgcccaccaccagcuguuccagggggguaacuauugccuugccaaaucguucccagguucguaaccaccacuccgauuccacauaagccacggcaagccaugucagcucccagccccaaggacucgucugaagagcauggagauuuccuuccacagugauacauccucacaagguuagaggaugucccccgaauacccucaacuuccuuuaaaagucuaggaagcaucugucauuuggguuugaaucacccgugguguacuggaaaggccuggucagaagauaggauuucgggcucugugcuggcauucgaccagcuguaugacuuuggggaaguuccuugacccugcgguccacagagaguacuuguuucaugggguugcuguggacuguguauuuaugugaugagucuugaagucccucuucuccuuuacgagagacuugcacaucaauguaaggcguagaugucucuaaaccucacuuccuuccucuuaugcuuugguaguguauuuuuaggauuuggaagauagaaaaggauucuugcuuucuaucaccugugucuuccccucucuucucgcccagccccgaagucaguaaccaacgauccagaccucugagagcaggaagaggaugaagccaaggcaacaagccuggggccaagaugacucauggcuguggaauccauuaacgguggaaugcucucugccuuucuccuccuugucaaguuucuggguuagcaagguacagaugaccgauaaagaauucaaguacuuuucuuugcaggucugaauucauuuauaccugcauacauauaugcacaugcguguacuuucagaucaacagaacacacucaucuaucaagugcuauaaaaacaaaagcugacuuguuaggaaaaaaaacauguuugauaaaguacaguauauuuuccaguugucuuuuucuccacugggguuugguaaauuaaacguuacaaauuuucaaauagaaguaaaauguuaagaauaaggagcaaaugaaaaaguggauccugaaagucugggagauugccuagacauuggauuguagcgcuaacggaagaacacaacacagggccaugcagauuguacgcggagguaaacaaugauaggcuguuauguuuaaaaaaaaaaggucaaaagccuaaagcuaauaacguugcauuacaugcucguauagaaaacuacuuaaucuucugucugagcugcucuuuaguuaaauggggccgggauuacagaacaagaguaaaggaccucaaagggaacauuccaaaaccuugugccuggauuuucucccacugcuguacauauuaaaauucuauuaaaccagcugcuaauaauuuucaaauggcucauuaguucuacccaugaccuugggccacuaccaauuucaaaccuugucuucaagucuuaaucaacagccuuggauggaguccucuucucgaaauagcaaaugcauugugggcugcauagaugcucuucagcauccgcggacuugugugauauggaacuuaaccuaaaaacuccagucuucuggaaagacacuagaguuccuucucuaaagaaagguaaaaacgaaacuuuucucucuuguuaaaaaacuaaaacuaaaaaccuuucuucuuuaaaaaaaaaaaaaaggucucuuucucuguuuaguaacagaaugccuagaugggucuuucaggauacuaggaaauucucuuguaugugcuugaucaacaacgggaauucauccaaagggaaaaagaaagaaaaaaaaauuccaggaaaauauacccuaagcucuuucagaugaaucugagcaaacgucaccuuuucuauuauaaucagggcguggagggaggaagaccucauaagugauuucauuugcagaugcgauuuauuaaagggacugaagacgacucagggagagaucagcacugggagcaggcaugugccaagaccaaaaggaauguccucuucuugggcuuggaagagaaaauauuuuucucucuugugacugucuuaacuucagaagcagaauaagaaaugucaauccacucagagcuucccuggcucuccauuuccauucuuuccaccacagagaaggggaaaggcggcccauugugugucccugccaacggguggggggugggggggggggaggaagaagaagaaacacuguuucuuaacuuucagaggacacaguuaccucagagaaaacaaaaacagagauggucagagauuauucuggaaugaaacguuagaauuuuuuuuaaagauaucaagaaaaucuggguauucaagaaauguucagaauuuccaguggcaaaaagcaaagaggccuugugguuuauguagaaggaaaauguucuguuuugcuuugacucuuuuuuguaggguuuuuuuuuuccucuucaguaucuuugcuccaggaagagaacucuucuuccacacagugaaaauuccaauuaaccgccccuucccuagaaccucaucauuucacuucuucagccagauacaguuuguguccuaccucugucuucuuauuaacccucaccaaauuagcuaaaacuccugcguucuuggacuagccacauucuuugugaaaagagaaaaauucucucaacuucaaggauguauacguuaaggacgacacuuagucuucaagaggaaaggggagaaaguugcuuggcucaucucuuuguuugcugugcuggcacguucccaggcagaagaacgugguaaucucaagauaauugaacaacauagccccuuacucgcucccuaccaugcaauauuguuuagcaugacagcaugaugcaagugacaugagcagagggcaaaggcagagaaugaccuggagaauuccguacccgagcauaugcccucugaccuagucacauuuggcuacccuaaggcauucaccagagcucagaagacaagcgagggugcaucacugggagugggggaugccuccccgaccccucuggagcuuagcucaacuacggaauguauauguguauauauauauauauacuggagcuaggcaugauaauucauaauucauaaucucagcacuuaagaggcagucaggaggacccucaugagucugaagccaacuuggguuacagagagauuuccaagcagugagggcuacagagaaaaacaaaagccauggcugaggauaaacaaagaacagcagagagaugcaaagcuaaacuaccuuauggaucauuucaugaggugaccugguacauaccccuaaaaggauucuggaagauauuuuggaaaacugcaagccaagaggcuaggucaccaguauuccuggaagaggucuugcagagacugaguuuaugauuaggaugcccccccccccuguccacacaugcagcaaaacugaagagggcacacggcguugucaaagccaagaaauccauuuuuacauucuucacugccaaaagagugauucuaucacuguauauuauaaacuuuggggcggaaccucaucuaagaauguucaagugagucugagaaaagucuagucuggaaauccagugagcaaaccagaaagguaaccgagaaaccugagauccacaugggaagacccugcaacccaaaauacaaauucucaaagaaauggucacaccuauuauuaguccagagaugccaucgugagcccacaccuuauucaccuuagccaagcaagucugaaaggauagccaggaugcuguccaagcagcuuugagggagguaaucaccagcaauuaaagaugagauagaagccaaagaaaauaucccacaauguaccacuuccaugugggcaguagguuauaccugugggugacugaagccauagauacuagaauaugaggaaugcagacuagguuuuucauuucuguagagccaauauuuaccacaaaccuggaaaaguagaaaaugcucaguaaauuccuuuuggugguugaggggcuaggacauagaguaucugcccagccauacaucaggggcuaguuuccaauccugccacagacuuuaaaaaaaaaugcaaaaugaaugaaugaaggaaugaaugagagggaaaacuaaagaagcccgaugucuugcuuucaauaacagggaaauagguuuucucucuuaaaguaacuaagcagaguccaguaaggcaaggaccuagaaauaccagaaaucaaauccaagagcagggcagggagaaacacagccugacaacguucuccagccuagcuccuuuuuaaccaggcauccuuguacacguacugcauccuauugcuagcacagauuucucauccuaaagaccgcagcauccgcaaccacggccugagcuuguuaacaaucacagcccuccaaacuccaggaauacaugggagcuaagagacaccagaguuuuacaagguaaacggggccaacaacuuuggaggccucuccuuuaaaagaggugggcaggacagguguguacccggggcggaugcaccgacuuccaccucggugccccauuaggccaauacuuugcaaaaccaggugugcacaauuugcuuauuaaaguucucacccuggggcaacugacaagacucaucaguccuggaagacaagugcugugaccccaaggcaaguuaaagcacauccagaauauuuuaaacuagaaagggaaucuuuuuguuaaugugaacaggagucauucaagcgaagacggggcagagagggaaaggaauuaagaaugguuuauucccaguuuauuuauuauuauuauuuuucaagcuaggguuucucuguauagcccuggcuguacuggaacucacucuguagaccaggcuggccucgaacucagaaauccgccugccucugccuccugagugcugggauuaaaggcuugcgccaccacgccuggcuuuauuuccaguuuuguaaaaaacauuauaccacugucuugcaaaacugagacucaaggaaugaucgaaaggagaaaaaaaaaaagagcuguaucuaugauuuugcaauuaguauuucaccagaaagcacaaguccuucaagauuuuagaacgaacacguuguugcuauuuugguuuucugagauaaggcaucauucuauaguccaggcugaccuggaacucacuauguaggcucaggauaaccuugaacucacaaucuucccacaucagccuccagaguucugugauugcuggugugagccaucaccauacucagcucgagccaaaaugcuuaaacaccaagauugcucagaaaucuggcuuaccucucuuccuuggcugcagagaaaaugagaaacauggagaagccaguggaaauagaccucgguggcauugcuaggacagcgguucucaaccuucuuccuaagcugggacccuuuaauacaguuccucaugcuuugguaacgcccaaccauaacauuauuuuuguugcuacucuguaaauuugcuacuguuaugaaucgcaauguaaauaucuguuuuccaguggucuuaggugaucagaccccugugaaagggucguucgacccagaggggucaagacccacagguugagagcuacuggccuucggcaagugccugaugcugaagacaccaaauaaaugaacauaugauuaaacaaacagccaaaugggccaaauggacacaccucgguuagaaaugacugaggcucuuucugcuguuagcagcaguagcauucaucucuaauucgacauuaauggauagcucuaccuggauugcuccuucccugcucaacacuaacccuacucaggccaaaguauuaucaguuaggacuuaaggggauaaagcuugacuuuucgggugguagguauccuggaggcuaacuaaagucuacauuuacagaacaauuaucacacagguuuacauuguucuagauuacuaaaaacccacaguucccagaccgccaggcacauagcuccucuauaucugcucucacagcacgucaucucuggaaguuuggcaagggcuccaaaauuauaucuaaugucuuaugggggucugguuucaagaaaaaucccugaccaaagauuuuuuuucccccaucuaaauugauggacuacauuaugcuaaggauaaccccaaagggccuucucaaucccggcucuaucauucuaacuacauaaaauuuauagauuccaguaugcuguaaagcaaucaucuucccugugaacuucuugaucaacacuugacuugucucauuaaaguaaauuaggagagagaaaggaaagagugcacaaugagcacuugacuuuguccaacauccugagagguuuugcucgguuuaacaauuuaggcaccuucagcaaaucucuucaauguuuuuagauucagauucucugaaacuagaagguuccuucuaguuucuacacccugguaaaugguagggguccugagaaaauuccuugguguggcacuaagguccuaguugagguauguuaacucuaagccagugauucucaaccuuccuaacacugcaacccuuuaauacaguuccucaugcuguggugaccgccccagccauaaaauuuuuuuccuugccacuucacuauuguaaugaauaguaauguaaauaucugauaugcaggauaucugauaugcccacugguugaagaccacugcucuagaccauucugacaucuuugagccuuuucuccuuuccaccuacaggagagaauucaguagcuggcuuaugagaacacuccagagaaagcaggcaaacuagacagcguguaggaauggucucuaagaagauggaaggcaacagggagcuggggaauccucaacaacaacguacaaagagcucauccuguuagcugauaaaaagcccacggugaaggccauuacggguucaaaccacuacuuacccuggauaagucacagggacaagcuauucccaaucaguuccugcuuccugauuaaacauucaguuucucacuuucaaccucuggaaguggacugucuccaagaacaucaagugagaagguguuuagcuagggagucaaucugauuuuaaaagggacaacaaccguggggacgugccaccuccugccauuuaucuucucccacccacucagccuucucugcuugaucuuuacucccuuccaacaagcccagacaaagcacagaauccuccaaaugaagcuccaggcagucuccaccaaucaaucaaaacuggcaugagcaauagaagcucucugccaacacaguugacguggaguaagcauggaucaccaaggcagaaaagugcaauugcaguuccgguuucccuggcugacuuuccuacacuguggacuuuggaccaaucacuuuaagccuuugcagagcuguaagcaaacugaaggggcugggugggacgacuucacagguccacauaaugaguucacauccaguacagaugagaguaacuccuucccuuucgacccugucucucccuucugcuuuucuuagcugauacugcugaguauuuggggaucaagguuuagagugugcucacagucuaugucuggauccucaaggcggcauucuggcauuuuauuuuuaaaaccgggauccaguauccuugccagcaugcaguggcuugaacccugcaagcuggauacccuugagucauuaucaacuuucgaaauaggcagcaaaauucacacagcugagcagaaacacuucaagcucuacauucugggauuuacaaaaacaucgugaagucaggcaaagauuaaaaucuaaaaagugaccuaaugaagaagcaacucccaccaccuucuaaccacccagcccucaguucuuuuauuaagucacuaaugcugaaugaagcaagaguccuucugcagccugucaaccuaagaccaacaaacccacuucccagcuauguguuauauguugguuauuacuuaaugaaacaaauaauucaaguuugucaucuuauucaaaauaagcaacacacacuucuuaggcuacuuugugcauacauuaccuuuuucugggggaacccaaagccuccgucuaucuagaugagggaacuuccaaagaccaaauaguuaggaggagagcaugacucucucuggcauccucucuuucucaccaagugguuuacacgaggacaggccuuuggaggaucggugggaacuggaagcucucaggcaucaacugggccccaaaccaucaagcaaucaacauuagucccacuugcgggguggccauuucaaguuguccuguucucaggucuucauagucucaucagcgcugcaccauaugccuaaggagugaccucaugcagauuucugcugggaaaucuggcaugggacaggaugguuugccacagugaucugagucacagcucagcaacaugucaggguuaacaagaucacauguucagcugccacuuaaagccuuggaggcacuucaaccucuuaacuuggguaagcauuaggagccuagcagguaguguccaacuccucaaaauaacuuuaaacuauacucccuucuuggaacgucuuagcaugccaaggacaugaccaugaguuccugggcuaugaucacuaccuuucuguuacuaaaaaugacugcuaaucagauaaauuuccucaaauuucuucuguaaaguccuucucaguuguuucuccugaaacaacauucuucccauccccuaugaaacucuuagcauugaaacaaacaguagagaagagcccuucucugauaacacguauucuauggccaacucacuguacugugagcaugguguuuuaugguaaauguguaacagguuuagggguagggaacauguaaaaaggagcaaucuccuuuauucucccaggaagucaacuguccaguccugugccugagggaucuguugagaugagcgcacaguacauucuagggagacaggcugguuccacccauugcuuugaagcagaaucuucaucuuccaaaauuaccucuuacccuuuggggcaagguuuacugaacugguccagucaagucacuccacacuaaccagcacagcuacauaucaggcauacuauuggcaagaucaggcauacaacacgcugcucuuggagccagggucacucagaaauaggucagcuaacaguggcuuaauguaagaggcagcagcuucaaacuaggcuguucugaggcuacacggaccaauucccuggucaacaagugugucucuuuauuaauagaaaaagaacauguuuuuuacuuggguaagucaguagcaauuucuuuguauuuagauauuaaugcaaugaccuuccuuuguuucugccaaauggauuaaaaugaaaaccauguacugacuuucauuaaugaagguggguucugcugacacaaccuucagggugggagggaugggacagggcaaaggaggaagauggaaaagauugagccugacaauggagccugccagucagacacuaaaguaacguuucccaaacguaaaucauucauacucaguacccuuaaggugcccuagagguacuacauuccugaggaagaaaaaacauaugccuauuauuccacagcuccaacaacuaucagcucuaguccuuugcccgcuuacugcaugcaagccacucaaacacaguggcugcaucucucuuccucccagcacagugacaacugugcucaaggccagugggacucugaggccuacacauccucugcucccagccuauauauacccaacgaaccuuaaagccuaguuucaguaaaccuuuuuaguucuaaguucucagaauaauucugaagagcaaccaggauuaaaaaucauaauuuuauagugauuuuuaaacggaggugcuaacuaacccuuuccuugccaagggcacgcacacacacacacacacacacacacacacacagagagagagagagagagagagagagagagagagagagagagagagagagagagagagagagcgcaagagagcacgaucacacgcauacaugguuccucaaacaucaucaucaagagcaauggagaaagcagaaagguucuucacuaccacucagauacccacaauuagcagccuaggcccauagauucuucacauucugagguucuuaaaacaaaccacuguaugucugcucugaaagucugcucaucagccuccaugacugcugccagcuucucggcccaucucaaagacacuagggcugcuguuuccagguguagcgaugaauaaaaccaaggagccucaagacugagcucuggacucaagccaauguucagacaagauuuacgaaucccuuguagagaauagaaaaauaauaacacaaaaagccaaaccaccugucguuagccacaucuaaucuaauccuuccgugcagugacaguucuacucagagcacucauugugcaagcaaggccaagcaagcucaguuggccuugcuugcacaaugaaugaacuaaugaugcaggccggugugcaaggcacucugggaaaauguaccuccuugcagugaacugggaugacaaguggggauuaaaauaaucggaaguggcaaacaagcccgugaggaggagaaucuuuucauuuccauccaugcaccgugcggccuuccucacacagcaucaaugcggaccccagcuucagaggggcuuugacugucugcugccaccaucgccucacuuuaacacauacauucuaucagagugcguuccaggaagcauauggcaagagaacuaggucaaccauuaaccaaauaacaggaaacugcucugcagcgcacacccuucaaaagcuugcuuaaugagcuggcucuucagaguauguccuucagucagguuggaacgaacaggauccauggguuucuuuaauguggcaaggucaccugaguccuagaagguuucugcacaaacucgacuuucaaccaucuaaaccacugcauugaaauguucaagaacuaaagucaaagauucaaagaagaauguuuucugaauccacuugacugcccgcaaagagcgucgacuauuaauucucccugcuucugagcagcgcucugucaaauugauaggagacacuauaugcucaucccucuuugcagaacacuucucucuguguuccuucaggcaucugcaccaccacucacagauuccacaauccacuugggacuuaacaggucaaacaaagucuuaguuucauuaaaaacuaggaaugaguuuccucuagaaccacugaagggcuggaauaauuucauauccuugagucuuacuucuucugcuccaguaugugugaagcccuauuagaacuaucuaacuuaauaaugaccugaaggaaugaacacgcuuacaagccaucauccucaaauuagcauccuccuacagcuaccaaugaccaaucuucucggccucuuuaaccuagacagcuagccacacauccugaauucugagauguuacguacuauggaucuggagagcugggcaauuuccuuugauggagaacuuaaaugucaaaauaagucuucacuaacauuaagagccgucugucuagugggauuugugucagcaaucugcccuccaguaucuucuagucuaguccuucuggugaccaauaugaaacacaacuaacucuuggucaucaagcuuuauuuugccaacugauaacuaacuaaugcuuucuuuuaaaaagagucauugggguuucagggaacaugaucauaagcaauggugcauugagcuagaagccaaagaaagggggauuccaagagacaaguagauaguuaagucuuuccaaucauggcuaaccauaucucccauuucuauucuagucuugggcauuuucaaguuuuauuuaaauauguuaauugcauagucaaaaauaaaacaaacaaacaaaaaaaaccuuaauccagucuaaggaauuaauaaauaaucuauaacaaaauguucgagauaaugcaaacagguugaguucuuauucuuucucuacugaugucucaggaguagaagaaaaggcauugcuugacccugaagccaagaguuaaagguuuaucauucucaucagggagggcuucaaggagccuccagaaagggacuucaugggcaacucaaaggcauucuaguuccaauccagacaggcacagcuuaacaaugcucucucuacucauuuuauaaaaauuuaagguugagagagaagggaauugcuuuuuuuuuauaugcccacuauaugucagacucugcaguagagauuuauauucacgaucucauuucuuuccuccauaagaaccuuacaaaauacguuuucucuuuccagauaaggaaauuggggaaucguucacucaaggucaguucacuaccagcugccuccgaagccuaagaucuucuauauacauaccacaguccucaccgccaaggucuucuuugaagggcuccagaaugcugauagcaaaggguucccuucuguguggccuuccucaggaguagcaaucaaaggcucaugaagaugcacugcccccagauauaaccucagagacccuuggaagcauuucucagaguacccaaagagauacugguaccgaaggcacaggaucugagcuguucaugagauccgaaacaagaugaacccaguggguccuccugccaaaugccuguccuuacucaucagcuggggcaugccaagaccucccuagaaugacgcaggaaaggucaccaggggugaucccguacccaugaaguuugcuacaaagaaacagcucaggacagagacaggcugauccuuggaaggcugccaacauugucucgcaggacucaaaauucuucaacuccuugccucuaucaaccucagagugaagcucaagaggugcagaaaacagcugagagucuaaagauuaaaggaccaggaauccauggauccaaucugccuuggagaccacaucuucacuuuggccucugggauuuccauuguaacucucuaaggaaacagaaggcuuuccuuuccagguacccugaaguucugaaggcagacauuuaaacagggaaauacugaugcaguucacaguuaugaaagaccuaacuuacaccauuaauaaaaacugacccugacaaccacgcucuaugcuagcagcuaguuccaugggugcauagcagaauggcagggcuacugaaauguagagcuacugaacgaacaaacuccaagucuguacuuggguugggagauguggcuaauuuuagaaggcagacuuuggaagggacagagcugggacuugucacuggcuuuggguagcccucacaccuacagccaaccagccccaagucaauguuucucacuccccaggaaaacgagaggcuucuccuuuaggagccucggaugauagcuuuugcaaugcuucugcagauaacuaucugagagauguauuuauucagaagagaugggaaaaucauuuugagcaggcagcagaaauugagagggcucccagugacugcagacaagucugccagccccauuccuauggaaguccuagcacacuccauaccucgaaugcacacaaaauacagugacagauauuauuguugcuggggaaucauacaacauggggaaauccaccauuccaagagucaggaaguuacucucuccucaucgcagacaacuaacuaacggacaaucccccagacugucaggcagugugcacucaagaaugccaagguuccagcccgguggacugauguacuugcuucucagccuucgaguuuaacagggggaaacaaucuaccccuccaauuguggacgccuucguuccagaagaacucgacagcccugauggcucucuccagcuacacagcaauuauguaauugcuuagccucugcagaagcccaggaacucucccgcagccuucuucuuacggacuccagcugcagcacaauguucagagaugauugcagccuuugaauggauggccagucucaaagaggagcacagaggcaccuacaaugggauuccaucucaagcacaaagauguuccugccuaaugaagaguccucucucuccuccgcccaaucugcgcagcaaacucuucccucugcccgccccuacaugagucuggacuguggcuuacuguuuaugcugacagguucgaaaagaggcagagacaccagcugagguuuugccacggaccauacccaggguaaucauuuaacacguaaugugaaagcuuccgaaggggacgagaagcaaaagggguggaaagcaucucucuaggcuuccugcacuggcauaaaaugacugcuuccucuccuucugccagcuccaauccuucauguugacauuacacauccuguacuguagauccacccccaugcugccgcuugcccggcugaauuaucuccugcgucacagcggugguaacagaacugcuggcucggcagaccugagagcaccguuuccauguuuaaugcauucagcaacuggacacguuaccagugcagucagggugacugguuuguggucuucucagcagccagugcaauacuugaccuaaccuucugcuaaccagauggucuguuugccucuugggaccgaaccauuaaacuuuacuuuauuaaauuccauccaaauguggggacaauuuacagcagcgugucugguacaucuccaacaggguugcuaagaugaaaaugaccuaaaaauaacuggaaacucuacuucacaccaacagagaacaagaucguuuggaguaaauauuuaaaugaucugccagauuaggaagcgcagcagugcugacugcaugguuaguaaacuguauuguguacacacacacacacacacacacacacacacacacacacacacaccuuacaaagguaaagacaugaauaaaucuauagaaaaauccacuacucacacccuguaccauguccccaggcucuuuuaaugugucuaaagacaccaucuccauuauaaccucucaaaccaaggaccuaagcacaauucugauagacagaucccacauuccccaagguugaccaucuaggcacaccgcccacgggccugguacgcaaaagauauuuccugagugaguauaugugcaagugcaaacuucuuuaaagguaacaacuuccauguaacacaucucauggcagugaagccauuaaauucuuuccagcucuaucaucagcucacagugaggcauggaaaccaggccucccucggcugacuggcaaggaguaagucaucugcgccagucauuggguggccacuaauucaucgcugcaaaugagcugcagaaguggccacuuacugggcaccuggcagggugcugggugcuuuacauacguuaugccucuuaggcuuucaccagcgggaacggaauucucuaaagauaagaaacaaaacaaagagacugggagccauuaggauccugaccugaggauucaaagcuagaaaguaaaggacagauaagggccaacugcuuuucuccauagccacagguaagcagggauccuguuacagguaguuaacggaauacuugggaagcuaauggcccuaaccuaagguccaagagaguagaaagccuuucuacucucagucuuuuacgcgugauaaguauuuugaguuucagcaccuaccuuucccaccaauauuucuuagggaauugagggcuauuauauauaauguagcauauacaauauauguaauaauauauauuaugugauaacuacuaccauacccauggcuauaccuccauucuuuuagguuuugguccacccuccacgacuagcaauuuuucaucugggccugguucugcagguuugggguacuuguugcaaagcccaacaaacugaauuugauccccagacccacaaaguggaaaguaaauggagcuacauacauacauacauacauacauacauauauauacaacccucauacauauaaaacaaaccaaccuaaacaaaguuuuuacgaaaaggauaauucccgcugauagguuucaaaccugggacaaaagacucgggccuauuuaacauauuaaaguggacacuggccaccagguccugccagucucuaccaguuacagggcauggcuggcaugccucuauccuaaacucucaagcccacggagcugggcugcucuucccuauauaauccaaccauuuugguuacucacucucuuuguaccuuugggucucuuagcugcagcaccuggcuccgcacucccucccuuucccacuucucccacuugugguacaauucagucuggucaugaccacuuuggccucucccaaauguuccuuccgcuggcuaugcucucccacauaucuacaauaaaccuuuuccuccacuauaccuagaggcagucauggccuuucuucucucucucucucucucgucucuuucuaucuuucuuuucuuuucucuuuucucuucucuucuuuuuuucuuuucuuuucuuuuccuuccucccuuccucccucccucccucuggugcugaaauccagguacagucauguaccuguaacuguaauuuuuuuaaaaccuaauuuuaaugauguuuuuuaaauguuuuaaccucccuuguacccaucacccaccacccgagguagugggaaagaaaggauugagggguggcgguggaccuguuuagaaaaguucuuugaagcaacuccugucuguguugccuggaaauuggcaauucaauucagagguuagcggcggcagcucaaucuacuggcaaacacuucacagccacacuagcaguccaguucagcagaguuaggcuagcaacagcagugacaagaccuagcagagagagccaggccucaccccaggcuugagucagugaggggggggggaccaacagggacaccaggaguucucagcugugccccugucagggaagcgaagaucagagacccacaaguguugcacagcuagcuguaccagcaagccaagcucugucucacucauucuguggaguccuguuucuacccuccaaacaucaugugucguccacgugccuugccucagcaucugucuuuccucaguaugugcaacugucucagcugauaucacucugucaaucggccugaguccgcagaagcagcaagaagccgcaacacaccaucagaaguuuuuuggugcauuucucucuauggagucccgacaaaugcaguccaaccacagaauguaagguggaccaacacaugcacguuaauagcaaagaaucccucaucacaucuccuuucacacgcuugcuuuagcagaacaucuuucaccugcaacugcuucaacuaaacguuccuuuacauguuugccccagcaaaauauuauccaaccaacuuuccaaagaacccuuaaguuucuacuucaugugccuuuccuuuauauucuuuugucauucacccccuaagguaugcucugaccucuacacacacacacacacacacacacacacacacacaccacaccacacugaaugaaugaaugaaugaaugaaugaaugaaugaaugaaugaauggaaaaacuuuaguaucucauuuacaagaaucuuggcgaucucaaauaccaauaacuaagaacauaaccacuuucucagguucacaaagcucuggacacaaaguuuaaaugguaaccauaaaguuuuuaaauaaauuuuuauaacuaaaaaaaaaauuccacugacauuugucuuucuggaaaauuccagaauguaaaaaaggaaggaaaaaaaaaccuuuauggguaauuugcucugugucugugugugugugugugugugugugugugugugugugugugugugugugaaacagagagagagagagaaagagagauugagauugggucucacuuagcccaggcuagccuugagcgccuccuguuccuccuaucaggagauuauauuauggacauacacuaccacaccuguguugggugauuugcuuuuaaguguaaaaaaaucacuaugcaguuuuaccaaauucuucaucuuugucaccaacauucccccaucccacuaccaauacccugccaccaaugaauguucaauggacaaagcaaagcagguaagggaaaucccauagggcccaaccaacaccuaccaauguuuccuaagucuugaaacaucaucuuccaguaagacacucuaaaauuagccuccuguagcugacaucucaaagcaucugauguuacagugcaugguaagcccaaguagaccuaggcugcuagagcagacaucugcacagagaaaacucaaagcauuucuaaccgaggucuuaggguagugcucaaacuggcuuggaguucccuuccgugggcaaagcaccagaggcagccaaccuggcaauggaaccagcauucccuugcaggaaguagcauuuucauagccaggaagacauuuuugucagaauaguucaaacagaaagguaacgacaucuaagaagcucaaagaacuucacaucuauaagcacuguacccuuccaccucucaggggacaaacucuacgaggugugagaggcagccucuuuacccugcaaaugcacucuugccaagaggaaaugacaucacugucagucaguuuacaccuuucuccugaggcaggguuuggaagguaaugucucuuaauuccagaacucaggaggcugaggcagggaaggcugcccugaguuccaggcuggccuaggucacccauggagaugccaugcagaacaacuguaccaagaaagccauggcaacguacacuuuucaugaagaccuagaacugcugcuggcuuucagagcaccagguuacguuguagcuguucccucugaacagaugccagcacuaacugcucaguaggaaagcugcagcaagaaagaggaaaguucagaaauggauguggaagcaaaauacuauacacggagucuaaggaauguggcaggugccgguaggucaccauuucgguuucuccauuauugagaaguuaacuauuauccauaagugcccgccauaauccagcgcuugaggaccagagagaagacgcaaugguuaagaacacuugcuguuuuacagaggaucugaguucaguuuccaguaccuacauaaggagguucaccaccucuaacugcaauguccucuucuggccuccauaggcaccaggcaggcaggcaugcaugcaggcacucacacguacauauaaagacaaauaaucuuuagagaggaagagaacuuagaaaagaguucugccccucucaaacaaacaaacaaacaaacaaauaaauauuuuuggagcccucauguuaauuuuaucauuaccaauaccauuugcggacuggguaggaaaccacaggaucaaaaagguuuagugucuuaggcaggacgauacaaggaagggucaaacuucaaacuguacuuacaccauccaauaugcuugacucacuacauacgacuugcuuuagggagcccccuguacagagaagggaauuuacacuagaaaaaauaguaaugcugcuguuauagaaauagugauagaccucucucucucucucucucucucucucucucucucucucucucucucucucucacacacacacacacacacacacacacacacacacagucuaguugccagcaguucuucagaccgaugaacuaaggucuagccacaguguacaaauuccaagagcacugcuuucccacguaacugcacaugcaaagagaaaggcugccaaacugagagucugacccagugaucccguuucacagacauacccacuucugauaaaaguugcuguuuguauuccuagaaaucauuggcucuguugaggagauuaagcagcaaauaaaacugccuaugagggcauacacucguagccucaacacucaggaggcagaggcagaagcaacaggcuccaagucauccuuggcuacacagaguucaaggccagcuaggguuacaggagaccaugucuuaaacaccaaaccaaaccacaacacacaacaaacaauaaccauagcaaggaaacuaggaauucuugcucucugucucugucugucuacauaagaugcauauauaucuuauguagcccaggcugaccucaaacuuucuguguagcuuaggaugacccugauccuugauccuccuccuuccucagugcaaagauucccaacacgggcuaccacaucuagcuuaugcagaacagggagggaaucaaauccacagcacuguguaagaugggcaagcaccaagugagugccacccagccugguguuuugaaauuacaaguacguugacauuaaguuucauaaauuuggggaaaagcuggagucacucagaccuugcuguugacacgacgacauuguuuacaaacaaaugguccucucauuuuaaaagucugccuaauaaagcacacaccauaucuugucagaugaaacacauuaaagcgacugacaggcuaauaugcuacaaaaaaaaaaaucuggccaauuuucaaauuuuuuaugcuucaagaaucucaccugcuaguuuauuuauccuuuuaugucuuaucugauguuucaaaucuuaagaauauguuuuucuguagaagccaacacaagucaaauagagugugugugugguuucgggcaacauuauacugacacaagccuuucuacaaaggaaaggaaaugaucaagggagggucacaaggggggggggagaugccccauccugugccagguaagaucacaaaacacuuaccugugcuagggucagcuaugauaauugcaauugacgucucgaaaugggguuaugaauauaauuauugugaagcagcaauugggcaaucacaagcuaauuaagcccacugacuagauuaucuuguuuucccucuaauaaucacauaacauuuaacacuugcuaauuucaggaccuaugggugauguucauucaugacuaacaagcugcagccacuggucagaaagagaacgcaccaggacacagggcaucaagucaagcacagagcagggauggaucuccuggccagccaacaucuguucuucagcaccucuccacuucucagcuccacuaaauuacuaacugcaggcaaagccacugggcugaaagacuuacuggacuuacaagugguuagaaggauggaacucuuggucucuggaaagcucccugguuccuguuauccauauaauaugcuuuccccuuuccaaggguaagguugacucggucuuugaaaauguggcuuucuuuucuuucuucugcaagauaaucacuaguuccucugccaggccuggguauauaaacuuuacccuuuugcccuccucacacaugucccuaagcccccgucucuccugcaguacauguugagcauagucacaaauugaacaucuuaaguccaauugccauggcauccagagauucauugacccaauucaccuugcuuucuucaaagcagguccugaaggaagccugggugggcuucucuccaaagaauuaaaaagaccaaaagaaguacguugauugaaggcuggucuuuugagguaggcugacaugggaacacagucuauguugcagcucagugccuacuccucucaauuagaaauucuccccaaagaaucagauguucugcaaucauuuacuuuacccucuuccagggucucuccacauaacccuggcugucuuggaacucacuauguagaccaggcuggcccugaacucacagauauccaucagccucucugccuucugcgugcugcaucucaggggucuuaauccaagcaaaccgucauuugagaacugggaauguagcucuguggugaagguccagucuacuaugugcaacacccaacacagcacagaggaaaaggaaauaaugucuuggguaagggugacuaguaauuauuuuaaugaugugaaaauggccuuuccucaugcacuuuaaaaauaggauguaaguuuacccuucuaucgaagucguggcgauguaucugucugggcacuacaguucuggugagcagacccacagcaaagauaucauaaaauuaucacuaguuguuugggggcugaggagaccagucagccauuagugucacagaacauccaugguccugauuauguuagaaguguaugggccaucucugucucccuaaggacagccacucacucugugaagaguaucugugaucaccuauaaacaucagcuucuguacuguacgggaacaguucaagaggggacaagcaagaccagaacacucacugugucucuguggucuaaguagagaacauagugaccacuaggaggacagggauuaacaguagccauauuuuuaagaguaucggccccauucacaaaugaccauucgcuaacucucaaauguauacauguauaaauucugacaauacucugguaaccaaagccaauacuaagcauugauauuuccaaaagggacccuaagagacagacgucugucauaagcacuuuaaugaguuugguacaguuuuaaaauguguccucccgccgggcaugguggcgcacgccuuuuaaucccagcacucgggaggcagaggcaggcagguuucugaguucgaggccagccuggucuacacagugaguuccaggacagccaaggcuacacagagaaacccagucucaaaaaacaaacaaaaaaaaguguccuccccaagugacucguacaaggucuuugucagaagacagagagggugcucuugguaaaacacuuucucaaguuauuggaaugggcugccucccuccucuuaaccaauacauuacaaucaaucaauuuuccauuaucugcagauucccuuccagagcacaaagacuccuggcugcuggaggagacagagcaucaggaacauaagccauuagcauauagaucagguccuaucagcagagagccaaggcucugaaggacgguaccucucgagugaacccuggcucccuuccuucucagcucaugacccugggcaaauuaucucccuaaccuuugguugccucuaccucaugaacaaucccugguucauacucaauguuaaacaaacguuaccugguauuaauaucaauugugagcccauccaggagggaaaucgcauuuugaagguuuacgugguauucccaugcuaaauaggaguuggcaggauuuguugaugauguaaucauuauuuacucggugucguuuucacucaacauuaggacagacaacauucaacggacagcaggaaggggagacgcuuuuguagccuuaccccuacccugguuacuacuguuaaauacuaauuaacagucuucaaagacuauucaagguugaaacacagaaacaaaaauaaaaagggagagauucuggugaguaagugauuaugugagcucuuccaugaucgcuagcugcugucuaccuuaagauagcuucagucuguagcccagaguucacauuuugcccuaacugaagaacuccuacacgaggcccaugaccaccuccgccgaaugacucuuguucaacugcucauuaaacguucguaacacaaaggaaugauguaaccagggaugagaauggcuaaagaucucgcaccucaauggccugguucaggauuuuaaaaugcugagaggagacuggcucaucagccuguggcgaaucaaaugguuuaaccuccaaacuggacaccaggcaguggucauggcccacucuuuuccucucugaaauaagcggcucuuugucuuucauuccuccugcuaccuugagcgugggcugagaagugcuauggauaaccuuagcagacuaucacauuuucugcccaucaauaaugcagcucuucgcuacagggcucuagucucugcaucacucauuuuccaggaaaauccucagcaagccuacuuaaccaguucccucaaguuuccaccugcccuuuaucaaagaggcugcaaguguaacccagaaguuucaugaaccaucuuccaggcccaccucuacaguuuuguuuuuuuugguuguuguuguucccaauagaaacuuacuaaagagcguguguguguguuagccauugcucuucauauuucaaaugcaauggguaccaaauuaccagguccuucucugccugccuuauuguuuucuuaagagcaaugccucacuucccaauggacaauccucuucuauuuugacuugucaauuacuccccugccucacuucuuuccccuuucccauccaagcaggcucucuuucccagcaaauuuucaccauauaauuacagcgaugcuuuagccuacuuuucuguuagcuuaacaacccugucuauuuucuacuugugcugauguuacugucugcuucucugacgggcuaauccauguauccuuucaaggccuaacuuccccuaccaugauagcagcuggagcucuaauucacagguaccuuccaaagcuuuucauuagcaacagaaaugagaugguuuagaaacccauuucuuaaucggcaggugaguacuggaaccuuugugcugcacacaucuuucaagcaucccacauugugccacugcacaauucuuuucugaguaauaagguccagugugauaggcacauuugcagugguaauagggaggaggaugugcccucugaaguaaccagcuuccaacccuccagcccaccccacuccaccccaccccaccccaccccaccuccaccccgcacccccaccccaccccugccuucggcauuucccagcucaagagagaagcacucaacagaaaugagaaaaacugaggaauaauggcuuugccuucuuauaccugcacggggaagagaagguaaaaucagagugccuuagcauguguucugguucaacuggccagacaagggcuuagggagcgaguguggccuuccccagcugggcucuguggcagauaagccucuccacaaauccugggcuuaauuacuucugacacaguuguccuaccugggccuccagcuccuuuuaugcucuaaccaauaugaauccaagguaaguuucugcuuacucaccugggggcaaaugcuucuaucccuucuaagugauccuaacacacuucauaaggauccacuggguccugggaacuguuucuucauuuuccuuucauggauucuguucaaagucuccuccaaugcccagcaaauaacuuucugaauuacacagucuucgucuucaaauauuucuuuaaauaaaguaaaaacccuacugaucccuucccccuaugagcagguucuucccuuugagugaaguuggguuuaaguguggauaggcccagcauuaagcaucuuauuacuaucaagaagcaacaggcagugaucugaacaagcaaacacaugaaagaaaggaaaucaauaccaaaacacccaugggcuuggcaugaaaaggaaucuucccuucaacccuccaagaauaacucaagaagaaauguguccagcuaggaaguaggaaaggaagcuuugaagaccucaagcaagaugcucccuggaaaagagaggacaguggcugcaucuucuccuauuaugucauccuacccacccaacugccccaacaaucaacuuugcauuggagccacccaucugaagacuucccaaaucuuauggugcagaggcccaugguccuugucaagaaaaucaauuuuaugagagcacauccaagcaggaauuguaaauccaaaucauuucugauggauuucucauucaucaguuggaugguucaagggggacaggaauucagaagaacuuccuaguaagcugcagaucccaucuggauucauaaaaguccacuuugcuguaucgggaaacuucuccugggucucauaaguccaggagacaguucaacucugauuaucuucuuuccagugccucugcuuccccaacccuacacuuuguucuuuuuccuuuagcccuggcaugcaaaccaugcuguuuuaacuucuuuccugcucucccaguucuucuggaacauuuuauuuucgacagucaacucauuuggaggagugccacacugagguucaacuguuuacagcauuuaacuguguuucugccagaaguccuguauccagcacuaccaucuccgggcugccucggagauuaagaauuuaugcauuuguuuggaagaagcuuagaaaauguggaaacuuccaaacaucacucuuccuccuuacaaaauugcuugugccuguccaggaggagacagacauggaaacucaucucacccuuuccagaguacucugcccaagucauuugaacgaagacugucuguuuacugaggaaaugggaacuagucauucaucugcgaaagagaauuaggauucaaaaauauacauagaaaucguucucucucucuuucucucuugaaagaaugaaugaacagagaauacuagaaauucaccaguuacgacuggauuucacgucuugaucauucaucaauauuacaaaaugacaugucuggaagcagccaauuugaauuuguacccuguugcaaaacagaaccucagaguccaauuguggacacuuuugcaaguugcaauagacccagacaaauuuccaaagaagggcauuugaaaaguacuucuaagcccuggaugguagaacuagagaggaaaacagaaaacuuaaaagaaaaauacagcuaacaguucagcagcuaaagguucacuaacaaaacgggucucugcauucgugaguaucaugccucagcugcaaaucccgaccuguucaauccaacuaacaccaacaccaccaauagcacauucaaugcuccuguccuaagaggacaguuauugcacaacuacacccaucaaagccuguugguguagaggaaagggcaucgggcugcagugauccaacccgaccugugcccuagcuaggcuaggcuuugucacaccugaacuuccugagcuuauggaagucacuucaugcccaugugccagcuuccucuuggguacagugagggugaugaaggguaucugaggcauuaaaaaaauaaauaaauaucuaagguauaaaaaauacccaacuucuaaccucgaaguuuugucuggugaauauuaacucuuuaauagucuucacuuaaaauguaaauaucugucaauuuuuaguaacuuugauguuaguuucuuuuuaagaaauaauguuucccccuccugucacuccaaacgccucaguucagucgccccuacaguuauuuaagauuccacaaaaugccucuuuuccuuucuuucuuauuauuuuaagcaaccuuccccaaacugagacuugugcuauuaaaagagcuuagagcuucccauuuccuugcuagggcuaaaauuaaacuguccauuccuuagggccccacauaacaucugccagaugucuuggcauaucacacaaggagagaggaauuuucuuuuagcauuaucuauucucuucucuguuuucucauaaucaauuaauaggucaccaacacccagauaauguuuucucucaaagccuucaacuucagaagcacaggacuaucacaagcuacugucacaaauauguccacauaucaccuggcaaaugucucaguuugcugaauuuuguccguagaccagggaaaccuucuccccucaaguucuggggauugaacuuaggaccucagucuagcacagagcuacagcccuagcucucacuccaacgucuuccgaaucuguaguauccacauagucucagacucauagucaccgucaugugauuuggauuaguugcuuaugugcuucuuaacccacaccuguaacacugagacagcacuucgccgucuccaguuccucuguucccaacuuagaaugaacucaacccagacccgugaauccucuuuuguguaacucggugaacugucuaucugaaagauucacauaccagaaagaagauaaagguuaccuugccuaaaacucucaacaucgggaauaacuaaaggaagacuagacccuauuaaacucaaucacacaugaaacaagacucaugcucaaagccacuuuacccucccuucuuugaagaaaacugacaagugcucuaaagcucauuaauaaacuuggaucccuagcucuacugucuucccucagacacauuagggaaaauagacauggacuuuuuuuucuaaaaguuguccucaacaccuggugggguuagggguagaauaagaagggucuuaagggaacaagaucaacggaucauucguaaagucaagaaaagaaauauuagugaauuaugaugacccaacagcuaucucuuguauggcaggaauaauccucguggacuugacaccucacaucaaaaaugaucucugagcuuugacagcaaaugagaaauguucaaccugaucuuguuuauuccuuucauuaugcuuaauucaaagugcucaauucaagcauguuggucuagaaaaaaaaaaagaaaggaaggaaggaaggaaggaaggaaggaaggaaggaaggaaggaaggaaggaaggaaggaaagaaagaaagaaagaaagaaagaaaaaacagaaaagaaaucaugcccuuaaaaaugauaugggaccuaccguauugguuaaagacaaugcgcaugcaagcguuuuuuagaauaucagaauauauucucaaauuccaaaaugccuauuagguaccucacucccccuuccccccaauuuccagauacauucaacuuuuaacacugucuggagaagacaccaaaucauuugauuuccaaguaaaaaaauguagugagucagguucuauagugacuggcauuuuuucacaccccuacccaacacacuaaaacaaauuaaucacuugccccaauauuaacaaccauaaagauaucacgaaaguuuguuucaagaucaacauauuuauguuuauauaaacacaagcuaauuagaugcaaaauuaucugauaauuacuugcccaaauaacuaucuacugcauuuaaacuuccaagcugaauaugaagcauucauauaugcauuaccaaauuuaaauauaccaugacaauuuaaaaaccaaagcaauccagucaaagauaacacuuuaaaaugaaaauuaaaaggucugauuccaggcaagaauuuguuuuucuaaguacucuuggagaagcccaggacuuuaauaaaggggcaaagaucuaaacauucuauuuuuaaaugaacauacacaucaacugaaaaccauacaucuucaucuguacaaccaggguuuuacuucauugaccauggacaauuaucagcuaaagagccauguauuuuccugucucccuucacaccccucugaagaacaauaacccucaauuaaugacacaacaguuugguuugaaaaaugugauguugucauauacagcauugugcauuuacugagugacauugcuaccagcuccucaacagaauauaauuacaucuggaaucaaaaaaccacuucaauaugcacaaaaacacuguagacagaaggaacuuuucguucaaaaaucugacaccuaaugagaaagcaaagcaagaaaaaggcuggugucagcggcucaccaauguguccuuauuucuguugaagcugguaccuuucugcauuucuccuuaguuggaagcaagguccaauuagcccccuuagaaucuguuaauugguucugaaccuccuccaaguuuucaucccucugugaacccuuccucacccaucuucaauaggccaugcaaaauucucccaacaucuucccucauccucaagauggcuaccuuagcuaaugggaaagcaacaucuucaucuuuuguaaauccugaaagcauuucagaauucaguucuuuccuugggucaacugcauacagucucuagaacuaaucugcaaagggcuccacagcaguguguaugugcuaagguagggcuggcuccuguucucaaaccacccucacaaaaugucucccuacaagauuaauaaauuccuccaauuaaaaagguuaagauaccuggucauaagguuuucucaacugauaccauuuguuuccauagugacauuguuaggaagacauagugauauuucugaagauuuacaguacuggagaacacagaaggaaaaagaaacccagcagaaggaaagggaagaggggaaacaaaggaagcaggaaggccuaacacacggauggagcaagcagccuggagaggcauggagaaccugaagagacugccaggcuuaaggguuccucugagaucuggaaggaacauauucuauucuuccuggcagaaaucaacccaaaccagacaauaaagucuugcaaugcaucagacuaaugauaaccaagccccagaacucgaaagaggaggaaaaaaaggcuuagcugagggucaccaaccauccccauacugaggaaauaacauuuccuggagacagucaggggacuuggagcagcugaaaguugggagaucucuguggaaacguuuuaagguuuugcuuugccuuuccugaaggagaucaaaacccuucagguccacuccaaaaggagaaaaaaaauuccaaaaguuuacuuuaaaauggaaacaaacaucucaguaacuugugaaggaacugcuugggugggaggacaaaaaaaaaaucugaggaacccuuaaaagcuuucauuuccuuacuuuaaugacuagauagugaggaaccaccacaaggucucccucuggagaggcagaaggaauaggcaggcaugcuucuuccuucagccaccaccaacagagcuucaaaauggagacauccauaauuuuauaaacacuucucaucucagcuuugucuccuggaagcccgcucuccuccauuuucugguggaguuacaguaugacaaggauuaccugacucaguucccagcucucaaccuaaccagucacuuccuccccaaaccuguaagcaaccuccagcgacaaaaccaaaccaagccaaacagccaacgcagacgcucagacacagcccccgggagcccuggagaaagccccaacugguuggucuuuccccaucccaggcgcaugcuuaaaaaugaaacuuuuuucuuuucucucuucuucuucuuauccgucuucuuuuuuuuuuuuuuuaaagguuggaaggauuuuaaaaggaacuccagacaaccuccuccccucccucucuguagguuaggagccacaaugaaaagaaaaccaggguuccuucaggaauggugaacagccuggagaaugaacgugagaaggagcuuuguguuuuggagucuggacuggaaccaaagcagacagcuugcaaauggaggacagggagauaaagaaagggaaagagaggggcugcuccaauggggggcggcugaggcuucccccgugccuggugggagggcagaccccugggaaccgcaccaggagugagagaccccccccgcccccacuccaggccccugccuuccuuucucccagccucagaggagcguguguaauggcuucuccucuccagaaaccguuguccuccugcaaccgacgcuucugaaccuucagccuggagacagcuccucagcugucccucaaccugcgcccccacccggcaagcagcccccccgcucgcugcuucucuccuccccagcagcagcggcggcagccacccccucgacacauccagaccccgcaucccaacuucggagagcgaggggaaagagagagagagagagagagagagagagagagagagagagagagagagagagaaccaaauaccugaggaagaggggggugccaauccgcacggcuuugccaucgggcaggggacaggcagacaggaggggaaaggaagcagagggacagagaaagaaagaggucaacccgcucaggucggggccgcucgcuccgagcgcucccuucucugaccccuugcucgcucucucuggcucgggcucaggucucuccuggccucuagccuuccgccccccuucucugucccuacuccuguccccacacucagagcauccguccuaagccuccagcucucuccucucacucaucuuuccucucucucucucucucucucucucucucucucucucucucucucucuccucucuucacagaacuacacgaaauuaauuaagccacagggcucgucgccccccccccagcagaaggagcagccagcaggaaaagcacagccaccuccacagcuaccaccaccaccuucuccucuuccuccuccucuuccucccuagcuucuucuccuccucuuccuccucccccagcugcucucccuccucccccuccuccuccuucuccuccuccucggucucucuuuagcuucuucucucuccuccuagccagcccaugcaggggacuuccucuccuccccgcgccuccagcccuucuuggccgaaugaaugagcgcguuugugccuccaccgccccgcgcucuccuccccggagcacucagaccaccccagagguggugguuaauugcaguaacuuacagaagaagcgucccggcgccgggaggugcuucggguucuccagccccaccgccuccuuauccucuuucucuuucuccucuuccugcucggguuauuguuguggaaguuguuugggagucucaugugcuucugccgggucucagcaauggaggaucgccaucuucccugccuuccucggcuccucagacucgcugcagcugcagaugaccugagauauccgucucucuccccucucccucccuccccucuucucucucucucucucucucucucucucucucucucucuc

SEQ ID NO: 1911 - RNA, 5341 nt, Mus musculus
auugucguucagauaaaauauuauagguuuauuuaaaacuuauuucucaccuugaguaugcaaaauacaaacuccacaaaauguucauuuuuuuuuacuuuguaguuuacaaauauacaaaauagaaguuugcuuaaauuuauauuacauauuuauuaaggcaaggaacuauauagaaaaacacauuuguucugcuuaaaggcauacuugggaauaaaccauuguacaaauuauugcacaucugaaaccacagugcauaacagacugucugcauaaaaauguuacagaaauaaaccaggcuuauuuaccuggcuuaggucaucaauguagaucggaagacaaaacuagauuuuccuugucaaaaguaugcagcaguuggagaacuuuggcucccccguuugguaccuuuagaaccacgacucaccaagcaccaucauuuaggcuguuagaacauguucuguaccugaaucgcuuccucuuccuccgacacaauaauggcuuuuuuuuuuuuuaagaaggcaaagagcauacaaggugaucuuuacguguguauugcaucaucgaaacacaauucaagggaauccuggucuucccuccccccaagcucacugauuuaguguauacccugauauccacaaacuuccagucaccccuuggcauuuuguaaguccgggcauguucaaguuggauuugguauuggaaugauagaagauccauccaguaucagaccccaucuguucugugauuuuuuuuucuuguuuuuuuuguuuguuuuuuuguuuguuuguuuuuaguauuucuguuuugucucuugaacucuuccuuucuccugauuauccauucacaagcugacuugcugggaacuugaccaugauuguagcgcuugccagcugggcuccuccccucgugggaagacagugugaaagguuagaaaaaaaaauacugaacucucucuccuggcagugugggucacauccacuacgugggauuuaaaagugccucuucauguguaaggcaaggugguccgaccuggaaaaggcccugucacacuucuggcacugaaagggccggugcccuguguguuugcgguagugccuggucaguucaucggagcgggcgaauuuccacccacagccgucccagucacagugguaagguuucucgccuguaaagggaaagagaacgggcugcugaagccauugcuagaaggaagaauuagccaccccccuuuuuuuucuuaaaaaaaagggagaggccagagagcaaauucuacugcaugccccacccucucuccuuucaagaaaguaaaaauauaauaauaauaauaaaaaaaaccuucaggaaugucuuuaugacacuuuagggccauacugaauuucagaugaagaggaaugacauguguuaugaguuuaaacucauggagaaacaguaguuaguaacuuaaaaaaaaaaaaagcagauacccucucaaagcguccacccccacaguacggaguuuucacucucgagccuaaccagcacuggaaauggacuggauuagaaguuggcucugcuaaagggaucugcaauccuauagguggaacaacauuaugaacuaaccaguacccuggagcucuugucucuaguugcauauauaucaaaagauggccuagucggccaucacuggaaagagaggcccauuggacaggcaaacuuuauaugccccaguacaggggaacgccagggccaaaaagggggagugggcggguaggggaguggggguggguggguaugggggacuuuugguauagcauuggaaauguaaaugagcuaaauacuuaauaaaaaauggaaaaaaaaaaaaaagaaguuggcucuguugaaacccaaaggaucccaugccauuacgcuggguccagaaugccacccguggcuaauuucuccagcagagccguucuggcuguuuucauaaaugcaucuggaagacucuacccacuaaaagacuaccugugcguucuuuguuauuucgagacucggguucuugaccagaucggucuugaaucaacaggauucuuucaacuuugguauuuguaacuccaaaguugagugucacccuacccagcuugcagggacaguuuuacaccagaaucccugcaaugggaaccauuaaauucuucaaacguaaauacgaucuaauuauucuaaagaccagaauagagucaaggguagguagaucuaagaggaggaggagacaacaaugaaaauaaucuagaaaauuuaaaacuuuucuuuuaaagauaccgccacaguuuugcauugcaaaguauaacuucuugauuaccaggcuaggaggggcaggcacacacaggaaacucccuaucuuuuaaaggcccaaugagaaacugcacauucaggcagcagauagcauccaucaagcaaaaggcuucugggcaaaaccauaggcgccuguuugcugcccuccucugugauccaggagauggagaagagauacaccccagcacccaagaaagcccuaaggagcccacagccagccuacggagcagacaggcaccaacccuccuccacagugcugguucccuuaccugugugaguucgcaggugugccuugagaugagaacucuugguauagguuuugccacagccugcauagucacaaguguggguggcuguucuuuuccggggccacgaccuucuuccccucuuuggcuugggcuccucuggcaggcaggaacccgguggcaugagcucugggagggggggggguaaagaaaguggggucaacuucaaucuggauagucucaagauccccagaaacaaagcucccagcgccaucucuaccagccagucccuuccccccacuaaccuugauaauggagagaggggacuugugacugcaucuggucuggcaggaaaggaggguaguugggccccggauggggauggaauccugggggaagaggcaggccagggugacagucccugcuguucagcaguuccucgggacucaguguagggguaguccugguggggagcugccgccccagggggaagucguguguguugggccgguggccguugcugagcugggguccagcgcucaaaugggccucuagggaccggcugaccgugcaggacgggaccgccucuugcuuaaucuuggggcacaugcgcggcgggccaccgcuguagggcgccacuaccacgggguggcugccgucugggcuuccuuugcuaacacugaugaccgaagggcugcuguacucgcugccagggguggucagagacgccuucagcacaaacuugcccaucagcccgccaccuggcggcugaggcugcuguggcggaauguauacuggguccaacuccggccgcaggagcucagccacgaagccgcccgaggggcucacgucauugauguccgccagguugaagggggccgugggagguggcgcagauucucggcuguagaggagcccuccaccuguguugcuggcagccacgcccgggucacccccggcccggaucggauagcugaagcugcagguggagggcgcgcuggcagggccgcugcucgccggggaagacgaggaugaagcugacgccgagguggucacgguggcggccaccgauuccugguggguuagcgaguuggaaaggauaaagucuagguccaggaggucguugaacuccucggucucccuccgggcuaggagggccggguuguuacugcugcaagcugcaccagcuccgccacucuccaggucuguggccaccgucgccgccaggucguaggggcggccgggaagugggggaagucgcuucaugugagagaguuccucacgccaacgcugcaagaacagggagggagagagaaacuguuaauuguagcacccuguugccaccccuaauauugacuuguugggugaagcacaccaacacccugcuauaggaacuggacagaacaggaaggcagccucggggacuccaggggccacacugcaaucucagcuaacaccaagguaagagguggcgcguucguucuccugcaagcuagugccgucgcuccaccagcccaguccucuuccccgccagauccgcgggacgcuccagccgcccacggaauugggacacugggacacgguggcuuucuccccaugcaccauagccaccgggucgcccacgcgcuacgaucacuccggcccaaagggucucgagacuuguccaccuaaaauauaguggacugagugcgcccaccccacgguccggacgcccgaagacuaguggggaaccgcugugcgccccuggcgguaccgcagugccgggaccacacgcacuuaaggccgacucaagggccgaggagccaccucggaaggcuguagaguuccaauggagggcaauccuuguccuaaccaaggacucuuggugacccccggauuccgcccauacaccccaccccaucugcagaaaucuacagggcacuagcgcgacacucacguuagucggggcaccugcuggacgcagugucuucucccuucccgccgggccggacgcgaacguggagaaggacgggagcagagcgucgcugacagccaugucagacucgccagguggcugccugcgggccgggcggggcgcacagggaccaggagucaggggacacccuggccacugcuccgaagcuucccuccaauccucaccccuuucuguucccaaguccaacaucucaccuaccucauuaaugugggggcccagaagguccuccggaguccgaagaagagagagggguaccugagccccaaagucaacgaagauuaaaaacuuuagaaacaaaaccucaaaccaaaacccccagauugcccgagauccuucuucuuuggauucaauauaaaccggcgaugucuuuaaaaaaguuccuuuguauacaaaaauucuuagaaaaguuguaaacucuuauaaaaauagacaaucagcaaggcagauaaguagguccgauggccaggcugcacgcucuuggacucagcagugucccccaccguugucgcggccacuguggcugucggcggcgcgggggcugugguccgggcggugggcgggcggcgccgccaggugagaauggccgcgguggcgcggaacugcgagcugggcgguggcgcggggugcggaguccuggggacugugccgggugcgcgcggccaugggcgcgggucacgggcggguugcuggguggggggcuggaggggcggggaggggcacucggcggcuccgggugccgccgccgcccgccaccgccucugcuccccgcgcgcccggagccgcgcucgcucucuuggccggggaacug

SEQ ID NO: 1912 - RNA, 52657 nt, Mus musculus
cggugacgucacucagcgcgccucgcgggugacgccacguccgcgccgccuuucuggugcuaccuggcguguuucgcccuucaguggaucguguuucucgucucccgugugcaucggcgguuccuuuccaaacccagugcgccgugagggcucggagccgccucgagggcgucguaggugagcauucgcccgucccaguccgagccgcugugugcggccuggucuugcuguccagggcuguucuggugcaggggagaugcacgcgcuucugccugcgcgcgccggcgggccgggcguggaccucuucuuucuucgaguuucggaugcuuucuguacacguuuuccccggggccgucuuggggcgcugcgagggaugaggguccgguaccccaauugcggguuuccuuguagcguguagauaaaaccucuaccagcuugucguggaaggugauagguaaauagaggccucugugcugugcugcgggucccuucucgcucgcauuugggacuuuucuaugaaguaguguaucucgugcuucccuaccugguguaccuaagccgggauuucugugauggcugugauuuuauagucuuuugucuuuagggccuaacauuuggcaagguuuuguuguaagucacauaacggaucuuagguauuguguaaaggauucguuugcguauugagaaccaugauauauaaccagcaaauaucucgauguguaagugaaagaaaaagagacaaagacaaauuuuaguuuguggaaacagagaugacaauaagucccaagccaggaugagcuauuauuugauaagagaucagcagguucucuguuuuucagguugcauuucauaugcuuguaagggucagcuuaugauaauaucaggauugauuuuaaugugaguuuaauguuuaguuuggucuuguucauuuacaagguauauagguuuaucuaaucuucccuuuagugagcuaccaagccugaagguaggggagaaaguggaucaauggucagaauuuugggacaugaucaaaguuguaugaaagcaccucuuagaacauguguggguggagucaagggaggugcaguuggaggugccaaaggaaggcuguuagcagauuaugauccuagaaacauuuggaagauguuuccuaacuuugaaagcauugagaaaacuacaggacuguguaacuccaaaaaguuaaaugagugagcagugucagaaugacaauuuagagaagucgguuuucaugcuaaaagaauuggggcauuagagagauuaaugaguuugccuuuuuaccaagugaccauggaggccagaagaaggcaugggguucccuggaauuggaguuauagauaguuguuaucugcuguguagguguugggaacugaacucagguccucuggaagagcagccaguguucauuaaccucugagcagucuuuccagaccugaacucgguaauucuuuuaaaaacucagauugccuugcuguguuuuaucagucaggguccaguagaggccagacaguauuucagcaggauuauuaugaagaauuacuuaaacugcuauaggaggaagaaaaagaaaaaaugaaaaacaaguaauuuggaaggcaaguggaaggaagcaguucccauggguagggagcaacacuagggcagauuuuggcaucaucaggacccaacaccucauagaaaggcccuguaacacugggauuagacugagaaugaggcucagaaacucaggaugaagccuggggcuggauuucugugucuggggauacagcgugccugauuaaugcuccuaccucuggaguggcagugaugaggcuggcccugguagugccagcguacagguucauggagagggaugucggucaugguaauuggaucauggcaacauuuggucauagcauaugcuauaguuaucauuugaugaugucuucagguuuaacauguuguaaauuaaccugcagauuagccccacguaaagcuagaugcuuuaggaagcgagaguguagccguguaugugcugguguguucacauuaaauaguacucccuauuccguuaaccacuuuucuccuuccugaacccuucucaaugugaggguggccauuuaucucuguuaccguaguccuuucucuuuuagcacuuaauguuucauugaggaaaauuuguuuuuuuuuuuuucccucagaaauugcuucaucaugagaaaucugaaguugcaucggacccuggaguuucgggacauucaggcaccagggaaaccucaguguuucugucugcgagcugagcagggcacggugcugauuggcucagaacguggacugacggaaguagauccugugagaagagaaguaggucacugaugcagaugccagccccugccuuggcccugcacuugucuucuuccaaaccuccuucuccacguuaguccccuuaagauccaaaguaauucacguauuccggaauaguuggucucuuugcuuuguguagauauggcuuacuagauagaacuuuuaacucugcuaauuuuguaagcuaaguuggcaaagcucugaccauauauuuuauguggguaccucacauuucacccugucuacugugaauuuauauuagugaucaauuagaaaucuacaugaauauuguccauagagcuuuuacauuuuauucauuuuguggugcugcaauuugaagcccccuaccugagccuuguagagucuuuuaaauauguuggacuucuaauccaaacugguuaaaguccuaguucuuaggguuagaacugaccauggcuauuucugaaaauuguaaguggauucugauaucuucccuugaguauuucuugcugcucaugcguuuuauuuaggugacugacuguuguugcacacguuguagagaugauaggcaacugaaugaggggcuagacguguucacaaggagucaaagcccugaguuugaucucccauuggaaaacagaugugacuaaagggcgcagccauuagcugcauuuuuacaggauauuuuuaaacagaacauaauuugguuuuuguuguuguuguuguuguuguuuuguuuuuuuguagaggggauuuauuagguauuuccuuguuaagacaauagcauugcaaucuuucuaaaaugaaaguuugaguuuuaaucuaggggaaauacucggaaaguuuauguuauaaaagaaucauuaaggucugaagagauggucaaugguuaauaguacuggcaacucuuaaagggaaccccaguucaguucccagcacccauuuggcagcuuacaacuaucuacaacuccaguuccagggaaucccacacuaucaaugggcuuccgcgggcaccagguacacacaugguccacaugcauacaugcaggcaaaauauccauauacauaaaauaaaaauaaguaaaucuuauauauaagaagaauuauuaggaagacuuuauuucugaaacuaugaugacucuugaauguaaacacugauuugcuuaugcguaugcuuugugaaaggugaagacugaaauuucuuugguggcagaagguuuucuuccagaggauggaaguggcugcauuguggguauucaggacuugcuggaucaggaaucuguguguguggccaccgccucuggggacgucauagucugcaaucucagcacacagcagguagguguaaggccugggaggaggaguaccaaguacccucggcugagccgggugugacauuaaaacauuuaaguuaaaaacaguuuagucuacugcauccauuaaucagacaguaaaguugggaccuuacauuuuaaauuagaacuuaaaaauugaaugaaaacuaauuguucuuauggugugcuaccuuuuaucugaauuucucaacuaagaaagucugaaugcuuuaguuggguuauguuuucugauuggaugauuuuagagucucauacaaguacuacaguaauccacuguugcauauucuaagacuugagggagcuaggcugcagcuuauugcucuuuuacacuagaauaagacagauucucuggauuucuauucuuccucccuucccccucuuauucuccuucccccuuuucuuucuuuguuacagggucuuacuguacauuccuggcugaccuccaacucacauagcgucuccuucauccaccucucuaaugcuggccugccuuucuuaccuuuuuuccuuuuucuaucuuaaauguaugaguguuuuccuugcguguaucuuuguacauuauagacauuucuggccugcagaggccagaaaaggauaucagaucuuuuggaacugaaguuacaaaugauaaugaauggcuuuguggaugcugggaauugaauuuggauccuauggaaaagcagccacuacuuuugcccucugagccaucuuuccagcccccucucuuuaaacaaacaaacaaacagacagacaaacacacacacacuauguuuauguauauaaugugaguguguggugguggcagugccaugguaggaguggagggcaaguuccaagcuugugggagucagcucuccuuguaccaugcaggcucuagggcuggaacucagauugucagagggcuugugcugcaggcuuuacccacugggcugcuauuuuuaccuucuuaauuacguaauuuccccauccuuuuuaauuaccucuuccaaacugggcauggugucucaugcccacagucccagcacuuagaaagcugaggcagguggauugccauuauuucaaggcuagcuuugcuacauaguuccaugcuaacaaugacagugugucugauuaccccaguagccuggucucuuuagccccacucgugucccaggaguuguaguguuacuaacagugggauaauaauugcagcuuuuaauuaguaaagacuuagauuaucgcaagcccuugcuacauuuuuuuuuaacgcaaacuuuuauuuacucccuacuaugcucuuguuagguagcuuguccuuucucaugguuagaagugcuugaggcuuagaaagcuuaaguagcucugucaaguucccagauggagcucggccgucccaggcuguggcaccuucacuccucagcauuucuuugaaugucuuaacaaacuuuacucuucauucacgcugagaauugucaaagucuaucauguauaaguuaacugguauugcucacauuuaaaaguuagaauuuuccauccaaauugucuccugauuccugagccagccccaguccauuuuaucuccauuuguggcuucucacugucacaagacagaauccguguccuuguugccugauaagaccagucgcuguuccccaaauacccuuucaccuuuguccucaugccauguuugugugcuccucaggaucuccuugccuuugaguuuuaauccuucuuuaagccuuggagccuccacgcugguuccucgaugguucucuccuggcccuacugcugaccuuugagaccuucacagaacuccccaagccuuugcucgcucuaagacucacuuuauuucccagggaccuuacuaguaacuaagucuuucauagagucauuguuuuauguccuccuguuuacuaugcuaauuuugcaucuccuuucucaacaguuguuccagaaggcacaccugguagaucugccaccuuuguguguuuaaguuuugauuguuuaguggaguccauaguaaaccuuuauugagaaaaugguguucucagucccuuuugguuuucucugaugcagcuggaauguguugggaguguggccagugguaucucugucaugagcuggaguccugaucaagaacugcugcuucuugccacagguaagcuuugcacuggugccuaacugacuuuguaaaacuugcuccuaauucauauagacuucucaaguuucacaagucuugguacgaucauagcugacuguaauguuaagguaguguauucuuaaugcuugccucguuguuagcaucccgaguuguuugugcagcuuuguggucuuugggaaugaggagcgggguuggagagcugaggaaucugcugaguucggcagucagugugagcagggcuugccuuaaccuacucuaagaccagggugugugugugugugugugugugugugugugugugugagagagagagguugagagagagagagagagagagagagagagagacuugcaguugaguuuuaagcucuaagucacacucaugggccucuuuccauccucugagacaacuucacagaaucuuucuagaaccucuugacucuccuugcucugagacucauuuacuaauucgggacucuguaguaacucuaggcaguggguguggaugugggagaucacaggacuaccugcaggagucugcacugggcagcuuuaggcaucaagcucuguuguccaguaaacacauuccucacagcucuucuguaugccugguuuccuuuucccuugaggugcuuuauuccagaugaauucaguuuauagcuauagaaaugucuuagaaaacuagcaaucuuuaaagcaguagaggagggcccuggggacuuuuauguugaauuuauacagucaguagcuaaggagaagcaucuggaggcuggccugcucagagcuuguguuucagggcauuaugugugcaugcaucugucuaccucuuccaccugggccuccucauucuggcucaguagcuucuggugccccagacacuuggaaaugacugauuuguuacaugaacuccuaagcucaacagacccugauuaugaugacaaaagacuuugaagugaucgcagaggagcagauccaccaggaugauuuuggagaagguaagcguuucuuggaaacauucugugaccuguuuuacccauuuucuuacucauaacauucguugucauaagccgaaaguucaucucaguucuuuacagacaugucacuaaccucccuucagaucugacagguagcuuucucgauauucuggugaauggaaaucuauccaugaggucuccuggauaucacuuaaaccugaggaaagauuuacacuagaauuacagggaaagaauuauugagguuagaauaaggggagcauguuuagaguacaguguauuagugggccacaagaaaggaguaggggcaguuagaaggcaguguucuuuuccuuccagcuagacuagaucagcuuuagaucagcuagaguuuugcuuuucuuuuuuuuuuuaaccuugcaguaaauuagaggaaagauaguugaaguuugugcuuuaaguuucuuugugagggcagacauaggcuccagucugcagaucccugcugugagcccaucacucacuaucggucugauuggaagacuuuucuuauuuaacucugguccucuaccucuuggggaccugucggagaagcuccaggcugagcacagcaguagccaccacucuucaugugugguggcagaguguccuuggaggguguaucaucacacuuggacaugcaucaugcaagcagacuagaaauggcuguguugagccauaauuuauugaauuguagguagucugcuucagaauuaguggcaagagggaagucuugguccuggauagugucaggaccaucuuucuguugccuccuguggaugaggccucgucugccucuaggagcagaaagucugugcuggcucuggaucauugccacuguguuuuguauaagagaaguagugucguuuagggagagcaaccuagagugcaggaagccuguguucugguuuuaggcacuguuacucugggguuucagagaagucuacacuaggaacuguauuuggugacguaaagccccuuucaccaccagcacaaagcuuagcugguugguuuaaagccaaaaaucagaacugcauugcuggcuauugucuugaguuaugugcuuguggacacguuuuauagacucuucauauuuguucagauuucugacuugggucaggcuugccagagaaagggccuuucacguccugcugggaccauuucugcaggucauuuggaggcucgguuuguaaccuaauggcugaugcucagcuuccugaguugucagugacugucuucaugaagaaugaaugaaacugcuucgauuucaguuccucugcuuauuacuugucuucuuguucuugaaaaacuguaggcaaguuugucacuguuggauggggcaguaagcagacccaguuccacggcucagaaggcaggccaacagccuuuccggugcaguugguaaggcgggaugaugugggccccguucugcaugugcuggagcacugccuggcuagugcaucucuucuguugucuuaaggugguagcugacagguguccucaggcagugagucacccaugagagauagucuucuuuuuuucucacggacugcacccagucucauuuauuguccaguagucuacaguaacuuuugcucauuacuuucauuuuuccuaaaggccuggucuugacucagaaguuuauaguuucagaaauggguagaagcccauugcuuauucagaagcgguacucauaggaaugaucugguaucaggcuaugguguucugaugugcuacuggcaccuugcugggcucaguaaaguuguuuuacguuuucuugcuuucuuggauaaguucucucacuaauuacaacauaagcauauacacaugcugcagucugggugagacauagucugcaagaugagaaucccacgguagacuaaaguacagauagcaccaaaguccaacguggugaaccacugaguuuuauuggguuacauacaagauuauggguaagggguacuuacaggagcagaaaugacucagagauaguugcauuaccaaggugcaugcaugauagcucacaaaagcuaggaaaucaggaacauacuggagagccagcagguagcucaacagguuggagagcauccauuccaggugacucuagucugaaccucuucuaggcagcccagcugcuuucugauuucccaggcagcuggucuggucucagaaucuucuuuguagcuuggcuuauuugagagagacucucagcuuuuacugcuuaccagucagggagggggucuagugaaucugauaauuuucagggacuuccugaagcuauuuugaguuuuuaaccuuccugcugaaggcgcuucucuauaagaagaaauauuucuuccuggaggaaauaguugcacaaccuuucauuagaggaaguauguguuguauaccaaagaacaguaucuuaguaagcugcagucuagucuagccagccuaaucuguggccgagcagagcuagcaguguuuugcaguggagcaaccacuggaaugugaagugugcucuggugcuccccugucucccacccaucacccauaggcuuagcugcuuccuggcucuggauugagaugcaggaggcacuggagucccuucuuuggccugcugcagagggcaggacugcuuuaccugagugcugcugcagcuacugcuucuggcccuucucuacccacuuuccccagugucuuuauucuauguccuguccugaaauaggacuguuuacauuuggacagacgcuuguuuccuugcuauaguucccuaaccuauuccuuagcuuauuacauuuaauaccuguauuuguagcauuucuagugugcaaagaaggaagguugugcuuauuuuauuuuuaaguuauucuugaugucauggacuaagagcccuucuagaaggguuccuggagagucucugaugcugguuuuguauagcuucagcauuauauagaagaugaguauuugguggccagggguuugacgugggagaguugauucccuaguaacacuggugucucucuucagccugagaaugccuugcccugggacgaccgcagaccacacauuaccuggcguggggaugggcaguauuuugcugugaguguuguuugucgacaaacagguauggaaauaaauuacacuuaaaaauuuaccuacauuaaaaucuggagaaguuuuuuuccuugaguagacuacacaaucauaaccuguaaagacuuagagaugccuccaggauccggagugggaaagaauugcugcuuuagauguuagugacuucggaauuaaaagaaugcuuugaggcugucuguucacuaaauacagaucugaccggucgugagguaccauaguauuuuaagugcugugucuguuuacucuaccuccuuugcagaggcucggaagauccgcguauggaaccgagaguuugccuugcagucaaccagugagucugugccaggacuggggcccgcccuggcuuggaagugagugagcauaaaagucugggacucuuccugcuuucccuuccaucccuuccucccgaauucaccuagauccuggauucuaaauagauucccuuuuucuaagaccgauacagguugcaucucuaauucuuuaaagguuaugguuguacauauggcuguugugggaaacagaagggagugugacuguuaaaaguccuaguguuugaugcucuguuggacaaagggauuucugugagacaggguaaaaggugcuuuccuccagacagauucccacagcagguggucugcuggcuaagaaaccugcaggcuacauucugcaucugccuucucuuugcuucuuugaugcacugcucugugcagaccacaacuuaccugucauuuaacugcacauagauacaaagaauaaauggcccuaucacagcagcagcuguuauaugcagugccaguagccucuagguggcagacuucuugcuuaccgccaguguuagcaggccuggguguugccuagguguuugaauuaagagguuggggagaguaggagugaggcagcuggaugauauagauagcuaacaucucuucccagcauuugugaaguuauauaacugaaaagaaaagaauuacugaagauguuaugcuugaaauguuguaggaaaauguaguuuguuuguuuuuaauaguucaguugcaguugaaaucagaaaaccugcaaauggugccuuggaacuaguuaggaaggaacaucuuuuucucuuaccugcuggggugaacuucuugccaguacuaguaaacaaauggugggcuuaacacuuccuuggaaccaacaucacagacaacaauaugcacacaacaaacaccacacacacacacacacacacacacacacaccccuaccuuacuggaaaaaaggauuucaauuaauuuuuuucuucugggaagaaaauaagaucucuugucuaaaucucugggccugcaggaugagcguuuuugacuauucugacuuagguucugcuuucagacccucaggcaguuugauugcaucuacucaagauaaacccaaccagcaagauguuguguuuuuugagaaaaauggacuucuucauggacauuuuacacuuccuuucuuaaaagaugaaguuaagguaggggucggaguucuuugucauccaauuagagugcucuccuuaguugcagaaguuugugucucacagagguuagcaacagaagcuaccaccguguggaaaggauggcuucugaggauggcuucugacucucagagcagagaauagaaaugcagcccuugcuguuugcuuuaaugacuaacuuuccugauguucaauauuuaaacaugaagcagcuuaugugccauugaaguccuggguggagacacaggaaaucuuuaauuguguguaaaauuauuuaggauaauguuucuuguguaaaauuuuaaguguuuguuuuauggagccauguuucuuauuuauauuguaccuuaauuaauauuaaguguuaauauaauauauaaaauuaagauaauguauuuuauauaauaauaucuaauagucaaauuucuugauuuuuuuucuaaaaauuauuuugcuuuguguuacauuuguauguaaaucuuuaagcacgugcauguuuuaaguccuuuuuaaaguaccaauuuugcagguugguuuaacaacuagaaauuagugacauaagcuggagucagcuccagugucguagggucauuugguuuaugggugcagggaauuaguagacaaccaacugaaggucagugugacuuuugucccuaccagguaaaugaccugcuguggaaugcagauuccucggugcuugcuauauggcuagaagaccucccaaaggaagacaguuccacucugaaaagcuaugguaugacagcuugugggguuucccaaaccuuccucaggccuucggugaaaucacuguagcugaaguagguggaugcugguggggagggguagguuuggcucucugaggguuucagucaugaacuauguagaguucucuagggaagcagaacuaguaggauauagauacaggacgggagaagaagcugugguuggcucaugugcgugucagguggcacauuugaaauuucuacggcaggcuguaaguucaggugggauuuuuguguugugcuauugagacuguucuuucucuccuggaacccuggcucugcuuuuaaggcuuucaugcaucauggcaaucauuucauuuaaaggcucucagagcagcaucuagcagggcaaagacacccugaaaccacagucaucagugcagaaaaugaagugguguagaagugaguggauuuagguuucacaugagaagggcucuuguagguuuuaugaucugucgguguguaucguuaaguauggacuuaggauuaugucugucgucucgucuuucuuuguuaccuccagguaacuggcccaggucuuagucuuacuaggcaagcccucugucacuaagccaacccccaacccuguuuaagguuuuaaggaagaaguaaaguaguaaggagggggguaacucuaauacuaaugcaauauauaauguuuccuuaggccuggcuggucucaaacucccagagaucugccugucucugccucuagagugcugggauuagaguuguaugccaccaugucuggcugauacaugcugcguuuuguuuuauuuugauguuguauuuuaauuacagcauuucucccugucuuucuuacccccauugauacagacugguuuuuuguuuguuugugguuuuuuuuuuuuuuuuuuuuuuuuuuuuugguucuaaguguuuuucaaauucauuaaucaguagaacuuuuaaaucugaaaaguauugaauaauuuguuaauucauucauucacuuuaaucuuaaccuggcuaaaccuuuaauaaaaauaaugaaacacaggcuucaucucagaauuggauucauuguuuugggauaauauauguguguguauguguguguguguguauauauauauauaauguguaauauauaguaguauauauuauauauaauauauauguaauuaguauguguaauauacauacacacacacacauauauauauauauguauauauauauaaucgcuauuuuggguuguguucaggauuuaaucagggccuuauaaaaauuaccaaaccaaacaggcccaaacuuccuggugguuuuaauaugcaaccacuaaaauaaaaauuauaaaaauugcuauuuauuuuggguuguguucaggauuuaaucagggccuuauaaaaauuacucaggcagcugaguauugguuaauaugggauagccuggaacaaaacuguuugcaaagaacccacaauaagacagguaucuuaugcccagcuuaccacaguguccuuggugcagccauaugcacagaaggacauuguucacagcagacuacgugugaggcccugucugugugaggagccuuuguaaugcuugcacuagaugagaccuauggaugucacauuucucaggcuguuccuccugugucgagcacagcugugcauuuagucugguuaucuucuucccaacuuugcaugcaggaaacaugcuaaaauacuucuuagcuuucauaagcacagaauuuaagguagaggugaaaauaaaugugcuucugauauauugaugcgugacauuuugucuucauaggaaauucacaucuuuuuauuuguuguuguuguuguuguuuuuguuuuuucgagacaggguuucucuguguagcccuggcuguccuggagcucacuuuguagaccaggcuggccucgaacucagaaauccaccuaccucugccucccaagugcugggauuaaaggcaugcgccacccagcugaaauucacaucuuuugacauugauuauuauacaauuaauauuuuagggagaccaaaaaagaagaaaaauucuuggaaaaauauaaaauuggaccuguuccccuuuugcaaauggucugcagcuuggucuccggucucugauggccuuuccuuccuuucccuccacacacaguccagcucuggaccguggggaacuaucacugguaucugaagcaaagccugcccuucagcaccacugggaagaaccagaucgugucucugcugugggacccggugacgccgugucgacuccauguucucuguacgggcuggcgguaucuaugcugugacuggcacuggaccacugaucggagcucugggaauagugccaaugacuuggcaaauguggcuguuauugauggaaguaaguugcugcgaaguguguccaugaaucuucauuuugguuguuugguuuguuugaugucuuugaugauugggagugucauuguguagaauauguacugugcugaaagccccagcuccaacucccuauugaacuauauuuauagucuuacuuacacauuaacuaaucuaucuggccuucgaacuugaagacugguacuuuucuccuuuugcagggaaaaguggagccaugauauagcagcggggucuguuagacuuguguugacuguacacgccacaguguggcuuuguuuuuuguuuaagcacuauaaaguaccucauuuuucaggaugcuuagucaaauccuagacauuuaccucucuugugaggacgauugguguuuuuaauuagguguaggaucagugguggggagcuagauugcagaaugaaauagccagagauaguuugcugauagcagauagaugcucuuggugcucaguguucugugcagugcuuuuaauacugacuccuauaaucauguucuguacagagaauuuagucauaccuuaacuauuaauuuauauauagaaaagugcuuuuuaaauguguguguuggaggucuuuuuuagguggaguuuuggaauauauccugguaguccuauguagaucagccuucuugaacucaagguagcccuccugccucagccuccuaauugcagcccuuacauuuuggcuauccuaguuuaagucucucuuccuuacaaacccagguuuaaagcugaaacuuugaccucuucaucuuuuugccccgaucucuggcaccugaaccuuccaagugcacuguagguguaggggccacauuagcuacgcgcacacagagauccucaugccuguacuguuuuuaaauuuauuaaugaggaaauaccagaagugauuuugaagagcuaugcuuacugccugcuuuucacauugaauaccugcauuggcuaauccuccuuuucauuguguagacaggguguuggugacagucuuucggcagacggucgucccaccucccauguguaccuaccggcugcugaucccacauccagugaaucaagucauauucucugcucaccuugggaaugaccuugcuguccucgacgccaguaaccagauuucugucuacaagugugguaaguggaagcagggauccaggagcucagucaguuccuguucccaaacagaagccagucacagugugguggcaucucagagccagaguuucucaauucaaaaguccuauuugauuucgccauaauauuuaauuggccuucauuuucuauacauuucgcugugccuugaugauccugaagaguccauuacuuaaaaaggacauucagcucuugagauagcacggcaugguccuguuucucagacuucccugcuuucuccugacuuugcacacaauugcacacaaucuuaggacucuccuaggaguguucugagccuuuuccugcaguauagaagcauguacauguggccacaaauaagaaaugccuuuauuccuguguccuggaaaauaggacauuuaguguuauuugugagacucugugguugcauccugacaguuguaacuuuguuucaaauaccuguuggcauuucagugaggacaagccuccauagcugcuaagagaauaacagaguuaauucauucacaguagaguuccuacuuucacaccaggccuucuuaagcaaacagccugcuuuucauaggaauucucuggacagaucaccagcuccucugauuucagucccacaugguacagugcuauugcagucuuucuccaugucugaaaccagcuuucaaaucaguaaugcucgcauguucauuguugagucgcaugguauauccucuggcaagugcugugcggcaagguugguauagcauaacauaggaagacugugagcaggaugguagacuguugggggagggugucccaaggaaggcuucucgguguuugagcacauuccugcugagaauccgagagggagaucgcauguguggcuaagagcauucuaagcauucagaagcagcuauagugaugucuuuuguugcauuuugaaacagcuagacagccagugacugcaggaagacagagggggagagaggggugggcggggcauagggauggcagagaauagcucuuucagggucuugaagguccuuauucugaaugagguaguugucauuaaagaguuggaacagggugcaguguucuggcuauuuuagaggauuauaguaccugcuguguuaggaaacuagaucuacagugaaaaagaguggugccccacccugcaagacaggguuucuccuguagccuaggcuguucuggaauuccuuuuuuaaaaauuauuuauuuauuuauuuuuauuuaaaugcuuuuuuuaaaauuacguauuuuccucaauuacauuuccaaugcuaucccaaaagucccccauacccuccccuuaaaauuauuuuuaauugguauguaugcauguauguauguauguauguauguauguauguaugugaguacauaguagcugucuucagacacaccagaagaggacauugggucccauuacagauaguuguaagccaccauaugguuccuggggauugaacucaggaccgcugagccaucucuccaggccuauggaauucacucuguagaucaggcuggccucaaauucacagugaugugacuacuucucucaaguucugauaucaaaguuguguaucaccacggcccagcaaaacuaucuuaggaauacuagaaccguggaggaugugaggcugcagaaagaugccuggggauguuggagaauaucuguaguguggggaagacagucccucccucggcccugcugaaggguuguuuuuauuagugaaaacuggguugacaugguauuaauagggagcagguuuugauugagccugaaaaguauguauguggagauucaagaaugagguugaaaugucauuauaguucagauuacuucauuugucuucaaaauccacuuguugcaagacccuacauucuuggcauuaggggaaauaacuuacaaugauaauauuuucauuuuuuguuuucuaggugauaagccaaacauggauuccacagugaaacuaggagccguggguggaaauggauuuaaaguuccucuuacaacaccucauuuggaaaagagauacucguaaguuccuaaauaguuugagucucugggaauggagcuagguaucguuuuguccuggauucaugcagccuuuauuucuggggacugugaaguagguacaccagcggagcuuggcagggaggcuuuguuuauuguguacccuguauuccaguggcaaggaagauagggucaugucccauccuagacucuuaugcccacagcaaccuuguuaucuagggagacucccauaggaagauggauauaaagacaguaaggcacaggacauucccuuacauacauggggauauccauguucguaguauguggaugacccaagucaguuuuaucuuggucucauuccagauuaaagaauuccugaguuuuauaauuuuagacucagcauugaaaucagaguguacucugucuuggaaacagcagugcaaauggcugcgugugauuaaugccauuggaggcauuugcagauccuaaguauuggcuucagaacaccaccaaauaagagggcagaauuagaagauauguaacaguuugcccaggauccuggaccugcuaccugcagaacccagaauuugaugcuauuaaguuuggucgguuccuguuuuuaaucacuagggacacuuguuacaauauuaauaggaacagugcaaguaacaauguagaaaugguuucuuagauaugugucauaucuuuaauaaauacauuucaaacaaguauaugcuuuggugccgcauauagaaugcuaauuaagguuguuuguucauuuguuuuuguugguuuuguuuugguuuuucaagacaggguuuuuccucuguguaguccuggcuguccugguacucucuuuguagacuaagcuggccucaaacucagagaaauucgucugcuucugccuccugagcacuaggauuaaaggugugcauaccguggcacaugcauacguuuuagaaguguuuauauuccuucauuuuaugcuacaucaggcaguuuucaaacuacugcaauaacuuccugagaucugugaacuuaagaaggaaaagucuauuuugccuccaguuuuugagguuuuaauaaccuguuggccccauugcuuuggcauggggcuucaggauuguaguacaugauagagucccacucaccacaugcuugcuguggguaaagaacuaacuaggcuccucaccucugugagugagguuauucuagugaccuaaaccucgacuuccuaucacuccacucguuacagugguccagagguaagagaccaagcccugaccugugggccuugggaggaguucuccagauccaaauuuaccaguuugaaaucacuagacagauacaauucagauuaagaguaaggcaguuuagaacagggugccuucuucaauuuucuacuaaguaugugacuguggguguauaaauagauaaaauaguguucaaauuaaaaacuaacugauaacuauaaacuuauuuuaaagcaauuucuuggggcuggugagguagcuuagcuagcaaaguguuggcuuacaggcaugaggaccugaguuugguucccagaaacuacauaaacaaaugucaggcuuggaggcauguaugugcauuuaauccuagugcuggggaggcgagaaggcgagagggucuguucugauuggggagcuugacgccagugagagaccugacucauaggaggugaaugguauuguugaggaugacacauaaaaauagcagccccgccacgcgugguggugcacgccuuuaaucccagcacucgggagguagaggcaggucgauuucugaguucgaggccagccuugucuacaaagugaguuccaggacagccagggcuauacagagaaacacugucucgaaaaccaaaaaaaaaaaaaauaguagcucaauagaauuuuaccccucccucccucccucccucccucccucccucccucccucccucccucccucccucccucccuccugcccucuguucuaacuuaccucuuccuuuguucauucauucauuuauuuuugugauucucacaugcaguauugugaccccaugggauccuaacccacaguuuacacaguugaggguuaaaauauauuuuaaaaaaugaagaggaggaaaauccuagucauucagaacagguauccuaaguacacaggucuucaucuugaucuuugggaaagaacugguugggauugggagggagaaagcuggugagaaccagagccggaugccugugugguguggacucuggccaagcugugugcaggggagacaguguugagggagaguuggcugagcaggcagauccugcucuggaccagcuccuuaaguggccacugauaauuugccauuggaccccaaggauaggauuuuccuucauuaaaugacaaaaugaugcccagaccagguaaguguuagaagcaaggaggcuuucccucccuuaguaguuguuuucaugagaggugcccagugaagggccccgucucuugaggcugaccucugcuggcaucuggucugaguguugguuauuggugucuugggagggcucugugguucauuaccuuaggcacaagaguggaaaguuuucuuacauaguuauuuucagaaagaugcucuucaaaucuaaauaucuuaggguaugagaagguugacuuaaaauaaucuguuguucuucagucagacaaauauuguuuuggaggguucugguauuugguauuagcaugguuuuuuuuuuuucuucuuuauucuugagacuuuuaugcaugcauccaaugacauaaucauaucuaucccccauuucccuucuccaacuccugccuugccuuucucacccugaacuuaauucuccuaucucuuuuuuuguaaauaacuaacuaaauccaguuagugcuguccauagauguaugaguauggaaccauucacuggaacgugggguuccuuccuauuggaacauccucaaaagagaguaacucccugcugcagucacuaucaacuccaguggcuccacaguaagacugggcuguggauaucuauacagggccccagugcugcugcgaaccugugucagccaugucuuaugcagaggacagcauucuacagcacucuugccacccaucagcuuuguucuuucugucuccuuguccacuguccuuaaauauuagggaauuauggguggugguugauacagguguucagggcuggagcucagguuugguuucugcaaauaauaaggacuugucuauauucauccuuuaaggaaaggucuuaaaguuucaugacuuaaagcuuuauucucugcuuauauguucucuaauauuugaacaggauucaguucgggaacaaugaagaagaagaagaagaagaaguaaacgcacugcaguugagcuuucucaccuggguugaagacgacacuuuccuggcuauaagcuacagucacuccagcucacaguccaucauucaccauuugacugugacccauucugagguggaugaggagcaaggccagcuggaugucagguaucaugguucauccauguauucaguuuguugaauggaaaugcaguuacacauugugcaggauuagggagaaggagcaacuuccuuguuagacaaagcaagaggccuagauguaguuuugagccauguuuaaacuguccaacaaguagugaaaaggaguguaaauacugucagguaggcaaaacaguguaaguugugauaagcauuauaauugauuuuaauagauaaucacuguggucaagucucaugaccaauauauuaaagaaaguuuaucuacagaauacauuuauuuuuaaguagugacauuaaacauguugcuugucuucucuguguguggcuucauuugccacuagaaagccucuuccuuuucugguuccucauucccuaggccugagcauguuugaaucaugaccuugucugggucacauagcaguaucagacuacugaagagacuucuuugucaugcaagcccugagguguaggagagaaaguucuggcgagcuucuagaguguuacaggcuuccaguggaaggccgacugcuuagucuuaugcccacguuaaccuucacauccauuuguaacguuuauguuuguuuaugguguguagugugugugugcaucauguauauguggugcuugugaaggccagaggagggcuuuagauuuccuggagcuggaguuagagaugguuuugaucaaccauuugggugcugggaaccgaaccuagguagguccucuggaauaccaucuagugcucuaaaccucugcguuaucucuccaacaccccucagucuucuuauauaaauuugagaagguuucacuaaauagcccaggcuggcauuuaauucacuuuguagcccaggcuccucuggaacuuggaaccuucuugccucagguuucuaaguagcugagcaauuuuaggcccacuaggcauagcugaugcaguucuaugugaaggcaagccguaaacuguaguacauuauaaugaaaaacccucuguaggagugcuguucccacagcuaggcuagccuacuggcucuggaagauuauguuaguaaccuucuccaucucugucgcuaucugugugugcaaaguauguauguauuacauugacauaggcagugugucuccaaaggauagugauagcuuccacuauagcaaaagcagagacauuucuccuuuuuguaaaaaaaaaagauuaucucuuauacuuaccucucugcuauuuuuaucuugcuuuuuuuuuuuuuuuuuugcuuuaguucgucugugacaguggauggagucgucauugguuuaugcugcuguucuaagaccaagucauuagcaguacagcuggcugauggccaggugcucaaguaccuuuggggugaggaucagaguuuuaggaaaagagacuuauaaauaaauaauucuugagacuguauacuugugaauaucuugucaacacgacuugauuauuggggauuuuuuauuuucaacuauuuuuaguucucuuccucuucucccuccuccuccccccuccuuuuauuuacuuauuuauugaaguccacugacugcauauaagagaaaaugugcaaugcuugucuucacaaagcugagugacuucacuugauuguugguuguuuuugcuugcuugucacaccagcguugcagcccagggcuccaugcacacucggcaagcacuguauaauugaguugcaccuucacccaguggcuaagccgucuaauuacccuaggaugcuaugccacagaguagguuggcagguguagucagcgccugauuggagcauaccagugaguguagaauccaaaucucagucaagguguuuggugcauucugguguugguuuuucuuucaguggguuugguggggauguuguucauuuuguuuucuuuucagugcucaacaggaaagugcuuaugcgcuauuuguaaacuaaauuuguuaaucuuacaacagagucaccuucucuggcuguggaacccuggaagaauucugaaggaauuccuguucgauuuguucauccaugcacacagauggaaguagccacgauuggaggagaggugaauagacacggcagggaaacucaucguggagaacaguuagugacugagggcacuggguagaaaagugugggucuuguaacuggaccugggucuccacuaaaucccagggcaguaacaggaaguuaucuucuucucuugcccccuggcuucuuuauugagaaaacagaaaaucagucuucagagcucaggagagaauuaagggagauaaugcauguaauuggcaaaucucaccucgaguuuauagaauacucaaaaccuuaugaaauaccucaugaugaaaacacccagucugaagaguaauauuugacagguugucaucacaaauauuagaguuuauacuugggcugaguuguaggauacaguagucagaaaacaaagcaaguuuuaguuccuuuucaguugcuauggugacuccaugaccaaagaaacuuaaaaagaaaauaguuaauucagaagcucacaguugcagagggucauggaauccaugacugugaugguggggguacggcaggaggcuggcaggcauggugcuggacaguagcagagagcuuauauccugagacaaccaccaaacuaacugcaaaaccugcccccacuggcacaccuuuucaaacaaggccacaccuccuaauccucugaaacaguuccaccaacugaggcucuugagacccgccacaccuuuuacuauagauaguugagugaaggcaaggagcaguguauggugguagcaaacagugcaguguuuggggcuaacuagagccugauaguuaugauagcguuguuccagaaagccucucugaggcaguggugugugugcuggacaugaagaggaaagcugcuccuagaaaggaagaguggcccuaggagaagguacuagaaacuccugaguuuagaaagaugggcagaguaggcuuggggcagcacacagaagaugcugcaggccacagccaucuguuguacuuccuggcucaggguccccgccuugagcugugguuuuugcuguucuucccaauugagguggcgcagaauagaggggaugacuuugucccaaccaggaguauauuuauacuguuuaguaagacucuucacuuuguguaggugaacacaaauguugggagugacaagaaauaagcacugcuuuguagugagaguuuugguuucuuuaaaaacucauuucuauuaugugagucugauuuugauuuaaucccaggugugggauauggggcuggcucaguuuguccccagcagccagcuaugauugucucaugcucuugggggaguguguuuuuuccagcugcagauuguuuuaauucugggaacucuggaaaggguauaaagggggaagcgcccaguggggcuguggaugguguugcucucucuguuguugcugcuggucguuccugcucuguguuugcugggcuguuauugcuugguugcuggauauugagacaacaaagauuggacuugccccuaggcgcccgaugcucuagucagcaaguuuauccccauuuucccucugacuuucuuucucuccaacaugguggugggcuggaagggauuaggguggaauaaggguugguacagugguagauaaauagaacccaaaaaagcaagucaagaaagcaugucuucacuaccuuuucuucuuaaucugguaauuaagagggaacucccuuccugccucccaaaaaagauaaaucuauugauuuuuuuuuuuuaaaucaucagagagauguguucaucauguucaauaugugauuccugcugccuagaggaguaggcgggugcugaaagggaauagaauggaagaccagcagacuuuuagggugaagucaaagaagggaaugaaauagacaagauagaguggcuugcuuguuugaaugguggugcauucacugugugaggcuuauuacagaggcuuagggaaucaacacuacaacuguacaguaaagaccauagauagguuuaagaacuugugaauugaguugcuuauaauuucacguucauuucuuugcaggaauguguccuuggucugacugacaggugucgcuuuuuuaucaaugacacugagguauguaggcuugguuuggguuuaucuuucucacaguaaugcuuccgaguaugauagcugacuucccgugggccucuugccuguugcaggucgcaucaaauaucacgucauuugcugugugugaugacuuucuacuggugacaacccauucccacaccugccagguuuucucccuaaguggugccucacuuaaaaguaagcucuccuauacaaaauggagguuaucuccuucuccagugucuugaauucuugaugauuuuaaauucuucaccuacuuuggcuguuuaccacagaguucuaggcucauuuguuaggcucuuucuuugauacaguauuuuuuugagauuuguucuuuucacauuguauggguguaugugcacaggugugccuacaccuuugguggguaugugccugugggugcagguauccuugggagcuggaauuagaggcaguugagagcugcccaauauagguauuaggaacugaacuugaguccucuggaagagcaguacacaccauuaacccuugaaccaccaccucuuuagcccccucaguauagauuuuuuucuaaaucauucuguuucaguuaccagacacuccacaaagaaaauucuaacauaaguaauacauucuaaaaaauucuucaugaaauuuuaucauacagcucaugcgcuugaacuuccuugaaauggauuuucucauugcucaacugccauuguacuucuggaugccaucuuguugcuuguaguccauuagcacugacauauauaucuccacccgcucaguauucuaaaaggccaguuuauuuucuuugcugcugacuugggaacaggaacucuuucugccguuaguaugacuauaaugugaagguaaugcuaagagauagaaaagguuuuccaggacuggagugauggcucagcgguuaagagcacugacugcucuucuagagguucugaguucaauuuccagcaaccucaugguggcucacaaccaucuguaaugggcauccgauguccucuucuggugugucuggaggcagugacaguguacucacauacauaaaacaaauaaaucuuuuuuuuuuuuuuuuuuaaaaaaaggauagaaagguucuccaaucccuguguuccccaagugcuuaagaagcugugugugugaaugugugugaguacucuguaaagagaggguccuuuccagaagugagauuacuggaagggccaaggaucuugaggcugaguaggagagcaaaggaacugaguuucagauaccgggcagcuucaaccgcaguugauggagcaugguuuccuauggucauucuccagccuuagccacugguauuuuuagugcuacaggcagcucugaguggcagucaugaggccaguggagaaauucugcggaaaguggaaagggguucacggaucgugacaguuguuccccaggacacaaagcuuauacuacagguaagcugacccuucagacguucaguucaccaccagacagacuacuuacaggcugcauuucaggcucuucugugcuuuucagccauuuaguauaauccuccuuucuuggcuaucuguugguuuuaugcaaaggaguauugauugacacagacucuggccaauaagauuuaaagggaaacuuacuuaaaagucaagauaaauaucgaacacaaguggauucugcuaauuguucauuucauaccauugugguggaucaagaaagguuaaguagaacugugcccccugcugcuuagaggaucuccaguugaucaaagaugcuggguuuuauuuugagaugccaaggggaaaccuggagguuguucaucaucgggccuuggucuuggcacagauucggaaguggcuggacaaguaaguauuuauucucugugugacuauaacugugcauguaaggacauauaacuauacauuuuagcaggaaaauaaugggucaccuguuauucuuauucuuccuguaauuucagagugaaagucagaacuuguuuguuauuuggaguguaauuggaugauagcuagucuguguuguaaugaaaauauuucauuacagggaauguagauuuuaaugaaauguguuuuuuauccauuuuuccuguccucacagacuuauguuuaaagaagcauuugaaugcaugaggaaacugagaauuaaccucaaucugauucaugaccauaaccccaagguacacuuugcgucugaccaguccucgagcuccuuucuugcgugaaugucaucuaagcuaaaaugcuuguauacuuucuuugauaggucuuucucgaaaauguggaaaccuucguaaaacagauugauucuguaaaucauauaaauuuguuuuucacagaacucagguaaguauuuugauaacucaugauuaucauauuuuaauuauugucucuuacugauaaagaaauagcuaaggagcaaacaucuuuuugaauaaaaucauuauaucacugagggcacacgaggguuuuugcuguaguucuuuaacaacaucagauuuuuuuuuuuuuuuuuuuuuuaauuuuuuuauuuuuucuucuucaugacaagguuucucuguguagcccuggcuguccuggaacucacucuguaggcuggccucgaacuuagacaucgcccugcauaugccucccaagugcugggauuaaagguuuucaccacuaugcccagcuauaccaucaaucuuaaaacugaguuuuaaagcucuaauccugaauuguuaauuugacuugcuucagauuuccccauaaagcuguucuucucgugagucuggaaucaaauaugguccuuccucugaugauuuuucuucaacuuuuuaaagauaggaaaauacugacuguuauaaacuuguagugacacccagguucuguaguuccuguugucucguguguguuuuuauugcuaaccaucacccaucgucuuccuguuuuagacagauguuaaaguuggagacagcaguccuuuagcucuagaagcccucuuguauagauagcauuagcuaaagcucucucuuaguaugggguaguuaacugcugcagaaugucuagugcugcguccagugaguuucggccccaguuuacacauuauauaauccaaacccuaucaugucacacagugcgcguucucucauccauucucuguuagugcuugggcagcuacuauucuguauuccagcacaggacagccucuuguuuuacaucaccacauaaugcaaacaggacggauuuauuguggugugauuguggcugcuuugacuugcuguguauacugcugugcaaauacaccacccuuucuucauucucugacuacuuggacgccuugguuguacccugcuuuaggcuaaucugagcaaaauuaggaacaugauucagucagccuuugguggauauguuugauuccccaccauuugaauaacuuaauuuuccaggucccuuuuuauuuauugucucacaaacaugcccaauguguauuaguacuuggauccccacucuauuugguaaagugaucuguucauauacugugguucuuagggaagaagaugucacaaagaccauguacccucccccgauuaccaagaguguccagguguccacacauccugaugggaagaaacuugaccucaucugugacgccaugagagcagccauggaggccaucaauccucgaaagugggugcuguguguuguuagcguacacaucccaggauguggagaugucuguccuguguauuagucuugucauuccgguuuucacuuacuaccucagguucugccugucgauacucacaucucaugugaagaaaaccaccccggagcuggaaauugugcugcagaagguacaggaacuucaagguagagaccugcgcgagacacuugccugacucagccuucauuguuggcagauggccauuacugugucauugccacuucauggaaugaacuuguccucuuugcucaccauauucaaaugugaagacuuuaagugcuaagcauuuaugaaugaaucaaaagccuauguucaucuuguaucagagccuguggaguuuccuccaagugacucuguucugauggucuuuucuuuucuucuuuuuucuucuccucuccccacuccccuuuggcuuugauuuuggcaaagucuccugugguggccucagacucacuauguagcuagagaugaccuugaacuucugauccuccccuugagugcuggaaucaucgggagcacaccccacagcugguuuuauaugguggugggaaucagucccacagcuucauggguacuagacaaacacuggacugacugagcuccgccuccuguucuuucuuaaacuccaacaggaaaucuucccuuugauccugagagugugaguguagaggaggcuuugaaauaccugcugcuccugguggauguuaaugaguuauuuaaucacucccuugggaccuaugacuuuaauuuaguccucaugguagcugagaagucacaaaagguauguggaguugagacuuuugcaccauuuugaaauuucucugugggacugaguucuuucgagugguacuuuaccuaguguuacaaguggaugcagaucugagucuccaggacuggaauugcuaauccccauggucuguauugucuaugugcauccauuugucuuugagacaauaucucuugcugaccuggaacucgauaaguagguuggcuagcuggccagcaggccucaggggucugacuauccauuucccaaugccagaauaucaggcccaugccaccaugccugacuuuauacguggguucugaggaucuaacuaaagguucuugugcuuacaguaagcuguaucccuggcccagaaagcugcucuuuaggaagaagacucagcuugcuaggcaugguacagagcaggacgugguagggccuauagacuuggauccaacucaguacauuuuuaccuugguuuugauguguguucuacauucuggcauuuaaaccaugucaucaaggacacugagagcuagguuuggcucucuuagguucacucuugacugucgcuuagacuguagguuguuguuuuccuugucagccuguguguaaggagcugaagcuguugugagauguagagguuagucauuauuccaaguuuaauuaaacuaauacccaaauaugagcucuuuuccccaaaacuuugaucugauguauuauaugauauauaauugauguauaaauauaauacacauuuaaaauuaugcugcucuaugcuuauugccuuaauauaauuuauauucuguagauauuacaaguaauaacuuuuuuccuaggauccuaaagaauaucuuccauuucugaauacacuuaagaaaauggaaacuaauuaccagagguucaccauagacaaguacuugaaacgauaugaaaaggcccuuggacaccucagcaagugugguaaggguuuuuuuuuuuuguuguuguuguuguuguuauuuaauuuggguuguuuauuuuguuguuguuguuauuuuucgagacaguguguuuggcauuggcuguccucagagauggccugccucugccucuugcaccugccucugccuucugagugcugggauuaaagguugugccaccaccuggcuuguuguaaauuuuuacuacugcuuuuaguguucauuacugcuucaagucuucuuugaaacuagacuauaagauaagauacaaaaaguucuacauuaauguugcuuaggaaacauagauguaaguaaaagccauuauacuuccaaaaugugauuuuuuuuuuuucaggaccugaguauuucacagaaugcuuaaauuugauaaaagauaaaaacuuguauaaagaagcucucaaguuauaucguccagacucaccacaguaccagguaugugguggguuaaaugaggcccgauuuugcuuuggacauuagucaggaagugaggacaucuugaguccaaacaccuguccuucggcuucuaggguuguccuacgacccaucagccucgucuuaaacuuguuaggagaaaauuagccagggcagcagugcuucaagaguuccagagguugguuaguuuaugucaauagcucuuuagguuuucuuauguaccagucaguguauuaucuccucuucccuguggccugauagggugcuguucccagguuacagaugaggccacagcuugcauaaagguccagagcugcaaaguggcuugccuagagcgcugagcccaggcucugaccaccguggccauccauucaucacucuucugcaugccacccucauuaccauuuugguuugucugcaaaucgcacacacauucuuacaguuugcuuccuagugcuaugauaaaacaccgggcaaaagcagccugaggaggaaagggagaaaccuggaagcaggaagugaagcagggacuguggaggaaugcugcugacuggcuugcucuguggcucaccuucagcuccugccuuacauagccugugcugacauacccagugguuccuucuacagauagcucuuagcaaucaaggaaaugccacccugacagccuuaggauacucuaaugaaggcaguuccucaauugagguuuucucuuccaggugcuuugacaaccaaggguggcuaucaaacaugucucucuguguucuagucucugccaguuucuuauuauuauuacuauuauuauuauaucauuauucucauuuauguauaugugccugcuuuccuguuuuugcacuggguucacucaggugcccacagaggccagaaagggguguuggcuccccugacaccugccugauaagguguuaggaacugaaccugguucucugcaagaaccucaagggcucucacccucugaggcaucucuccaaccccccagccagcuucuucaguaccacucucuugcauucuccauaugcccaguuaacuguagauaguuccccagauggguugaauaaugaccugccagcucuuuauuguauucuuucuugaguccaccuguccauggacauuaccagucucccaugaaagccauucuuagaugaggggcuagauaaagugcuaauuugcuacuuugucucugccaggcuguggcuucuggaugggcagggacugcguuguauuccuguaucucugcuucaccccaagcugccucagagcucugguuuucucuccuucccucagccccaguaacauuaaucucaucauuacuccuaaaucuacuguguacacucuugucacaaaacccuugugccugcucucuccugacuguucacauaguucauucccuugaagccuucagagguggcaaacuuaucauuucuccaucauuuaucuuccucugccauuuguuauagaccaugcuguguuagccauguaggcaaugcacuggauuuuagauugugugugugugugugugugugugugugugugugugugugugugguggggcagaguggcuguuaccaccuagacuaaugcauauguagugcucagucuuugcugaauguguaaauacugugucuucagaaaggguuuguguaggaaaaggaaggggccuaagagugguagcuaaaguugcccacacuggaaauagaaagaacuauuaccacacauuucuuuaucggaccuccgucucuugucacaggcggucagcauggcuuauggcgagcaccugaugcaggagcaccuguacgagccagcagggcugguguuugcccgcuguggggcccaggagaaggcacuugaagcauuuuuggcuuguggcagcuggcagcaagcccucuguguggcugcccagcuucagauguccaaagacaagguggcuggccuugcuagaacucuggcagguaagcagggccauuuucuguucauucuucaaaagguuuguguuuguugcuuuguuugguaauuuuguaaauacauuuagggcaacauucccgagacagacucauuuuagcucuuuaaagagagcaagaguccucaaauguccuggcauauuacagcaguuuacuucucugaccuggcugugcugggugucuggcuuugcaggcccuuaaaaugagauuguggcugcaaauguccuugaaguuacacucuguugucuaguccaccuuacucacugacccuuugauauuauggccauaucuaacaguguggcuguguuggcccuuuaagaagguaaagaugaaguuuuggauggagcuauucugguguagacaauauaugguugaaaaccguaauagcaguugccagaacugauguggacaagaccacagguacaagcagaaagcagaggcugcugaguggcucggggaugagggauuuccugaaguggaggcuaggcuagcacuucugaccucugagaguaguuacagggcugguaaugaccaaugagguaaucucuccaacacagguggcaggggguaggugcuuagugaauacgaugucuuggaaccuuugagaagaaaggugcucagaacugcggugaauuucccgaguucauauaaagagcauaaugggcugucccacauaugagcagcaagucacucacuuugaaccuggccuuacuggguuuugaccuggucagggaagcccgugggcugugccaacaugcauuuguuuuguuacucaccaugacuaccugauaaaaauccacccuaaggcaggaagggguuagggccugaaacacuguucuauucucagaggucagaaguccugugauuaauuuagauuccuuuacuaggcaggcuagcacuccccuguagucucggggggggggggggggggggcgcacagcugaacauuuccugcuucagccugaccacguagaguacucagcuaggcuggauaggaggggugugcuucauguuguguaauacccguguccucacaaacacucagaagcuuuuaggcuggagcauuguagggacagaaguggaagccaguucccuuuugcugccaaguccuuguugcugucuuuucaggaaagcugguggagcagaggaagcacagugaggcagccacaguccuggaacaguacgcccaggugagcuccuccccgacaccacaugagcgagagaaucucccgucccugcugauggugaaaacugaaggaauccugcuaaugguuauaaaggacccauuuggugccuugcccugaaaaucucagucuggugugucuaacccugcauccaaaucugaaaacccucaaaaucugcaguguuugagaacugaaagggacgccacagaugugaaauccuguuccuguccacggacagguuaucuucaaaguguaggacacggggugugcauaggaaauacgaaugagcuacuuguuuaaacuuccccucuguuccccaagauaaugcauuguauacguguaaauacuguaaaaucugaaaagaaaaacccaaguucuugagguccuaagcucauauaccuuuucugcuguaguguuugcuagugaccugacucaguagaaagcaaacucaacuuccuauguuaauuuuggcaaagaaguagugagccugggccuuacuuagguuucaaaccaggacaaguggcugaggugccagguuuucccugcaaucccucaguuccuaccugacccuuacaggguccuccuggcugguguacccuacccccugcccuaaacucucuagcgcagggcucuggcugcucuuuccuauauuguccaaccauuuugguuacccauucucuuuguauauuggguuucagccccaaaugaaugaaaaaaggaaggaagggccuugacugcucuuagguaugauggaggaaaauguuuaaugaagaugugugggagagcauagccagagguagugacauccaggacaggccagaguggacaugaccagaagaugaguugugcccugugagaagaguggggagggaacgaguggggauccaggugcacuggcuagaagcccaguguugcgaagagagucuguaaccaaagugguuggauuauauagggaagagugccuagcccccuaggcugaagaauucaagaggcagaguauggcagccagggggaacccugcagcagguagagaugggaauuguagggagaaccuggucuacaggucugcuuuugauuuuaaguaggcaccucugccauuuguaccaguuugaaacuuaacaauuagaagauaguuaauuaagcagugggcgcugucuugccuuuuaguacccuucuguguauuaaaaauguuucuuuuuuaaccaaggcagcuuggagguuuccaguguuuugguggauuaucugugaaauuuugguagaauuacaaaauucuaccaaauguauuaugaaaguauuaaggcugcacuggcacugaccacaggcugcugggacacaggcacaguggguagacagacaccaaggauugcugcucugcuccacuuuggcuuuuuguguuguuguuggugguggugguggugguuuugagacaguuucucugagcagccuuggcugugcuugaacucacucugcagaacagguuggccuugaacucacagagauuaaagguguugcaccuccgucaccaguucaguuuugaccuuuugaaugagaagacuuuucuuguuuuguuuguuucuacauguguaugcaugcaaaugcacaugugugugcacuuacuacauguguaugcaugcaaaugcacaugugugugcacuuacuuggcaaucagaggacaacuuucaggguguucuucucucuuuccacaguggguccuggggaaacacgauaagguggacaggcuuaugaggaaaguagcauuauuguucauuuguuuuuucauucauucauuuauuuagucuugaaacaaggucucagcauacccuaugcuggccuugaguuccugauucucgugccucuaacuccaaagugcugggauugaaagcauaaaacaccgcaccuggcuuaggagaguuuuauaguugucacugcuuguaugaggauucuugagagaaacaggaccaauagaaugaauauauauuaaaaggaaaggacaggaagagccgcacucaguaugaucuggguagucugcaguggcuaucuucauauggagaggcugagaaccacuagcugcucagucuacaaggcgggugcacugcagggcugggagcuucaguucauucuggaagacugaaggacuggguucugauagcacugaagggaugcagcagcagcagucugguggaugaacucgccagcaggacacaaagcccagcagacaaaaaucaaagcuuuccccuccuacuuucuuuagucugggcugucaccaggaggugcuguccauguguagggcugggcuuccuacuuuacaugaccagaucuacaaaauccucauagcugugccagcugcuuaucuuuaguuagagcccagcuucagucaagcugguaaucaagguuaauuuucacacugguagacauauuuaagacaaaaaaauuguacuguuagaauauuucaaggucugucauggguuaagacagaaagaugauaauuuguauuuuagaagauacuguaagaaaucacguugaugaggggagcuggagagauggcucaccccuauggcaguucacagcuccaguuccagggcuccuguacccuuuucuggccuccauggacacuuggcaugcauguggugcacagacauauaugcaggcaaaccauccauagaaaugagaauaaguaauagcauuuuuaaaaggagagaagaaaguguguugggugacugagcugaaacaucaacucaaaaccuugccuaagaguguagagagcuuagaggaagguuccuacugagaugugccucacuugcccuuggaccugccugcaccaggcguguuagcuguggcuccguaacaguuuacugugcacacaagacagccagccgcucacagcagguacugacugcuucaccaucugggaaaaagcugcuuaacuugcagcuuaaaaucaccaauuucaaacucacuuucccucucuagauuuuuugggguuuuguuuguuuuaauuuauguauguguguauguauacaccuguguguaugcuugggugcuuggcagggccagagaagggcguuagguauccuuuguuccucugccuuucuuuugaggcuggaucuguaucugaaccuggaguucacucuuuagcucagcuggaagccagccugccucauggucuuccccugucugcccacucaggaccgucuagcucgucagcucuugugcuuguggggcaagccccuuccccacugaugcaucuccagcgccuccauuucuagcuuaagcaaaugcuagugcccuguuuguccucauacacuaucuuggcgacauuuugcugcugcuugugaguuaugcgucuguucucgaauucccuugugcuuucuucauugacccauggauuguuccaaaaugugguauuuaacuugcagguauuuugaaaauuuccagccaucucuuacuaauuuuuacuuucuguugugguuauauacuuaaaaaaaaaaaaauacuggauuggccaaaauauggucacauugagagaaaguuguaugccugcgugguaugauggaguguucccuugguuacauuggggugauuagucguuugugcaguauggccuuuuuuuguucuuauugauucucuuaauacucugaguugcugggagaaaaaacucuguuuagauuucccauguuuuugccucucagcaaguguuugcuuccuacguuuucaagcuuugguguagguagaugccugcccauggucaugccagauaccaucccucuucacugguuaguacuguuccuuacauuccucauucugaaguaggcuucguguauugggaauccagcuauuccagcuuuuuaaaaacuguggccugcuuuuucauuguuuugauccaucucugcauuuucauguuuagguuuagaguuuguccacuaagcucuggccccaguucaggcucagcacugcucaugaauuuaucaucauacuccacuguugguaauuaagugucccucaugcuugcucugugaauuacaguaaauaccagucacacauuagcauaccauuccacaugcagguaagggucccaacaagggcaccuuucaucucuccugccucuccuuaguguaacagaguuuaacuacguauacuacaaauucugucauuuguuacuacuuuugcuuuuagugaugagaaaaauuucagaugacucaaauauguaugucucuuauuuuuucccuuucaagagaagcuagaaauguggacuuuaauuugauauuuccugagcuuuaagaaacuugaaggcacucaaaauauaucuacaaccuaauccuaagagcugaaagacugcacuuagggaaacccugcugaguuuauugauaagugugacugugugcuuagaccccacaccaaggucagcagcuaaaaaucagaucuauaaacugggcuucauagaaacuaagaauuaucaagacugaacaaagacagcuugcagaauagaagaaaauauugucaaagcauuuaucugauagugauuuaauaucuuagacuacaugaacgauaauucaacaagaaacacgcaagccaaccaggaaauuauuguuuaguucacuauacuuuuuaggguaugguauuauuuucaguuaaucuuggcagugaauugcgaaaacaccauuuugacaagcuugucuuauggcuuugaucucccaggagcuaacaaaaccauguuugugucacucagaagauuaaacuccacccccccuuugucuuguacaccaguguuuguggagauuaauaucuagaagauaccgggcaggcaagaugcugagaauuggagcugugaaggcugggcugccuggggaggaggaggggcucuguguggcggcucuggcugcuguguucaccagugcucccuugcucuucccuugucaggauuaugaagaggcugugcuccugcugcuagaaggaucugccugggaagaagcucugaggcugguaagggagcucugaaggcuucuccugugcugggagggggcggcagugggcgguggcgggcggcugcagcucccuggcuucugagugagguuaaauagcaacggcuugcuucccaauccuaaggacaagcaguaacuauaagccauuucaaaccaggaggugguggcacacgccuuuaaucccagcacucucgagacagaaacagguagaucucugugauuuugaggccaacuuggucugcagaguaacuuccagggcagccagggguauacagagaaagccugucucgaaaaaccaaaauaauguaacaauaacagcagcaacaacaaauacaaauuugucccuugaaauugggccuucauaugcaacauacugcuuuuucuugcuaaaaucaguugaacugccuuggaauucaacuuaggaagcuuguuccucgggaaauguccagauccucucagucucugucuuaacuaacucucuguuggggagaaguguuccuguccuaacaggcugcauuuucuucccucuuaggucuacaaguaugacagaguggauauuauagaaaccaguguaaagccuuccauuuuagaaggugaggauuacauuuaaguaguauucccuuuuagaauuauggagaaagggaaaagaaagauagggcagggcuccuuauauuauugcauuuuaauauguucugcugacgucaccagagucuuugagaauauagcaagcugugaaaugaugacauugucaguauuuuaauguugaaggcugagaugcaauaugguuaagucuuuguaauaccuggguuuggauuuauggcaggccugacucagcguuagugucccuugcuagaacaaaccugcccucggcagccugccucugccuguaaggcacuggcacugagguggguuacacguugaugguggcuguugcgggcgaaucuuuguguuugggauaguuaguaggcuuggacaugcaguauauuauuagaugguguauuuuuucagugguaacuuuucuguuuuuauuccuuuauuauuauuaacagauaagugccuacaugcaauuucauuuccgauucuacagaguugcaguguguguguuugugugugcgcgcguguguacaaucauaaacauuuuuauagagaaauaggaaguaaaaugcuaccuauggguaaauauagugaaggauuuacguguguuuggggcuauuagaacuuuugaguaggcuugaaauuuuucaagauaagcuaaaacauauuugugaauaaaguauguggcuagagaagagaagaauauugacuagcagcugcagaaugucugcucucugggccccucagaagcaacuugggaaagagcauugguuucacauauagagucuuagggagucuguguuggcuucagugcugcccccugagcagggcugccugcugaauacauuugugugaacucacauucuuaccuuuccugcuucugauuacaacugguggguacuuuuguaccguugucaucccagacugaguauggaaagcguccucucugacccugugcccucagcuaggcugcuccuaccccugacaaaaacuugggaauaagucgggcagugguggcacacauauuugaucccagcaucagggaggcugaggcaggcagaucucuaugaauuuuaguacagccaggacuacagagcaaguucuaggacagccagggguaugcagagagacccuuucucaaacaaaacaaaaaaacaaaacccccaaaguugggaaugcugauacuucucuguagaagcuuaauaucuuugcccguggagagcauaguuuguuuuuuucccacgggacugugauuuuaggaaccauuagaagcuucuguuccacacucccagccguauccguggguuccagaagcagcuuuaggcucuccuccugccuuuguuagcagcucccuucacuucuccugugcuugcucgucucacuuuagauugggugucaggucuucagugauaggauuguguaaguuuaguggcacuggcaugguauccucagggugucuuugcaggugucaaggcaggcagcaguugcuaagaauuuaauuacucaguucacauuggucucaucaacuuugaucaaauauugggaaaucugauaccaggagguuuauugucaguauauuuaaacacaauauaauuugauaaaaaguuuucugguguaauacaaagaagugugauuacauugaaacucaacucaggguacaugucauuucuuccaagaagauggguucuggaguuaggcuaccuguauuaauuucagggccuauggaaggaucuggccuggucucuaucauauagauaauauagaggucauuugggauauuagccaccuauagucaugauuggggcagccuuggggagucucuggcuauacagaugauguaagggucauuuagacuauuauuuaucuacaguucugguuguggguguuuggggcagccacuggcuaugcagguaaugucaagguccuuagauuaauagccaccucucugggccugguuguaggagcuugauauggccuggcccaacagauaauacagaucaccuggcuauuaaucaccuccaguucucagcuuucuggauggaagcacaagguuuauauuuuuccauugcaaagaauccugcauguuuaacauuccugguuucccuggagauaugugggcacaagaacuuucaugcucccaacagaauugaugaacucugagaucugggaucuccaacucauuaauggaggaauaaaaaaaaauuaugguugguagaccuggauacaucuuuuauuauuaaauuuuagcuuugcuucgucacaccccacucacuuaaguuugaucucuuugcuuaaauaucaugcucaagguauuuuucauuaugcauccucagcccaaaaaaauuacauggacuuucuggacucugagacagccacauucauucgccauaaaaaccgcuugcaggugguucgagcgcucaggaggcaagcaccacagguccaugugggugagugccuccaaaaaguaucccgcugauacugggguguguggaagauggccccagugcgugcugucucugcugcucgccugcugaccguuuucuaaggcggucaguuuauaaagagacagggucuguuuggucacagggucuuggaaggagaagaguagggcauccacacuuuggugccaacauaugcuugacuuuggggagggcauugugacagaaaacuagguugacaaauccaagagguacauguguaagaagugaggggcaauaccagucucagugcaggagucccacaagagccgggacuccauaacugugagaacagcaucagucccuugcuucaucacugucccauugagauuuaagcuacacgaguugcugagucaggacacacuacugcuuuaugcuauauugugguugucugaaaguucauagggguuauguauauuggagaagcgcuuaagaucugagcaaggcagaaaucagaagaucucuaccaaguagucccuccuuucccccauccugccagaccagugaugucuucgguguaucauaaaaugaguuagucccuucacaccuacucccccaaaaaggaaaagaguaaauaagguaaacucugauguucuuauuacuuugagaucaacuuuguaagauccauccguucuccagugugugcugacugaauguauaguuauuuaugucugcaucugguucaucuucucuagaucacgagguggcccauggcccagagucagaccucuucucggaaaccagcaguauuaugaguggcagugagaugaguggcagauacucccacaguaacuccaggauaucugcguacguacgagaccuaggcacacagcaacauaacagaccggcuuucuccgaggggggugccggguggggagguggaaggaugucccucgggcgcuguaugcugugcaaggaccucccagcacauccauaagaugaggcuguuuuuuaaaguucacaucuuacuguagaauucaaguuggauuuuucuuuucuucauuguucauuaguaugcuuucaggugaaccucauuuuauuuugcccuuauuuuuuaagacaggguuucaguauguaacccuggcuggccuggugcuugcuuuagagaccaaaguuggcuucugacucacagcaauccaccugccucugccuccugagugcuggaacuaaaggcuugugccaccaccccugaucuuacccugcauuuuacuccuaacuuaagagaaaaacagaacucuugagguauuugcuucugucuagacuccacuacuuacaugugggguuacuaccgcauuccuaacaucucccaagauacgacugccaucuguagacgcccugguuucuuagcaagugguggccaauagguacaguuggcucaucagauuucacuccggaggaaccuccuuuuuaaugucuguaauuucugacaggaggucaucuaaaaaccgucggaaggcagagcgcaagaagcauagccucaaagaagggaguccucuggagggccuggcucuucuggaggcgcugagugaagugguacaaaguguugagaagcuaaaagguauggcuucagugcucacugauccuugaccacagcaaguagcaauggguaccacagacagauaguacauauuaagaugcauguggggcuguugaaauggcucagaggguaagccugacagucugaggucugacucugggacucacauuguagaaggaaagacccauguuucacacaucguucucugauuuccaccaagauaacccacaaauuaaauguuuuuuaaaaagauacuauuuucuaguuagagcagcaguucacagccuguggucagaacuccucugguguggaaugacccuuucacagggcucacuugagacucagaaagcagaaguaguuacauuaugagucauagcaguagcaaagguaggguuauaaagcagcaaugaaaauaauguuauggggggcuggagagaugacucagugguuaagagcacugacugcucuucuggaaguccugaguucaaaucccagcaaccacaugguggcucacaaccaucuguaaugagaucugccaucccuuucugaagugucagaagacagcuauuauuuuacuuacauaaaauaauaaauacaucuuuuuaaaaaaauaauguuaugguugggggucaccacaacgugaggaacuguguuaaagggccacagcaugggaaggaugagagccacuguguauggaacgcucacuuccguacacaguccuaagucagcuucccugugaggggaucguugcuuaagccagggacagggguugcacaacacagcgguuugcucauugccacugggucucuuuccuccugauguacugaguuagcccagcagucaggaggaaggggugggagggugcaucuguaaggugcuguuagacacuggcaacuugggaaggagauuacuguaugauucuggcaguggaguugugacacaauuucccauuucuucucuagaugaggugcgugcuauuuugaaggugcucuuucucuuugaguuugaagagcaagcaaaggaguuacagagagccuuugagaguacucugcagcugauggagagggcaguuccagagaucuggacuccugccggccaacagaguucaaccacaccgguaagcuuccucagaagccaugggcacucucucucuuccuucucacagcuguagccacauaacccagcggcagagagaacccucuuugugccaggguuaaacucccucagcuuugugcucacgcuggcuucuguuuaccugcugcuucaugcuaaggggaaguaggcuguuauuuuuccuuuauguaaugcagcugucucaggggugaucugagaauguccagugccaguggaguagggagggaagcuaggauuagaguugcccuuuccuucccagauccaaagucacaaggggacaggagcuuugugcccgugaagccuucucaugcauuaucaucccugugcuuuuuaggccacagcuggcuaccugaacccucaagucaauuguugagaaucuugauuaggcuuuaggaaggcuggugugugaguccagaaaggaaaaguccccaccuguuauuuccacgcagaauguaaugccugguugguuaaacaagcacugggggugggggcggggaggagggcugaaaaggcaaaugagagacacagagaacuagagaggcaucuuccgggcccugcugaggaagaacggacagaguugggaauggugacaggccagaggcccguggucugcagccucuggagagggugcugguuagugggaccugagauuugcggguggcaguccugaggagcuaguucuaagugagagguggauagccacuggcgugaacagcucuuccuguuccugaugggucacuuucccucugacuuugccgucucccuuauugguggaguauaccagggaaucagcugaagagaagugugcuucaugcccagcccugccuucacugacaguggacagaaggcuggauuugguacuuagcgacaggagcuugcaaucauuucauuggcuagaaacauuggauucugggucuugauuuccuccguuccuaaggauacuucuccuguguguuugacuaaacugcuuugaagguuccauaagaggcuguguguuuguaaagagcacgucacaaaccacagcaaaaaaaagcagcuaaaaaccaggugcuacaaaugcuugcauuuacuguaauggguguugcuuagaaauagcauuuucaaacuguaguguuuugaagucaacaaugucucuccacuuuugcucagaaaauauuggcuucuaagacaccaacuauguaaaucuuguagauaacauguauggauuuguuuuguuuggaaauguagacaugggccauguucuggauaccaugagucacuugcaaacgcucacaguauuaaagcugguaucucccagaggcucacugcagguguggaccccagugaaaucuauguaggguugguguuccacucauaaggugacacauacauuuuuuuaauauaaaaauuguuauuuuccacaguucuuugaauagaauggauccuuuguguguccuauagacuuuugguuuuuccccucccauguauuauguucauuuggaaaaggccagacagauauuauuguagaacucucuccucuguuacuuguuucgggaagucaggagacagagguccgagaugagauaaggaaagauaguuuguugaaauuauaagggacagaacaguuaccuugucagaaccauaacuaggaaaagcagcaggcuggggugcugcuaguggggacuuggucugcugccaccuggaguguaaucucuguugacauaaccuguuuucugcuuagguccuaggucccagcuccacugcgaauagcaucacagccucuuaccagcagcagaagacuugugucccugcucucgguuagugucucuucucuccagauuaucucagugcugugcagggcuggguguuggucagcuguggaagggacccucucaauuccaaggccacacuuaagcggcucuauuacuuguaguggugguuuggagggaagaauacacuaugacuuuuucuguuuguauuuuucgagacagggucuuacuaugaagcucuggcuagccuggagcucacuguguagaccaagcugaccuugaauucagagauccaccugccuccucccaaauguugcaacuaaagacaugcaucaccaugaccagcauaaugugaccucuguuuaauuuuaaaguaacuggagaagccugugcccaaucuagggcguguccuauccucugucuaucauuccucucucugccucucauaauaccugugcuucagucugaauuaaagucucuucuuaagaaaacuuugcuucaaaaaacaugcagugccaguugcaugcaguguucaucaucacagcugcagcacgagcccugacaguccgugccugugcgugugugagauugcugagcugugauuugggcucuuucaaucuucacagcauuuuuaggagauagauauuugcauuaccuuacaacugaugguugaacuugaagccauaucuaaauaucaguucuuuacauuuccuauuuauuucugccuaaaauguuuuuuuuuccuucccuuugugggagaugguucuuaguuacauaacguacuacuacaaguuagaaaccaccaaggcuucaucuugaaagcugucuugaaauuagcaugcauguauuuaucaccuaaguauuuggacuucagguggacacuucaccauaccagccucugugcucuggaaagcuaacugccuuuaaaguugcugcuccuggcuucuugugugauaggcagugguccggaguguuucucauguaaaagcugugcugcaauggcguuuugaugacauuuggagugggccuugcacgguccccuagcaccuucuguuguccgucucgucugagcaugcuugucugcccaggaacugugugcucauccccuuccuccugagacuuggcaggccaucuuugccaacacuuucacacacuucccaugugaagcaaaaaaucguuuuagacuugaagccauuuugcugugcuguucuguucuguugucuagucccugugcccauucuugcugccgacccaguuaugaccuucaggacagcuucagugucucuuucccuaaguuguucugauggcuuaccagcaucaaagagcacgucugauucucucuguagagacugaaaccuuugaggguuucugucugaguuuaugaugucagugucccaugguuccaaggcugggugauaguuaauuucauuucuugucacggacagaauaaacccaucaugacaccaagagcauguuuguaggggcagcuugcugcuaugguggcaggauugcaacauggcaccaaacaggaacuagagaggucaaguucaaaccauaaacuccacuucaccucagcuccugugccugcuagcugugccccauggccaaaagguccuauagccucccaaaacacugccaccagcuugggaucgacuguuuaaauacauaaguuaugugugugggugguaguguaucuuaccaaauccuaacagguagaaaaagagaaagucuugucauucaaaaguaguuagcaaaaacuacucucaaaauuagucccaaauauccccuagcccuucccaugcuaacacuggugugaauauacucacggagacaucagcagcccugcaggccauucucugugcuugguuccugcuuggugcuauacagcuacacagauugauuguaggcccugcagaaaugcaggauuccuggccacagcuugaagugauguuggaaaagagcuacacucagagcuggauguuauagucuugggugcuucuacaggaaucugacugcucacgccucacuaaagaauccucaaaguauuuuuguuaaaaugaaacuuuuugucccaugaaauuaaacaugaaaauguaaaacacauccccuuuugcugucagccagccagguugucacucuccuggccacauuggacaugcuauauuuauuguugguuaagucuagaaucaaauacaacuaugugauuuuaaaagacaacagguuauuuuauaacuuuacuuuuuuuaaagauaaaaucuuauucaggcuuuagccgccaugaaauuauggaccuuguuuaucucuguuucgguacugauauuuuuauauaaucaaaacuucuggugggcuuuauguacauagcuucacuugguggguuggugauggugguggugguggugguguuuuuccauuucugguaaauggcuggguggaugauaaauaggguuaauuauaaacuguuaugaucaguagaagaaucuggauuacaaaguauauugaagaaaacucaaauuugauccuggcauggucacacaggccugucaucucagcucucugaaggagaagcagaaagauuacauguaaaaccuggacuacagaauagcaaaauccuucccagaaaaaaaaagaaagaaagaaagaaagaaagaaagaaagaaagaaagaaagaaagaaagaaagaagaaagaaagaaagaaagaaaaggaauuaaaaccuggcaauucuuaauuaauuuguguguguauaagcauguauuuguggaaaaugaaaaauuauguuuuaaaaauucucuuggauuauucuuacauuguuaaauauuuuaaaaucauuuaauaauauauguauaugcaaacauacuacuagaaauuuaauuacugacaaauaguaauaagaaaaacauucuuauauauacucuuuuucaugccugugcuuccuauauaugauuccuaguuacacaggagacuccuaaaagucuaaaggaagaaaugccuaaguuugcaguuguaaugacagaguccccccugaaacugcuuccugcauuacucuuucauagucacagcuuugcuggccguccugcucaguucuaccacacguccugucaucgcucgaugcugauaccacugccacaucuuauuuuaugcuuacaacaaaaaaauucacacauuguaaaauguagcucuuagauguauaauuuaacaaugaaaagaaagcauacagugcagggcuggagcgaugaguuggugauuaagagcacucauugcucuuguagaggaccaggguuggaccacccaucguggcucacagccauccaaaacaguucccugggauucagugccgucucuggccuccaaagguauuguguguaugguacugauacauauaugcagagaaaacacucacauacauaaaacacauccaagauuuaaaaaaauaaaccaaacaaugaacgcuagucuucccuauugaaccuucuugugcucugaaucaccuagugagcaugccugaugccugaugcucucccugucuucccagggcagggccuccaagcugcgcuugcucugaccacccccaccccccacacacauuacaggguggcgagcccauuaucacuugccuuccauucuugcuuccagaugcugggguuuauaugccaccgaagauggacccgagaagccaguggaagcugagccugcuggaaugacugcccuguuaggaaggccuugccgggaagaccguuuguccacucacucuucgugcuucuagcuguggagaacugggauguggaagagucugccuuugaacagccucagcuagcacuaggcaguccccacuuucuuuuggguauacaucuuagguacuaugucagaacuucguuuuagccagcuuauugcagucuuuuuaaaaauugcuguuuagcuggcuauaguaggacaugccuauaaucccagcagcccaggaagcuggggcagaaagacugaugcaaguucaagaccagcauggccuuaucucaaaacaacccauccugcuguucuuguacucaguacuguuugaaagcaugguuaggcagaucaugaacuggagucucguuucuguuacaaccuuggacagcucaucauugauuugauccucaguuccuguuguucauagggaaugauguuucaugguuucuaccucaaaaagugaagacaaguggaaccacguuucuaaguugcucuguguuguuaacauagugcaugguauucauguaggcaguuagugcugccagcuuuuaguaagaugugauugcauagcuggcaucugugcauuaacucaaagcagaauaaaaagcuguuuggggacuggagaauugacucagugguaaagagcgguuguugcuuuugcaguggaccuggguuucccagcacccacauagcagcucacaacggucuguuuucuccaguucuagacgaucuaacguccucuucggauuucacugagcaccaggcaagcaugugguacacaaacauaugugcaggcaaaauacucauacacacaaaauaaucuuuaaaaaauuuuuuuuaauuaaauauguuauccuaccuuguuaugugcuacuagcuuuaauugggcuagacuuccccuagcuggcacuguuccagggauguucuauugccucaguauguucugcuagagaguuaccaagaguaggguggacuucagugauggguagacagcaggcauaugugggagcaggguugguuguuacucugucccccaaacacuaccuccuuugacuaacgcauucugucuguguccaggcagacucacuuggcuuuguguauggcuuuuuguaugacaucagaugcggagaugcagagucuagaguuugccuagcugguucagucuuucaguaacucugcuuccuccucaauuuuggaacuguauacccuaugcuauuauauguuggaaguaugugauuugcuuuuugguuuugauuuuacagaagauuacaaauaagagauugcauaaaucuuagaagaaacuuuggacuuuuaaacacuguugagagaguguuagucuaugggaacuuuugaaguaggacuaaaugcauuuuacauuauguauggcugcaagccugugggggccaggaguggaauauaguguuuugaauaggaauggccuccauagacucauguguuugaacccuuggcccgugggcaguggcacuauuaggcguggccuuguugguguagauguccuuguuggaggaagucugucacuguggaggugugcuuugagaucuuccaugcuuaggcuacacccaguguagcagagucucugcugcuaacuucugaucaagauagaacucuugccuuguacagcacuguuucugccugcaggcugccaugcuuccugccaugacaauaauggacuaaaccucugagacuguaagccagccccaaagaaauguuucuccaugauaguugguauggucuuggugucucuucauagcaaugaaacccuaagacauugacugacccauguuucauuguuuccaagagaucuuuggaagaugagauuacuuucucucucuugucaagucuagaaauuggucaguuuauuuuaauaagagauuuugaaaaauuacuguuugacaauuuuauauuuuuacauaaugaauuugauuuguucuca

SEQ ID NO: 1913 - RNA, 6280 nt, Mus musculus
auuuguguaauaaagaauauuuauuguuucaucugaacacuauuuuuccuuucaaaccaucuccuucaccugagaaugcagaggcgauauauuuucagaguuaaauaauuacagcgguauguucaaucuuaguuucacaaucaaacaguaucuggaguacaauccaagucccugaacaaguggcacuacagggacaaaauguaguaagaguuacacuucugggucacuccaauacaaaagaauugguuuucacaauaagcaaaaacagugugaagaucuguuuccauaccuuuuguuguauacauaaagcuagaaggaaagaccaguauaaagaacuuuggacuuggagucagagacucuguaaccaaguucuggcucuauccuuuuaggauguaaacuucggagagaggagggcaggagggggaagagacagaaucagcaaccaguuuuucagggcuccuaggacucugaccauacagucacugcgauacugccuggcucacagggaguccucaaaggcgccugaagauuauaaagugccacacagaagcauugcuaagcugcaguaucaacaucaccaauacauuuccauuaguuaauuaauucuuggguaacuugcaaaaucaaacacaaauacugacuuugugugccccaggugggaaagaaacuccuugcaaggacagcucugggcagcuaagucuuucugguagcucauugcaccgcuggggcuuguuaccaaugccaucgcagcaccauaacaaacucacugccaguauuuucacuggaaaucgucuucuagaagaccuguaaacuugaccaaaaacugguugagaugcucagagaaaugggggcgaggacaggagaacaauaucaagugcaacagucuguccccuccuaagaucaaaaugugucauggcauaauagaaacucagacagcccagggaaaggaaauaaguuagcauuccucaauuuuaauugaccauggaaucuccccucccacggcagcuuuucucuuacaacucuauuaacugugcauacaagugcuauagggaacuuuccacuuuucucuuuuuuuauuuaugugugacaaaagugacugagccgugaggaagacaggaggagcagaaggcaggcugauggagaggaccuguuccaucugaauucgguugcuaacuggcugcugcguaagcuacuuuacccacacauugguuuccuugucuaaaacaaaggcauaaccugacuacaacagccccuccaggcaccaagcuuuugugacacuggugagaagacucuaccuacaauucuccaagucgucuuaagcuauugagaaggcuguuucauggguucagauauuaguuuuuccccagaccuuagugaguuaacagauuugauagcauaaugagcaaagacuagaaacugauaaaauaaauaaauaaauaaauagaaaauaaauacuaguuacucuuugcaggaacaaaaauuugggaguauauugccauaagcaaucuucacugugaaaagggcaaagucccacucggaaaggcugugggaggcccucagaagauacuggaagguuagguaggacuggcguauggaaaguauuuccccauacaccaggguaaaaccucaggauaccaccuaaacaaauguauucuagucuaaaccuauuggccugaaggucccagcacuucuuggcacacuucucagucaccuagaaaagugggaaacagagaaaugcugaagucccgagagcauggugaguucauaugaaggccaagguuagcuagaagaccuuuccuacaagugcuuugcugccuguacacugguacaaacagcugccaugcccaaagccacaguuuggacacagggccucuacagaacacaucuuggucaccacuuuccaacccaggcucaucucagagcccaaaggaaagcagcugguucucagggaagaagggucaggacucucacggauuuauuaucuaauccuggcagccaaagaggcuggcacauaacugcuaaaaauaagagugagagaucaggcagaaugugcagaacauggaacuuacacuuccagaccugcaccucguucuuguagcaaaaacagcaguaaaugggugagcacagcuuguuagcuccccauuuguuagcaggaugaacaaauccugcagcuuaaagcggacagaaauugguaaauuaacccauaaucuaucuguucaauccaagaugcuauggaggauuucugcucucaguuuuacugagcuacuuuugcuucaugggugcauucuccugagcaaugagguccugguuacacacauacauacauacauacauacacacacacacaaaugcacacacacacacacacaaaugcacacacaugcacauguauaaaguagccaaaaagucugcuuacaaguggugcccagacaaggaguuaggcagaaugggaaacugggcuucuaaugccguagaggagucaggaggguaggaaggaauggauauucuguuccaggacaucaaccaaugucaggagucauaaugggccaagcuaauaacuagcaggugaacauccugaaauggccugcuuuggauuauuauguagucugcaacaggugugcccuucuuaagcaaggcugugagggauucauuuuaggagagauuccugcuauuaauaugcuuuuccuguuguuauuaacaacauauauaacaaucacuaaguaauagcacacccuuuuggagcagaugucugcaaaucuacaaagauguacugccuugugguggugcuauccagacaaacagguaaugucuuaagucuuaaugaugacccuauaaaaauuccucaaauuauaucugucguuauuaagaucuuuuauagcaggacugcuauuagguccuuuucuaauagucaaaacuacaauaagaacucugccaguuucccaagugucaccagcuaacugcucuuacaugguaaccagacuuuuccuucuuagaacauauuccaagagguuguaaaauaauuaaccaaaggucauaaaaagggaacuaacgauuuauuauaggugcuaggaaagaagauaaaauauugacugggggggggcuggagagauggcucaguggguaagagaaaugacugcucuucugaagguccugaguucaaaucccagcaaccacauggugguucacaaccaucuguaaugggaucagaugcucucuucuggugugucugaagacagcuaccguguacuuacauauaguaauaaauaaaucuuuaaaaaaaaaagcaagaaaaaagaaaaaaagcggucuuuaaaaauggguuuaucgauacaaaacuucacuaauaacuuaguuaugguuuuaagccuucagugaaccuguggagcugagacagguuaugguugcuuagucagaaaauuacuccuaauggauguagacauucuuuguuguaaacguauaauucaguuuaugauuugauucuuuuuugugaacuugugaacuuuguaacaugugaucauguauuuuguuuguuuguuuuuuguuuuuuguuuuuuuuuuguuuuuuuugagacaggguuucucuguauagcccuggcuguccuagaacucacuuuguagaccaggcuggccucaaacucagaaauccaccugccucugccucccgaguucuggaauuauaggcgugcgccaccacgcccggguuuaaaauguguagaccaggcuggccucgaacucgcgauccuccugcuucugccuccuucagcaaauccuacuggcgugcgccaccacaaccagccauguauucuuaaagauguauaaguacugaggacgaagagaugaggaggagagagagaauuuuuugccuuuccccacuuaagaguagagaauuuuucccuuucuccacuuagaagaauuuuucucuuuccccaguuaggaucuuucugcuuuuccccuuagacaacuuucaugagcaacauuuuacaacucaguaauaagugcuauaaucauuuucuaagugucccuuacucuuccugagacuuuugauuagcaggcagaaaguuagagcccagcaguuccugcugagauauuacaaaggcuauuuacuuaaucgcuguuuuuaggaagagaugcuaagugccagaaacugcaguuugcuguggcuggccccuggcaaaccaagaaguuuauuauggcugcugccacuggucggucuaccaccugcuuuguucccagagggaauuuucucuuucuucuuguuguuccuauauucugucucaaaguuggaagaaugccugagcaauuggaaaagcugcaaguagauacagaggaacuggagaaacaaacaaacaaacaaacaaacaaaaaaggaugaaauggguccuucuacuuguuuuugaaagguuuacagaauuggcugugcggaagcucuugaaaagcgccugaaaggcaagaacaaaagggcucaagaagcagugacugagagcaggagcuuccagcaggaugaauaaaggauagaaggccaaucaugcccaguacugcccacuuucaguuucaaguccccccagccaggggcuggggagacaugcaggaaaagcugaaauagcccguugggaaagaaaggguuaaucucaugcuagccauguggguagaggagaggucuuggauuacaaaaucuccaucagguuuucccagugauuguaaagcacaugccugcuaauggugcugguuacaaucauaacaugucacccuauagaaaugauagaucugaggcauuuuaaagagucugugauuuccuauguaaugcauuccccuuauguaaaagauagauuaaguaaccaagcuauccaaaauagaauuauuccccaagauuggaagggauuggugcuguacuggagguuggucagcaguuacuaugguuaacaugguagaggaaggaagccuggaauguugaacaaugaaguagagaauggggacugaauaaagaucaagugcuuagugaagggugguauucugaucuacaaaauacacauucaaucugaugaugccauuauagaacaauguggcuuggcagcuuuaagagcuuggggacaaaguugaggagcccaaggaaagagccacauuuacuaagauuauauaagcucuggggaagccuucacagauuucuugcaaagauuuguuucagcuguaaacaaagccauauaagacccugauuccagacagguguuguuaaagauggugacauuugagaaugcuaaugcacaaugugaaaguguuauuagauuauuagagccgcgguagugccaauggaugaguggauaagggacacaacugauauuggcucucacaaacaucaugcuaauaccauaguauaagcuauagcuaggucucggauauaaaaaugcccaguguuuuaauuguggugaauucagccauuuacaaagaaauugugaccaaguggcuaaaagccucagauuucaaaauguccaugugauaacuguaagaaauaugauacuuucugagcacaauaaugaaaugccugguguuaacugugggaaauauaguacugccacuguuucuggcagcaauauguuguccaaaagaauaccuaggcuucccggaguuuacagguguugugccaagugcucucauuggauagauaagggcagguccaaaagggacacacaagguaaucucuugccaucaggaaaugaaaagggguaggaguaggaggcugccagcuugaggccccacaguguuucccucuggccauccaggagauuacaagcaggcaacaacaacaaagacaacagcaacaacaacaaccagcaacuaaguauuucugaucuuauauugaucuagauuugaccacagauaaaccuuguacugccuagucuugugucaacuugacacagcuggaguuaucacagagaaaggagcuucaguugaggaaaugccuccaugagauccaacugcaaggcauuuucucaauuagugaucaagggggaaaggccccuugugggugggaccaucucugggcuggcagucuuggguucuauaagagagcaggcugagcaagccaggggaagcaagccaguaaggaacaucccuccauggccucugcaucagcuccugcuuccugaccuguuugaguuccaguccugacuucuuucagugauguaagcugaauaaacccuuuccuccccagcugcuucuuggucaugauguuugugcaggaauagaaacccugacuaagacagauugguaccaggaaugggguauu

SEQ ID NO: 1914 - RNA, 6280 nt, Mus musculus
aauaccccauuccugguaccaaucugucuuagucaggguuucuauuccugcacaaacaucaugaccaagaagcagcuggggaggaaaggguuuauucagcuuacaucacugaaagaagucaggacuggaacucaaacaggucaggaagcaggagcugaugcagaggccauggagggauguuccuuacuggcuugcuuccccuggcuugcucagccugcucucuuauagaacccaagacugccagcccagagauggucccacccacaaggggccuuucccccuugaucacuaauugagaaaaugccuugcaguuggaucucauggaggcauuuccucaacugaagcuccuuucucugugauaacuccagcugugucaaguugacacaagacuaggcaguacaagguuuaucuguggucaaaucuagaucaauauaagaucagaaauacuuaguugcugguuguuguuguugcuguugucuuuguuguuguugccugcuuguaaucuccuggauggccagagggaaacacuguggggccucaagcuggcagccuccuacuccuaccccuuuucauuuccugauggcaagagauuaccuugugugucccuuuuggaccugcccuuaucuauccaaugagagcacuuggcacaacaccuguaaacuccgggaagccuagguauucuuuuggacaacauauugcugccagaaacaguggcaguacuauauuucccacaguuaacaccaggcauuucauuauugugcucagaaaguaucauauuucuuacaguuaucacauggacauuuugaaaucugaggcuuuuagccacuuggucacaauuucuuuguaaauggcugaauucaccacaauuaaaacacugggcauuuuuauauccgagaccuagcuauagcuuauacuaugguauuagcaugauguuugugagagccaauaucaguugugucccuuauccacucauccauuggcacuaccgcggcucuaauaaucuaauaacacuuucacauugugcauuagcauucucaaaugucaccaucuuuaacaacaccugucuggaaucagggucuuauauggcuuuguuuacagcugaaacaaaucuuugcaagaaaucugugaaggcuuccccagagcuuauauaaucuuaguaaauguggcucuuuccuugggcuccucaacuuuguccccaagcucuuaaagcugccaagccacauuguucuauaauggcaucaucagauugaauguguauuuuguagaucagaauaccacccuucacuaagcacuugaucuuuauucaguccccauucucuacuucauuguucaacauuccaggcuuccuuccucuaccauguuaaccauaguaacugcugaccaaccuccaguacagcaccaaucccuuccaaucuuggggaauaauucuauuuuggauagcuugguuacuuaaucuaucuuuuacauaaggggaaugcauuacauaggaaaucacagacucuuuaaaaugccucagaucuaucauuucuauagggugacauguuaugauuguaaccagcaccauuagcaggcaugugcuuuacaaucacugggaaaaccugauggagauuuuguaauccaagaccucuccucuacccacauggcuagcaugagauuaacccuuucuuucccaacgggcuauuucagcuuuuccugcaugucuccccagccccuggcuggggggacuugaaacugaaagugggcaguacugggcaugauuggccuucuauccuuuauucauccugcuggaagcuccugcucucagucacugcuucuugagcccuuuuguucuugccuuucaggcgcuuuucaagagcuuccgcacagccaauucuguaaaccuuucaaaaacaaguagaaggacccauuucauccuuuuuuguuuguuuguuuguuuguuuguuucuccaguuccucuguaucuacuugcagcuuuuccaauugcucaggcauucuuccaacuuugagacagaauauaggaacaacaagaagaaagagaaaauucccucugggaacaaagcaggugguagaccgaccaguggcagcagccauaauaaacuucuugguuugccaggggccagccacagcaaacugcaguuucuggcacuuagcaucucuuccuaaaaacagcgauuaaguaaauagccuuuguaauaucucagcaggaacugcugggcucuaacuuucugccugcuaaucaaaagucucaggaagaguaagggacacuuagaaaaugauuauagcacuuauuacugaguuguaaaauguugcucaugaaaguugucuaaggggaaaagcagaaagauccuaacuggggaaagagaaaaauucuucuaaguggagaaagggaaaaauucucuacucuuaaguggggaaaggcaaaaaauucucucucuccuccucaucucuucguccucaguacuuauacaucuuuaagaauacauggcugguugugguggcgcacgccaguaggauuugcugaaggaggcagaagcaggaggaucgcgaguucgaggccagccuggucuacacauuuuaaacccgggcgugguggcgcacgccuauaauuccagaacucgggaggcagaggcagguggauuucugaguuugaggccagccuggucuacaaagugaguucuaggacagccagggcuauacagagaaacccugucucaaaaaaaacaaaaaaaaaacaaaaaacaaaaaacaaacaaacaaaauacaugaucacauguuacaaaguucacaaguucacaaaaaagaaucaaaucauaaacugaauuauacguuuacaacaaagaaugucuacauccauuaggaguaauuuucugacuaagcaaccauaaccugucucagcuccacagguucacugaaggcuuaaaaccauaacuaaguuauuagugaaguuuuguaucgauaaacccauuuuuaaagaccgcuuuuuuucuuuuuucuugcuuuuuuuuuuaaagauuuauuuauuacuauauguaaguacacgguagcugucuucagacacaccagaagagagcaucugaucccauuacagaugguugugaaccaccaugugguugcugggauuugaacucaggaccuucagaagagcagucauuucucuuacccacugagccaucucuccagcccccccccagucaauauuuuaucuucuuuccuagcaccuauaauaaaucguuaguucccuuuuuaugaccuuugguuaauuauuuuacaaccucuuggaauauguucuaagaaggaaaagucugguuaccauguaagagcaguuagcuggugacacuugggaaacuggcagaguucuuauuguaguuuugacuauuagaaaaggaccuaauagcaguccugcuauaaaagaucuuaauaacgacagauauaauuugaggaauuuuuauagggucaucauuaagacuuaagacauuaccuguuugucuggauagcaccaccacaaggcaguacaucuuuguagauuugcagacaucugcuccaaaagggugugcuauuacuuagugauuguuauauauguuguuaauaacaacaggaaaagcauauuaauagcaggaaucucuccuaaaaugaaucccucacagccuugcuuaagaagggcacaccuguugcagacuacauaauaauccaaagcaggccauuucaggauguucaccugcuaguuauuagcuuggcccauuaugacuccugacauugguugauguccuggaacagaauauccauuccuuccuacccuccugacuccucuacggcauuagaagcccaguuucccauucugccuaacuccuugucugggcaccacuuguaagcagacuuuuuggcuacuuuauacaugugcaugugugugcauuugugugugugugugugugcauuuguguguguguguauguauguauguauguauguguguaaccaggaccucauugcucaggagaaugcacccaugaagcaaaaguagcucaguaaaacugagagcagaaauccuccauagcaucuuggauugaacagauagauuauggguuaauuuaccaauuucuguccgcuuuaagcugcaggauuuguucauccugcuaacaaauggggagcuaacaagcugugcucacccauuuacugcuguuuuugcuacaagaacgaggugcaggucuggaaguguaaguuccauguucugcacauucugccugaucucucacucuuauuuuuagcaguuaugugccagccucuuuggcugccaggauuagauaauaaauccgugagaguccugacccuucuucccugagaaccagcugcuuuccuuugggcucugagaugagccuggguuggaaaguggugaccaagauguguucuguagaggcccuguguccaaacuguggcuuugggcauggcagcuguuuguaccaguguacaggcagcaaagcacuuguaggaaaggucuucuagcuaaccuuggccuucauaugaacucaccaugcucucgggacuucagcauuucucuguuucccacuuuucuaggugacugagaagugugccaagaagugcugggaccuucaggccaauagguuuagacuagaauacauuuguuuaggugguauccugagguuuuacccugguguauggggaaauacuuuccauacgccaguccuaccuaaccuuccaguaucuucugagggccucccacagccuuuccgagugggacuuugcccuuuucacagugaagauugcuuauggcaauauacucccaaauuuuuguuccugcaaagaguaacuaguauuuauuuucuauuuauuuauuuauuuauuuuaucaguuucuagucuuugcucauuaugcuaucaaaucuguuaacucacuaaggucuggggaaaaacuaauaucugaacccaugaaacagccuucucaauagcuuaagacgacuuggagaauuguagguagagucuucucaccagugucacaaaagcuuggugccuggaggggcuguuguagucagguuaugccuuuguuuuagacaaggaaaccaauguguggguaaaguagcuuacgcagcagccaguuagcaaccgaauucagauggaacagguccucuccaucagccugccuucugcuccuccugucuuccucacggcucagucacuuuugucacacauaaauaaaaaaagagaaaaguggaaaguucccuauagcacuuguaugcacaguuaauagaguuguaagagaaaagcugccgugggaggggagauuccauggucaauuaaaauugaggaaugcuaacuuauuuccuuucccugggcugucugaguuucuauuaugccaugacacauuuugaucuuaggaggggacagacuguugcacuugauauuguucuccuguccucgcccccauuucucugagcaucucaaccaguuuuuggucaaguuuacaggucuucuagaagacgauuuccagugaaaauacuggcagugaguuuguuauggugcugcgauggcauugguaacaagccccagcggugcaaugagcuaccagaaagacuuagcugcccagagcuguccuugcaaggaguuucuuucccaccuggggcacacaaagucaguauuuguguuugauuuugcaaguuacccaagaauuaauuaacuaauggaaauguauuggugauguugauacugcagcuuagcaaugcuucuguguggcacuuuauaaucuucaggcgccuuugaggacucccugugagccaggcaguaucgcagugacuguauggucagaguccuaggagcccugaaaaacugguugcugauucugucucuucccccuccugcccuccucucuccgaaguuuacauccuaaaaggauagagccagaacuugguuacagagucucugacuccaaguccaaaguucuuuauacuggucuuuccuucuagcuuuauguauacaacaaaagguauggaaacagaucuucacacuguuuuugcuuauugugaaaaccaauucuuuuguauuggagugacccagaaguguaacucuuacuacauuuugucccuguagugccacuuguucagggacuuggauuguacuccagauacuguuugauugugaaacuaagauugaacauaccgcuguaauuauuuaacucugaaaauauaucgccucugcauucucaggugaaggagaugguuugaaaggaaaaauaguguucagaugaaacaauaaauauucuuuauuacacaaau

SEQ ID NO: 1915 - RNA, 34764 nt, Mus musculus
ccccaaagacagcgacucugaagucucccagaaccacagcccacaccgggaguaagaccuuguaucuuucuaucuuuguaucuguugaguuugcucaguccaaagugccaguugagaggaggcgguaucugguaccuguagcgagcucccaaaggugcucuccugagaugggaacauaaauucuaaugcccgucuguacaggugacaaacugugugccugagcucagagaagagcagcuaccacgcucccagaaccugcaggucuuguacugcccugccugcccagggcauaugcagagcuugucugagauauuucuauauagccaaguacagagccaaggaugugcuugcccugauuccucuacacguaagcucgaccacccugugaccucagucaccaggaccauacuaacauguaggagccugccagaacaacaguaugcccuugggguuuguuuuaauucgguaaagagaaauacaaaacaaugcaaggcuaccaaaauggcucaggaaacuaaggcacucauugccaaaucuguugaccugacaugguggaaggaaagaacuaacuucuaccaguuaguuguccucagaccuccaugugugcacuacacacacacacacacacacacacacauacaccaauuaaaaauguaaaagaaggcuuuuauuggcaaauguuugcuaaggacaguuuuuucaaaagccuccuguggccacucucuuguuugggaccagugagacaauguccuucuuccuacuauggcuugcaguauggggccaucagacaucuggucuuucacuguuccguuuaauauucacuugcugcaggcuuucauggagccugggcucgccuccaacuugcugcugaagaugaucauaaacucuugcuccucccaucccguccucuccucucgaaugcugggguaccgccacagccaguuuaccuucgcucuuccuaaagagacgcuccccccucguagaugaaggccagcaaagagcaugucuguccugaaagacgggucugagucuugaguuuuucaggaacagccgugcaucugcucccuuuugccuugaguaucagcucagagcugcucucuguuagacuccauuguucuugcuucaccagacccaggcgucaggucugucgcuucucuucccgccucaccuuuacaguucugucagagaugagugcuuggggauaagcuaucuccaaucacauuucggaacagguaaaccauagaucacacaccauaucuuuaaauuaaaucaugauaggaacggguaaggcauuaggaggccagucuuagccauuggauauucaaacuguuaagccccaaauaauggcccaaaccaagaaagguaacgccucccuguuggaggaggauuagcaagcaggcacuuuggccaaucuguacacguuugccaacaaagcuuccaggcuucauagacauuaagcacaucaugcauguguguuagacuuucccaggugaauugcaggucucuccacuuccauacagagguccugcccacagcaaacaauagucuucagcugaucugcguuuuuaaaaccucugcuuaaaugguccgucccugcagucauuauuuccuugugacagaaacuccaggauucuuuaguugaagugaucacucugucccugcagcuugcaaccugcuguacuguugggaaggucgcaguaggugggugugggauucauugcauaagccuguggccuugcuggcuaugaacagaucuagacaugcaaagcaggaguauagaagacgucgauuagaaccagucaguccucccuggccuccagacucuguuucuuuggcacaaggagaaaagagcguucagggaacgucauccaagggcuuaaggaagcccacauacacguucccugcuuacggcacugaagagcaucuagauuuuuuucacuggccuauacagcagccacccaccacaggcaagcugcuuagcuuuaagccaacugaaguaagauggauguucagcaucuaggaagggaccacaaaguggaauuugguaaggcuucauuuuuagcuuccuccagaccugggucaguacugugucaucugccuccccugucacacugagccucugcggcuugggagaacugucaggguugggaaaggcgggggccuacacagauuuucccacuguuugacagccacaagggaugugaguaugucuaggcuuucaggggcagaucugcaagccacaacucugauggggcuacuuauauuuaaacucuugagaaugaaguacaauuuaaugucugugugucugagcucuguugacuuuagugauuuuuuuuuuccugcucuguucauacugcaugcugauucucugaaugucuccaugagaccuucucuguaaggugacucccagagcauuuucucuuuugcagcccaggauucagagaaacagaugguggggacucuugacagcuccgagagccuguuuuguuggugggcuucgcacgugguauaugguuggaaaaccagagccuagauccccuccacggcaucaaggaccccuccucacuggagggaaaucgcucucuucuggacuuucugaagccucaacaucuggagcgugugaggugggguggaggagggcuuuauuccccaagcaagagauaccggcuagucugaacuuaacugagaagaaacucagccgguaccauuguauuuacaaaauguuuaaggagcguuugacauguuuucugcagaaaaauuggugcuaagagucuaaaagaaguauucugucaaagaaaucagacgaggaggacucuuuuuggagaagaauuaaauguaauucaaaaaagagaagggggggagcuuagccccacccccaccccaccuaccccacccccagugcacagggaaggaacaucgucccggcagaugagucacuugcugguuuguuccauauuuauagcggugccacggaguuuaugauuauaguuuugaagccuuggcagugugcuuugugcccaggcaggcuggcgcuuuuguuauucccagcgcugcucugaacuucuccuugcuuccaggggaaguugcaaugcuggcagagaagcagcuuuuuucuucaugguaaaaacaaaauccccaaauuccucaucccccucgcccagauacaagggagggaagaggugugugcugagggagagcuuacccucggcgcggaugcugaaggagacaaggcucacagcggcucagauuuguauuccagaguuucuuuuucauagauguuuuggugggucaccagcaugggaccgcagagucuucucuugcugucauaguaacucacuggcuguuugccuccuggcugaaggccugcccucuuauacaggacacaagauagcucuugcauucauuuuuaaauguauacuuuggagggggacuuggggcauuaucucuccaucuacaaccaaagagaaggaguuucuauggcccaucuucugggaccguggggucugugaacccuaccaaugacaggcaucccagucgugaggcaggcuguggugcuguuaggcacucggauuguugguacagcugacccucuccgcccacauguucugcagccacagacuugucaaucaacugcauguccagugucaugagaucuuuccuggucaugggucagagcuaaacguguacagauuuuuuuuuucuucucaucaggccaggacacaaguguuugugcaguauugacacugaauugaguacuguaaguaaccgaaagaugacuuuugaaaacacaggagggugcacauaaauaaaaugaagccauuagagcguuuuguauaagagauuuaagcaucuguggcgaaugcuguccuggaaccgcaccucaggggauacugaaggaaaguguuuguauuuuucucagacuaugcgauacaucuccaugcuggccugguuugccggcucccgccucaggcucuuagcacacacaccacauugcuguccaguccuucugccagcccugccuauuuuccuuuaagcagucuggcucuucuugccaguuucuaccuuccccuucucuuccacuauucuuaggcacccuuaccagaauacagcagcaaauaugggagggggucugucucuucagggagccagccagggacaggguuuccuugugggugguggugacugccauuaucccugagccggacuagguggguaaacacccacaagauccuggaaccuccccaccucaucucugcucuucaucuuugugucauggcucccgugugucuugggagggaccacugucucagagccacccaguuugcaccugcugggaaccucagucuuccuugguccuguuuccugcugccauucucuuucaugugguuggaccucgcagacaucuuuggaaugagagaaagcaucccacguucgugcgucuuugaugggggagugcuguucuuccucaucucucuaacguugcagcucuucagaaaauacuguucucugguggcauuugucacuggugccuguuauauagguaguccucggaugccugacagucugccucugcgccuucauccccagagccuggggugugccugucccacucugacugcucuuuucuggaggauggggacaggucucaucguguugccugucuccugcucagaaauggcuucuugcuuccuucacgccuuucucaguagccuaugaauccucccuacagcuucaauccccugcaguuccgcagggagcccugaccauccuggccucuucucucccggcauccuaguguuccgcccaccuucucauugucccauuuccuccuugggucucuguccguccacccuuuauaccaagcagaaugucauuguuuucugcagggaugaacuuuaguguguaguugauagguccaaaaacuagccacuuguuccuuagcccacccugacgcuaacucuccuccaacccuacuuagaagacagguugggaugcggggugucuuaaacuaugucaguguguguagugacugcuguuugcuauuugaagauagaaucaaaauguuuuaggauuuauuauauuuuuuuugcguaugaguguuuugucugcauguauguaugugcaccacaugugugccugaugcucacagaguucauaaagagaacauugaauccccugaaacugaaacuguagaugguuauaaaccaccaggugggugcugggaacccaaugcaaguccucugcaagaacaacaagugcucuuauccccugggccaucucuccagcaccauguucccuguuugagcuagaucaggagacuuuuguuauuuuuaauuuuguuuuacuuguuuuuuuuguuuuuuuuuuuuuuuuuuugagcagggucuauauauacccuugccuaucuuggaauucacuauguagacccaucuggcuuuagaccagaguuuuguauuaggaagaaaaaagcacuuugaaacccugugaaauaaaaacucaugaacuaaaauuuuaaaacguaaguaagcaggguauuuauugauacaauuuuauugaaaggaccuuuuuuuuuuuuuuuuuuuuuaauaucacaggcuugagagaugacaaccaguaauccuucaggcccaauucuucucuuacacauaucuguuuccacacuggucucccagugaauauuuuguucaaauaaauuaagacugugaaucauugugugcgaauagguacagauuuuauauuuagaguagucuaauuuaggcgggggugggguagggugggggguaauagcucaguucuugcuuaccaugugagagguccuggguucuuaacacugaaggagaaacaaaaaaacccagccccugucccccccgauuuuaaauugcucgugaacagaagcaucauuuaaagaacagucgcaggcaagggccugggauagaguguuagugaaggcaaaagcagaagugggaaugugugcaguguguggagaagccguccacgugggaguuugcaggcugcugugcuaguuacaacaauuaucaauguauagcuccugccggucauuauuccacaaaugaugcucuguuuccuggcauguucaaauuagugggucccaggcagaguuccagcuaggaagccaaggcagaaaaaucucuugagccagaaguucaaaaccagccuaggcaacagcucucguauuaaaccagaguggaucuacacauuucgccaucaaccuucaaagcaacuaggguagggguuguuuucagggcccauugguccccccugcccuucugcccuaagucagauuugacuuuguuuagccucgaugauagcauggguagcccaaggacuuuugcagaaaugcucagguuccaggaccccguggugaucucaagaugccagccccuaacaaccaaugaucuuuucucugauaauauugauugacuuauaaaacaucucuuuccucaccaugaaggaguuuguccgaaaacaacccagcccaaagcugccugacccagaagucauccaguucugugucuccaucuucgaaugcuccaggcuccugcucuccagauggaguugaccagcgguucuuagaagacuaccacaaggugaccaaagggggguucgucgaggacgccagccaguacuacugugauaaggugagggacuuccggguccugugcacuuucgcucgugacuuggugacucguucucacagagagaaaaauaccuugucaccagccacugcagaaggaagugguguaaacaacccucucacgugucuucuagagugacgauggagauggcuaccuaguccugauccggaucacaccagaugaagagggaagauuuggcuuuaaccuuaagguacacugcgagcgucuguagcauucuuaggugguaccaagcgaaacagucuucagguggauucugaauuucagucagaaaucuacuaccuuaccuacgcugcguuuaaaaaaaaaagcagaaaagcucacuuagagcuacagagagcucagcugguaagguucuagccaugcaagcaugaggacuugguuucagucccuggaucuaccuaacagagauuguggggugggaggggggagacagaagcaggugcagcccuggccagcucuuaccucaagaaacaaguuagauagcagcagaggagugaaagcccgagguugaccucuggccuccacugauagccacacauucacaugugugaacgcaaacccaagcacacgugugcacacacuauugaaaagcuacucagggcuggggauggcucaguggcuuccagagguccugaguucaauucccagcaaccacauggugacucuaccaucuguacugggaucugaugcccucuucuggcacacagguguacaugcagauagagcacucauacauaauaaauacacuuuaaaaaaaaaaaggaaaaaacagcugggcagugguggcacaugccuuuacuccuaguacuugggaggcagagauagacagauuucugaguucaaggccagccuggucuacagagugaguuaagugaguuccaggacagccaggaggacagccagggcuaugcagagaaacccugucucaaaaauaaauaaauaaauaaauaaauaaauaaauaaauaaauaaauaaauaaagggaaacuacucagggauaagaacuggcuuuuuauguaguaguucaauugccucguauuauguaguuguuaugugcccaacauuugcaagacuagaucccugucauuguagugaguucucagaauaagcagagccaguuuauucuaagucagccuagacuguguaugaaguucacggccagccagagcuauggagaccuuaucucaaaaugaaggaaauaaauaaagcauacaacagccguuaaacacaucuuacaaaggaaucccggggcucagaaaguugagugucugguuggugaucaaaugcagcuacagcccacccaggagggauuauuuccaggcccauacagcccugcucagcugauaugugaaggcagcuagcucaagucucugggucuaaugagucccucuaggcaguggcugcaaacugcugucaccacccaguucccaucuguuuguguauauagcauuauugaaacgggugcugugcccauuggauuacagcuucagggauuggguggugggguuaagugacugccucaggacccucuuccccacacugcuuaaauaccuaucgaggaagcaucuaacuuccgucucucucaugcccauucccucgcccaccucuguacuccuucuguacccccacuccugcgcagugagcagacugccccugcuggcuaccugcccucuagagcucugcucacacggggagcaucccagugcacauggcccuuccugaggucuugugccuccucuuuugaagaaguaagcacacauucuuuuccaggaaauguuuuuuuccaagggcaucuucaguucaggugaugggaaugucaggauaugcuucuggguaaagaggagucagcagugugcccuagaauuccaaaagggguccccaacccccgugauugauccucccguaaaaccuuccugaauucuuaaggcucauauuuauuaugucuacauaccuuuguuagcaaaacuacucaaguguucuguuuuauuuuugauuuugcuuacuuugaaaaauguuuacagggaggaguggaucaaaagaugccgcucguggucucgaggauaaacccagagucaccuguaaguaaauauacacuaugugacuuccuguguuugcuuuccccuacgucaaacaaguuucuuucuguacgccccauucuuggauuuuguugagauuuaguuugucuuugacugauugguuggaugguuauaugaucagcuacuugcuugguuugaucgguagcagcauggauuuguauuuguuacggcagacagacugagacaaagagugggauguccguuaacugcaaccaugcugugcagcgugguccaucccugcagcugcagcaccaugucaccuguggccuuguuauauguggggccgcuggccccagcucagggacaggcccagguccuacuuacuuaccuuggaucugucuguaacaagauccuuggauguuugguguguacauuuaacuuugggaaguacuagucaaggcagggaaacugaggcagagauugcuuuccacuuguuuccaguagagauccuuugccucuuucugguuuuuucuuuucuuuuuuuuuuauuucggggcaggaugugguuugucaagacaggguuucucugucgccccaagcuuuccuggaacucacuuuauagaucaagcuauccucaaacucacagagaccuuccuggcucuuccuccugagugauaaagucagguuccaccacugcuuggcuuuucuguuugcuugcuguguacauauuuaagaugcagcauguugcacugccaagccuacauggagcagacgggugagcguacccaccgucuccccugguuucugugugaugguuugcuuucaguaaaacauaaaugugaacacugugccuucacuccucagucaagcuuaccccuggggccugggaagauggcucaguggacaacauucacacugcccaagcauggacugaaguuuggaucccaaggacccacguuaaagucgggggccaggggugguggccaccuguaauacuguugugugggagucaggggaucccuagcgcagauggauagcuagacuagugaauugacaagcuccaggaugagcaagagacccugcuuugguaauggaguggaagacaaucaaggaagacacauguccauguccguguaugugugaacacacacacacuuacccucacauacaguuuuuuguuuuuuuuuuaaaguuauuucccaguagccuuuuguuugugguuucuagggauuagggaggcuugcuuuccuacaacauugcuguaccuggcuaagcauuuucaaacaguauauccaacaaacagaagguuggaggcaucaagagucaucuuaauuagcaaggugggcucccauggaaaaauggcuucaguaaacuuggcuugccuguucugaagugucucacagcuuaccuucagagccacuuuaaaaucccaccaccagcugcuagguccaccuagcagcagccauacaaaugaugacagcaaugcccaggggagaguagguacauuugaucgcagucucaggugucugggaucagagggaggcggccuucuucuuccccuugaggcuggugcuaugguaacagagaaagucgcuucccuccuuaggcagauaccugcaugccuaagcugaaugagggggaucagaucguguugaucaauggccgggacaucucagagcacacucaugaccagguggugauguucaucaaagcaagccgggagucccacucgagagaacuggcccuggugaucaggagaaaagguaacaggcucccgggggcggggccacagggauaucaccugagcagcagcagcggcuugucuacccaguugcuuugggguuuuuuuuuuuuguuuuuuuuuguuuuuuugguuuucugggacagcucccucccauacuguagcccaggcuguacuuucucuugcagcaauucuuccgcuucagcuucuuggaugcuucaguuaaaagcuugaaauuccauacugggcugcuugcuguguuuucuacauaguagacagcgcuugaaaaugaagaguuguuuuugguuuuuguuuguuuguuuguuuuuuaacaauuaggguaucuuucuugucacugccagaaacaaaaaauaaucugucugcaggggccuugacugcuccuggcugggucuuuuggagagaggcagccccaguaccucuuuacauaggccuagagccccagaauucaaccagccccagcccagauagcucccauuccacuguuagcuugccugguccuaucuuacuuugcguguuuggcuuggucaggaggcagcuaggaucagagggcagggacuugaccccaccuccuacaccacugagaggcgccucccaaguuaaccagcauugcucugacauaacaugaguguagguagucuuaugcagauucaauggcauccucagggcauuggggaaugaggggauguacuguagauaaguaaagaaaggauuguuaaauauuguuccuauugcgguuauuguuuuaauauacugagccgaacacccuucacuagagauggcaagagaaugaaggaaagauggacacacaggacagcuggauaugugaacuauguucauucugguagcuggcaccaccaauucaguagccuaguaguucaguguguuuacugugugcagcgcagaggguggaguuagcuagcuuccauaggcagugucuguaagcgagcagucucguaaaguaaacguccaagaggaagaagcuuugguuacuaguuuugcaaacacuggccaguuguucauaaauacucguacuuggaccacagagaggccuugcuauucugguuuuucaugggucuaaggaguugccuugaucuggcugugcccgagguaccaauaacaccacucaggacuucaucuccucucuauaaauuuacuccaggcuuucucuagucauuaccuuaaucuauccauuuuauuuuuguauguauuugugcacgauuacugugugugcaugcacugagaggucaaagguccuugaaaucaaacaugaguugucagguuugguggcaagcaugccuacccaaggagccauauugcuggcccuuauauagcuuuaaauacuaauggaggucuggccuuggugucaacacaacccaaugcucuccucucuguuccugagccaacuggagccgugcucaccccaccucuucugggaggccuuagggcugccucuagcucuucucuuucccuauccuggcaccccaugcuacaaaucccagccaucuucuagagcucagaggcuuggugggaguucagcaguaacaggaugcaccaaggaaaguguguguuaugcugaccacuuuaugguggcaucuccucugacccucaugaaucccugagaacagggauucucauccauccccaugccaaaaaaccagggagcaaagccacaggauggagaagcaguugccuuacugccauacgguugucaacagccauacacugauaagggaccaaagugccaguccaccaucugugacauccuggguguccaugcccacaggaaaagcuaccuuugugggccaugagggacugguaccugcuagagguaaggaaaacccacccagcaugaacuguuaagagaccaccuguuuccaagcaacuguaauuguaauauuaauauuauuucuagcauagacauacaagugagaaauacgaauugauuuaaagaaaaauaagucaacuauuuuaacacaaaugguugcaaauaugacagaaaccacacagcacaagaaaaacuaauuuguucuggccagugacuguggacuuuaaagucaaguaaagauguaaacuuucuuccuuggguauagggagccauugaaaguucagugagggaguaauuucccuuucggaguuauaggcaaucuucagaaaugauccuaaaguuucaaauuuuggaagaggaaguaagaaugaauaaugccaucugaggugaaauacuguauaaggcagagaaggguaagccuagagagaugcuucaauagucagggugaaaacgggaauauaggucucuagcacccguguaaaaaccagggugcauuaucccagcacaugggcagcagagaugggacccccagaacaagcagcuaauuugacuagucagucaauucacugaauucuagguccaaugacaacugccucaguauaagguggagagcgagggaggaagauaccuggugucaacuuuuguacgcaugugcgcaugcauacccacaagaaggaagggaccuugagccucuauuuuuccccauagauuuugacaugaauggagaaauugaucuggaagggggaagggagacugguguguagagauguuagcacuagggcuaaccgcuuagcagaauugaucucaaaugaaaagcuaagcucuugaacaauacaaugagacaauacaaugggacaugcuguaccauagcucagcagggaaaggcucccaccaccaagucugauguucuaaguucaaucccuaggacucaugugguaguagagaaccaacccuguuaucccugacauccacacacacacucacacaggcacagaaaaugauaaauggaaacauaauuuaaauuuuuuggaaaaagaaacuagacugcagggaauaauaauggaagauccugggccucccguguccccggaagacugccuauguuaaagaugccaggugagaaccagagagcaaauaauccauauauguuucuuucuuucuuuggggcucuggaaaccaaacuuaaagccucacacauacuaagcaaucucucuaccacuaagcuguauucccaacccaugagcucuuucuguaacaaugcucauucccacgucucacccauagcguaccacggucacucaccugcaagugacauuggguacaaauaaugacuaccacauguggugucccaggccgauaagcagagugaccggcccaaccuccugucuguucuguuuguuccagcugugcgcucgcuggcggagaucagaucagaagaugagcugagucagcuuuucccagaagccauguuuccugcauguccugaggguggggacagucuggagggauccauggagcugcugaagaaaggucuggaaagcgguacaguguugauccaguuugagguaaggggauccaggaccggagucuccaaccaguuacugucauucgcuguguaauacaaugugagcugaguagcaggcagcaaagcuggaccaugguccugucuccuuggucaugguuacucugccucaggcagcagagucucagugaggaggaccauaauaaggacugauggaaccgucucgaaggcucugugugauggagcagcaggugaaggacccacgacauuucccagguguucagcucucccacugucuccuagcaguggucuguaggcaggggcugcugaggaugggggccucugaaucugcagagcugccagcaggagcucagaacgccacaggaaaggaaauggugccauccacagaacgggggccccuaaguauacgugggaauuuagaaagucccuaucuucccacaagggcacagugucuggcccuccaaggcuaccagaucacagaaauuuaaagucuguccuguuuucucaggaaaaaauggaugugggauuaugugggauaaugcagcagcaccccgacaggccuugcacgccgcccccaaaagcagaaguuggccugcuuuuaaguccguuuuauccaccacuaaacaaaugaaaauagaauguguucaucuuccaaguuuggagguagaagaaagcugucguucacgcagugaacagauuaaaaaaaaaguauggcaccucaguaugcuggaggcugggcaguagcaguaggaccacaaguucgauccuagccuggaccacauacugagagccugucucagaaagggacuugaggcugggagaauagaggaaagaacacagagagucugguaaaaggaacuggaucagaguucuaacaaugucaugcauggccuaggcucacaauguaagaacuccagcuagguugagaaacaggucaacaacgcacaguuuacuagauaaacccucgaaaguuuccgaaaggcaggcaguuuguccaauguauuugacugcagggugacucaggaagaaagcuucugcggcuggcagaccaaaagcagaaagccuuaagcaaaaggcucgccauaugguagccugggggccagcguguaaaugauuggggcagaggggaguugaacagcaguggaaaggacucagugagagaaaaagcaaagguuggccucucuucccuuccaucccacaccaacagaagauucucaauuuuuuuuuuauuaacuggcugucuggacaaauaacauaaaggcuugcaucgagugucaaugauauuuggaugagaaauggugacuccaacaccccagaauaacugaaacgacacucgaggauucuccuuuuggugcuggggaugcugugaacugggagaggcauuaugcugacucagacaguaucagaggugcuuugggaaccugaugagggaccgagaagggggauucuagcuacuaggagcuugcugccuaauuuugguauauuuaggaagcuguuuguagagccgggcgugguggcacacgccuuuaauccuagcacucgggaggcagagacaggcagauuucugaguucgaggccagccugggcuacagagugagguccaggacagccagggcuacacagagaaacccugucccaaaaaaacaaaaacaaaaagaaaaaaaaagaaaaaaaaaggaagcuguauguaagacuaaaagcaagaugggguaagauuuuauaauagugaguguauguucccuggcaacuggugauuccaguugggcugggaauccacaaggaggcacugugggcucuccucggaaacacuugaacuguguccuuugccuaaagccaccucugugcugugacucacucuuggugugcuuuuuccauacaggggccuccguaaggugcuccuugcagugauuucauuagcuccggaaagucuuuuaaaaguauuucuuaaagagugagccugcagccauguguauggaagucacauagggggcacgaaccucgcccacagcuacuggacauugguucuuuaacaaggucaccuaaggguuuguguauguugggggcauuaauuuguuguuauuagugaaugcuguggaagugggcuugugcuguaacauagauguagaagucagagcacagccuugcggagucaucuccuuucuugcguguggguuuuggagagugaacucaagguugcuacauaucaagcgcaucuguccggugagcagccucuccagcccucgguugguuuggaugcauuaauugaucccagagagggagguagagaugguaucagguccauugauugugucacgucugucugucccaguccuccgucagagauuguaguuggagaugccuacagaacauguacaucugggguguacacucuagucugguacaggguuucauggucuaggaagcucuucuuuuaaauaacgucuuagugaguucuaagaucuugacuacccugcgaugaagcugcugugaucacagaguucucccagugucccucacugauccuccaggagcccuaggcucccgagagcuucaugugaaacuaccaucccugguggaagggaaggaugucuuccaauacuacucaagcacagggacccacugaacaccggaccaaacaggaaaggcagccucggugagcccuuguuguguaagggcauccaucggcuucuagaauucucaugacacccuguuaggugugguuucaucccgucacacacagaagggaggagaaucugagauuaaguguguguuccaagggcucacagacgucacagagccuaacuggcacccuggcaagauaccaguaccucaggcuuguucuuuuaaccaccacguacacaggccuaagaaacugagauggauguccgcaaccugugaaguuguuauuagaugcaugcacaucaccgccgucuaggaggcugucuagccacauggagccagacagacuuuaaauucuagcucuacccccuuagggccauccuuuaaacucuauggcucuugccucccugucuauagauugggugucuccuggauuagaugagauaagugcuuaaugcuuuaccuggccugugauaagagcacuaugaaaauuaauagcuguuauucuuuauaaaccacgagagacuucaucagcaugucacgccugcagaagguauggucacuuggcacuaaacuuggagcccuaggcugucaauuccagagucguggcugucugguuccucccacacccccccccccaggaccaugacaagugggcugcucagcuagugaccgcucggcucugugggcaagcgcaggaaaaagguccuggccccagcaggcauccacgcugccgccuccaugacacagcgccagcuuucagguuguggucucuacacagauugcccaauccucacucuucuaaggcuuauucaaaacauuuuuuuuuucauucaggggauuccuucaucccuuucugugucucucaguaaacagaaggcauuuggucccccguguaacagaacagcaauuagcauuucuaaagcacuuagcagucuacugcguauguuuugcauguuacacuaauucucacauucucugugaaauaaauauggugggaguuauuagaaucgaucuguacacucuuuccaugccagagucugaacccacacucagcaagcacucugccacugagccacgaccacaaccccagaucacccuuaggaauggagaaaagcaggcucagagaugugaaggagcccauccagugcccauaccucaucagggagagcccuagaauuagaaccaugucaaaaaugaagaaccaccugggacuagagaggcggcucagcuguuaagagcacauacugggcuuccagaagacccaagugcaguucccugcacccauguuggguggcucagagcauccuguaacucuaguucuaagagaucugacccuuccucuucuagccucgugcaccuacauucaugugugcaaaucacacaugcacacacauacacacacacacacacacacacauacacacacacauaaacacaacuaaaaauaaaaugaaucuaaaaacaagcaaaacccuaaacuaugccuggguggguagguauuagacaccuguagucuaagcuccugaggaugcugaggcaagaggauaaucacuuaaacccaggagcuuugagguuuugagacuacccugggcaaugguccaaucauugucagcagcucacacuuaccggguagaguucagcagcucuuucccacccugcuuguuuacuguuagcuacugccuccuuggaggcucauggaguucaguugauagaaaaugagcuuugcaagggaauaaccucuucccugggcgaacggacaagugaaugaguggguggauggauugacagauggagggauaaaugagugggugggggagguggugaguggacagguggguggauggaucauuacauggguggguggguggacagauggauagcuguguggguggagagagcaguauccaggagaggccacugagggucuuuucuaccccaccuaacuuuguguaacaccuccaucauccauuuguaccaaaaccaaguccccucugucugaccccuguuucuuaagugacgccuacacugccacucaaggaacugcccauuagggucaaaacaagugacucaggggcuccugcgguuaauuacagaauuuguauuuggaaggcuggaggagcugagcaacacuucaccagagacugagaucaguccauguugcaauuagcaaggacaguuguaccuucaagauuagaucugaucccuggaaaaagugcauuuaaaaaaauuaguuuccgucagaugugguggcccacaccuauaaucaagaggcugagacaggaggguggagaauucuaggccagccuaaguuacaugccucaugccuauccucaagccucaggaaggugaugcaggagaauugccaagaguuaaaagccaaccuugggcuacagaauaagaccccacucaaaaaagaaaacaaaacaaaaaaauguaauuuuuuuucuuuuaaaagugcauuauugccugcacauacauuacauuacacacacauuaccacaugcauuauauuacaucacauacacacucagaucaccacaguguacaugugguggccagaggacaauuuugcggaaucuucuucuacuuccgucuugguguguauuugggggaguugaauucaggucaccagauuccguggcaagcaccuuuacccacugagcugucucacuggcccaggguuugguuugguuuuccuuguguucauuaaaaaaggaaagaugaaagacauuguggcacacauucaaucccagcacucaggagguaggugggucuucaugaguuccaggccagccuggguuaagugguaagagccaugcccuuuuccccacuccucaccucucccccuccucccucaaaaaaaaaaaaaaaaaccaaccaagaaaggaagaguauccaugggaagcccagaguacaugggagcccuugaaugugccuacaugcaguauguacauuccaugccuccagagaauauacugucccguccugugugucugccuguguuaggauaccagacacgugcaccugggaccauuaaggaucccagagucacuggcaccugucccauuguagcaugucugcauggaaaggucagcagaagccccagguacccuggagacggugucuugaccucugggguggggggaucagguacagaggaaaagagaugcccucagugugggugagcugcucauagaggagaaagugcugaugccccuuccuaccagauaguaccaggaaaaccacgucuuggugccauucugagacucgguucuccauagcuuacuuauggcacugugucuaagaaagcuuggcuugucgcucucugguaguguggcuuaaaaccuuugguuuugguuuauucuuucuuaggauuaaaccuaagggacuaugaauacuaggcaaguacucugucccugaucuacauccccagccauguauuuauauguuuuugucuauuuaguugucuguucuuucuuuuacauuuauuuuauguuacugaguguuuugucuguaugaggucuuuauaccacauacacgccugaugccuguggaggucagaaggugggaguaggggugggggucagauucccaggaagugcaguuacagacgcuugucagcuaggaacccaaccuaugcccucucucugcaaaaaguauucuuaaccacugagccccuacuuauuuguccuucgagaaagaaucucacuguauuuucuagucuggcuuugagcucaguguauagcccuguccuugaacuugugaugaucuuccugcuuucgccuuccaagcaauaaggauuguagcccuugaccccaaguuuggcacgagccucucuucuaacccuuuguaaaauagcagcucccuacacugcagugucuuuauugagcaccuacugugugacagccacacugcauucauagagggucccaccuggcuguggcugcagcaguaaugucagggguccacacucugauguaagcuccugugaacggcaggaaccuggacaggcaggcaggcagguccaagguccaggagugagugcuugugggaaagagccuucccccaaguguuacagcucaguuaaaaaaaaacaaaaacaaacaaacaaacaaacaaacaccagccagucucagacaauucuuggugaaauaacugugggcuuuauuccaucuggacagggacuaucuaugaaccuuggagaguguuauggaauugggggugguaaauacauucuauugucugaggcuaagaugcuggugaugcucuguuugcauugggaagaauuccaggugcugugcuauguaacuaauuaacccauaaguuacuuguucugagacaggcacagaaacuggggggugggggagaagguaguucacuccugauggucucuggaugaauuuucucaaucucaaguucugagauuucugggguuugggcauguucaaccucaccaguucaagccaguuccucuggugacacuguucauguguuccaaauuugaaugguggcugucuuaggguuuuacugcugugaacagacaccaugaccacaacucuuauaaagacaacauuuaauugggacuggcuuacagguucagagguucaguccaauuaucaucaaggcgagaacauggcagcauccaggcaggcauggugcaggagaguucuucggcuucaucugaaggcugcuggcagaauacuggcuuccaggcagcuaggauuagggucuuaaaguccacacccauuagugacacacugauacuccaacagggccacaccuucuaauagugccauucccugggccgagcauauauaaaccauaacaggugaagauagcagguaucuuuaaaaucaccacucugcuacauaugcagcuagagauacgagcucuggggguacugguuaauucauauuguuguuccaccucuaggguugcagacccugucagcuccuugggugcuuucucuagcuucuccauugggagcccugugauccauccaauagcugacugugagcauccacuucuguguuugccaggcacuggcauagccucauacuagacagcuauaacagggucccuucagcaaaaucuuucuggcauauacaauagugucuggguuugguggcugauuaugggauggauccccggauuggguagucucuggauaauccauccuuucgucuuagcuccaaacuuugucucuguaacuccuuccauggguauuuuguucccuauucuaaggaggaaugaagcaucuacccguuggucuucucucuucuugauuuucuuguguuuugcaaauuguaucuuggguguucuaaguuucugggcuacuauccacuuaucagugagugcauaucuaaugacuucuuuugugauuggguuaccucagagaggcccuugguauugcaaacuuuauaugccccaguacaggggaaugccaggaccaagaugugggaguggguggguaggggaggagggcagagagaggguauaaggaacuuuugggauagcauuugaaauguauauaaagaaaauaucuaauaaaaaauaaauaaaauaagaaaaaaaucaccacucugacacaggcuaguugcacuuuguucucuccuuagccaggguccccucaccuccucuugcucccuuccuuucccugucccuugucaucuauccgcccccuucugagguuuuaagaguguuucugcugcugguggcugucauuugcuaugguaggacaggauucagaggaugugccuuggaauaaucaaagcaaaguauguuuuucuacuccguuguuuucuuaaaagccuugucucuaacuguggccacuaccaugaagagccccuauaauugacuccucuguaacucugaccugucucauagcaagcucuucacacccacccuaggguccugagaaaaguuggaaauauggguucuuaaggccagcuccuggcaaugcugagacucaguguuggaaucccauuacccauugaauggcuuccagccuaggcuuugugagccuuugccaagggcaugcaggcucaagagugcugucagacccugcagaggccaaacccgucuucacugcuuacguguucgcauuucugccucugaaaauucuguaauuuucaauuacauaaauagguuuucuguuguacuccuuuucugugcacguguugauuuuagagacaagcuuauuauagauucauaguaagagcuuaggagggaggaagaggagagagugcacagagcuguauagcaggagggaccccaggucuucuugggguucccaguuucagagaguuaggguccgugacugccuuguuagggaacauggcagcagacaagcauggcucuggagcaauagcugaaagcucacaucuugagacacaaccucaagacacagacacugggaaugucuuuugaaaccucaaagcaaugacaaaccuccuccaagaaagccacgccucuuaagccuugccaaacaguuccaccaaauggggaccaaguauucaaagaugugggccucuggggguuguuuuuccugaaaccaccacagcuacauucaggaaauuuuuuaaaaaaagauuaccuuguaccuuauaauucuaucagcaggucauuauuacugagauacaaguaaaagcuuaugaucacaccuuuuucugggucuguguuugucugccugaacucagauugauugcauuaaccuuucuguuauuuggaaauaaaucuuuuuaucuauaggcuagagguucugguuccuauucacguaauuggacuuuccuuccacacaguuaaucuguuagaggcaaaaugccauguagauaaaugugacuggcuccuaugacaucucugccagaauucugccagagccuccaauaaaccaugaguucauuucuagacuguacguacugucuauaaaagcccaccagguuuuagaguugcuucagcagcuaccuuuagauuguucggugcugaaacuguccagguuguaggucauaggucaguaguugaguucuucgagaacuggcaaauucgaaacauccaguagauguauaagguauaaguacaauaccauuauuaugauccugaaucuccacguuaacucucuucugauaaguuuuaugcaguuugucuaauuuaaaaaaaaaaaaaaaaacagaccuaaacaaugggaauuuauaaaacaauacaguacacggaaauacuucuggggguggguguucagccucucuauucaaaaugcaaagaaaucuuauuuaaggaugcuggcuauagcuuggugaccagaucaguauucauuccugcagggcgguuugguuaucugcaucagagcccuggcagauaugcucagacacugugauucuguucucggcuguuuaccagaggggaaacauuguagaauggacuaauagcaaaguagaccaagaaugaagguaaauuauaauaauuaaauuucugagccauuaaaaaucaucgauguggagaauagcuugcaauaugggaaacagauacuguuuaauaaugaggaugaagcgggcuucacaauugcagcuguuucccagagcgcuggcuaugagaugcucagaucuuuugguuuaaauuagcuugugaaauguuuggcuggugagaauuaaagaccucugugaugcaucauagcacuugucuuguuuaaagauuuguagaauacagaguuaaagaaaauaaauucuccccucccuccaaggaauuuuguguuugcuuuuuuuuuuuccugcuuuguuuguuuauuguauauuuuucaagacagaguuucucuguacuucucugacuguccuggaacucacucgguaaaccaggcuggccuugaacucacagauccuccugccucagccuuccaagugcugggauugaaggcauacgccaccacuccuagcuauguuggcuuuuuguuccugugucaaaugcccaagagaaacaguugaaagggacaggauuugcuugggcucaugguuucagaaguccuggcccaugguuucuggacuguggucagccagccaucgaagcgcugggcauaugaagcagagcugcuugucucucagcggccaggaagcagaaaggagaagccuggaacaguagaguuugccucuugccuucuguuccauccugguccugugggauggccacugacacucaauguugcucuaucucccugcaaaguacauauucagagguguacugauccgaucuaagugucucucaauccaguugacagucaagacuaacucucacaaauaccuaucacuuuaagauauguugucucuguugaggauaacgugagaaauaccacuguggacugcagucucaucuuuugauguuaagaagguaauauuggggcuagagaggugguuaggagcacuugcugcuccuucagaggauccaauuugguacccagcacucacgugaaggcucaaaacuguaacuccaguugcaggggauucuaggaucucuucuaguuucuauggacaccagacuuucaagguacacaaacacaaugcaggcaaaacacucaaaacacauaaagaaauuauaagaagacaguauauaugaguauguuuacagauaugcuuauguauaugcaugcauguauaugcagaaaauaauaagcuugugaaaauaggaaaagaccaccucagacuuuuauaaguauguuuuuauuuuuguuugguuuuuugguuuuuguuuuaguucagcgccagucugaguuugcccaaauuugcaguaagaaaaaaaaaguaucccuugcaacauugagaagggaaaaauaagaguuuaaguuccuggggaguugagaagcaguugcgugaggucuuggugacaguugugaaaacuguggaagcagauguauagacaugaaaaggggguguggccacuuccuucagacuggagcuaguccuuuacuuucgaucuuggaccaagcacuuaaccucccccugccacuuagagaacuccuacuaauaccucccacagccgcggcuacuggaucaacucggccaggcugugcauagaaggccuuauuuuuaauuucuaguacuaauuguauagguagggaaaugucucuuuaaaugaaguuacuauaucaggaucgguguuacgggcugugggaauguguuacugaaucggugaaugaaguauuuuugcucuuaagcaaugaauauguuucauuccauuaaacugaggaaaauguaguuuuuagacuaauuuaggugagucagaauuccccucuaucucucccacacuugucaauugucauaaaaauaggguuuugcuuaccuggcuccauugucugugacucaaccccugccugacuucuuugcccuacaaugcgcaaguuuaaguauauuuaagacuuuaguugguuuguucuaccagaguuucuaagguuuuuguuguuguuguuguuguuguguagcauaggaucacuuugaacuguuaagauucggggguaggagguggucucacaagaagaccucugcaauuaggauauguguucauggguuguuuuguuuuguuuuaaauagcaguggggguuuucaaaaugucuuuauuugucuaauagcaacucuacagaaagaagcccggcuuagccgucucauuugcaaagcugccucagaauuuggauaaaaaccgauacaaagauguguugccuugugaguauccggccugaugccuccuuccccuacaugagauaaugcuuccuuuuuaaaacagauugucugggaugcuggaaugguuuucagugugucuguaaacaccaucgucuuuauugcagccaucucagacucagaacaguuggggaauaguguuuaugcuaaugaggcgagagcugcagauggggcugggaacugaacccuuguuuacuugggaugauaaaaauaacauucagaauaaaugguaaauuuuucucucucccacagaugauaccacgcggguauuauugcagggaaaugaagauuacauuaaugccaguuaugugaacguaagcugggaaucugggcaauaaaaaaaaaaaaagacacacugauccuaguaaugaggguggggccagcaagggggacuuuuccaugacagagcauguuuccacucacuccguccuuguaguccaaugguuuggugggacuaugagugaucucacuuuauagaggugcaaaggggcacugaauaacuugaaaagccacaaaccuuauuccaucuccaccugcugauauaccaggcucuuggcauuucccucugcugccgguguguugguaacuuucuguguuuugcccgugugauauuagugucccucugccucuaagucaaagaaacacuuccuccguauauacauauauauauacauauacguguguguguguguguguguguguguauuauaacccaagaggaguaaaagaaaagguuggccuguuguggagacauauucaucauggacagcuuacuugauuagauuucuccacuuaaagccagaagcagcaaacuguaaucgaccacacugaaaacuacccuuagcuagccaggcagcagaacuggccgcucgggcccucaugugcuaaaccaugacuuugcagaaguacccucuguaaaaacugguucucucagaagucucacucacugcucugucacauuauggugaaauuuggaagcggcuuuuugcugcaccuuuuuuuuuuuuuuccuuucugacugugaguggauaagaucuuuuucugguaggauucagcuaagcuauuaggaagguguaaacggagaguccugcucaccuucgccagugaacagucuaacgauaauaaccuuccugcucucccaacagauggagaugcccgcugcuaaccuugugaacaaguacauugccacucagggaccgcugccaaacaccugugcacaguuuuggcaaguugucugggaucagaaguugucucuuguugucaugcugacgacucucaccgagcgagggcggguaaguggcuuccuuuccaguuaccgugccauuggggaacaugagucucagggcuggaaagggccuccuaccgaccuauaaaucuccaauggacaccugcagugaugagaaaguccucuuccugccuacguccucacauacaucuaugaaaccccuaugucgccugugucucucccugccugugaucaaugucucaucucacacaauuaagacuguagucugccgaggcaaugucucuucccucugauauacaugcccuuggcuccuggcaucuuuauccaacacugggcuggacugggcugacaacauaguuccuccugaguaaguuauuaggcugucugaaucacuuucuugaauguguaguagagaugguaacagcgcccaccacauugggaggacuggggaaagcuggaaaguauauauaaugagcucagaggacuacggguuuccagugucccccaaacgucaucaucaucaucguuggaguuuagcgcuuucagaugccucgcuucucugcuguagccuugacucccagcuucuugucacucacagauuagccagagucucuucucaucccacaaaucaggauagaaaacuguagugcccaagggacagcagaaaucucuuccugaaugcugguucucugaggcacugagaggaugcuucgaagggugccugcuaauccuagcaucuguucuuaccuccccgguucccaucuugccuacccccucaucgugagagacugucugcagugcagcuggaauucccaugcucuccagcucagcucggaucuuugucugaaagccucauucuucucugguuuuguuugaauaagagguggaguugcugggcccuguuuugaacuuagagacucccagcucccuaagcuagcucacaggacugcacccucuguuuuccuaaagugccuccguccaucaaucagguuacuuggcauugugaguaagaagguggacccgccagccagccagccagggucaguccccgcugucccuucuaccugugugauuaagaaaaauaucacccauuucucagggcuguggggcacugagcuggcugcuacgggaagccucugaagagugcuugguacauguucauuuuguuguuguuauugcuauuauuuguguggauuuuguuuuguuuggggggaaugaguuuuacucuauacaccaagcugauguuaauccuccugucucaguccucucaggugcuagaagagaacacaugugcugucacacccaagugaucaccauuaaugcuguacacauguuagccagcagucccaauagcaucaauuuggauauaccuuaaugacugcauuuguuucauaguuuuaguuucuucauacuaacuuuuuuuuuuuugcuuuaguguuauuaacguuuauuuucuuaguguuucuuagacauaaauccaguaucguuugccaaagguaaaaguauguguaaaagucucaaaaagagcuaaacagagccaagcacgauggcaaacaccuguaagccagcacuugaaaggcagaaagaaguacagggaucaggaguucaaggccaacgucagcuacauugagacuucuuuuucucaaagugcaccaacaaaacaaauguaaaaccuuguucggaaagcccagguguucuucucuccuaagcccugccccugaggccagcaacacugaucucguucccuggucuguguugugaaaacagaucacaagugucagguuuggaauguucaaguggcccuagacccaggcgcaggcuuccuuggugacacagugagucacuugacaugcacaaaaaaaaaaagaaucuguccccauaucuggcagucucugauucuaguguguuauuggucacagauauucugugcucugucugccuuuacucggccuuguauucugaaacuucggugcucaaacaucacauuuccucaggagcaguguguggagcugacucucugcuguccccugaggucuuggagcucacgaugcaauucuucagagcugacacccgaauccacccagugacucagcaccaaggcuggcuugcuggugucaggcugcuugcuguuugauaguucacucuccccuuuccaguuagacagucauucuuuucagaacagggugccccugaaggaaugcaggugacagauucgcugcccaguggcaaccccaacuucccuugauuugcuuguuccaggucagggaagaaaagcuuuuuacgagaaaccuuacccucauccauugcucuuccagggccugccucuccagcucccggcugcagccgcucuuuccugucaucugaguucuccuugugacccagccuguuucucuguuucccagucuuuucuucuuacuguaacuucaucaugcauuugagaguucccaugaggccugcccaucccuucagcaucucuggcccugccaacauuuuagaaaccuguucuucaaaaaucccgggugccugcuucccucuccgguuacagauuuuccggugaccugugcccucucuccucagccccaguccacgcccacuuccgacucagucauuccaggugaauggcuuugccccuccuuugauguaagaucaacuuuccaggacguccuguuuguugccccuaugccaugcccuaagugggucucccaguaggcucacacuagaguccagugcccuuccugugcugcccugagucguagggagccagcccccugaagagucugcagagccugcagggucacugacccagguccuuauuuugguuagguucucugucgacuacauggggguuucuucuuagauggaucgcuuuucaguugggaaagccagugccuucuaucagaugucugaccccaucccaccccacccccugccuuuggaggagcuauauuuuauaccuacacaugaauaauguguauaaucuuccuuuccaucccaccagucaguugacgcacaggcuuugaauaggacuguaaggcuccaguucccacgccgccacaaagcacaaugccuauaucucuugggugguucugaguacugggaugaauuucuagggacuaggcucccagagucccacugucucgcuggaccagaggcaguggguuugcucugaguagcaagcaguaaagcccacgacuaccaugaggcuaccaagaagaggucugggguagcacagaccuccuuccugcucucuaugugcuugagaaggugcacagguagguuagauggauggcucccuccccguggaacuuauuucugaaucugguuaguuuccuggugcccuucgguguccuccuggaagguucgaccccaaguccagcuguuugcuuucugcuuggacacaucuaccuagugcuguccuguaagaggaucccaaagccaccacccuagccccucgugugcacacaugugcacauaugcagcccagcuacaugagcccacgucugagccacaggcacacauccacuuaaguacuuaugccagccaucuggagcaggucuuagcucuccuuucucuucaguucauccacucacuguuuaaugccauuggcacacaugacgcccacugugucccucuugucccugccuaaucccagaaccuuccucuuugucucccacggcaaaagcagcagcucagucguccaguuuucauacacuaguccauucacauuuccuucagcugggccuugccagaggguugguugguccagcauuuccugcccugcccuguaugcccuguauggcuuauagaugcacagagcagaauguugcauggucccagaccaacuuguauccuuuguguggcucugcugaguggucuuuuguccccuaggugcccaggagacccuucacauucugccuccuuuucuuuggcuugaaugaucuguccuugcaucgucugucauacaccuucagucugaacgcccuuccuacucuguccacuccugccucaccugcccccacccgugucuguucuuucuuccugcauuacuuuggcuggauuggaaagcauccagaggcuagauaaugcccuaaugucucugacucauccaacccuccccagggaugcuuguugaccaacuaaguuagcaagaaaucaagugcugaugauacagccuucuugcuugggcccacggcucuccucucccacaaccccguccgaugcaucuuccugaaacagcagucuuccucaaccaaaagcucagccuucagcaugaucugcugguucccuagagcucuuccuuuccaaagucauucaguggcauccuuccuuccccaccccuugucucagagugaucagauggcugggacuguaagaaaagagucaaccugugacugcauccuuguggagacagcauucugaguccuuauggaccaccuguagccuguagccuauggcccaccagccagcuauagugguccuuguccuucugcaaccugcuucccccaugguagcagauuuccucucaucuccucacagccuugccgugcacuugucccuucggagggcaucaaccuggaaugaaaucuaggcucuguccccauaguucuugugaccugacauggggugaaucugagccuccaagccucaguuaagucacuaccagauagucacuaucccuaccucagggaguagucucaagccagaagugagcacugugcauaaaagcaaccccuggagcuuaacagcuacuauucggaagauguggggccuucacaccccucccccagcaggcgugagaaacgggcucccaagacacccauuggguucgagagacuggaccuucaagacucugauucuucuggugcguccagacccaaauagaccuaaaaugaguccaguucccugcagauuccuugucaguaaagaugcuuagggagcacuggccuguguaacucggccuugcacaagggggaccacuuuggagaguauugucccccagcuauccuaggaugggacccuggagagccugggggaucauuuuuuuccuccuguauacaugagguagauguagguucagauggacagacaggugagcugucugugucuggcaacucugucucuaguccuguggacagagagccucugaaucuuggagagucggagaaaacuccccaccaggagagguuuccaaucuaaacugucccaacagacuuuuaagucccgcccccacggcacacuuuaauuucagauauucacugugacauuugaaaagaaggcuaggaaagcuguuuccccaacaaauuccaugugucuguuggcuaugucaccucucugcuauaaacaaaugucauuuuuuuacuuacaugggaaccaaucuagauuugaggggaaauguuuuuucuuuaagcugugcaugaugguacuccuacagugcaagcuauucaagaggccaacacagaaaucucaaauaacaacgacaauaguaauaauaauguuauuguuaaaagaaucaaaauuuggcagaguaacuauggaccgcuuagauguguacuuggugaggaauccagaagcggaaacuacagugguuuacgggaagggaaucuacagugguuuacgggaaggggaacuacagugguuuucgggaagggaaucuacagugguuuacgggaaggggaacuacagugguuuacggggaaggaaacuacagugguuaacgggaagggaaucuacagugguuuacgggaaggggaacuacagugguuuaugggaaggggaacuacagugguuuacaggaaggggaacuacagugguuuacgggaagggaaucuacagugguuuacgggaaggggaacuacagugguuuacgggaagggaaacuacagugguuuacgggaagggaaucuacagugguuuacgggaagggaaucuacagugguuuaugggaaggggaacuacagugguuuacgggaagggaaucuacagugguuuacgggaaggggaacuacagugguuuaugggaaggggaacuacagugguuuaugggaagggagaggcugcagguuuggaaggggaaauagaacaugggaacacgguaacauuagaaagccacagccaccauauugagagacacugacauagcacggaacgaaugcuagacugucacgcagcucuguggccagggcaauccacuuagugcccaagucccucgaauccuaccuuugcuguauaggaagucuugccucuguugagaauuuucuuuuuuauuauuuuuacuugucuuaauuuuauuuuacauauaugaauauuuugccuguauguacggcuauguacugguguaugccuggugcccauggaggccagaagaagggaucagauccccuggcacuggaguuaccaguaguugugagcugccauguaggugguggaaauugaacccugauccucuggaggaacauccaguucgcaugguauaguguguguguguguguguguguguguguguguguguguguguguauacuuaaugugcuagagcacagcacucauguggaaauaaacaaguauuuauggagucaguucucuuuccaccagggcuuggggggacguuaaucucauuaucaggcuuccacugagcaguucaccacccucagaagggcaggugcagagucuguggccucggacccuauuuccuauggaagcguuugaggccauagcaggcacaguccucacggagaaggauaguugucucagcuuggagaucuuugaggaaugucaccaaccuaauucaguugcuggagcucccacggcaacaguguggaugaccaccauagaccucauugagaagugaccccacguugcacccucacugaccucugucaguguuugaaaaucugagauucaaggaggucaggggcuguuggaagucaaauggccaguaaaugaguugggaaauuccuccaguagagcccugacacccaaaugggaucuuaacugcuuugucccaaggcuucugaaagaugagcagcucugaggugggagagguagaugcugagagcagaaaagaggcccaaggagccugacucagccuaggcagaguguagguagccccuaacuaaacucaaguccugcugcucuccuaaugaacaaacccuagaagguaagcugacucccuucaggccaugaacacaagugggucucaucuguguuucuccucuccugucacaucucuuuggacagauaugacugggugccaugcagcuacccuaccucugguuaggcccuaagaaaagccugauuuguauuuucugguuucuuacagaccaaaugucaccaguacuggccgga

SEQ ID NO: 1916 - RNA, 2673 nt, Mus musculus
uaaaaauguaaaagaaggcuuuuauuggcaaauguuugcuaaggacaguuuuuucaaaagccuccuguggccacucucuuguuugggaccagugagacaauguccuucuuccuacuauggcuugcaguauggggccaucagacaucuggucuuucacuguuccguuuaauauucacuugcugcaggcuuucauggagccugggcucgccuccaacuugcugcugaagaugaucauaaacucuugcuccucccaucccguccucuccucucgaaugcugggguaccgccacagccaguuuaccuucgcucuuccuaaagagacgcuccccccucguagaugaaggccagcaaagagcaugucuguccugaaagacgggucugagucuugaguuuuucaggaacagccgugcaucugcucccuuuugccuugaguaucagcucagagcugcucucuguuagacuccauuguucuugcuucaccagacccaggcgucaggucugucgcuucucuucccgccucaccuuuacaguucugucagagaugagugcuuggggauaagcuaucuccaaucacauuucggaacagguaaaccauagaucacacaccauaucuuuaaauuaaaucaugauaggaacggguaaggcauuaggaggccagucuuagccauuggauauucaaacuguuaagccccaaauaauggcccaaaccaagaaagguaacgccucccuguuggaggaggauuagcaagcaggcacuuuggccaaucuguacacguuugccaacaaagcuuccaggcuucauagacauuaagcacaucaugcauguguguuagacuuucccaggugaauugcaggucucuccacuuccauacagagguccugcccacagcaaacaauagucuucagcugaucugcguuuuuaaaaccucugcuuaaaugguccgucccugcagucauuauuuccuugugacagaaacuccaggauucuuuaguugaagugaucacucugucccugcagcuugcaaccugcuguacuguugggaaggucgcaguaggugggugugggauucauugcauaagccuguggccuugcuggcuaugaacagaucuagacaugcaaagcaggaguauagaagacgucgauuagaaccagucaguccucccuggccuccagacucuguuucuuuggcacaaggagaaaagagcguucagggaacgucauccaagggcuuaaggaagcccacauacacguucccugcuuacggcacugaagagcaucuagauuuuuuucacuggccuauacagcagccacccaccacaggcaagcugcuuagcuuuaagccaacugaaguaagauggauguucagcaucuaggaagggaccacaaaguggaauuugguaaggcuucauuuuuagcuuccuccagaccugggucaguacugugucaucugccuccccugucacacugagccucugcggcuugggagaacugucaggguugggaaaggcgggggccuacacagauuuucccacuguuugacagccacaagggaugugaguaugucuaggcuuucaggggcagaucugcaagccacaacucugauggggcuacuuauauuuaaacucuugagaaugaaguacaauuuaaugucugugugucugagcucuguugacuuuagugauuuuuuuuuuccugcucuguucauacugcaugcugauucucugaaugucuccaugagaccuucucuguaaggugacucccagagcauuuucucuuuugcagcccaggauucagagaaacagaugguggggacucuugacagcuccgagagccuguuuuguuggugggcuucgcacgugguauaugguuggaaaaccagagccuagauccccuccacggcaucaaggaccccuccucacuggagggaaaucgcucucuucuggacuuucugaagccucaacaucuggagcgugugaggugggguggaggagggcuuuauuccccaagcaagagauaccggcuagucugaacuuaacugagaagaaacucagccgguaccauuguauuuacaaaauguuuaaggagcguuugacauguuuucugcagaaaaauuggugcuaagagucuaaaagaaguauucugucaaagaaaucagacgaggaggacucuuuuuggagaagaauuaaauguaauucaaaaaagagaagggggggagcuuagccccacccccaccccaccuaccccacccccagugcacagggaaggaacaucgucccggcagaugagucacuugcugguuuguuccauauuuauagcggugccacggaguuuaugauuauaguuuugaagccuuggcagugugcuuugugcccaggcaggcuggcgcuuuuguuauucccagcgcugcucugaacuucuccuugcuuccaggggaaguugcaaugcuggcagagaagcagcuuuuuucuucaugguaaaaacaaaauccccaaauuccucaucccccucgcccagauacaagggagggaagaggugugugcugagggagagcuuacccucggcgcggaugcugaaggagacaaggcucacagcggcucagauuuguauuccagaguuucuuuuucauagauguuuuggugggucaccagcaugggaccgcagagucuucucuu

SEQ ID NO: 1917 - RNA, 62316 nt, Mus musculus
uaggacuccgggcucuguaggaauuccccggacgcgagguucuggcggcgccugcagcggugcacuaccuugggacagagaccgggaucuaagccaggaagucaggcacggcugagggucucguggugacaugggaacaaaagguucucgggauaucuagcacccagguccgaccauagaauccuaaccaucucuccauccuuuuguuaucauauucauucaacaaaacguuuuuaguucuuacuggaagccaagcgucguuuagaggcugggucucuugagaggcggaguuaccgagcugacacagaggggagguacuccuuaagggggaaaucuaagucgcgagagacagccggcaacauacuccagcagccccuccgcucgcccuuccguuucacgggcacaaagcuugcgcucguuuuguuuugagguuuuuuuguuuuuguuuuuguuuuguuuuugcaccggcuuuaucgucccaagaaagcuuccuuguuuagcugcgugacugaaugguauuugucaccugaucugguuguuccaccagcucucaccgggccacccccuaucuuucuugccuggcuccuuuccccuguucuuagaauuuaucaccuaauacccugcguuguuuacggaccuguuguuuguugcgagaaagucccuucuaaacucccaacaaggggcagagauuuugucuauauauuaagugugaagaacguaaguaacuguugaauggauaagugauacaugcuuggagugcgguaauggacuuggagagggagcaagaggucagggcuaauuuagaaagguagccagaaaggucucuccuacaagaggcaccugaauggugagagggcucgaaacaccagcaaagcagggcaaaagacguccuaccucgagggaaaggcaguguaaaggucuccaggcgggucaaguucagaggguaugauggggaggaaggugcagucggagcgcaggaagacaggugugggaggaggcggaagaggccggcuggaacgcccgccacuaggggcccuauaggcuuugggaagggcuaaccugccugguguccuaggaccagcaaaggagcccugcgacccccaacucagccacggagccgcuggagucagcgagacccccaacucagccacgaagccaccgcgcaaggcucgcugucauuucagauucguugagcgccaagcccuugccauucuuaggcaugcaauccgggaaagccaggcacacaguagguguucaauaaaugcuaaaagcacgaauggcugcgugcgugagccaggggaccuggaggucugcgggaguuuggcagguggucugcggaggccaguggcagcgucccacgaguuugccccgggcccgccccugucccgggucccccgccccgcgcgcgggcccgucgcggccacagccgggccggcgggagccgcccgcgggcugcacugggcaugcucagacggcggccaggucgcggcgcgagcgagcuucagugccgcccgcccgcgcgaccuaccugggcgccccgcgcccccggaugcugcagguaugggagacuggguccucugcggggagggucggagcgcgggcugcugcgaucgcggacacgcggggcuuacccaacccccacccgguccggggcucggcggacacgcgggaggacuagcgguugagcugguagccccaggucuccgcgccacgucgggcauccggggggcgcaggcccggaucaccuggcggggcuggggcggggcgcgggcgugggcggcaaaaggcugggcguucuggacgcagcggcgcgggcgugggcgugcgcuccagucuggccgagcccugggcuuggcgccgagguauccgcagcccggcagagggggcgcaccgcugcggggauccagcucuccgcgguccccgaagcucagccacccggggcgaauuccccuucagauugcaaagauggcauuuccugggccuggcacgaacuccagugccaaaccaauccgccccguuccgcgggcgaccgggguggcuucucugguaacuugcggugugacacugcugcguugugcagggagagagcgcgcccggaaacccccgcccccgguugcugccuccuaaacuuauuacgaacuugaggguugccuuuaaaaaauucaugagaaguuaagauaacuugacaccuggguguuccgugaagguacagggaacuugugguugggaaacucuagaccuagguucaaguugggcucuuccccuuggccagcuggugaccuuggacgagucguuuaaccucucugauccuccauuuccuccacugcacgcaggcagcaauaaugcccaccucgccugguuggugguggauuaaguaggauaaaugguguggagguguuuggcuccgugcccggcauaaagcaagcgagcaguuggcgugaugugauuuuaauucaguuagagacccucauggcucccauuuugucaggaagguagaauuaggcagucauuuucugggucuguguuugugcccaggagaacgucugcugaggcuuugaaaaaagcaacuccacagagcgguggugagcugcucuuguuuaauggcagucuuugugaguuccgaaacuccagaaguugacacucgggccucacagaaagaacuauuuuugcaagaugauccaucuugcaaaugucgaagcggaugaauuggaaauccugguugggaaaaagaugcauauucugcaaagcucucaugcuuaaccuuauguuuuuggauuggggagcgggggucucuuagcuucucacagcggguuugaucguucuuugugguggcugcuccuugugcauuacagagugcccaaaagccucugcucaguagguuccaguagcagccugcuuccgaccgugccuaccaggaaugccucuauauagugucuggguugaagugccucaccaccuccaccccucccccaccccaccccccgugucgucccucuuuccccuuuuaguagaauuaacugagugagauagccuccgccuucuguguaaccuaggcuaaaugaggauuucaucuggacuuuuguuuucuuuuuuuucaaugauaauaucgaaccuuugcagucaccuugcagagcugugcuagguauguggacuaucucauuucaguuuuacaggucucccucugagacuggugucacgaucccauuuuauagaggaagacauugaggcucugagcaggcaacuguaccguccuggguaugacugggauggaggaaaccaugcuucugguucugggggcagagcuuuuucuucuggauaagacugccaugugugucuuacacagaugucuuucccgaugauuaaaucaagaucuagauuguauuggaaaacggaagccuuccugagauugacuaguugaaaauuaacaaugguaagcuauuuucugacugagaguaggccauucuaguuaaauauucuaguauaugagcgcucccauaaaucccagcacacaguuaauggaauaccagucugccgagaauuagaauagaauaaaacaugccuauuacucuauauugaucuguguugucccuggugauuugucucauccacagacuaguguaugcaaauuagaccugaguggcagacuggagguuacugagggcauuuagaagagcugaggcaugucuaugagcagauguuucuguuugcagaugcagggcuguggguaggcaaacauggugaauaagccaagggacccccccccccaaccuggaauccaggguaucuuucauccagcucaggucagaucuguaaugggccuuagugugacucuggacucccagcuaaccaagaucucagcuugaagcccucacuuuaccugaucucacagcaaaggugugguaguuuuuaauauguuuguugaggucucgacucccugccaguaagacaaggucagagacagaucuuaucccagaaagaaaucgagguuguagguuggccguuggucucaguccugggaugggaauugcucucaguuuuuguuggcugugaccuggaaguuuaauuacaguguugugcccuccccuccaacacacaccacacauaugugagcuggcaaaggcagugagaacagaaguaagaggacucauuguggccgucuaagcuacauacaggucugugggugcaagaggcacuguuuucuaagaugggucuaacuugcuggaggagcccaaagacguggcauacacucuucccuuucaguucccagggacuggcauguugggaagggaucggugauuugugguccccccucucgaccauaauuacagggcucacucuccuacaucagucaauuccuggaaagcaaagccugccccuuuuucucuccucaggcucugccagggcuggagugcuggugguacccuagccuggcucagcuagugggugugugggccaauccucugggaccuuucccucauuuugcagaugagagaggacugggucauauccacaucgcucuuguccgggcccagugaccucaggcucugaucucacagaggucuccuaacucuuuggcagaggagacuccaugaaucucuuuguagugcccccccccagccucccccucccccccggcugaaauccagaagucucaaauuuauuucuagaguuucugcacccgaaaccaucucuaccuccaaguuaccuggcuaucuaucccaaggcccuccuaagugcagauccaauagcaaaugcagacuucugugaagucucuaauaugugucgggccuagagacuagaagaugcugcagagcuagaagacgagcuggacugugaacgugugcacagugggguugcgaagaccaugugcacaugcguaugugcaucuaucuauccacccaucuaucuccugagugaugugaaggaggaucaaguuggaugcaagugaugacagccauaguguguuucuuuucucauugcugugaccaaauaccuggcagacagcuuaaggagggcggguuuauuuuggcucccaugguauaguuuacugugacaggaaagucuucgcugcaagggcuucaauuacuuggucagguuggauacacagucaggaagcagggagaggcgacugcucacuuucucccucuuauguagucugggaccugggaucaggggaugguaccacucacauugugaauguucuucucaccuuuauuuaaccugucuagaaaaugccuggcagucaggcuugccuccugugugauuuuagguccugucagguugaagguccuuauuaagcagcaaggauggcugucaggaaaaacacacagggaaggguacggcuuagcacuugcauuaugccuccaaggugguuggcaugcagaguaauggggguuacuuucuaguugcugagucaggcaggccucacucuguguagagcuaaccguuagauuuucuuucuuuccucugcauuggaauaacuugugucagaggugcuucucgggugucucuuauuucgaguuaguauggccuuugcuggucaccggacgcugccugaguccucacagccacagucuggccacuuugccuccccaggaaggcugcuuggaaggcaggugagagcugagcuugucugcccugcaugucuccuucaguggguguccucccaccgauggagacaacagaagugccugcugggcagcuaccaaauggaagaucacaggagaccugguggcuuuuucucccuggugcuguggggcucagcugacaacauuuuuccugaaauaaggcugggcccuguccguccgucuggugaaaacgaagguuggcagguguucucucucuuuaagagaaagcccggaagguguuuggguaacgagagaguggaguuucugaggcaguuugaugguuuaugugcaaaguuagaauacaggcuguggaacugggauaguucuggaaaccgcaagccccugauaaacugucaguuugcacaugcuugaacaaacaugacugcagccauggacuuucagugcugagucucugcuacggcaccccucucugacucuaagguguagcaacuccuccuaccgaguccauuucacagacgcauugaacaaacgaggcugagagaugggagugacuucccaaaaggcccugcagcgugcugaggacuggaacaugcaucugucccuaaacugauucuuugccuguaaagugaagacuaucauagaacuuaugucccuuaaacaggcuuucuuaagggagcuaaugaucugggacaugaaaguccccucccuuggguaugggagucccggagucacugccgaguagcuuccccauggagggaggccuucucccaagucaaggcugugagugcucuuccucaggacugaagaaaagcaggauucagacuggagggccuugcuggcuggguguuguguuuaugaguggagacaggcgugggugugggguggaguccuggccucuguacccaccucccuuggaugagucagcuuugagggccgggccugagaggcaacagcucccuggcagccgucccugcccacucggcacaugguuugaccccuucagacccaccacauccccucccugccucugguuggcaaaugcaugcaugugguuuguagaucauuauggugucagggggcaggagaaacacacagauggugcuucuccaagaggcagcugucaccaccaccaccacaguggccuccacauguccugucacccguccagucuaucgcuucuaggguaaggacagauccaagcucagcucuucccuuggccccgauccaccuacucuggccuugagcuuccagcccugccucaugguccugcagccuggggcugacuggguuugcaaauggcuuccuuccacgcaggccagcuuaguguggcuugggauguucaggcuaucacaaccuugccgugguagcccuguucacaguggcaacuuuaugguaauuagccugguuuguauuaguaccugucuccgugucugcccugggagcccugcuacaaagacagaguagaucucagccccucuuuuugccauccuucccucccucccuuucuuuaagcuuuguuuuuuaaauuucuucugaccuagucagaccuaaagaaaaguuucgagaacaccaugaggaacacccccagcccucaugaccauuuuauccuauuuaucauaacccaguguguaguguuuuuccuuggacaucacuauaguacacaauuuauuuuacuuuuuaguuagagugcaaagacaacagguuuuuuuuuuuuuuuuaaagauuuauuuauuauuauauguaaguacacuguagcugucuucagacacaccagaagagggcgucagaucuuguuacggaugguugugagccaccaugugguugcugggauuugaacucugaaccuucggaagagcaguugggugcucuuacccacugagccaucucaccagcccccgacaacagguuuauaaccuuuccauacacuagcaccuugcucaaguugauuaacccucuuccaccucucccgggccucuucuccucuucugcuggugucuuccuucuucugcuuucauuguuucagaugugugugugugugugugugugugugugugugugugugugugugugcugguucaugcauguagagaaagauuuucauaggagaaaaaaaauaauuaucuuguucaaauaccacuucuuucauucugagauagggucauauggaggccagcuaaccucagucuuuaugugcaguugaggauuaacaggugugaaccaccacguuggguuuuugugcgguuagaacccagagcuuugugcuugcuagagaaguauuuugccaagggagccucgucccugucccucuucuccaccccuauaacuuuuagacucuugaaaugaauaguuacagcacugcugccuaaucuguacaccuuagcucaugccacuuuaugcccuuggcggacccaaaaaaaagucucugcuugagcguguggucucugcuugagcaugugggcuccaguuuuacgucucuguuagaaugcucuaaagcagaacagcucuccagcuugcccgugaccuuggcuuuuuuuuuugcucuacacggguuggucauuuugucacagguccuuccacuuaggccuuucuuguuguaugccuagagccaggcacagccuggacaguccauggugcucgguaaauauucggugagugagcggaguuaugcaguggugguaagcgaagcaaguuuccuggcuuucuacauccccagccccugucuuuugugagggaugcugguguuauuuguugcaaucuuucuauaaauagguuugaauucuauuuuuaaucauagccuuaccccccaaaagggugggaugcugagccuacuguuggcacagauauacaagggaccucagugcuggguuaauggguguauuagaaagaccaguggaauacuuggugagaggaaggacuucucugugcagguuccuccgcccacaaaucgccuccuccaagugcaccuuugacucaagcauaucgucaaaacaaaacaaaacaaaaaaacaaaaacauuuugagagugaacgggcaugaucuuaguaaaugcaucugauuggccggccuuaccuggagcuacucuaggucuaaguguauguguucauuuuacccaaguaagacuuuggggggguugagauaagaccagccuagcaaaccuccuggcacuagaaauccuccaucugggugaagacaaaauccauugaugcccuuggcauugcccaggggcccuauguguucccugccaugguccuaccccuuucugccucuguccuacccgcucagacaguuccugucaugcauggccucuuuacagcccuuacccuacuuugcucuaacuucacugcaggcucagguuagauggaggagcagagcggguuuaaugauagaaggccucagggaaaagcgugccaagccaagccugcugucccccgaugccuacuccaagggaacucccaugggauucagagggcagauguagauucagagggccugguagaguaggagaccacggucucccuagaucagaccccccucccccaaccacucccaguucaggucugcaaucagacccauuggcagaggcaugcaggcagguggcauugggaaccuugucacaagggccuggguauucgaugcucaguagguacagacaggcuuggaugcagagaaaccaggcaggaagccauccuggaaagauccuagugacaaugucacuccaggccacucaucaggaagccuagguuccuggggggucaagugugcacuggguuggggcaggacccuguauacaugcgguggggccccuugcucuuuuucuccccccucaggaaacaccaaccggaauuccugggcuccagagaacuguaggaugggaauaugaaguuaagcagcuguuuucugggaagcuggccaggugggcuucagaacaucauccagggaagcacagauuugugaccguuugagauggugccuuccuauguugccuggcugcccaggaacucacaggcugccccuacagcagucccuugcuuuuagccuuccuaucuccgauuaaaaguauaugucagcgggcccugcucaguggggugguuuuacagaugggcaccuaccuguuagagaaccaggugauggagugucccaguucucagaacacagggcacuagauugcugagcgucacgaaggcuuucuagguuacuguuagauuuugcuguuuaagaacaaacuuucgggccaggcgugguggcgcacgccuuuaaucccagcacucgggaggcagaggcaggcggauuucugaguucgagaccagccuggucuacaaagugaguuccaggacagccuacacagagaaacccugucucgaaaaaaaaaaaaaaaaaaaaaaaaagaacaaacuuucugggcuggugagauggcucagcaguuaagagcaccgacuauucuuccaaagguccugaguucaaaucccagcaaccacauuguagcucacaaccaucuguaacaaaaucugaugcucucuucuggagugucugaagacagcuauaauguacuuacauauaauaaauaaauaaauaccaacaacaaacuuucugccaggcagugguggcacaggccuuuaaacccagaacuuggaggcagaggcagaggcagaggcagauggaucucuguaaguucgaggcuagccuggucuacagagugagaacaaaaaaaaacacuucccagccaagccuggugucacagguacauaaucccagcuauucuugaggcuguggcaggagaucauaaauucaaguccugcccgggcuacagagcaaguuagagguuagccugggaaaguugcugaggccuugucucaaaaggaaagagcccugggucuguggcucaguggcagaaugauuguggaucacuugcaaggcuguggguucaaagcuugaauacuacagaaaugucaaccaacauaagacuucuaaaacaaagaagcuuagagaggcaaaagcauuuugcuuugagucuccuuuuuauaggacaaaaugucacagugucaaaacuucagggaccucaaagcaaccuucauccacuccccuuucauuagauggaaguccuaacaaggcacugggguaaagugcagcagcuggaacuugcaucucaggggcaugcccagcccccaggucuuggauguacuuuuuuuuuccuuauuauuagacauuuucuucauuuacauuucaaaugcuauccccaaagcccccuauacccuccccccggggugcacuuuuuagguccucuucgacugaguguaucagacuggcuguauauuuuuauuauuuguuaauacccuuuggcauuucucuuacuacacaaauaaguauauugucuuuagaguaguuuuccuauucuuuuauacagaagggaguauuaggcuggugaggaauuccccuauauaugguuuuucgagacaggguuucucuguauagcccuggcuguccuggaacucacuuuguagaccaggcuggccuugaacucagaaaucugucugccucugccucccgagugcugggauuaaaggcgugugccaccacugcccggcuucauauauauuuuuaaaggccauacaaacguuccguugacucuguaguccgugguuguguuucucaaauucagaacaucagaauccccugcaggacuugauaaggcugccgggccacauucucugagcgcugcuggucugacucagacccucgguaggccagcgcguugucauuccugcugacuuuauggaagccacugauuucagagacccucccuuugcagagcugugcuaggguaagagguaguugacaaugacagcucagucuacugacucucccuugugguccuuccuugcuccgauugguucgcacccuagccuugaccucuacguucauucuguccgggacucccucccuucuccaggucagcccuaccccuucugucugucacucuguaaugcccggaggcauuugaaggcuccaccucagcuucccugcuucucuuccggcccuucacuccuuacuuucccccagucugagaaaaagaauguuucuauguggccuuaggccuuuucuaaccaaucaccaccuaaagaggccccacccacuuccugcaaagucucuguccaacuucucucuaccacagagggcccuggaggggcagucaacagaaacuugaaagcgguuuucaccucccaggacagguuggccauuuaauuccaguucagguuugugaugauucucguuauguuuguccuuccuauaaugagugaagggucucaauaagaauggccuucgugggcucauauacuugacugccugguucccaguccguagaacuguuugggaaggauuaagaagugugcccuuguacuagaggugugucgccagggcuggcuuccaggcuccagaaagacuccuaagauuuccagagcucucucugccugguggugguggaucaagaugugagcucucucucaacuguuaacuucguuccuauauuaauagauguuagcccucugaauuuauagcuaaauugaauggguuuuguuguuuguuuuguuuuuugguucuuuaagacagaaugucucuguguagcccuggcuguccuggaacucacucaguagaccaggcuggcuucgaacucagagauucaccugucucugccucccgagugcugggaucaaaggugugcgccaccaucacccacccagccuugagugcuuucuuucauaaguggccuugguuguguuuuauggcagcaguagaagaugaugccugaagauuggcagaggaugccugucucugcuuccugagugcuaggguuucaaguggucauuauaccugccaagcucuuuauguggguuuagggacccaagcuccaguccucauauuuguaagucagacgcuguaaccucagccauuuguucagcccuugcaagcauccuuaaucuucaucuuuccaucuuacauaaagcugaucuuaacgggcuguggucaggaaggcagguuccuuaccacgaaagauauuaagagaaaaguuugaaagacuuuauuuuccuagccauaggccucaguauauggaaggugugaaaggcgccccucuggguagaagcauccacuucuucaguuuuguccuggggcccaguguguggggagaggagcugcagugcagccagcuuggaugagaguguaugcaggucuggaacaggccagaacucugcaggcccugggagcuugugggggugggaccuagggccagagccaccccuggaagaggaaauuaggcagacagguugcaaaauggaaggaagguaggaggugucaugguggggggggggauuaaguucuuaauccuggggcaccuuaaagccucaggagacugcauuucuuucaaaagaccucucuucuuuguuuucuuuaaguucauuguagcuuauagaaaaaucgcaccgcagauauggcuuucaaaaaccuaguacuuuguuuuuuauuauuauaaaauuucucuuccuguuuuggccugucguuuugagacagggucucauguagcccaggauaacccaagauucaguugugucgcugaaggugaccuggaaguccugagcuuugugacccucuguuucccagaugcugggaguaccauaccgucaugugccguggccaucguugccaccuucacaccugguuugugcaguggcgacauuuucauggcugucuuguggcuaucuguaccacacuuaaguggcccccaaaaguuggcaguuggccuuuucauuuuuuaucuuuuugguuucuuggguuugggguuuuuugguuuuguuuuuguuuuuuucaagauagggcuucucuguguagcccuggcuguccuggaacucacucuauagaccaggcuggccucgaacucagaaaucugccugccucugccucccaagugcugggauuaaaggcgugugccaccacacccagccuuuuuuuuuucagugugcuagcugccaccaggaggaagaacuuugcagcuacaaccuuuuuccugugugugucugaauguuuccugguaguagcucccugggaaccauuggucauaaccaccuucuggcuccacuggaauguguuaaggcuaacagcccucuucacagugugagcacaagccccaugugggugagacggccucuuacucauccccacgugugucucacaagcaucuauuacggguagagauuccaucuccuguggcuaagucaguugccacccacacauugagcuugacugacagaugugggagugucaaaugacaggugaugucccugcucuccuuguccuugacaccacucaagggucccagacagccuguggguccaaaaguaagugugggugccucuguggccacaccuguacauaugggacugucuagaucaccuaugugcugucuuuuauccacuuacucauaugcuaaggagaaaaauaaagugacauucugggcauaaggaaugaggugaaaggccauauuaguaaaguagguaauaugugaguggacacacgagggaagggagaaagccagaugaguaucuacagggugucacagaagagggggcagcagguacgaacccuggagguggaauaagccuggcacaagcuggggacagucaaggaagcuguggcuaacuaggcagggugaacauggugaagguggacagaaguagccauagccauagcaugcaaagcccuuggauagcuaagggagaugaggaagcugggguucccaucucuagcccuuugaagccagucagaacaaugauauggaucuuucuuucauacauaugucauguccgcgaacaccgggagccagacuauacuugcuccuggauaaggccuuggguguugaagcccaggcugugggaaggucccaucucaguuccucauccaugugacaaggacccaagacaggaagcugguaagaauaugcugagcaucccagggcugggacacuuccaucuugucuuuccuuagggauuucgugucauuuuaggguagccuuuggguguguguauacaccgugguuuguugacgcacauuuagucuuuacucuguugaguugauagauuuaauaucugucugcuguggguaguccuauagcagucaggagcuucagguggauggucuggguaugcgugcccugagauggcuuuucugcucacagaggcauuacccacagugauuggguaauuauugauuggggggaggggggcugaucuuuuacaggcccaaguguuaacucugcuucauacccuagccaaaaaaaaaaaaaaaaaucaacuggaaauauguugaugaccuaaguauaaaagcuaaagccacaaaaccucuuagagaaagccauagggaucagucuucauugccuuggauuuagcaguggguucuuggcuugcgaugccaaaagccuaaaccacaaaggaaaaacagaaguacauugaguuccaucgaaacaugaaugucggugccuccaagcaagcgauggcggccuauagaaaaggagaaaguguuuuagaaucauaagcucauacaaauuuaauauuaggaacuuguucuuaaaaccaagggcuagagagauaguucagugaucauccaaaggacccaaguucccgucucagcacccguauuagaagcagcucauaacaaccagggccucuacacccuccuuggcuuccaugggcacugucaucauaaacaaaagcucacacacagacauaugcuuaaaaauaaauccuuuuuaaaaaaaugcccuaaaauugaccagcucuaaucuugacaaguucguuucagcagugagcagagaacuugaaugggcuuuucucuaaagguggauggccaaaaagcauugugugaagggacucauucacuguugucagucauuaugguugggaaaauccaagccaugaaauacuacuguauacccaggagaauggucuuagcccaaagaaaagggaggggacccccuaaguguuagcagggauaggaaacauugcuaguagaaaugugaagugguccaggcgugguggcacacaccuuuaaucccagcacucgggaggcagaggcaggaggauuucugaguucgaggccagccuggucuacaaagugaguuccaggagagccagggcuacacagagaaacccugucuugaacccccccccccaaaaaaaaaagaaacgugaaaucagcuagggucgguaggaaaguucaacuugcggaggaaaggguuuauuucaguuacgcuuccacacugaaggaagccaggacagguucaaaaccuggaggcugaugcaggagaggugcuaguuauuggcuugcuuaguguucucucuuuccccucucucuuucucucucauccuuccuuucuuuuaucuuuccuuccuucccccccuuucuuccuuuuuuuuuuuuuuuuucuucuuuuuucuucugcauuuucaagaccgauagguuucucuguauagccuugucuguccuggaacuugcuuggcagaccaggcugguauggaacuuaacaaagaucuuccugccucuguccugccuccugagugcugggauuaaaggucuaagacacuacugcccugcucugauaucuuaauagauccuagaaccaucccagagauaguaccaccuacaaugggcugggccuuccuccaucaaucacuaacuaaaaaaauacacuacaggcuuguguacagccagauuuuaggaggccuuuuuuuuuuuuuuccaguugaggcuuccuccucucugaugacucucgcuuguguaauguugacauaaaacuagccaguucaucuugggaaggguagauagauauggcauucccauauaaccuggcagucugucccuaggcacugaacagaaaaaacauccacuggauuuguuguuuuaagacaggauuuuucuggguagcccggccuguccuagaacucuuucuguauagaacaggcuggccuugaacucagaaauccacaugccucugccuccugagugcugggacuaaaggcgugggccucuaugcucagucccaaauggauucuugcacacuaaaguccauugcaucacuaggcacaacagacagcgacugaaugaauccaagcgaaggaaaucccaugggaaaacgcgcugagcuaaggaaaaugaauguagaauggucaugacaaggagagaaguugucacacgcccugaaacauagaagaacguagagaauaugcugaagaauagucagccagaaucaaaaugagaugcuuugugauccguuuuguccagguuagcuuuuuuuguuagcuugacacaggcuccagucaaauggaagaggcuucucagagcagagggugccuccaucagauuggccuuuaagcaaguguguguguguguguguaugugggggguguauucuugacugcuagaagauccagcucacuuugggagauaucacgucugggcauguguucccggggcguguaaaagugggcugaggcagccaugaagaauaagcccguaagcaacacauuccuucauggucugccucacacccugccucgacuucccuuggagugacugugaucuguaggccuaauaagugcuuuucuccccaaguugauuuugguuguguuuuguuuguuuguuugguugguuuugguuuuuggcuucucuguguagccccuggcuguccuggaacucacucuguagaccaggcuagccuugaacucagaaauccuccugccucugccuccccuguuugguuuuugguuuuugguuuuuaguuuuaucacaauagaaagcaaaccaggacacaccugcauacucacaugaaagaucaaaacuggguaaacccacagagacagaagacgguagagagauugcuuggaauuggguaggugcguauugcuuaauggguacagaguuucuguuuggagugagggaauuuucuggaaauagugguaauaguugcacaauguugaguaugaauauaauuaaugucacagaguuguacuuaaaagugacccuauauauuuuugaaaagcacaauuaaaaaaauaaguucaguguuagcauccgugccuggggaaagcucggcucuuucaggagcccccgggauggauugugacacaggagauacacaggcucagcccagggucugagcccugcucuugucucugauacagauuuccagcaaggcacugaguggccaugaguggcauucauguauccgucuaguccaguguaaggauugcucuaccugaugaaaagacagaaaacgguuaacuuaggugaugacccaccacccccagauugcccucgauagccuguugguuggucuugcuggguuugagcuugagcaucggucuggucucuuccuaucagcucacccagccagguuuccucccuaaggaaaggaguuuccugguuucacccuaacacacaucucuucuagccaugaaauuaauuaacagcgccuguccuagucaccuguuccuucucuauauuuucuguggguccuuuugaaaaucugagccccacuaaugaagaguggguugaauguccagcuguggucaugcacacccacuuggaacacuguaaguuuggaagauaggagguccgugauguuugaaugaaguacccgaacacauguggaccagugagugauagugcagacccugaugugcuguaaaguggagauguuacagcuuccugaaacccaugagcacaacucaaacaaaaucacccuccagauuggcuuguugcuuugcuucagguaugcucuccagagaaugcccuuggagaucacguguucucccuccucccccuggaccagcucagagccuccuugcuuagcucagagccuccaugcuuagcucagagccuccuugcuuagcucagagccuccuugcuuagcucagagccuccuugcuuagcucagagccuccuugcuucuugcuuuuggcacaugcagauucuguuuuacugagccggagcacccauuuguguuguagauucugagacuggauuguaucuuccugcagacucaggucuccaacauacccuaggugucucccuugcuuauagucccacgaagacugucuuuuuuuuuuuuuuuuuuuaguuauuuucuucauauacauuuaaaaaaaaagacugucuuucuuaauuagauccucuguuuggaaucauuagguguaccugcaaauguaaaagagcuggcugaguucaaguuuauagaguccaggcugcagugaggaccucucugggguuauaggagugucgagacccaaggccaacuccagggucuggccucagguacuagguggcuccuaggaagcuaauuauuaacagugggguggcuuucugaucugcuggaaaggccuugauuggcacacgaugcuuuuccgcuggcaccuuuuagaagaccgaggaaaucguuugcuuuguuucucaauuugaaaaggugcugaaagggccgugaccuucccagaaaaaggacugucccuuggguguuguuucuuuuuuaaguuuucugagacaccuguuagaagcauugugucaccuuccaguagaggaacauggguaauaaacagcuauaucauuaccuguguuucuaauguugcagaauuaacuggggagaaagguggcuuuucuagaccacuuccuucauaagaggaaauucaccuccacgugagccuuggggaaugcuuauaaagauuaucucaaaaggguaagaauagaccugcagucaguaaauuacagaggcagagugauuaaguauggggcgguguuuugccuccagugaaucaccuguaauucaccucccgcccaguggcauugggucaggagacuuggagcuggcaauuguguaaugcuagcacugaauggggauccauaugacuguuggaguugaccaugacugggcaugcuuuccugaggcuaaucuacugaccuggacaacgguucagugccuucaaaagccacgaugucaggagagauaauggauggaaaagcacuuggaaccucagaugcccugugggaccuucuuccucccgcggcaaucccagcuuggggguggcccagggaccuaagaaggagguaggucgaguguagacuguggguauggaagaccagcuacucugcugccccucagaaauguuuacaggggaugcagcggagaccuaggaaguaagucaguuuguccagggucacguuagucacugguaaguggccgagcuggaggccugcugaguuaguuacuccucuaaaauggauuuucuucaguucaccaagcacuggcuucaacacaugucgggguucagucuaaauaagugcaacagaaccaacaaaauacacuuuuucuuaagacuugaaacacuugcuuuuauuaguaguucuaggaacaaccauaccuuuuggcauuuugcgcauguccaguuuccagaaccaugguguuuugaauguucauauacauuucuuuucuuuucuuuuuuuuuuuuuuuuuuugguuuuucgagacaggguuucucuguauagcccuggcuaaccuggaacuuacucuguagaccaggcuggccucagaaauccaccugccucugccucccaaaugcugggguuaaaggcgugugccaccacuguccggcuacauuucuuuuauuauucgucuguccucauuuuaucuugaggggggaaaaaaaaacuucgggaagcugaauaggcaccaugagagcacaucucuaucucaguuucuagaggcaguggcggcuggcaugguuacuguguuuggucuaacccaagaugaccuguugggauugaaaccuuccaagcagagggcuuuaggggcuggaacgagccucugcgggcucucuccuaggagacccaugaaggaagagguggccgaagaaaagacuuuccaggaugcuaggaaguagggguugggaaugggagcaaggauaaggguuggagcguuuuuauguguuuccuugagauaaaaccuuggggaaggcagcucuaugguagugaguauggguuuucucuggcccagcuggcccuggcuucagacaucuuggcaggggcggaggcuggcaggacauucugcugugagauuccagccucuuggcugggaugcaccaugauuaacacaucccaaaccuuucaaagugacuuuagcuguuuucuuuagugaaggcuucugccgcuuuuuuuggcuguaaaggggucgggggcugaagcccaagaccgaaauaucagaggcugacacccaaauggguguggccauggccuugggcaaauauuaacacaguauuuuuguaaaguuuaugcaacuugauucauguuccuguagaguaaauuuauuccauccugcuuuuuccagucuguucugagcuugguggaacuguccaugggcaaggcgaaaagagguuggucgcuuaauuuuagguagaaagugcuaagaauugggcuuacuccauucucccuuuuuuuaagccuuccaugaugcuucacucuuuaaauaguacucuuacaccucugaugggcuguuuaaaacuuucaagagcgaggcauccauguagaaucauuuccgugcaagucuauguaaggagauagaaacugaacaguucuacaguggaauauggcuucuauaaacagaaauauauacccugggcacuuucaaaacagaagucaugauagaauuuugguccccaaagccuaaagcucauuuuucauacucuccaguagcuuuuucaauacgaguuccuuuauuuaauuaccuauaguaaugcguuuuggucaacuaagaaccucccgccaccagguuccucagagcuacccagucguucagccgagagcuuaguaucuuccauguuuaugcagccuuuaccuuaggccccuucuucuguugagcagaagucugcuuccuuuucuuucuuuuguuguuugaguaaguguggugugugcgcgagugagggucgugaggcucacuacauguuuguggaggucagagaguaaacggguguuguugacgcuuggcauccuuccguguuggagaucagggucucucuucugcauuccacuucucuguaccguauuccaggugaacuggccccugagcuucuggaaauucugucucugccucacaucuccccacaggagcucugggagccuucacagaaggugauucaaacucccgguuguuacucuccaauggaaaagacuuacccacugagccaccucccaggcccugaaccgguucaugucgccucuuuaaccauugaguuaaaaagaaucaguccaguggauugggcuaagguguacauucucugcuaaucucaaaacuggccuuggaaagcagggguagccgcucucuccuaaauaacucuuagaaaaaaguaagcaauugcugagguuaaccuccacuaaagugauuaaauuggaguucccacccucccauugccugauucuaaaccucucaccuuauccuuauuccucuuuuauguaaaagcuucuaaaagaaccuggccuaauccucccagaacgcucacuaagauaucagcuaucccucaggcuccucuuuugcucuggagcucauaaaaccucccagaacuuccucuccugaccuuucaguaaggucccauaguuguggagucuuugccuggaaaccucagcgagcugguccugucacccaccucacccuggaaggucucagccuccuuguccccuagacacgucuucaccuccuauggaagccagguuccccgcaucucuaccuucccccaccggcuggccacuuccuggcuuggccuggggccaaguaaaugaauauugagucaaugggccggaacuccuuugccaaaguaauaacaaaggaagccaaaaguaauuauaaacaagaucuacagguccuggggcaggggguggggcuaccgaaaauacccucguagaaggccggaauuuggggauuacuugaaggcuugaugacaucuucccaaacauuaaaauaacuaauaaaaaucuugucuucaacugguaucagcuggggagaggagucacacgagggaggacucgggaccuggguaguuuugguugccuuugcccugugugauaccccaggauaaaggcuucucauaccuacccagggcugccaccuuccugugcugggccuggcuuccucuuccccgaggcagaaguauugaagguagcugaggcccggagggcuggagccuguuucgcuuuuuuuuauagcgguuuauaggccaccucucaccgccuguggcuucagccugcuucccauccugcgcucugagaggagcugaagccucuucuuaacuuccaggcgcccaggcuaacuuuuuuauuuuguuagcuuugaccacggugucaugguguccaaccuauaaauaaaaacuaaagauaaacccugggcucucgaauaagaaaacuauuuugacauuucgaagucaucugggaacaagggagcuaacuacagguucugguuuggauugaacugacgggagagauuaucucagcacugcuuugggggcucagggucuucuuugggagguccccucucugaacaaauuaaaggucagggaacaaaugagccaauucugcgguuguggucuuggagcaugaggauugguggugcaagagaagaugguagaguuuugugaaagucaagacugauugcuaagucuuaagugcacuucugaugaaaaggauccauuuuauaaaugcacaugcaaguuucaaaaaaaaaaguuuuguuuuuacaccauuugugauuaucguuguuuagcagacguuaagcuuuuuucuuuccuuguaugucugugaggauaucagauccccuggaauuggaguuacaggcaguugugagcugccaugugggugcugggaauugaaccaggguccucuggaagagcagcuaucuuaaccucacugugccgucucuccagccccuaggcuuuaagcuuuaaaaguauuauuuuaaaaaaaaaaguauuguuuuaaaaguauuuuguugcuguugugggaguuuuuuguuucuuuuuuugguauauaagcuugauguuuuuuaaaaaauggauuuuaacauuaauuuagcaauaaauaugaucaugccuuguuuuaaugaacaggcuuguuuugcuaacuuaguagguguguguguguguguguguguguguguguguguguguguguguguguguguuggguaugugugcccgaauaggcccaggguugguguuggacucuuugucauucccuccccccaccuuauucuuugagacaagagccauuuagcuuccucucccaucucugcuuccugaccgcuggggcagccuggaccuuacuuuacacuuguucagcacugugaacaauggaaaccaacgguaacagugagccugcacugcaccuuugugaagaugugcaggguuguauuuaagagauucagaaagccaugaaaaggaaaggacaguggacagauaggguuggucaguuugugagagucacagccaugagggaaaagaugagauuccaugagccacuucagaauuuuguuaccaacugcacauaauuaaaauugaucgaacgaaaccgcguugaugcguacauauguggguacuuuacaaggaaaaacuaaaaccgcucauuuuuuucuuuuuuuaaagauuuauuuauuuauuuauuuaauguaugugaauacacugucgcugucuucagacacaccagaagagggcaucaaaucccauuacagaugguugugagccaccaugugguugcugggaauugaacucaggacuucuggaagagcagucagugcccuuaacugcugagccaucucuccagcuccaaaccacucauuuuuaauucauuuggcugaauugaacuuuaaagcauuuggcaagccuaauaaaucauacacaauguaaacucccccucccccaugcuccuuuuaagaagaugcuagcugucucuuccacacgugucugagagggagucagucugugcuuguguccuggucuucauucucagguguuacagagugaugagaauuuggggucugguaacaccaacucugagggaacaagccaagacaccugguuacauaauugcaaggugacagcacuuuugaacuuucuuucucuguuugaccucugggcuaaucccagcccugaccuauagacuggaaaaucugucacuucaucaacaaugauuuaggaagcacuccagugauggggcagcugccgagcuauguaccucugggaagcaacuuuguagcauaggcucagaaacugacauagcgcuuuggccccaagacccugguuauaggcagaaauccuggagacugguugacaguuucccaguguguggcucucagguugccuguaucucugucuaggguaggggguuauuaaaaaacguauguaugucuucucucugacaguaaaguaugcguggucucagacugcaucccgggacaggaggaaaggaaggaucaggauaauuuguaaaaucuuacugucagcucuaagauaaacgcuuggucaguguuugcuuucuugagugcugugguuucacugugauuuugaaauacauaaauaaacuuggucuugggagaucagugcuaaaauauguacagguaaaaugauaaccagaccuguagcaugugccuaagagcaaacccuggggucuguacacauggccgugugugugucucacaagcaugugcaagcgacccaccugcuuuugcuuuaggagugcugggauuaaaggauaagcucucacaccugguuuccucuuauuuuuuaaauuacguguaagugugugucuguacccaugugauaccuccucucacucacccaggagcuuguagauucuccucagccagagagcccgccugccuccaggguuacagauggccauguugccuguuuuuuuuuuuuuuguuuuuuuuuuuuuuuuguuuuuuuuuuuuugguuuuugguuuuugguuuuucgagacaggguuucucuguauagcccuggcuguccuggaacucacuuuguagaccaggcuagccucaaacucagaaaucucagaggcuggcucugccucccaagugcugggaugaaaggcaugugccaccacgcccgguuuauguugccugguuuuuauguaggugcugggauccgaacucccauacuccaguccucaggcuggaugcugagugccuuauccacagacucaucuccgcacuccuguaaaguuuuaucugcagaaggcauucucacuuccuuuagaauguucgggcaccuuauccugguuccaaaccaaagccugggggcauugccugucaggcggaggcagugguggaagaacugguuuauguuuuuccugggagaaucauaaagcaugugaugugguuguuaagggccugguugauuucccucacccccaccccucccuuccugcaccaagacuaaauuguuuuaaaaaaaaaugcagcccagcuuccaugaucccagcaaaaaaagaaaaaagaaaaggcaacacugauauucucucagcggccaaauaaaccuucuaugucccauccauuaaauauugauaauugaugagaauugguauugauuuggugagucaucacgaggcugauggggacgcuguguuccuuucugugcuagaaaucucccugucaggcagauccaucaucuguugaugcucagaauuaggaagaaaaaagaggaaggaagaaagcuuucuucagcccagcagggaggaaggaucaggacaaagaagcugagccgcagagaaauuguuacauagccagccggagagugauugauugcacaguaaacaagaacacagccaaccugugucucccccuaagucguaggguuggaggcaagagcuuuccucugcuggccacuagauggcaguauuggcaaggucagccugaaugugauuaccuggguuggcucuagucucgagguuccacgguucacuaacagaauacucaacacauuuguuuauaaauccagacuguuuucuuuuaaaagaucugguugugguggggcaugccuugacaucuaauagcaccaagauuuucaagucucuccuuuaccacaucgaagcaucuaggccagccuagguuauauaagacccugucucaaauaaauuaaauuaaauggaaucaauauccauuugucuuuuucugaaagucuuauggccuuaaguuucugcuaucccugccuccaccuacuccugaggguuuggggucacagguggauguugcccaguuuauacagggcuggagaucaaauccuggucccuaggccugcuauacaaacugagcaacuucaccgagcuccaucccugggcccugaaacgugcauucucaaaguaaaggcccaauuucuuuuuccagaggcauauaacagcuauaguagcaacugccuuugaacaccagugaguugcuuuaaaagggauaacauuauagaaaugaagucuuuauaaaugugugagauauuugacauuaagauagcccuacaaaaucuggauucuauagucaguuccuguucacaucagaaacuuagcauugauuaagagccuuauguucaggccuuggcuacaugagaccccgccucaaugguaauaaacaaacagugccuuuuaaugcaugucuacucccuguccaugcuaggcaccuauguauucccucugcaauauuuacugagccccagcugugugcauaaugagaucaugcuuuuucuauaauauguucucagaauaucaucuuugauuaagaucugaaucacaguagaacccacagccaguguucccgcuaccccagugcucuuugauuugaaacacugugcaaauaggcucagcucccaugaugucaguggcuuggucugcagcugugaugucccugguuccugaggccaguguguuccuguuuggguuuuggcuuuguuuggaauuaagaggcuuauaaaggaagccauagaacccccgaguuccccaauggcugcgguacaggaaacagggcaaucugucagcaucuauuguccagccagauuguuuaagacacaguuucaagacaaucuggaaacaccuccuggcucgguaauauguaguuuagcaucuaugucaagcaagcucuuaucaagguuuguuuuagggacaauugccggaaaaauauucugcaguuuucacgaaacaacuuuuagugacacuguccuuagguuccaaggccuucgugugacaaucagggaggagggaaaagucucccuaaauauacucgggccaugcugggaagcaucaccagccacgguucaguuuucagugcuaggaucaucccugaugcuagcuagcacagggauaagagguugccugggggaaauggccuugcaaagcccugccugugguuggcaugcggcuccuguugcuuuccuucccggcuuccuccuugaagaccuugguuuucuguucagugucugugugaggauacuuuaucugcccugcagaccucgcuguguuccaaggccagccgugugaagagccacugucuggaccucagcgaucucagcuuccagacugcccuuugagggguuccuaaaggcccagggcacugaauucccaugggaggugggaccgagaaucaucuauagaaguucccaaggaagcucugagggccgcugcccauuaauaauaauguacuuccuaacuaugcuauuguauguuaaaagaacacaguccaccugggauucuuaaaggagaagccagcgacagagcugacauauucaguugcgugugggauaaagcauucgggaagacauuuguugucucuugauaacuuuuuguauuacucagaaaguacaucccugauuccagugacauuuuuauugaaaagggcaugguggagguggugggugaguggguggaaaucucugugugugugugugugugugugugugugugugugugugucagcuuucuucuuuuuuccuguuuuuuuuuuuaguacuaucagucuccaggaaaaaaauuauuaauauuugagguuuccugucccgagcuaguuauagaacuuuaccuagagcaccuugaauuuauugcuagggacucaaagcacagcuucugucguccuauguaccuagucugugguccuugcuaucccagacguuugauuuuuuuuuuuuuucagucucuggucugcucugcccuccuucccacaggugagcgacacaucucucuucccacugccuaggucuuuacaucugguccugccuugguaucuggugcugucucuccgggugucucugccuuggucccccagaacagauggaccuuggauggauagcuugagcaucgccuggaagacugggagaugcuuaauucuucaugcauuuauugguuuauuuaacguacuuaacggauugcccgucaguguugagugucagaggcccagugagccagaguagcacccgaccucacggagcuaggcugguaguaggaaaugaaguuagaaacccacaucaugacuuuuaagugcagaauuacagugagcacaguugagagucuaacacauuggcugagagacccaggaaggcuucccccagggagugguguguguguguguguauguguguguguguguguguguguguguguguguguguguguagaauggucagaaagcagggagcacggcaugggggagggggagcacggcaugggggagggggagcacacccugggggagggggagcacggcacgggggagggggagcacagcaugggggagggggagcacagccccccucaaccuucaucugcauuugcgccuccuccaaaccgcuuagucucaaguucucccugagcgcauccacaggaugcugcugcggccuuuguguucaguugccaaucucuuuauucugccuucccacucuugagcucucuaguaaaaccagcuaaagacggagggucgggguuggugaggcggcacagcaggccgaagcgucugcccugccugacaaucugaguucaaucccugggacccacucacgugggagaaggagccaccggucuccugcgaguuguccucuagucuccucaggcacacacaagcacacacaaucuuaagauguaaaaacaaaacaaaaaaaaccaacguggagagaagccauacagcagcaaccucugcugaccucuggcuuucacuuguaggcaucgcugcacacauacaaaagcauucaggaccauccagaagcggccacuagucaguaccuggaauugugccuggcuucuuaacaguaaccauuaaaguaacauuaaagaaaauccugcuuugcccacagcaaggauucauuucucugcuuggcuacauacaggugcaugaucugagcaugccaugauuuacccauccuucagccgauuggaauuuagaucucuucccaucugcugguauuaugaagagucuuguacguauauauuugugaaugaaauguguuguuucauuggacacauaccuaggaaucagauugucauaucuuggaacguggugguguguucagcuugguagagauuuuccccaacaguuugccaaaguaguuguguuaauuuaagauauauauguauguauguauaugugugugugugaauagacugucacugucuucagacgcaccagcagagggcaucagaucccauuacagaugguugugagccaccaugugguugcagggaauugaacucaggaccuuuggaagagcaggcagagcucuuaaucgcuaagccaucucuucagccccaauuuauguuccuugcagcaucucagagagacggauagcugaaccccuuccacacuguucucaguuuuacgucuguccucguucuguggcucuacuuugcauuucuuugacaagcgauugccuaagaaccucauuucuucccauuuuuaaaaaaagaaaugcuucaccuuuauuuucagugugucuguguaugugcauuuuccucagcggccggaagagggcaggguauugauuccaccggagcugacgcuaacaaguagccaugagcugccugauguaggugcugggacuagcuagaacuuugguccucugcaagagcuguaucugcuccuaacugcugagccaucucuucaggcaaaauaugauaaaucuuuaaaaaaaauuuuuuuacaaagaaauaguucuuaauuuuaauauagcauaacuuauuaaccagcuuuuguguguuuuacauauuucuuucaugcuuaguuuugcaaaacuuaaaaauaccuaagguagagcgagguggcgcacgccuuuaaucccagcacucggggggugggggggugggcagagccagccuuugagauuucugaguucgaggccagccuggucuacaaaguaaguuccaggacagccagggcuauacagagaaacccugucucaaaaaaccaaaaaaaaaaaaaaaaaaaaaaaaccaccaccaccaacaacaaccuaagguaggaauuuuccucugggaaauuagaagguacuaccuuagagauaacagggcaaacagauaaauaagccacguauguauuuccuugaccuaacguggcauugcaucuuugagcaacagauucugcuuagcagugguucucaaucuuccuaaugcugugacugacccauguauacaguuccucaugucgugaugaccccaaaccaugaaauuaucuucaucgcuaccucaaaacuauucauuuugcuacaguugugaaucguaauguaaaucucuauguuuuccaguggacuuaggugaccccugggaacagguguguuugacacccuccccaaagaggccacagguugagaaacaccagcuuagcacaccucaaaagucaaaaaugaaaugcaaagaugguuuuguuacccugcucuaccuacagguucugcagcugaugcugugaggagccaggccguccugcgaggggcuguguaaggccugauugccugccuggaaagcacugacaggugucuucaucuugcagguuacucggcggccguuaugaccucccgguuacgugcguuggguggaagaauuaacaauacccgaaccucugaauugcccaaagagaaaacucgauccgaggucaucugcagcauacgguuuuuagauggcuugguacagaccuuuaaaguuaacguaaguucuccauaauuuuuuuuucuuucugccuaaaucaguucuugguuuacaaaacaaaaaagagguuguuagcuaacaaggaaagcuugaaauuucagaacuggcacggugagauggggcuggccaugggagcugugcuucugucucuucuuagggaugugaaucuguuggcaucuucuaagguugauggcucugggauguuguuccccuccccgaauaguccccuaggcagagcuggcccuuggaugacuauguccuguacgugauuuauuugagccacgugacuuuguguuuuuaaaaauagcauuaaaagaaaaaaaagcaaccuaggauauaaguguccugcuaaagugugagccccaugaggacaggccggguguccuggcauagcacugggcacucagcugugcucugugagauggucagccucguggguggcaggaauccuaaagguccugccuggcuccugcuccgagcccuugaucucagaucuucauguaagcagcuaugagaggcaaggacggcagcugccucggcuggcuccgcacccagccaccacccaugcccagggacuucuugugucucucaguccugauggcgucaacuccaagucaccugugccccaguuuuaugugccgagaaagagaauggugauagaggagccgggcuggaugugaugauaaaggccugugauucggcacucggaagguagacuccagagcagcagaaguucgaggccagccugggccucaaauaaacaaacaaaauuggggaggggugaccagaaaaggccauagcacuuaaaccuuaaugaaaacugacagaccccugcuguagcugcuacuguuacccuacccuaccuucuccuuccacagggacucacuauguaguccaggcuggccugaacucgcuauaaagacuacgcugcccuagaaaucacagaggccugucugcaucugcuugcuaagaguuagcguuaaagacuuguacuaccacccuugugggguuuuacccagucaccuccccccuucccuuccucucccuuucucuccuucccuccuccaaccccccuguuucugucucugucuccucaccacuauuagucaucucgguucaggcaaaagacaauuuuuaguucuucuaaaccauggccaggggagcugccccauacaguggaugugagaauguucucagcggcacacaggacccaggggugcagacaauggcggugauuagcagagacuccuuucccagccuuccuccccucugccuggcucucuucuugaccugucucuaaggccauguucugcucuucugaagaugaguuaacacuuauuguuaucaagaaggagaagggcagauagcucagggagugauggugccugccauugagccugacaagccuugagacccacauggugaaaggccaguucccggggaacgaacggccugagcccuggggggagagagccagagauaagugaagucggagagguuccaagcagggauggggugagaggccagcuggagcccgggcaugcuggcuucuacacgggguaacguagagagcucugacuugcagccugacauggcgugacucaagggucacucagucugaaguagccagaggggaagaggacugauagacuaccauagcagucccugagagaaauccugguggugggcagagcagucuugagagcuuggcuagaaggcaguaccuggaagauagagccaaauagugacaguggggcucucugucauguuuuccuggucuaguuuguccucuuuguauuucucuucccccacuuuauuuauuuauuuauucauucauucauucauucauucauucacagucucacuguauaucuauccccugcuggccuggaauucgauauguagaccaggcuggccucaaacucucagagauccaccugccucugccuccaggauguugggggaugaaaggugugcgucaccacaugugggauucucuuuuaauuccuuugggaacuagaacggaauagaguugacacaugaguguuuuucuggcucagagaugaggcucaauccagcaagaacaaaagggcuuugguguugcaccgccgaauccgagucaggggaucauguagcuacugguugauggugcggguaugccaggcaugucgccucgaagugcuggggcccucgguggcaaggccgauguugggcuacuuugccaguuugucuucucuguauuucccuuccccccacuuuauuuacuuauaauaaauuacagucacuaaugacauaauaaguccaaguuacauaaacaauaucccaaacauaaguaauaguuacacuaagugagaagauagcucugaucauuaggagauugucccgugugcugaagagauggcucaguggauagugagugcuugcuuugcaagcaugaggaguucacauccuuagcacaagcguaaaaaguagcugacgguacacguggcuguaacccugcacuggggcugggauggcaagagcccacuggcucucugagcagccacucugccuaaaacuguaaacuucagguucagugagaaauucuguccccaaaaugagaugagaugugauugaagauaucccagcaucaaccuuuggccucuacacaccccaggggugcguguacccauaacuguacacacaacacacacacacacacacacacacacacacacaucuaguaacuuggggaaaugggugggcuguauugcuuuuuaaaaacccgugaagacucuugugauggaugguggcagguccagaggccuucaaaauggacagguagugcauucugaaaaugaccgaguucauacacaacagagcagacccccccccccaagucacgcggaagccgcugccacaggaguguccacaugcuaccuuguucuccccacccuggucuccgcgacccacuuucugugcaucaccugcucucagaagcucgcaggaagagccucuucuauaccugucuauuucugacuuguauuguccugaguugaauggguugggaugaaagcaucccugggaggucgaccucugaaaacagaaucugaaguccccuaagugcucugugcccauuuugugugugugccugucucacacuguccccagcuaucuuucguuugugcagccagcuucagacugggcggccacuagaaugaugggagggaugacacuccacccugucaccccacuaaacacaaagcgguuccuugucccuguccccagguggacccuacuguccgugcuguguccucuaagaaaucuaucuacggugccuugacugguucaaagcacuugacagcguuugacacuccauguuagucaccccuccugcagccaagcaagugaagaggugcuuccuguggcccugucccagugcccacauggggcugccccauaaacacuggugcaggccucugagucccgcucuggagugaaguguggcuaaauguccccaccggcuucucacuucagaugacgagaagcagcagggcagauaaucccacagggggacacaggccaagucacuuugaggguauuuuggauggcguucgaguauuuuuagcuguuaguagagaguuuuccucccugcacacucucuggguucuuccaggggcaggagcugcagcugggcccccagcagccaacaggagcugaccugggauuagcauuugcugugcguaauccgcagcaggucauggcguguuugcuguguaaugugugaguuuuccaacuuagaagucacuggagaaccucagcuaagggauggaggcaaccuaagaaagcuaaguuaagcugugugugugcacgcgcacgagucugugugugugugugucucugugugugugugugugugugucuaugucugugugugugugugugucucugugugugugugugucuaugucugugugucuguguguguguguguguguguguguguguguguguguaguccagaagacaaccuacaauauuauuucccagaaaccaucagucuuucacuggccuagagcuucaugaguuggccaggcuggccagaggccaauauuggguaucuucauuauucuuuauuuuauuuuuuucaacauucuaccugucugucugucugucuaccuaucuauuagcuaucuaccuaucaccuaucuaucuaaucuauuuacuuauuugagacagagucucacuguguagccacagcuggucugaacucucuaugucgaccaggcuggcuucagauucacugagcucugccugccccugccuccugaguucagggaaugaaaaugugcaucacaacuaagauauauuuuuguuuucgugucuguguuaauaauguacaugcaaucaacggccagaagaggccauuagcgcacccuuccccuccccccuccccagcugguguuguaaguguugugagcuacucagcuuaggugcuggggauggaacuuuagucuucugcaagcucuggaaucauucuaccauggagucaucucucuagcccccugccuuagauuuuugagacaugaucucacugaaccuggaguuucuauauuuagcuagauugcuuggccagcaaguuccagggucgugucuuccccuguacacacacagguucucacgcuugcaaggcaagaagucaaccaccuuucuccucagucccuuaaaaaauccagaaugucugaaaacaugucaauguaguuugucuuaaccccacuucuguaucccuccuuucagccuuguaacuugaaauuuauuaaugcuuuuguuacugugggaaguguuuaauucuuaaaaucucagaaaguuuuacuuuuucuuugccuacuguuaaaaaaaaaugguuacuucuauuucuuugguucauuuuaauucuugaugguuuugaucuagaaacaagauuugggccagucgcuucuggauauggccuauggccaccugggugugacggagaaggaauacuucggcuugcaacauggcgacgacccaguggacucuccugugagugcucgcauguacgaugugcugcuucccugcuuggguugguuucauagcuuaucuuucucacuccacagagauggcuugaggcaagcaaaccccucaggaagcagcugaaaggugaguaugcucuugcuucacuuggucgcuggguguacggcaaacugucuucuccuuaugggggacuuaagguggcgguggggucagggggagguguuucagggcaaccuugagggugaggggagaggaggcagcucgacaagggagcguucguuuauuuuucuaagggagcagguggaugaaggauagauagucuuucuuagcccaguauaagaagcagagaccgaaaagggcuggggugaugucuuagcuggcuguccaagcuuaaggaccugcaccaacacaagaggcugggaacuguggugcaugcccagaaucccagcuccggagacagagacaggaauuccugcacuuggcuggccaggcugacgagucgaaggaugagccccggguucaguaagagauccugucucagaaaacgaagauggaaggcaguggaagacgacaccugacuucagccuguggccuccacguacacaugcagacuccugcacacauaaagggagaccgacacacacccucauacagcagcacagaugcugucuuauccaccaugaaugggccccuguauugcucucagcuuccagugagacagcuacuccagccaugcccacucccucuggccauccuuucucauucuggcuuuccucauggcucucauuggccccauacauaucuaguguuccagacuaacuugaucagucugcagaaccacccuuuaaucuccucucucugugguaggugcauuucuuugucccuaugcccaucuccuauuccucagggcuccucagauaccuccugcuaucugaaggaaagcgccaacucucuccuucccucucauuucuuugucccuucguggcuggcugagcacucuugcugucuucucacagugaggcgcuugcacugccucucaggacuguucuguuccacucagccccacacccuucacaaugcuugacacacaggacguggccaguuacaugaggcaacuguuugucauccucucucuggcuuguccuugcagcagacacauccccacugcucagaccaaggcaaagcacucugccaagccugggaacugcauucaaaccagauuugaacccugcugucaugaucaaguguagaaguagaaaagaggaauucuaugauaguacucugcacacgcgugcguguacacacacagacacacacacacacagacacacacacacaugcacgcucugaauccacagaagaaauaagaaaaacacagagacuaugccugagacaccaaaguaacaauaauggaagggagagacugaggagguaagacaaagacggaauggaaaaacuuuccuacagaguuagcgccacccacuggcagcuagguguguauacagaggcacagacuuacuguuaaagauucuuuugguaccagcccagagcugacaaaggaaggaacuaagagauuugggguguguggaggaaguguggagccacagugaacaaggcaggaggcaagaugagcagaagggucagccagcugggcagcccacagaaggacuuggauuucagagggcccgaagagugcuacgugagccagcagacaggaccuuggcauauuaaccaagaagucaaaaggucuccccaugucuuggcgacaugucuugaucuucuguuguccuaacccuagcuggucugaucuuguaucagacacacagccaguuuuagccacacaaggaaacuggcacuugguguucaugccugaguaacaucugagugacuuguguaacacucaggauccccgugacuauuuuaauacgcucugaacugaaauuguaaaaauggcuuccaguuuuuuuuuuaaagaaaauaaucaagucagaaacuucagugcuaccagauguucuggucuugucacuggcuaccuaauccagagagccguuuacauuucuccaucuguaaaguggaaccacucagcccgcagguacccauagcgguguuaaggcucuagaugcugcguggaaauguugggagaguguaagucgcuauguaaauguaagcuucagaccuucgggaguuuuauguauagaagcuaauuuaagacuuuuaauauagauaucauuguuugaacaggacccuaaggcagacauacagccggaagugggugguaccaccguugaagcuauauaaauacauuaggugugcguggagaccucugaacaguuaaacacucuguauugggagccggggcuuuucuaauggaaaccuugugguggagugacaaguacuuccuuuaugggagaguuagcagcuaugaacguggacuuucuuguuguuuaaagggaaaaccuaaucuguuuuugaaaaauguuguaggagguuuucccuguacccugcauuuucgaguaagauauuuuauaccugaucccaacacacugcagcaggagcaaaccagguaaucgccuuuuccucuugauguucucuuauauacaaauauacagauuaguauauauaaauauauauauaaauuaguagcugccaaaaauguacucuuuguuuccuggcuguggacaaguaacuugauuggguguaaccuccgaccaucgugaaauccaaguaaaaauuggauugaaauuuuaauggcagguuuguuuacagucuguggccugcauccuucagccccggucugguauaaugcaugugggcacccucucucucuucccgccucugguaagcauugugaagacugagguugcuaagacaguucuugcaaugcaggccuggaguggagcagucagccacagggcucggagaaugauuucugaggggcuggaaugaagucccuuggggaugacaaggcuuagcugaaaucagaaacuuccaccagguccccguuugcaggggugagugaggaaggagaacgaguucuggcuggaccccgcuugucugcugggugaaucagcggguguaggaaguuugugaggcagaucagggaaggaaggcuccgauaggagcuguuuaccccgcagggcuugcaggcugggcugacucuaguugauccuggcaagugaguuuucugaguggggaaacuggaaugugcaggaugggaaggguacacugugaaagccauugccucggggugggagacccagccagccgcuuccccugccucaggcgcaagcccuuaguaucccuuugcuguucuuaaggagggaaacugucucccugagaugaagcagaagcuguucuggguuacugagucccauuuuauggcagaaaaucucaccaaagagacaccauuugcucagucauagaauguucucucaguuuucucucucuucuuuuuuaaugacaauuacacaucguauuuuagcuuuugauauguuuaaaggccaguuguugguuuauugcucuguuuuuccugcuucuguauugcuuuucuccacagaggcaggccuuggggugggacugcguuuaucacuucggucuaugugaagucuguguaagggaggccuagguggcucauugggaagccgcaguggagugcaugcugcuuugaaucauuuuggagccuucccuccauccuucaugucccauuccacccccacccccccauacacacucacauaccacauuguucuggacuaggggcaguguugacacucaacccagcaugucaugucaucaguuaguauacauaaaacugauaacaucaucugucagucugaugacuacuucucugagguuuccucaaaacaguauaaaguagagucuggucaagggaugcauuacaguuacaugaagggccagacacaaugguacacaccucaaaucauuacuguguuacuggggaggcagaggcaggagggucccuugagcacaggaguuugaggcuagccuaagcaaucuagcaagacccuaucuccaaaaaaaccaaaaaaaaaaccaagaugaauaccuuugaagaauuauguaugcauguugcaaccucuccucucucucuuuuaagugaccauugugaccaagugaccaaguugauuuuuaccuuaagaaguuccaguucauggauggucacuguugucacaguccuuccuauaucaucucugggaugcugaagccccagcuguauggcacccuguaugcacacucaagcuuucaaguagaaaggcuugagggagaugcucccagagccagacucaucucauggucccucuagaguucuucauggccaucccccuuaggaaagaagccgagaccuuguggagugagucuaccugccuccagggagcauccagggagaaaugugaggugguugcucacaucaacauccacagucgagaacacacgugcuugccuacuuggguucagcuuaguuuccucacuucuuagggaauggggccgcccauaaugggcugggucuuugcauaucaauuaacuuaauuaaagcuaacccaugacaugcccucuggccaaccagauauagauaauaccccuguggagacuuucuuccugggugauucuagcuugugucuuauugacaguuagccaucaucacaggaucuggguggaguauacucucaaagggggucaaacauuucuaaaguuagagucgcuguuagaguuucuccuagugauagcuuuccuucucaaggguacuuccaugucuguuuauugugagccuccacaacugcuguuacugauaaauuuagauuguucugagcagcguuccacauaccgacaaucucuaaugacaaucugagcucccugaagaaaaugacaaagccuccuaaguuuggggcgcauuuggugacucuccacaugugguucugugggguuggcucggauuugcucugcaaagcaccaguggcauuuggggaaggaucucugaguguucguggucuccuuugugccccucagggagagcgcagguuuuuaaccagugcaucauuuauaaaacugccccucucuccuuucucccaguauccuuccaggaggagagaacacuuaauucugguugaauguuagccuggauaaacauagaaaccaacuagaaagaacugguuauguucuccuagguggaaaagaugaucacacuacugaguggacaugaauuagcacaaguauuucauuauugugaccagaguuuuaaaccagaagcuacuuaaaggaagaagggcuggucuuggcuuacaauccuagaggcuaucugccaucaugguagagggcgugugugugugugugugugugugugugugugugugugugugugugugucugucugucugucugucugucugcugaucacaguguacccaagguuaggaaacacacugaucggccacuuccucccuuuauuuggucugggaucucaguccaugaguuuaugccucccagauagagggugggucuuccaucuucacuuaaaccuucuggaaauaccaucagauacacccagagguguguuuccauggugauugcaaauccagucaaguagacaaaaagguuaaccacucaagcccuugugaauaauaccagcaucaguguccgauguucaaaacaaguuucuccuauugguagcuuucauaacucugacacaauacaaagugauaauugugucagaguugacauagauccuaagcuuaguaaugacuuaugcagcccacagagauucuucuugucgcaugucuguccaggauaaaggaagacaauucugacuguagagaguuuauugugguguauacucuugaggccugcuucauuuuuguagugugauuuuuuuuauuugcaaguucuuuaucauagaaguuuuaauaaguuaagauagagauggugugacagccucacagauucacugggaggcugacaugaggaagaaagucacagaguaccaggcaccuaaccccagacugcacauaggagcuugcaaugcuguuucaaacauccaggucucaaaacagccagccccgugaccuuugucaaccccaaggaacaugagacugguuuguuuaaauugacagagugaucucucccccgccccggcacuucugcaucgucgguauuagcuuucaggaggcuucccuuuugucaucuuuggccagacccuggaaugucaaucccgcuugaaucugggguuuaaaaaagagugggagguaggagccaagcgucacaugugugccgcaucccuaaauauaaaugccuccauggcacuuccuggccucaccagggcugcugaugccacuccauggugcuuccuggccucaccaagguugcugaugccaccccauggcgcuuccuggccccaccagggcugcucaugcuggccuccuuuucuucucucuuucccaggacagacagagaugcagccugcagggcucaggggccuggaauaguuuacccccccaggacagcuccaugcuuucaaagcugacucugcugcuugccugguaacuaggcuaccaauacuuucccuucagcccccagugguucuuagacuccaggaaaaagcccagcugcgugucgcacuccagccaagcugugaucuucacagacccacacuccccucuuagcaguuucacagagcaaugugugugugugugugugcaugugcgugcgcgggcagcuuguacagagugcugugggucccugugccuaguugaaagcccaugcagcaagcuguggguagggaggcacccuuggcucuuaccccauauauccccucaguccucccuagcacagagcaccuaggcaguuugcaaauaggcaaaaugguuuuugcaucuacucuguuuuucaaaugugugcuuuguuguucuugcucacuuaccacauucugagcacuuguuaacgaacacguuuguuucccaggcaucuauauuucuuacaacugaagauggauguuugcgaaggaagguaaugagaauuuugaauucuucuuuuccugucagacuagccagauuccugguuuucaucuaaugagcacgcauuccccggcaacaguauucgguuuaaaucaagucuguauguuaggcugguuucaacucccucuugguuuacagaggcuaaugauggagagacuucauuccacuuuacuacaauuuuauacaaagcgcacagugaucuuucugguaaagacuuggggaauuuuaaaagggaagagaagauucugaauguaaaacaggccucagcucggguagcgaauaggagugaguuagagccauuucugagaccgugcuacuaaagagauuugucuuuucucugggaggaagcguguugagaugagcaccugcccgugagucagcacaccggguauauccaggccauuucagugcuuaggcgguaucugagaguggccagaaagaggauuaaaaccccaaguccaaaaacuccugucuuccaaauccuuaguaucuucuuugcuuuucucuucuuuuuuuuuuuuucuuuucuuuauuuuaguuuugguuuuucaagacaugguuccuagagauagaauggaugaguguguaugugcauauguaugugcccauguguacauguauguacaaaaguacacauuugugcaauugguucucuccuugcaccuuuacauggguucuagggauugaacuugaugcaccaaggaaggcauuugcagcaagcucccuuaccuacuaagcccucuuggcugccagccccuuagccguuuuuuuuuuuaaccuuauggggaauaaaauggcagcaggaaaauggcccauuuacuucaauucuccucauccccacuaccuccuaugaguuuaguucuacuguagagggucaucagaggcccucagccugccacgucacaaggaggcuggcaguugugacucaugacuuaggacgggaagcccaugaggcaaaugagacccauaugggcagugggagucacaguuggccuaggguuucaggagugcugugggagugacaguuggccuagaaaagucucuguggggugcugggcauaagccagguuuaggauuaguggagaaaagagauuccccuggacagcaagaaggcuuccccauuccagcuagaagccaugugugguugacuuguaggaaaacagagagaaggggcuucucgugcccacugcagacgugugucucacacccaccagacggauggaagagaacagcugugugguauuauagaggccgaagguugugauaagacaucugucuggagggaugguggccgugcgcacuagggcuucccuaugcuacaguccugccagccggagacaggagccuccucgaaggggcuggcuucagaacaguugacugcuuagugaugacagaguucaggaucaucacgaguucugugugucccuucuccaagguagcagucguccaucccuucuccagcacaaaccauagaccaggugcugagggcuccucgugugcgagauaacccuauguugaaaugcccagcuccccucuugagcucuucuuggcagucacagaaaccugguccagggcucccuuaugggcaggugcuuuguuuuuuccauaaauacuguuuucgcauccauuaugaggcagguucuaucccaagaaacccuagggcccguccgaagauucagagagacacagacguuacucaugggcaucaggggccuucagauagggaaugcuaccuucagauguaccuucagaaccagugggaguauaguggacagauagagaaacaacugggaggccaaccagcuuacacuggcaaaugggcugacucauauggggacuucauggcugccaugccaacggcaugcucucucgacuugccaugggacuggaagaugcuuuuaaaaaucuugucgccgggcgugguggugcacgccuuuaaucccagcacuugggaggcagaggcagguggauuucugaguucgaggccagccuggucuacaaagugaguuccaggacagucagagcuacgcaaagaaacccugucucgaaaaaacaaaaauaaauaaauaaauaaauaauaaauaaauaaaaaauuuucucgucucaguguuugcucacuuucccaggcgcugccccuagccuuucccagcuugguucuugcauucaacaguggcccuugcugaagccggcagagcuucacagagccagguuugaauggagaaaagagagcaauaaagacagguagcgucacugagaacaggcguuugggaggacugggaauagcuggcaucgagaacaaacccaggccagguuaguggauuucuaauggauagcagggagacagagaugguugaaccuugucaaccuuagcaagagcgguggguuuaggaauagucaguaguuagugaacuaaguaauuuaauuacagaauuacagacguuaaaauacagaauucuuccuccuaccucccuauuuuuuccauuuuaaagguaucaccauccagucucuaggacguagucagagcccuacagaaagucucagauuuuuauuauuuauuagaaggaucggaaggcugcagauuuaucucagauucuaccuuucucacuucucucaaaccagaaguuucuuuuuuuuuuuuuuuuuuuuuuuuuuuuugguuuuucgagacagggauucucuguauaggccuggcuguccuggaacucagucucuagaccaggcuggccucggacucagaaauccgccugccucugccuccccagugcugggauuaaaggcgugcgccaccacgcccaguuuacauuuuuuuuuuuuaaucuccaaaaaacucuacuguauuccuagugccacucgagauugauuuguaucggaguugccuugaagauucaaucacguuguugauuagcaguuaauggagaaaagaaagccccgggcuaccugugauuuaucaaugucugugguucuucugacuuagcuaauccuucuuucucccgacagguuaaccugcccucucaacucagcggugguucuagccucguacgcaguacaauguaaguccugagggagguugacuaggugguggcuggcucguucgagccacccuaucacuggcugcucacugaggaagucuuuuccucaagaugcuggggugggguauauauaucucuuguugucuuaacgguaagacuuuugaccugagccacacucucgucuugcuuggggauaucagauggacaguggugucgggggaaggaaugguguggcauuucccccuagggagcuaugaaacagcagacagauacaaccagcuuuuuuccagagccucugcccagguauuuggaucuggucuccguacaaaccccgauggaacaauauuuauaucccucaccuccucugaacauggaaaccgagcccuggcuagguuaaggaauuugcuggaaggcacuccugcugcuugcuugauaccuaucuaaaaugcuacugagagcuuaccaauuuauauucagagccucaguguagcuauuggguuauacacuggucuaugacagaagaucacaaguucaaagucauccuccgcuccauaaggccagccuggacuacaugagacgcuccuuuaaaagucuguguguguguguguguguguguguguguguguguguguguguguguguaauuugaagguuuuauucggcccauuuaaauauuauuuuaauauauaaucagcauaaaaaugaaugagcuauggguguguguguuguucuguuguguuuugcuuugcuuuuuaacuaaaucuuugaaauccagucuugguuuugcaauuuccacacuuuuccacuugaacaaggcauacuuaacuacaggugccacgguggauaggaaaucuggguagaguuuuccagcuaagauuuuuuuuuuuaaacuacagaagucucuucauccugucagcaaaacuuaauaauuaagcauacuuggugucagauccugugcacggugaaauaccacuuugccauucauuagcccuguggugccagcccagagcucccucuugguuguauagcgucauauaguuuagcauaagacugaggaguccccucugucuuugcagaagucucagcccacagcauggcagguaacuaagaaagcaaaauagucaggucucagagcaggugcaggccaaauuacccaucuuacuguggccucagaagcaaaauggagagagagagagagagagagagagagagagacagagacagagagagagacacagagagagacagacagagagagagagagaggagaaaaggaaaggaaaggaaaagaaaggagaaggaaccaaggaaggaaagucagucagacagacagacagacacacacacuugggcuacuggggaggcccaagcugugcuuccucccugagcaacaagaacagaaacaagaaaggaggugaagaacaagccugaugggcccacagcuuaccugccuacugcauggagccagagaauggaggaacgaggauggugaggugaccccaugaugucaagcauacagcaaggcuccucacugcuaagacacacucagccucagcuccaucccaccagccuccucuucucgugacaacgaaaaacucagaagagguugcccucugggacacagcagcguguugcauccacugggaaggacaugaaccaggagauagggcaccagcaacagaucagagaaacucuuccauccaaguccagccuagugagcugcuagguuuuuacuuuaaacgaguauggcugacuucaaaaagcacugcaucaccagagucccacccaacaugaaugaccuccccaaacugcacaaauggagcugccccuucagcuaacauuucaccuacuguguaccuuggccccuuuugagaucagggagagauagagcaguaagaaugacuggccggaauaauucuccuuacuguuucuagaagggagaguuauuaggcucugcuuugugaggcucugggacuguagucacagcugcuaugauuaagauggugucugcccugucaugacacagagccgugauacauagcccggugucagcguguccacaucagucucuagauuuguggcucccauuucuucugggcugaugagugacagaggcagggccuucucacauugaagccagggcuggauguucacugcuggagcaucugggcugaguggcaagaacuugaggauggagagaacugugcuugguuuaaccucgcccuguucuuuugucccuguacuaucaccuggcugaaccuuaggcuucccaccugugaauggaagcggcugguccuuaugcaacacggcugcuucagauuaaacagugcacuuuaagguggccuguagccaaaaaaaaucccuuaauauugaaccuacacugaccgaggcagugagaacagggauggaagccacgcucucugggucuuagcuuuuccucucaucugcauggcuugaccuuccaggccucauguggcgagcaggaccacgugucuguucugcuuuguagggcuguagggaacagaacaugaaccaccguaugaagcacuauuaccguagucugaacucuuggcgucuucuccugccaguucagaagaaaacuguguuaaguuguguacgaggugggagagaugacuccuugcaucagaacgcuugcagccaacaaagcccaucagccugaggucagucaggaaacccacagugaagggggagaacugacuccugaaaguugucaucugacccccacagcuaccauagagaauaaaaaguaaaugcaaaaguugccuaugauaagcaauaagcuguaauuagagaaaaauggaaggccuacauguaagacauccuguuccaagcuucugcccuugggcuucccgcuguggaggauugacagaagagccacugaagacagucccagaaccuaaacggcagagcucgcugaggccggaaacucaacauugcuguccuacuaauaaaucaugggucgucagacagacggcuugaagucuaaguucuuuauauuccucuagccuugauaaaugaauaugcauguauuugcauacucugcauacauguuuuguuuuguuuuguuuuguuuuugagacacgguuucucuguguagccacgguuucucuguguagcccuggcuguccuggaacucauucuguagaucaggcuggccucaaacucagaaauccgcuugccucugccucccgagugcugggauuaaaggcaugcgccaccacugcccggccuacauacauuucuuauaggacugauucugagauauauugauauuccucuagccuugauaaauaaauauacauguauuugcauacucugcuaacauuucuuuuaggacuaauucuuagauauaaaauuaguggcucagaauguauacuuaguaccuauuuuguaugauacauucugucagguuguuucaagaugguugccuaguauuuaagaccuaucugugaucugccaaccuaagcaguuuccuauuagaucaagaaguacaauguucaagauagaaaauacuuccagcccaguggcucaagauugcugcuagcuagucaggggcuuaugaggcacaaaaaggaagguuuaggaaauauguaguuacucuauaauguucccgagccucugccacgagcagacucuauaccagccucagguugaagggagcucugcagccuccugaggaugagaaagagugugugggcggggaaggggggcuagaaaauuaucagaggagugagccccaagaagaggcuccaagaugaaguuagaacaauggcagauggaggucuugcccauuggucagauugauugaucgaucgaucgcaugaaacgugggugccugggaucacaagcuuggggcacguguucagcagacagauaagauaggaccuguggugagagcacagggacucaguuuguaccuuuuguucugucuccuugucuguuuauuauuagagucacccauguuguguaggaugggggggcauuugcuuaagcccuccagugaugugacauugucgacacuguuagcagcccccccacuccacccccagguucuuguaaauguguguggcuguggcuguucacuguuucccccuagugguuaucccagaacccugugccaggguagcagcauaagauuucaagugaaaaacugccccgaggggaagguucacugcucucacauugaucaaaauguuugucagugacauugcuaaagcaaggagcuuauaguuuacuccuguugaauggaagcugggugaguauggcuaguuaacaggacagacgagcaaguaaaugauucagaaggcucuccuugagcuaucgaaaccaacaggaaaauuaaagagguuucugccuuaacgcuuggaaaaaguaucugcagccccuuguuggccuuucuaggacaucaagaaaagucagcagcucacuggacgggcaggcgggagaugcagcgcuaaccuagaucccugucaccucggucuuuacucugucugcugaaaauagcccggguuagggcucccuugucccugggucuccauuucuuccucuuuaauggggacccugaugaagauauauuaaugcauccucacuaugagcccuuguaagagcaucccagugguaucuuuuuaagcauacuauugugaguuuaaccaccuugccccucaccugccacaccccugcacuuacuuggaauuuagcccuaaguagaaguucgaauuagaagcaugggguuggaagcuaaugaagagccgguucuuguggcccagagaugaucagaccuguucccauggagguaucucucucuugugauguaaccgaugcuuguugauaaggaccacacugcagaguugaggcuaaucaugauuuuccccucguuguaucuuaauagcucauuuuggagacuuuaauucuucaauacaucauccaggcuaucuugccgacagccaguucauaccagaucaaaaugaugacuuuuuaagcaagguggagucacuccaugaacagcacaggugcggggacugggggguggaugugggggguugggggaguggggacugggcuuaggaacucaagcucgcucgguauuuauagauaaccucccucuuuguguuugaugccccccuugccuuccugugguuuccuguauguuuaaccugggauuguggcaacuguauauuuagcaucaauugugccuuuuguaaagcauaaaaaugcuguaggaauugaggauguuagcuggccuguuccuccuccaagaugucaucgcccuugguuaauuccuuaaggagaugcccguuuucaaucugauugauuggccuccaagcugauagagccaggcguacauuuuagccgguuaccccauguaauaaaacaggccauucccucugguguuguugaguggagagacggcuggacuggcgagcugacugauggauggggugggugguccuggauugagacugcuauuccuccacauggggaguugucuucggacaagcuuugccucuaccaaauacuucccacucccagccucuucuucccacuccucacgugacccagugcuacuguggcagcugcucuguucccauuaaaugaaaaccacgcugacccaggccagcccuccagagacaucucaguucuugggaagggccauaaaaacaaagggcaaguuagcagcguaccuucucagagggugccgccagcccuuucucccggaauugcuccugggacagaagucagcauccuaaaauagcacagggccacuggcuuuugaagcccgaggccacuguugagagaauagacaggcagaaugaucaaagauuaccuauuaauugagcaacaugguacgaugagagggcaggcaucuugaaaggugauagacaguuuucacugucgggagaccuccggaagagcccaccaagugggaagaugucuuaguaaaaaccuagggguccagaggaggucagguuccauggacaagaagaaaaaccugcuucauuagcauuuaaagcuagagugcuuacgggggacuggcccaaggcacuuaguaacugcuaauaacuuacagaggacuauuacaacauuuuuuuccagguauuuuuaacuuuaaaagcucaagguuauauucuccaccuauugggugaguuuugcauuuccucuuuucuucugcagugggcuaaagcagucggaagccgaaucuugcuacaucaacauagcucgaacccuugacuucuacggaguggagcuucauggaggcagaguauguacccuuuagcucagaaacuauuuauuauuuuuaauuauguaacuucgaaaccuuccuugggggauuguuucccucccguuaucacaaacaagaucuuuuuaaaagcuauuuaggggcuagagagucgccucagggguuuaagacacuuguuccugccgagaaccuccagaacccacauggagguucgaaaggugcacagacauacacgcuggcaaaacacucacgcacacgaaauaguaaagaaaacaaauauaauuauuuuuaagagagauacuugaauguauccgggucuuauuggccauucaguugauguuuuccccacacuucugagggaccaggguguggaagacuuacaagcuuucaacauacugaaugaugauggguuugagggcugaagcugucucuuggcugguagaaugcuugucuaccauucaugaggcccuggguucaguucccaccaaggaggcaagaggaucggaaguucaagguuaucuucugccaccuagugagacugaggccggcguguccccucaucucagauguggggaggggugguguuuacuuccauggaugcauuucauuguauuuuguucaugcuuaaccucucgucacccuccccugucucuccucccccuggccccccuucuccccucaaaugcucccucuucuacauuuacacgacuauaaauccauuuuuaaguggcuguuggcugagccaagguuucuacuacaucuuaagcaguacucagauuagagcuggcugcucaaauacagaaacauguauauguuuguguaugcuguguguaaguagugugugugcugcuugugugugugugcauauauauuuguagguauagcuagaugcaagguacauaaugacuguggaggccagauguuaguccccuuaucguucuuuuuuuuuuuuaagauuuacuuauuuauuuuauguaugugagugcacuguagcuguacagaugguugugagccuucaugugguuguugggaauugcauuuuuaggaccucugcucacucuggucaaccccacuugcuccagucggcuccacucgcucaggucaacuccucucacucagucccugcuagcuccgacccaaagauuuauuuauuauuauauauaaguacacuuuagcugauuucagacgcaccauacaagggcaucagaucucauuacagguaguugugagccaccauguggaugcugggauuugaacucagaaccuucggaagagcagucagugcucuuacccgcugagccaucuugcuggcucuuuuuuuuuuaaggagugcaugucuuguaccucacuucucauauacucccuuuuaaaaaagaacuauuuauuuauuuuauguauaugaguacauuuuagcugucuucaaacacacuagaagaggccgucagaucccauuacaggugguugugagccaccaugugguugcugggagucgaacucaggaccucuggaaaaacagucagugcucuuaccugcugagccaucucuccagcucccucccccccccccccccccccccccgaaacacacaccuuuaucuuuuaaaacauguaucacugaaccugauacucacuuccuggcugcccaguaagcuccaaggaucuacacgcaucuccauuucagugcugggauuacagucaugcaagaccgugccuggaggcgaggaauuggaacuccaacccucacauuuccacagcaggcacuugauugccugagcuggcugccagcccuauucaauuauaauaguuuuguagaagaaauuaugguggcaugauugugagauugaugaauaguuuacauuguuauuaguuuagaagacuaauacaugucaucugcugggcaaacuucuguguccggguagacaguuucuugcaaucauuccaucaccuaggggauaaucacuuuucccaccuuauagaugggagacugauucucugguaucacaaaggucacucagcaccuaggaggucagugcacgggcucagcacuggcugucuuagucaccuucacugcugugaagaggcaguuuauaaaagaaaacauuuguuauagcucaugguuccagagagaguucaguagugagcauggcagcaggcagcugagagcuacauccugaucaguaagcaugaggcagagagugugugagaccuaacugggaaugguacugguguuuugaaaccugaaagcaugcccugcccccagugacauaucucuuccaacaaggcccugcgcacguacauauguguauuuugugaguauggaggccagaaguucaucaugaaaggaagccuggugggguuuuagccuggugccuugugcagauacuuaggacuuccucuguaucaauaccacuucccuauccagucucuguaucucucuuuguuccugaguuacuuguaagugauggccccaccccaauagaaaguaaacauuuguuauaccugccaagugcccaugcauauccacagaucuguuauuuauuuuauguagguacacugcggcugucuucagacacuucaaagagggagucaggucccauuacagaugguugugagccaccauaugguugcugggauuugaacucaggaccuucggaagagcagucagugcucuuaaccgcugagccaucucuccagccccugucuguucuaggcucuuauauucuguacuuuaagccugauacaaaccuuuuagggggauccaaaaauguuuauaauguaaaaaggggaauuggagggguuccuaagcccuggauaacauaggcuaugaggggaaggccagcaggucauacucgugacuggcccugcccaauguuuguacuuagccauaccugauuggaaacagaaauuaugugcgacucaaggaagcagcuccgucccuuugaauguuauuugcuuauacucaaguggauuuaaaaccguuuuaauccucuccguuuuccuucuguguuuguauaauauauggcagugccaggcacacaagcccuuagccaguauaauuccauuggauucauaaguaacauuuguuucuuaauuggauuuagagucuugucuacauguguaaucuuucuucaucauuucacaauagcuaaagcuuuuucaguaauugaaauugagauuuguacggagcuauaugugggagaggccuguuugagucucaugugggucccaaaagcugauguuugaaaauucaagaguguuuauaugugacucuguggaguacguaaucauaucugguaacuuccuaaaccagguaucaugccgcgcgcgcuugcacuugugugugugugucugugugugugugugugugugugugugucugugugucugugugugugucugugugaguguguguguguguguguguguuuguuaugugcuguucacuuuagaagaacuagguaccaacuacuuggcugcaaagcaagauuuuuuuccuguguucauggcguucccccucuugagcggacgccgcauacugcuauuuauaaaagcgugggugcuuuaaaguuagcagaguaacacacugugaaccuggacgcuucauuuguccccucaggaucugcacaaccuagaucuaaugaucgggauugcgucugcaggcauugcagucuaccgaaaauacauuugcacaaguuucuacccuugguaaguacaaacacuucauauugucugaaucaugcuauaaaaauaugccgagcaaaagcaaugcuagcucuaauuuuaaauuuuuauuucugaagaauggcuggaacuccacaguacuccccccuaucccucccccuuccccuccccccaguccuccaaguuuuaagcucugaacucugaauuugauccagauugggcacuuggaagaguuaccuuugguuuucauuaacuucccuccagucguuguccugugguucggcuaguugguggauccaugacauaaggcaggucuuguuauugagagauccucccauccucuuguauguguauggaauuaguccuagauucugguaacccugcaccugcaacuaguacuaaguguguguguguguguguguguguguguguguguguguguguguguugguuuuuuuguuuucuccucuacauacaugccugugguaaaguuuaauccaugaauuaugucaacuaaauggucucucucucucuuaaaagagucaaggccguaguguuuucaaacugugauugacuccaggcaacugaauguauagaaaacaagaguugaagugggcgaggggagacccaauuggcuuuucaagaugaguuugaguuuacugugcccaggcaauggagcuuucuuugggaaaauauuauaccacccagaugauacauuuuaauaaaugauaauauaagcgagugcaggcagggguggggcaggcugaagagaacaugugcugcgggcugugagagaugcggaaguacgcacaugcaaagaaaagcggccacacggaaauuuauagacagggcggaggagauuuggguggcagaguuguggcagacuagauuugacauuagguuuacgccuguuucucaguuugaccacuuagaacuucacaaauggagacaggacagaguuuauugcagcauuauuuauaacagggacaaaaaccuauaaauaaaguuacagggaccuuaaccaugauagcagcugucauauuaucgaguguuggcaauauccaagucgcguuacucuguauuuuacuuaccucacucaagccuugaguaaaccguucuuaucccugacuucuccgcagagaacgcuguagaacaaggagguuuguaagaccugucaggcucugcugcuaauaaugguacauuugaaagucacauccaguuugucacuccagacguguuuuauauucuaccucucuuagcuguguuuguggggacaugcguaaauaagauacuuacagauacugguuuucgauuaauuuuauguauauuugauuuccagcaaaaugugccaugguccugcuuaguuuuaccauagaaucagucugacagauaagaccuucuugagcccucgcuggaagcaggaaaccccagccacggcuucaccagcuggguguggccugccgaguucucugggccgcuuggaacaaaggaccaggcggugggcgcgggccugauuuucucuaagugccucuaauccucuaguucuguaacccagaugccaccggagucuaguuccauguguggcugaaucuacgagggucccuuaagcagguucugaacaucacauuuagaggcagauuucggucccuuaaggauacuuuagauuccugauaaggauaucugauucuggauauccuuaaagauauccagaagccaaaaacuucacuaagcagcuuuguaaacagaagccuuugcgucaggccugacagggccucucggcacaccuccucaggggcucguucugaucaucuugguuauucuucagcuucagacuggcuccagugaaagccugucucugaugcccgugcucuauuaccuacuuuuuauaacacugugacacaauaauagaaagcagcgacucaagggaagcaaagcugacucacgguucagaggauccagaaugccgugcaggugacguguggacacuugaacgggauggaguguucaaacacaagcaccucagaccccaacucuaacaagggagaccaguagaggucagcccuggagagugagcaagggcaggguacagaagggcccagagccuacagaagugacucuaaagagagcaggcuuuggccucacaguguacauucuagaaagaagguacagagagggaacagggagaacacaguggucaguccaggguaggugggugauugaggcuagagcaugcggugccuuagccagcgacuagagagcgacuuggccauggagagccucacaggacaccagaguagacguaaugguagaugcucuaaugggagcaagauucuccugcaugcaguggucaagaggcuauggcugugggcaucauuugacaccugucuccuucguuagguuguacauacccagguugcaguaccuccuuacugucuuguucuuucugucccugggaccuggcacaggacuuggucccucuagacacacaguccauuucauaguuccugugacugaagggcaguaggcagccugauguaggacuuucagucuggaaaccacaucugcauccuucagauuugcucuagugaagaacacagucagagagagagagagagaguugaaagcacugagcagaacccucugaaccaggggcaccagcagggccccccuccccauaugaagccaguagugcacaagcagucugugcccagcaagacaagggugggaacucacacacuggugagcagguucucccgaguccugugaaauaggaauuccugugcuugcccccucaacacuuagggaggagacguggucacugcagaagaacgggacauaagagccuucugguuuggccugcagucauucccaaaauucacuaguuaaacaaauguaucugccagcagauugcuuauaauggguguuuuauaauggaaaugugcugugugugugcucugugugucugucugucuaucuuccgcuggggaaauaucacuugaauaaacuuucccuuuaucuacucaaugucucuguucuaggaugcucuuagcaaggucuugguaugaucccagagagcagucgauuuccuuccuuccccccaguacuguguagauuauagucgcuugucauggugaauaaaaccuauuuaaaaggugagcuggcacugagcgugguggcacacauuuguaaucccaacacuggugggucagagaggcuaaccucugaggucgcuggccagccagccuagccucaugggauuggugagcucagggucaaaugagagauagacccugucucagaguaagguggacagcaccugaggaaagacaucgaaggccuccacauaugcacccaccagaacacacacacacacacacacacacacacacacacacacacacacacacacacugguuucauucaucaguuuuagugguguaccauaaucuuauaagaacuuggcaugcuuacuccaucuaaauugucauaagaccguggcgagaaaggcugucaugggccaccacucagcagauaucauaggguccaagauccuaggcuuuggaggcugagcucuaacagugacuccaaacagugacaucucugcaccucagcuuccucuuauagaggauaacuacauacuauucuggacuguugcaaaaacccaguagagacaguguuuauaaagcccuuggcaguggccugguauaugaaaauauauuuggugaugacgagugccuuuuauucuguauuaugcacacguggcuguuaaguaacagagcuggggcgcauccaggccuggccauacugcuccacacugcccucagcugucuucccccauguaggcaccagcuccugcagggcuucagugucacaaagagacuuacagcaaagagugcgcauggcccacgcuucugguuauuuaaaagcugccucacaauccagaggccccguggagauccagcucggucagcuccuugaguucugccaagacagacucccaguggucugccgucucuggaugaugaaauagaggacccgugcagaagagggucagccauagcccggcugagccccgaugucucuguuugauuugcaccuugcuuuauuuuuugugcuaugcgugguuuuguucugcuuugcuuuuuacagggugaacauacucaaaauuucuuucaaaaggaaaaaguucuucauacaccagcggcaaaaacaggugaguuccacuugcuguguuugcugcuuuguugagguuuguccuacucucagcuccucggggauugcuuucugugucuuuaggaagaaaagauuguggccgucaggucuucagacccuguggccaucucugugaguugguuggugccuguguggagaaugaacuugcuuuauagucagacucgagguguagacccugccucuucccccuuuaacagcugagcauuuucuuucaucuccucuaguccauauucccucguuucuagaagcucaaguaaugagugcccaccucucagggagcuguacggauuagacaaaagggcccaguuugggcaccuagcagagcagagcaggaagcguccacauggcuaaguuccaaaagugauagcuuguuacggacugggucuuacaggaggaauuggcaggauccuagacaacucuguuuguuugcuuagccacagcacaagcacacucaguaaagaagccaaggcucccacagccucagagugaaggagcuggaauuugaaccaaggcgccugcccuuuccacaccacgcccugucuuguuaugcugcauaguugucaccgacugccccagcuuuucaaauaugauaugcccuuagacuggccccacacagagaacggacccuuagaaaugggaucacugaagcucaaaguaccaaggacuggaaccuagacugucugacuguccuccccccaccucuagugcacagggggucagggugggagaauauuucuucaggaaagagauguucacaaaagcugagauuuaaguuuucacauggcagcagcaaguaagcccucucuugaacuauaagcagguuugaaacagugacuguggaggaccccagacggugaggagacauggguucaggcuauuucuaugaccccacccauggaggguucacagcucugcuccaaaaaaugauuccuaggacacuggggugcaucugaggugucuggaggccugcgcccuuccucugucacaucuuccccggcuuuuacagauggguagcgagccggacacacuuuuaucauccuaccguuuuccuguuccuccucccaggcugaauccagggaacauaucguggccuucaacaugcugaauuaccgaucuugcaaaaacuuguggaaauccugcgucgaacaccauucguucuuucaggcaaaaaaguuacuaccucaggaaaagaauguucucucucaguacuggacucuaggcuccaggaaccccaaaaagugag

SEQ ID NO: 1918 - RNA, 1306 nt, Mus musculus
aacuggcucucugcuccucccuguuccagagacagccgcaucuucuugugcagugccagccucgucccguagacaaaauggugaaggucggugugaacggauuuggccguauugggcgccuggucaccagggcugccauuugcaguggcaaaguggagauuguugccaucaacgaccccuucauugaccucaacuacauggucuacauguuccaguaugacuccacucacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaaagggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaauuuuggcauuguggaagggcucaugaccacaguccaugccaucacugccacccagaagacuguggauggccccucuggaaagcuguggcgugauggccguggggcugcccagaacaucaucccugcauccacuggugcugccaaggcugugggcaaggucaucccagagcugaacgggaagcucacuggcauggccuuccguguuccuacccccaauguguccgucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagaaaggcccuaucccaacucggcccccaacacugagcaucucccucacaauuuccaucccagacccccauaauaacaggaggggccuagggagcccucccuacucucuugaauaccaucaauaaaguucgcugcacccaaaaaaaaaaaaaaaaaaaaaaaaaaagaauauaacaaacugagaau

SEQ ID NO: 1919 - RNA, 2657 nt, Mus musculus
ucagaagggcagggauuuuuauuugaugaucuugcccuaaguguccagaaccauuguggaccuuagaugaugcuucuuaaguaacuuaagccgugaauggcucuguuucauugucugcacuuggauuucaaacuuuuguuuugucuccuuagcuaugcuuguuucagguuuauucuuaacucuucuuugcaaagaagggagaucccccuugcugccuggacuaauguccuacucauccaugggaaacuguuuuccaagccucgggcugcuuggggauguugucucuaagcuccacacgcauccuagaaagauuugaacuuccucccugaucucagcuuugcugggcagagcuaagccugaccugaagaguuuauuguugcuguuauuacugcuuugagaaaagaucucacagugcccaggcugguggagaacucagccucccccaagugcuggauuaagauaauauuuauuauagaagugugugggcuuauaaucccagcacucugaagauaggaacauugggaguuuaaggucaucuucugcuacauaaugaguugagaccagccugggcuacaugauacccuguaucaaagcaaaucgugugugugugugugugucuagauuauaaggacaaaacaagaucauguuaggcugggauuuaccugcuguaaauuuggguuucaacccaggcuucccgguguaugacucacugcauaaucccugcuccagccuggaccaucucccuguccugaacguccuguuccucuaaaauguucuccaccgugccugccuacagaaaaauuacucaucccucugggccagggcugccacagccugcucucacccuugccagaguucauaucuccuucacauccacgaacucucucuuuucuauucccauaagaaaaaccuugucaucuguccagcucacuguccacaggucuguccuuuggcuaaagguaacuugcuuuaggacaaggaagcugccccaugagaaagcucaugaccaccacccgugcuugcuuauugcauggccucacaugcaaacaaacaaaaauguucacuggguacucauuggugaagaaaaauaaggcugugccagguuuccaagugcccacugccucuucucacuccuuagucuagggcaguccuugggcaaugugaugugugaugugugaagaacagaccuuggucucaggguuuaugccagcagaggccgaauaucacucagucuagaauaagcagaagggaauguggccaugaaugagcauggaggcacccuaacauggagaaaaggucacuguuccaaaggcuaggaccucugcuuccaguccagugucacugccagcugugugagcuguggccuguggggagcuugucccuucccaaagcccggcaacuucaccuauuuuagaagagcaaugccacccccuuccuuaccccuuccaccaggugugugcguguggugaagggaaagccauagcaccugugugcuuugcuguccuccugcagugguaaggacaggacacauggcacacugcucuuugguaauagcucuguaaacacagacaguaggauucaguaaauguagacuaucggcuggaaugaacaauccaggaaaggcauguuggguggaguuccugaacucuaagugcuagaaggauucagcuuugccucccgucaaaaacaauucccagggguagcgagauagcugauggguaaaggcgcuugcuaccaaauaggaggaccugaguuugaucccugggacccagguaguggaaggagagaaauauacuccugaagguugcccucugaccugcacacccuugcagugcauagcaugugcacacacacacauguaaauaaacaaaaauauuugaagucgcaauucugcuccccuuuuacaccaucaaaugcagcccgaguuugcugcgaugaucgaagcgacugaaugucacacugcagaagcagaaguaugggagcgguuggcgugagagaggcuucaggauugcccaugcauccugaagaguuuauucaaccccuaugugguggcaugcccuuuguaucagucagcuuucucucucggcucuggggcuguaauguguagcccagcaguggggugucauugcucauaguucuuucauuauuucuauuuuacuggcucuuugauuuuuauguagccaaggcuuaccuugaacuugcuaugcagccaaagauagccucccucucccaaguucugggauuauagguauggcucaccauaccuagcuuguuccuauuuuauauuucuauagguguaguuauggauccguucuauguagcuucauccuaggacucaggaugggaaaggcacccacauguguggugcauggucacugauagaggaguaaaaggcaccggcagagccacacgugacucacacaauucacacuuggcuaugccaccuguuguuuauguucccuugggccuggcgugggagcgauagggcaauccacccuucccaugaaguaacucugaaaguuucuuggcauggaaugagcauauauaauuaucucaugagggaugcagaaaacaaugagaaggacagcgcagugccacaaagcugucaugaguagugucuaauauuaaucuucuaauaacccuaugacauaucucug

SEQ ID NO: 1920 - RNA, 8133 nt, Mus musculus
guaucgguuccacacacaugggcacacacauuuguauauaagacacauacaauaucagcaccagaaaacaauuacaugugaauugagaagaaaaaaaauuaggaccaaaagacaaaguugguuuuuuucagaaaauguucuugaauuucauuggaguauuaaaaaacaacaguauugaauuuauuguuuaccgaaggaauagaagugacuuccuaaaguuaaguggugaauugagacugguaccugugauucuccuggaauuuaggcaccuggggaguuuguuuacaggcucaugggcucugaggggugggaguguguguguguguguguccuuggacuaaguugccaguuucagggacaccagaggacuaccugugcugacacaucugcccaccagacaccagacugggauacuagaggggcuacucguggugacacauccuacagauguauaauggauacaccucaacuagaagugcccuuuccucccgaccccucaaauccucagagucccaaauuccuacucuagaaugcucuucccucccucugcuacccacaaaucagagagagacugaccaugugacuugccccuuccucugaaacccacaggauaggggaacccgcccugguuccugugccugcauccccuucggagccccaccugcucaugucugucuauccaucaguuccugguguucuuuuggguccugcuuuucaggaaggaccugagugauccuacaggcugcaaaggagguaguuuguggagauaccgaucucccaagcaggaggcuccucccuuaggcugcgauuacaacauuacuacuuucaacaccgacagcuauuuugguugguuuguuguuuuguuggagauagggccucacguaacgcagucgugaacucccgauugucuuuuccuccaguggcugggauuccacacauuugccgccacaccuggcuaaugauugguggauuuuagaaagaaguuaauuggcagaagagaacacggauacaaggagugggaaaaaauauauagaaggaaaagcugacaggaaauagguuuguagugaagcugggauggaccaucucagugaccagugaaagaaaccauccuuuucccagagacuccuuaaacccacagauguuauuggggagcugucucacccuuuuuacccaggccgaccacagucugggaggcucaagaugggaagaugugagcaccacuacuaacuggauggucucuaaguccccagacagaagaaccagaaagaaaggugcuaaguucucagagacccucccagcauauacaaagaaucagaaaguauuggggaaggggaggugagcuccuauaacccuagacucccagacacugugaagauaucccacuggcuaaagguccugcuucacuucugggaccaaggauuguauugaucccagcuacagaggcacaucuauaggguuacuuagugacguuucuuauaagauuaaaguugggcuggugguuaagggagcacuuucauccuggcgguacucagucugacuugggugaucucuugaguuuagaaggaaaauaaacguguguccaugaagaagcucacuucccgugauuccaaaacugagguggcccaacuguugcucauuguacagggcucugguugcggcuuugcgugguuccucguuaguggccacagggaugagauaucagauuuaguggaaagcuucagggugggccauauaagcccagguuccgggcagcuugggagauccugggugguuuccucuggggaaauggauaguaagcugguuuuccagaccuuaaaugcuuuguggaagaaagauacugagcucuagagccugcuaccugcaguggggcacagcccuccugacuuugacacugggcuaccucugggauuuugacuuccugcugugucuucugauuguuuuucaaaacaucagugucucccucgggugagaaccuugguucuggcuccacaagguaucccuugggguucccuuggugaccggcuuccagauggaagguuugaaccaagcgaugcagcucuaaguaugugugccauggaguuucagaagccugauggcagcuucuguccccuuccuccagcauccccucagccucggagucugucuccucuggugacagcgagcuccuucucuccuuguuaauccaaacagcacuggucaucgauucagccggaguaggcauggucccuucuaagaagagaaaggacagcagcgucaucauugggaggucugccuuugaggaaaacucauagcuuucagauuaaaggaaggccagacccugaaugccaaggggaccagauacccagaguauuacauaugugaacccacacaugcaaacacgcaugacccagcacaugcacucuuccccaacauauaauuauaauuauucauaaaucaacaaguauuuaccaaacacuauauacaaggccuuguuuaucugagguuccauguggugaaaauacucacaaccuuaugaauggguccuacuagaggagaaagacagcaagcaaauaaauauaucaaaaauucaggugcuaauuggaacaugugcagagagugagagauuuugucacucauucauacaugggauguuccgccaggcccucucaggcucagagugcuguguggaagaggagucaggaagauuguaagaacuggaggagauggauggcuccaaggagccagcauccugcagacacagcagggcugaggcacacaugaacucgcaggcagcacgcacagcgcaugcacagguucaagucagacagggucccagugcugagagagggaggcagacaggggcacccacuccuaaucaucugcaauggguacacacguacauagaaaaaaacauaagucuuuuccagugaugccuuauuaaucacauuucuggguaggccccaggcccagcaguagauagccaacacagaggaauuaugguaauuauccgugguaauuauguagacuuuucucauauugcuuguuuggcugguuuuuuguuuuguuuugguuuuugguuuuuuuugucuuacuggucuuuugcuuauauauguugguuuccacuuuuguguuucugugaguuuuucuucguaugugugcuuucuuguuuguguuuuaaagagagaaagaaagggcuuggagcugagggaggaggaaaaaugaucaaaauauauuguauggaaauaauuuuuucaauaaaaauaauucaggcuaagaucaaaaacucaggugacagcagaugcuggcgaggauguggagaaaagggaacacucccccauuguuggugggauugcaagcuuauacaaccacucuggaaaucagucuggcgguuccccagaaaauuggacauaguacuaccggaggaucccgcaauaccuccccugggcauauauccagaagaugucccaaccgguaagaagaacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggaggguaucauccugagugagguaacccaaucacaaaggaacucgcacaauauguacucacugauaaguggauauuagcccagaaacuuaggauacccaagauauaagauacaacuugccaaacgcaugaaauucaagaagaacgaagaccaaaguguggacacuuuacccuuucuuagaaaugggaacaaaacacccauggaaggaguuacagagacaaaauuuggagcugugacgaaaggauggaccaucuagugauugcuauaugcagggauccaucccauaaucagcuuccaaaugcugacaccauugcauacacuagcaagauuuugcugaaaggacccagauauaccucucucuugugagacuaugcuggggccuagcaaacacagaaguggaugaucacagucagcuauuggaugggucacacggcccccaauggaggagcuagagaaaguacccaaggagcuaaagggaacugcaacccuauagguggaacaacaauaugaacuaaccaguaccccggagcucuugucucuagcugcauauguaucaaaagauggccuagucggccaucacugcaaagagaggcccauuggacuugcaaacuuuauaugccccaguacaggggaacgccagggccaaaaagggggaguggguggguaggggagugggugggaggguaugggggaccuuugggauagcauugaaaauguaaacgaggaaaauaccuaauaaaaaaagaaaaagaaaaaaaugaauaaaaugacaauuuggaucaaaaaauaauucagcuguuaaucaguuuuagggaaaaacuaaagcauaaaugacggucaaaacgucagugaggggacuggagagauggcucgguuguuaagagcacuggcugcucuuucagaggacccagauucuauucccgcacccauauggcagcucacaacuuucuguaacuccaguuccagguaaucugacaccuucacaagacagacauaggcaaaacaacaauguacauaagauaauuuuuuuuaaugcuuugguucuaggagaauuuuagugucauuucaaaacaaagcaaaaccaaaccaaaaaccaaaccaaaaccuuuagugagagugcaugaacucucucuuggaagaagugagaguuaauauuuaagaauagcaaggguugccaggaggugauggcacacaccuuggaucccagcacuggggagacagaagcaagcagaucucuaggaguuggaagucagccuggucuacagacagcuaaguuccaggacagccagagcuacacaaagaaacuuugucuccacaacccccucccccucauaaaaagaauggcaaggaucaaggauauacacacaugcacacacacaauaccauacacacacacacacacacacacccugcugugauuuagaucuuaaaucucaaaaauucuuugcuaaaggcuuggucccaggguuaggaugagcauccuuaagagaauguggaagaucuggaaggugccuacucauaggaaguuggaucauaggggcacacuguccaaggggguacugggauaccagcaucuuccccuaguuuuuguuuccuggccuccaggaggacagcacugucugccaccacaugcuccuaccaugcuggucugugcugacaaagauccaaaacaacagguccaaguaacuggaaugaaaguccugaaaccaugagccagaauaaaccuuuccuccauuuaaguuuacucgucugauacuuuguuucaagauguaaagcugacuaacagacuccucucugaacguucuccuuagcuuggggggcggggggggggggguugugucuaggcuuccaauaaugauuuaaccacccaagacagagaagagaguccacggucacuuuacugagaugcuuucagugucucuuucuucucugaacagggcuucuaagcugcggcugcagacagaugccucuuccuucucaaggauuuuuuuuuuuucacuuuguggaaugugcuaguucacugugaacuuuuagagcauagggaauuguuugccuacagaaaucagauccauccugagcuggaaguccugaccuggcacuuguuagugcccucauugcuaacaaaguagaguuggggggggggaugguacuggaggaaugacaucaucaggaaggcccucugagucccagcuugauacauccaaaagaaucagaggaacuagaagagcagaugcagccaguucugcacacaggugcagccuuccuuccacauggccccagggaugagggaugaucugcucuggugaugacuucacuuccgccuuuagcauggcaagcacaccagucuacugaauuagauacucugcaggaguuagagaacaaggaaagagggggaggaaaacauaggcauccgcucgcucuccagucuaccaggagagggcucuggaggcugggagucaggggagggguugucauaaggccaggcaggucuucagaguaggaccuuuuaacuuucaguuccaguuccagucuauggucauacaggacaaagagaaagagaagcacacacacacacacacacacacacacacacacacacacacacacacacacacacacgggaagagaaggagggaaggugggaggaagggagggagggguccguggccccuagccaaauagugaaaccuucugcuaaagcccuagacugcaaauccuuuagcauaggguccuccuucaagcaaaugagaauauucaggagcacagacaaguuuuacacuuguuuccccuuccuuuuaaaagaggcuuucaagauuaauuuuauuuuugcacguagaaauguuuuugccugcauguacauaugugcaccacaugcaugccuggugccuguggaguucagaaaaggauuggaacuggagcgagaggguugcaagccaccauguaggugcuggaauggaccccagauccucucugcaagagcaacgcugugaucuuaaccacagccccccaucuuuuaucuuuccaccggcuuugguuugguuuagucuggagggggcaugggggaagguaaacucaggcuuugucccaagccugugcagaaccgcucugugcuaaggugugauaccuaucacuguagaauguagaacucuuugccugcuugagcccugaauccugacucagccaguugcucuaaaauugggacuccccaucuuucuucugcaaagccauucucucuguuuugccuguggauccagucaggaggcugacucuccaucauccuacuuagccuaguaggagggugccaagacugcucaccugaccaaccagucaagccagaucagaauuaggggaaaauagacacggagaccaggaacaguggccguuggccaaaugcuuggcagagaggccucuguuccuuuggcuaagaaacaggcugggcacagccacccugaucaagcuuccguggcucggugcugacugggucagcaaacagcuuuuuucuuccucuccguggacuuucaguccccccgguuccacccacagaaguuccccccucugcaacacacgcccagcccuaccuuuagggaacaccauuaggugggccuggguccucugcuguuuccucagaccuucauacugggcacgaagaaacuggauguuuacaggaggcccuugaccuggcgccugaguccuggaacccucagccauuaagcagguccccaguuccaagaacuuggguagagcagggcacgggcaggccaacccuuucauccgcauccgggagaagagcaaacacugagggcugaggcagggggaggggaggagaaaagaaguguagacgguagcgugaaagaaagagaagaagaacagggagcaaggagagaagcuggcaagauacggggggagagagaaggagaaacggaagggacaagaucggggagguggggagaggaagaguggggaacaguuaguucuuaacuaaagaggaggauucggagaggggcugaaaagggggcagcggaaagacaaggagagaauggagugaggagcgguuaagagcagagaguggggugggcaggaggagaagguggggaggguugaagagccacagguaggaguugagcgagcgagggauccagcucagcugcugcgcucuuucucaguccagggagcuuuuauuccagacggcuuccuugagugauggucaagcuuagaaagccguuccgagggccaccgugagauuccaguuuccuggcagagccgagcuggucugaggagugccaggugccugcucaguucacagauuuugaacuugacuuagcaggucaucaaaaccugcuggcuuaaugagcaaccaccacaaaaaaaaagaaacagcuucugcaacuucaaaagcuggggcuccgauguguacaaggucacccuaagguuugaaggcagcccccagcacaccucucagauaaaaacuccggcauaaagucugccauagagacagag

SEQ ID NO: 1921 - RNA, 194406 nt, Mus musculus
gaggauaacaguucugaggacaagaaauacuggacaccggcuacucugguggaagagucacagcugagguaacacugccagcuucucauacacucagacauugcaagaggcucuccagaugugggaucccucaugcacuaagguuuccuugcaaucauaaaaauaacuucacacauugguuuuuaaagauuuaagugugugugagagagagagagacagaguaagugcucaagugugcucaagugcaaaugcccaaggggccagaagagguugucuccuaucaauuccccuggagcuggauuucagguggcugugaguugaagcagacucugguccucuggaaaagcaaugcaugcucuuaacugcugagucacaucuccagcccuacgaauugacucuaucugguuucacaacaucucaccaggcuagugaaauacagagguugucaugaagagagggagacacaccuguaaagcuucuaaauagaacauucacaaggaauuccuaccacauugauaauuacuuuaucacgugugcuccacauguugucuuaccuggguuacgcgaugggaagcggucuuuuacuacgcaggcuauuuuaaugguuuaaguuacuuguucucucgggucacuagaccagagcuuauugaaaaucuaagggcggaugccugaaucuucucagagcaaaguaaaggaaaucuuucuccucuagccuuuguuccauauccuaacuccgugaguuacguauucaccaugacuuagcacuuuaccauggcuuagcacaaucgcgaugacuuauccgcagucaugcagacugguuaagucaaagugauugacaaagcuaugguugugacuuggcacaguccacgguucuuucuguggcugcagauuaaacccggcucuaaugcacaguaauuaauuccuccagcccugagcuccaccccggcugugucgcauccccaugugcuauuuccagcuagugaguacugagcuacccuguguuaugggcacuuuguuucugagauuuuucucacuggcugcuuuauucucuuucaauaccccaaccauaguguuuuaaaacuaugucguuaaaacuguuuguuaguagucuuguugaacuuucaaaagcccacacuaggcccagucucugucugcuugcucucugaagaucaggaugugagcucuuggcuacuguuccggugccauuccugccugccugcugccacacucccccgccaugaugaucauagacuaacccucugaaacuguaagcaagcccccaauuaaaugcuuucuuuuaaaaguugucuuggucauggugucuuuccacacgaacagaacgguaaccaagauaacagacuuagccuugcgcuuccccaggucaagucugcauucuauaguucaagaaaccaagcccacagggucuuaaaaagcccaucccucaguccccauagaggacuccaaaguaggaaucccagagcuggccaaacgcucagcgauccacaugccuuuuauccuccucuacugauguauacagugaauggcuucccuucauguggucacaagaggauauuggaauacuugguggcgucuccacacuucgggcaggaaggacaaagagaaaaagaaucacgcccguugaauauguuucuuuuuauuuuaccaguaaacagccauuuucuuaaaagcucuauccucauuaggcuucugcauacuguuuagaacuggaacccaaccccagccauaaagagugagacagucauuugccugggcuccuugcugcacuaacaacacuaggguaugcaugcgguccagaaaagagagagaagagaucgugaugggcuggcagcccacaagucugccacuggaccuagcaagaaggaauaacuggagagugcucacaucagacucugugcucauaccaucugcugcuccaauuguuuuugccagagaauagaggaagccauaaccguccuugcccuaaaugggaaagacauguuguaaucagaugucaccccguggaccaacuaucagagaaacaaagcaacagucugaugguguccgugggaaucuuuccuugucuucuguuaagaagaugagacagaguguguugugguuucuaaacugcucaugugugacuguggaccuuggggccaaaggguggaguuuuucauaaccacuggcguuuacagcacauuaccccagcucagcuguuucucucucuuccuuuuuucucaauuuauguguuuggaaaaauauccauuucuuacucuucuuaccacagguaacuauucugacacguuccaguuguguguauguguggugcaugugugugcaccuguguguguguaugugugcaugcauggugugcacaugugaguguguguaugugugguguguaguuguuuuuuuguguucuuuuccuuucuucucaucuucuuuuuuucucuuuuguuuguuccuuuuuucaaccuucauuuuuucucuguuucucuguuauuuauuucuuuguuugcucccauuucucugucucugugucucugucuaucucugugucucucuuucuuuuggacagaguccauguuacacaagagcaggcagggcuuggguguugcuccuuugguaacuguacaugccugaggccccgugaagacauggucacaaggaauuugaguccuaacugacaccuguauuuaagccccucccucuccagagccuucucaaaccgaggcagcagcagacucuuaccuaagucccugauauagugcacucauaugaagucauuuaauuuuuuucuuuuaaugauccuuucuccaaauauauuuauagccugagcuaggaugggauggaaugaaugggggcagaauucaguccuuaccagagaaauugcguaaaauguggauuuuuagauugugggguauaaccuagcaaucaaaagacauucuauacuugaugccuauggagauaaagguguuagaauaauggaguucuucauacaagggugcauuauagauuguagucauggagcagaacaccagaagaagcaacuccagccuugaggaauuagugguuguauaccucaguuagggaauaauacgauacaauagaauaaacaaauaauaaacuauaucugucuauuuggaagaugucugugacauuaaaucagacuucccucaccccuuccaaaaaaccucgaggcuggggacacagcucaguggcagaguacagacuggacaucugugaggccugggguucaaccaaaugaacacauaaguaaacaaagaaauagaaggacuccaauuugguuaaaaaccagaaaaguccuuucuauguauuccugaaugaccagagcaaaggaaugaaaagcagucagugacaguaaaaaccguggauucaaagaagacgaaaagaagacggagacuaaagaaggggugauggcgacuaaagaguuaaaacauuuuugcacuauggcauggcuuaggaaguuagccugagucuuggugacccaucaaugaacaagucgcugagaucuggcacccauucucccacaggcugguccuaaggugagacacaaagauggaaaauaagagggacaggaagggagagaagcugaucgcucaaaaaccuggguagguucccuauggggaucagaaacuccaagauaaaaggucaaggucgccuaaggagaagguggugguggugggggggggggggguucugagcccaucaccucaagcaagauuguucaacgaauguuugugacuuaagaguuuuuuuguuuuuuuguuuuuguuuuuuuuuuuuaaugaacugggugcucucucugccgugagccugagcaacgguccucaggaagccucccuaacguuuccuuuacagaagggcggucuuuaggacagaguaaaccagcuugcaccccacccccuuccauaguuaagcuuaggugcaaauuauauucuuugagcgcugugacuuaggcauugcccgggagcauagauuucuaaauguucugcuuacauccuuacaucgaaagcaaguguuuucccucaccauuaauaaacuagcugucuuugggacuuaaccugaacgggauucuugaucuggggacaccaggcugcuggaagcaagcaaugcagacuccaucuccccacugccacaacuacauuuuauuucaccuuauucuuuacgaaauauauuuuuagaugccaugacugcacaccuucuuuguuaagguuucagagaaccuagcaccggccucacgacaggaaguagucagcagcagcagcuggcuuaacuaaugcuggccagaggugguaggauuuuuccugaauuaacuguguaguaguuucuuguuuucuuugcuucugaugcaaacauaaauugugaacuuaagcaaaaaagaaaaaaaauauuuaaacacacacacacaccccucccaaugucccuucccugcugugugugggcagaagcuccaaagcuuccagaaguugccccucccuggagaagccccgcccucaccgaccgcccaguauaagucaaguccugggcgcuuugcgaagcauucagagcggucucccgggaaggaguuucugugagcuuguguaaguagacucuacacuacucuauuugagcccucucuuuucucucuucccuccuccaaccccuucuuucuccccgccgagcaucuagagccugguugagcaagugagcacggcaggcacccccaauccaccccaccgguacucggcgacuccuggguucugcacuuaggaaguuagggaggccggggucgucucgcgguccugcacgcccuugaagagauugagacccgcacuaggaauagggcaaagucuggcugccuguuccguugugggugcauggagcgcgacugccagcacccaggaaggccugggcaacagaguuugcaggauugccaaacugauucaaaagagaagacagggguggggauuugcgcaugcgcagugaaagcuacacuugcaagucaggccauguacggagaggacccuuugcaagggggaccuacuagaccuguggcgacuucagaaggaccaggcgcugccuuuuuggaaaaagagacggaauuauguauucuuaaaacacaagggaaacccgccugugaaauagaugucuccgcgugugaaagugcuuaucacacaagucccaugacuugaguucgaucccugaaaccacggguggaaggcgggaacccacuccugaagucgcuuuaggcucucggugacacgcaagcgcccucacccacacaccugcaucauguacacacgaacuaguaauaacaguaaacuagauuaaaccugagcgagcaugccuguuauaucuuggcauguagaagcaagaggauggaagguuccaagauagcuucugcuauagugaguucaaggccagccuuggcuacacagacgggcgcuguaaucagaaaaacaaguugagcugggcagugguggcacauccuuuagucccagcacuugggaggcagaggcaggcggauuucugaguucgaggccagcuuggucuacagagugaauuccaggacagccaaggcuauacagaaaaacucugucucagaaaaacuaaaccaaaccaaaacaaaaaucuaagaaaaagaaaaacaaguugaacucaugaauauggggugaaaugauaguuauuagaggcugaaaagggcuaaaaguauuugugaaaggguacagaaacaugaguguggcucuuuaaacaauaaugauauauaauaauaauaauaauaguucaaaccaagcagauuauuucucaugaaaauagaagcuaaagaaggcgauggguauguuaggcacucuacauugcagacacuguguccuaucaagguaaguuuaaauuugucaauuaaaaaaaaaucuuacuuugcagggcaggugacauggaggcuggagagaugacucagacguuaagaucacuuguauaggguucgguuccgauuaccaggccacauaaugguucucaugaagcucggauuguaagaucacuaaggccagccuggguuucgagaacccacguugcaaacagcuacaagccaauaggaaggaaggguagggcuuuggauuggcucuccacccuauguccagggugaacuaacugguuagccuugauugcuuaucugaagaauucacuggggucccacgugaugauggguuggucuggguuucuaacccuugaaagcacuagcuccuuugucuguugguuuugccuggaggcaagaugaaaccaaauaauugauuuccaccuuggagccaaaaccagagaaaauuagauggagccgcugcgcccccuaguggcuaugagguccaugcuucuguaggaaaaagacaaaacaaaccuguggucuuugguucucuguauuugaggcuuuccugaggagucacagcaggagaggugaggaacugcaggacuuugcacguccauuaguuguuuaauguucuagagaaauuccagcauggcccggacagaauuuuccagguuacauuuuucuuugcuuugaguguuuguuuuagccuguuuccgcaucuacacaccugagucuugacaggaaaaucaugggaauaaaaugagaucagacacgugaagugcuuagcauaaugccagaaaguucucaaugaauguaauagaaugauaauaugcuaaaugauaauagggcuauguuucccagcuucagugcuaugcccaggggcucuaagauggucauugaguccacguuuaccauguucuagguauaccaggauggugcaggccaagagcuggacccugaagaagcacuucgaaggcuucccuacggacgguaacuucgaguugaagacgacugagcucccacccuuaaauaauggagguaagggagaucuuagugggggcugcaacaguuugcaucugcugcagaaaagagagucccgccauuugacuucagacaauaguuuuuuuuuuuuuaauuaguuuacaguucucuguguuagcaguuugacuaguauaaaagucucauugucauucuaaggauagcaggcuuccugcggcucaggcugccguuccgggaggccagauuggguuccuucccugcagugugguucugugguggaucuagaacagccugggguuggcaaacuccaaaguuugagaacuuuucaagcuucuacuuauaguacuuuucuuaaaaaucccauagaucuaaguaaguuguccagauuuaaaggcuggcaaauuccuuuuuuucuuuuucuuucuuucuuuuuuguuucuaucuaucuaucuaucuaucuaucuaucuaucuaucuaucuaucuaucuauuuuggcuaccucuuccucgccaugaucugagguaaccacugggcuacauucacagcccacagauuucuugaccggaaggccaggacacaguggugggagguauccguguccauuuugcaaucugccacauaaaucuuuuuaguuuuuuuuuucuuucuuucuuugaagcuuuaaugugcccuguccccagguaggaaguuucuuugaugcagcucauaccuggguauaccuggguaccuuaaccuucauggcuuugacagaggaggaagucuccugugucccugcaagucugauggugacagugaguugagcaguugugcccugccagagaccagacuaugagggcugucuguggggugccgcagugagcaagccuuugagaacaggaugcaggcgcuguucaugccagagucacuguccaaguuuaaggugcaguggccaaaacuuggauccagaguuucagaaaauacacaguuggaagucacucuaacaaaggcccaucuucuuugguauuccuugagguagguaauaaaacacgauguuuccugguuaguuuuucugucacguugacaggagcuagaguuaucugggaagaagaaccucagcuaaggaaaauggcuuugucaaguugccuguaggcaagucuuagacauuuucucuagaacauucuggaaggacaggucauagaggagggcucagcucacuuuaggcagugacaucccugcagaggugaugguauagagaagaaagcggacugaauaagucaugagaguaagccaguaagcaggguuccuuuauggccucugcuucaacuccugccuccagguuccuuccuggagucccuacccugaugucccuuuauaauggacugugaugggguguguaaggggacacaaacccuuccuuuuccaaguugguuuugaucauggucuuuaucacaauaguagaaagccaauuaagacacuacaugaacacuguccugagguaguuacuaauguggccuugaguaaguuacucaccuugaccuuaaauaggaugggccaauaguugaaaacagcaaacaaauggaucccucuaaaauaauaaaaguagcauuaucaucgucaccaucaacagcugggcugcuccgaauggaaaguccuucuuaucgucaguagagagcacggguggggagcuggacgugaagcucuugguaagagcguuucucucacaugcacaaggcucuggaguccauuggcagcacgguagguuuaauuaugaaugguaucuucugccccuaagcagaaagaguaggcucguuuauucagaaugccagaauauuguagccaccaggucuguaacuaugucuggaaugcuuuguuuuguagagguccugcuggaagcccuguuccucucuguggauccuuacaugagguacuauccccuccccagcuucuuagguugugugucagucaguguuuugaagcacugcagcucauguuuuaagacuggccuugaguaaaacaccaggcuucccuguuucucccuguacuguaucaguugaugagauucauggcuguucaucuucuauaggcaaggucagcucugcacagugaaguugcuucuauaauugaugugggggggagcggggggagccagccccaaccccugccauuuaccacugcaaacauugagcagaaguuacuaagacuaaaaccagcucuucuugucuucuauuuaccaguauuuuuguuuguuuguuuguuuguuuguuuguuuguuuuaauuaugugguccagaguugacucaaacucaugacucagaaaacacugaaggucaggaagggaauaaaugcccuucaauggugccucagcaauuuuuuuuuuuaacuuaaguaaguaauacagaaaaucaaucaaucagucaaucaaucgaucauauaggguuuuuuuuuuccucauagcuuguuggcaaagauucaacucuugguuuaaaaaaauaccauuuaacuguguuaacuagcaaaugggcaggguggcuagaaccuugagaagcugaggcagaaagaccacgaguuaagacucgucauccggagacuccacugaaugaagccaaaugguaauuaccauccuuucgggguugguugaucuugggguagcauuaguuugugcuguauuuugaaugccauugacagacacucacuuccaagcaaacacagugguaggacucucucauucauucguagaaugcguacuuuaggguccgaggcagaaacaccucccaccgucucucacacgguugugccgcccgggcagcuugggugcuguuucuguacacagugucccagccguuugccacuggcuugauacucaagcuguuuucuuccagcuggucucgcacacuaaggaugguuuuuuuuuuuuuuuucagaguugcagccaaaaaacugaaggagggcgacaggaugaugggcgagcaaguggccagguaauuugugcaauuguguaauugguauuuacacaaguccugcuguguggauaagugccuccucuggcuccagccugcugggccugccugcaucuguccaccugcugcucacugcugcucccuccccagccuuuguggcugugugguucacugggcgagaacgaagaaugauguagcccugaccaaggaccccgagcgaaaugaccuaagggaggaauggcuuguugggcucaucauuuccuaggacucaguauguggcucuugccucuuugauucugagccugaacugagaaggaucauggcagcaggagccugucgcagagucuuccuggcuccaggcaaacgggaagacaaagaaggauauauauagauauggaaauagaugaaagauauagauggauauagauauagaugauagauauggaugauagguagagaugauauauagaugguagauauagauauggauauauagauagacagagugagagcaccaugcuaauuugcuuuuaucucucuguucuuuuauuccaucuaagcucacagccuguggcagccuaugcugccuacauucaaggaaguucccacauuaguuaaccccccccuuauaggacauaucccgaggugcgcaccuacucaucuccuagguggcucucagccaggcgaguugacaacacaaacuaucauagacuagaacuguccuuucagccucuccaccauccuuacuuuuagugauauaaauaaagcccuauauauuuauucaugauuauugugaaaaucaaauaaauugaaauuugggaauggaaagguuucccucugagucaguuguuaaugcauuauuucaaacccuguuaaguacagacguuuauguauuuuugauaugcuugccagcaaacugguuuuuccucucaguaacucauacauuguuuguugucagugcauaaauauaccaucuguguuuguuaaaagcuagagauuauuccauuacauucuucauuuaacuaaaccuacuacugauaacaguuauauucaaaguuuucuacuacuaguaauuccuaaugaagcuugcaucucucugucucugucucugucucugucucugucucccugucucccucucucugucucucugucucugucucugucucugucucucucucuguguuauuguguguguguguuauuguguguguguguguauuguguguguuauuguguguguguguguguguguuauuguguguguguguuauuuggccacuuagacaagaaugcuuuauauuguguuccccaacguacaaauucuauacaaagauuauauguauguuuuuaauugugagcuaccuuauuuauuagugugugcugguggggugcaggcaugcaaggaccauggugcacaaacugagaucaggacagcuuccaggagucaguucuuucucucuuucuuacugggaucugggauucaagucagguucccuggcuugaggagcaagcgcuuuuacccgcugugcggucucacuggccuauacauauuuuuaugcugaaaagauguugacaaauuacucuucaaaaaaauggcauggguaucugcuuccuugagcaguaucaaggaaucuguuugcuugauccuugugccccuccuuggccaucggucuuggugaucugagaugaacagcguagggaugggggccagggaaccuucaguuuaguuggccuugcuuuuguuacuugcgauguuagucuucuugugaguucuuuguccacuuuaucuuaugaguuacguguguguccuuugcacagaaaugucuguagaccuuucccucuguuugacuaguuugcagagacugcuucugugccagggguguuagugugacaaauauuugggucuuugccuuucucuggugucuaaucacagcuuaaaauuaaagacauuuguaauuguggcuuucagguauccucucauuugcuuaagaaaucuuccaaaaugaugaaaaagagguauugaauuuucuuuuaugcugagagcaagcccggcauccaguuuccugaggaaggcaaugaaagggguauagagucaggaucgggaccaaaagcugcuagcucuggcgauuuaacaucugcugauagcaguagggaauuaaagagggagaaauuaguuauuugggcuuuucucuguggcucaagggccccucauuggccaagugagaggcuugguguucaccaacucuucaugaggcagagagaaaagaaaugaaaugaagaaagucucucucucucucucucucacacacacacacacacacacacacacacacacacacacacacacuggucggacccaaccaccuguuucaucaauuucacaagugcacaugcauacuuauauacauacacuuauacauacauauguauguaugcacauauauauauagacagacagacacauagaacccaaacagccacauuuuauuuuucucuuagcccauuuuuuacauucuuagacaaaaguucuuuauaaaauugccucauagauaaaauguuacacaaaaggaaguucaaagcaguguuucauucuguaagcucauuuuaaguucaaagcaacgguuucacauggccuugcuuuaucauagugcacaccuguggucccauccuugggcuugacuuagaauuaauguuuuuccuugaucaucuguggccucauuuuugaaccugacuuagaaugaaugucuuuccuugaucacaaauuugucccaagccuauuuuccuucuuagugcaauuuauaaagcucauuguauuccuuauuaugcagccuuacuuacuauucuuuucuugaugcuaauuuuauuacaucguuccaacaaaacaacuaaaaccaucucccaaaauuuucugccuaaaauuauuugaaucaaguuaggaauaagguaaagccauuaauuuauuuaaacagcauuaauuugugaaaguucaucuucauguugaucuucaggaaaucuacacaauagggugggcugauguccaagaaucauuaggcuauguaguaguggcaggaaaggccuaucagcagcaagaaguaauccugggaugaaguuucugaggcuaugucucuccagagugcacccaugguagccauguaaaaugguggacuauccaggaaacucacuugcuugccauagccuuuccuagauggcuucugucacuuuuauaguuuuuuuuuaauuaaaaauucucaguggcuuaauuuuuauguuauuuuuuucuuuuccagugcagaguguccucccuaccugcuuuaccuaucagcagccucucuucuguaaaguuuuauguuucgugcuaaucaaggaaaugaacacauacuuguguuggcagaggaugggggacagaggcaccuggagccaaaggauaaaggacccuugcucaaaagaagggaugugggcagggacagggauagaugcuggacccauuguuaauguucuucucugaaggcucucacaauggcuaagaauuaaggggagauaccccagagucucauucacagacuauuaaccucaauaucgucuugugaacauuccccacacagaccccugacucccaugaaugggaaaagguaucacaugucuuauuguacuuuuaucuuucagagucguggaaaguaaaaacucagccuucccaaaaggaacgauuguagcggcuuuauuagguuggacaucacauuccauuucugaugggaauggacugacaaagcugccuguagaguggccggacaaguugccacugucuuuggcacuggggacaguuggcaugccaggguaaguguccuggguggguuuuguuugucagaauguagaugugaggcaaagacggaugagagggaaaugguagaauaaagaaaggaaggagcucaaacugaguuaguggcuaaauacagaaaacauuauguauaaaagaaucccguguaacccuuaaaaggaaggaagucuuggcauuuaugauauuguagaugaaccuggaagacauuaaguguaguaagucagguacagaaagacagacaccacaugcucucacugucauccugugucagcuucuucuuucugggagaagugcccaggagcagaaacuuuaauggagggaagauuucugcuuggucaugguuuccagaggcuucaguucauucaguucauacuguugcuuugauggacgacaagggggauggucauggugccaggggcaugauggggcagacuugccuagccuuuggcacucaggaagaagagaaacgcaacaaggagccagagaugagaugcaucuuuucuagagcaucgcucacagugaucugcuuccuccaacugguuccugucuccuaucauauuaugaauccaugcaauuaaugcuuugguuacagcagagcccucaugauuuaaucacuuugccaauaccacaucucugaacacugaugcuuuggaagccaagccuuggggaagccauaaugagccuuggggagccuggggcagggugggggugggggucagcucaucuucaaacuguaauuuaaguggaauccaugguagggagaguguaaugaugugggccgagagacagguugguccaaagauacaaaccuuaucuaggagauguacauuuaagagauacugcugcuguacagcaggacaaacauaguuagaacaauaaguaagguuggaaauuaguuauguguauguuaauuagcuugauuucacuauucuauguauguguauauaaaacaugcuauguacaugcauaucuuuauauauaucuacauuugugcaguuccugucaguuaaagguaaucuacaaauauucuugaggcuaaaucaaagaggggcaaaaucaugucagagacaccucacuuauuaaaggcuccgacauuccccagugugcccaaugugggaaaucauuuuuuuuuuuuaaacacacaagagaaaaccauccugucuucugucuucugcaaucccagcuacucaacauuugaggcaggagggucaugaguugaaggccagccugagauauagcuagacacuauauauauauauauauauauauauauauauauauauauauauauauauauauuuuaaaucaagccaggcaugguggcacaugccuucaauuccagccuucuguaggcagagggcagacagaucucugaguuugaggccagccuggucuacauagcauguuccaggccagaccagcaugggcuacacagugaaaucugucccagaaaaaaaaagaggaaggggguggggaguccaaauuaauauuuucuuuucuaaauuguugguucuuuaaguuccccuuaggcuaaagcagcuuaauaaauucugccuaggacuuccuuuguuguuguugaccuuucuaucuuaccucuguuuuguuucuaaaaggaagugagguuugguuccuuaggucagugugucuagugaaagcugacucuaaagaucccauggagguagauugugaaaggagaugcugguugacacugguguaacagagccagaaaauguggcccuuagguuguagagagaccuguguguguguguguguguguguguguguguguguguaucugugaaauuguguugggauguaauauauguuuucccagcacuagugaaauggaaggaagguugggcuaacauagcaaaagaggaggagagggagaggggaaacgggaagggggagggagaggggagggcagggaggaggagggguuaugggagaagaaaggacagggagggggagaaggaggggaauagggagagggagagcacucuucauacauccauccuuauguucuuuccuuagccucacugccuacuuuggccugcuugacaucuguggcgugaaggguggagaaaccgugauggucagcgcagcagcaggagcagugggcucuguuguggggcagauagcuaagcucaagguaugugucuuccucuagucgugccucugcaagacucugugcacugagaacagcagcgccugcagaggguucucuggacucaaggggugugcagucagcuugcugcaacuagcuuagaaguuagaggcugggagggcacaaugagaagagaauaguaaagacgagcugaccaguguugauugauaacuacaggacaggucaggagugggccagcuagacuacugaguacugaguacugagugcuauuuuucuauuguugcuguuauuguugcugcugcugauacuauuacugcuacuacuacuaguaguaguagcgguaauaguaauaguaguagcagcagcaguauuuuuacuaaguauucucuugcucaauuuagagggacaaaggaaggggaauagaguugaaucuugggcuagauccaauagccaaggguuggucuuuauuccuaauaggagcuugaacuugagugagguuguaggaaagauuuacauacguaaauacauaggugagaaagcagcuggaucuugaauccuccuccagcuuuuguugugcugacuuuacagacaaugaaucgcauuuguuuucuggagccauuuuagcauuccauauacccuugggacugauuuaguaguuuuggggguaaggcugguaauugaacccagggucuaguacaugcuuggcacaggcucuaccaccgagcuauaccccagucccugauuugauagcauuuagagagaauuuugccucugucuuuuauacgugaguuugauuaggagguuugguuuuucuuuuuccgaacuccgaaugucuaacuauauucaguauaggcuagauuuauaaaaugaauuagaaguauuuccgauauauagauugaaaaugcuuuauuaaaaauauggagagcuggggagaugacuacaugguaaaggagcaagcugcaucugccugacgaccugaguucagucacuggacccgauauaaaggugcaagaggaaggagaaagcuggcuccacagaguugucuccugaccuucauaugugugcugcuaugcauguaugcauccauacucacgugucaugagcacacacacaugcccaauaauaaguauaaaguuuuaaaaauccuugcgggguggugggguggugguggugucaaaugguguucuaaggaccacugcaccaugcugaagagauggcucaguaguuaacacuuguuuaucaaguucaguucucagcacccacacaguggcucacaaucaccuguguguccagcucuagaagaccugaugcccucuucuggucuuccuaggcaccugcauacacacacacacacacacacacacacacacacacacacaccccaaacacagcaacaacaaagaccacagcacugggauaggauaugucuuugggagaaaagaagaggugccccagagugaagaagccaggcagucaggugacuagguuaguaaagcagcggguugaagggcaaacauagcagacagaggugauaucugcuaagcggucaggccagcuguagcugguuucuagucuggcuuagggaccaguuucacccuuggguuuuguugaguuacuguggaguuccucaugugugggguguaugugguuuggguaggaaauuuguucccauacauugaaggcuuggcccuacuucagaagugggacuuuggugaagugauuggguuauaggggagggggcagggucugaccuugcccguggaucaacuaccgauagauucauagucugauggcacugucgguagguaggacaaacuagaaugcaagaccuuaccuggaagaaguaagccacuggacucaugucuuugaagguuguucuagagucuccuuaucugucucugucccuucucguucuucugccauagaugaguggcuuucuaaugccaugcccuucugcugugaaauacauaauauacucuggacacauggggucaagugacuauaggauaaagcaucugaggcuguuagccaauuaaaucuacccuccuuuaacguguuuacccaggugguuuccauagcaugggaaaguugacuagcacaagguguguucuugggcaaccugaugguguaagccugggaaaguggauuuggaccaugcuucuuguaaugggcggcauuucccccucccauuuagggcugcaaaguuguugguacagcagggucugaugaaaagguugccuaucuuaagaagcuuggauucgacguggccuuuaacuacaagacaguaaagucacuggaggaagcuuugaggacagccucucccgaugguuaugauugcuauuuugauaauguaaguacaaacucagcuuaucugauuuuaccaauaaaguauuacauaaaggaacagguuucuaaaguuuccagcuagaacaaaugaauaaaguacauucuuuggggguggggagaucuguuaagcuauaauugcacagaccaugggauuuauucauuuaaacugcauagccagacauaguagcuaagccucuaaucccagugcucacaaugcugaggcaggaggauagcaggcucagggcaagccugggcuucuuagugagaccacgucuuccauuaucaagcaaugaauaaguaaauaaguaaauaaauaaauaaccaaccaacuguagaauuuuagacugaagcuauaacucaguaauagagcuguugccagccauguacacaggccugcauucagucccagcacagcaaaagaaaggaaguuacagcucagaucuuacccacuuuaguaucagacugucuauaugacugcgguuuuagaauguuuaucauuccccaaagaaacauuaaucaucagucacccccucccguuuucuuccccccaaaaauguguuccuuugugccuggauucuuucacuuagcagagcgauuccauauccauccauguugucauagguauccgucauucaucuauugaaugagugagugcucuuucaucauauggauauaccacauuuucuaucuauucaucaggucuuaggcaucaaguucuuuacacuuuuuuuucuuuuaccacuguauaagguacuauaaauguucauguacaaauuuuuguuugaauucguuuucauuucucuugggcguucacccaugaguagaauugcuaggucacauggaaacuucauguuuacaucuugaggaacugccaaaguauuuuugcaaagugacugcacugucuuacauuccuaccagcggucuugaaggguuagaaucauuccauagcaauugcugguuuucuuauaccuaucuuagucuuuuugaagugauaucucaaggugguuuugaauuacauuuccuugggacaaauaacacugaagaucacucauggacacacguguaucauguuuggcgaaaugugcacaguguaguguucaucuagguugucugaguucuuuauguuugaguacaugccucuuuguugcaguuaacuuuauuugcaguaguugugucacauaaagccaccaggaucacugaacuauggcuccuaggagaaaugucuacaugugaacaacguuucucauguggauuaaaaucuuaaauccuagcaccuccccgcucccguaacuuauuuacaaaagagaaauuaggcucaggcgaauuacauuaagaugaaguguuauguaacuggcccuuaaacucacaaaguugacauccauucuccacugcacucugcccaaagcccgggcuccacugucuccauccuuuguccccaugguauuacaggaagggagagaaucgccuugcuuguucagucucugcugggaacaccuaugucugcaaaugaccugggucccauucugaaggcacagaugaaucuuagcaaguaauacagcucacagauauggaauccugugagaaugaagguugacuggauaugguuuucagggguuuucuccagcuccaugagcuaucgucauucucucgauagaauccucagaaacacagauguuucgacuacuucuguaguugguugggcauuugcugugcugucuaaggacgcugccuucucagggucaccaaugugcaccucuuugcuucuacugagaguuuaaggguuagcccugacacuccugucaguauuauaaacacauuuguguuacaauuugggagagccacuggcuuuuccguguggcuaugcaccaacugcauguguggcucugcaguucugcaccagcuguuaaggcuucuccccuuaggaacugucuugacauucauuuauguggaaaccaauugauaacaaauguaauggcugccuuuggucuccgucugguuccacugcccaugucacuuuaauugagcuucacaguguauuuugaaauuugaaagugugagucccguagcuuugcuccucaaauaccuuuuguguagucuuacauaccuuuuagauuauaggauaaugagaccauagggcuauguagaagauucuaauauuuaacacacuaacuuuaugcuacacaaaguauguuccugaggcuaaaugaaaauguuccuuuuuugcaaucuaucuuaugcaacucaggcuggccucagacucacuauguaagugagaaugaccuuaaaguucugauccuccugccuccaccuccuggaaauauccauuucugauauauuuuagcugcaauaauuacaacuguuguccugauucgaccaauuuugucgauucuccuaaauggauucuugaaaguacuuacauuguuuuggcucucuccuuagguagguggagaguuuucaaacgcuguuauacuccagaugaagacauuuggaaggauugccaucuguggugccaucucucaauacaaccguacuggaccauguccccaggguaccuugcuccugcagauguaggagggcuggacaaaggggaaauuucacagauauggggaagggaugggcuggcugccauaucuucacagccaugggcugacuuucuagagcagcaagccaucuguguuugauauggccugacagauagaggcguggcugaccccgcccucccgcugcacacacucuuugauuggcugcuuuuauuucucuugugcucucucuccuacacugaagucacuccccaccuccccuuuacacucccaaguccaaaagcaguaucaaucaaucaaucaagagcccuaccugccuugcuucuggucuaugagggauccuaugcaagccucuuacaagaugagcgacugacacaaaaccacacccagugcuguugcuccucaccuugggucccugcucuguuaucagggugacagauuuaucugagaucaccaagaaagaagaagacaaagggaucugugucuaucaucagucuaugggugaucgcagaacaacugguuacugcuguucugggcucgacuagugugaauaaaaucucacagcacagauugacagcagagcugccuggagaugggcacuugacuggccacagaaucccucuuggguuguggagaaucaaccaguuucauuagaccuuggagacaagucauuauuuccaccaauuuauacccauguuugcuuuguugcacucaaaauagagaucagcgcuccugucagcgcagagaacucagcagacaucccagaguaauuggcaaucucacugguagggacaaaccccucauccaucuucuuuugcaacugaugcuaagguggaaucgugggaaaucaucuguuugcuacccaaaggguacauuuucuuaaguguaguucaaauaaguauaaccaaagauuucuagacauaguaauuuaaccuaguauuuuuagcaauuaguuuuuauaauuuuaguuacucagacagaucuuagagauggcaacugaccuugucuauuuuaaucagauggggguucugccuugcuucugaggcccagaaauucuagcacaguccaguuucauuagaccuuggagacaagucaugauuuccaccaauguauacccauauuugcuuuguggcacucaaaaaagaaaucaauguucuugucaggaugaauagcucagcagaaguauuuggaguuucaaccuuugugcaugugugaggugugauguauauaugugugucaguguauguguguaggucaaaggucaacucuggggauccucuugcuuuccaucuuaguuuuugagacuguugucucucacugaagcuggagcccaucaauucauccugaugccuggcuaaugaguuccagggguccuucugucuggaguacagauuugaaucaccacgcuuggcuugcacaugugugcuagugaucugaacucauguccucaugcccgcauggcaagcacuugacugacugagccaucucccuagccaaaguugaaccuuuaacucagugacauaagguuaaugaaaugagguugcuaucuaugagccuuugaagaagcgccaugcugcagaaguggugauacauucauucugcauuuacauaugccacgcaucaugugccaguuuccaucgguucgagacaagguuccauuuuccugacuacaaaugguacuuucuacaagguagugauuggacugcaguuacuccagaugccagggacgcauuguucagcucucccaacccuucccuuccauuagcaucuacagcugacccauggagaaugugagacuaauagaguaucaugcucucagaugccggccgccaggcaacagugaggccucuucucucacuguucucuuuuuuucuacagaauauaauauacucacaggcugugggguuugggcugugaaugucuuuggugccauuauucucccugcuacacaguuaguaguuaguggcaguggucagcagccccauggaucagaagggaguggaggaaaaagugggggcgagggggugugcuuagagaaccguggcagugauuuguauuacuugugcuucacuguggacaugucccuggacucugucccacaaacgcacccuacuuuuccaggcccagccccagaggugguuaucuaucagcaacuccgcauggagggguucaucgugaaucgguggcaaggagaaguccgccagaaggcucugacagaguuaaugaauugggucucagagguaaggggaccaaggcacuccaccuccucaccagcucccaaaggcgucugcaacucacaaccuaacccccuguccuucagucuuucauuuucuugcucuguuguuucucuaagccaguuggaucaguguuuucaaauacaaacagucucuucucaucuuaaaaaaaacaaaacaaacuucucuaaauuucugaguuagaggaaaagacagugaugaagucaguguguuacuguguaucacgacagucuuaucucagcacccugaaugcuggaguuagagacaugcgccaccauguccauagcugcucuacauuccauugcuauucagauccauccauuuuauaacaggaugccuggagguggucuuaucuauauuugcauguauagugucuuucuuuccauucuuuuucagauguguaccucaggcuucuacaccaaccccaucccaccaaccuuugucaagggugcauugugucucucgcucuuggagccacuuggcucugggaguggacuccucagucccauuuccucacugcuugaacuucuugcuaaaugaaguugagcugucuucauucauucuaaucuacuuccuuguucccugcccccaccgccuacuccccagccugguacuggcacugaguccagaggcucagcaaacauuuuuccucacugaaagcccuaccuuuuuuuuuucuuucauaguuuuuaucuuaauacaauugaagauugacaagaaaaaaaccugauauauggaaguuuccauauauccucauauuauaccuucauuuucuucuuuauuaaaaucuccgcuaguauuugcauuaguuuucuagggcuacugucacaaagcaccacgagauggguggcuuaaacaacaggaauugauuuucuugaaguacuagaggcuacucugaacuugcuugcuucuucacucgguauuccuccugcauuuucucauggucuucucugggcgugccugguuuacuccuuaaaauggacccuagucacauuugauuauggccugcucaugugaccucauuauauuuuaauuaugucuguaaaggucuugacuuagaaaaugcauucugagguacugggaaacuucagaauucaucaaaggaaucugaggggcggggcagguagggcacaguucagcccacagcagcaauauucaucccguauuuuuauuuauuacauuagauuuuagauuuccaucuuaugcaugucucuguccugucaaggguaggaaugaacuagggcuuccaggucggggauucagacucuacuuuuguacuuucugaggucccucaagcauguggcauggccauaagucuauaaggaguauucggccaucacuggaauauauuauguaagaguuaucagauagccuggguuucuacauaaaaccccuuuaaaaacaaaaacccuagaguugagugcuguggugcaugccuguaauccacagaggugagaggacaagaauucuaggcaagcuggacuacaguagcuaaaccaugucucaguagaaccgaacauccuugaacaugugaaguacauugaagagucuccucugaugugaacccuugucucccaggcuccaaaguaacgugaggggaccuugguuagaagggagagcagggugugcagccccgugguauuuauauuuccugaacaggcuguaccucuuccagucuuagucgagguguaguguuuccugucaucuggcuaugauguaaacagccucugcugagggugugccucucuucugagacccccgaguuguuggauuggugcagaggaccacuuugccuacuauuccacugggaugggucgugcacacucuguccauagaucuuguuauccacggaugagaggaccuacaccucagaccuccaggguucuuacgguguaucugaugaguuuguugcuaggaugggaaaaaaaaaugccauuuggaagaugaugucaaccccuaauauuuguuguuucaacgcaggguaaaguccagugucaugaauacgucacugaaggauuugagaaaaugcccgcagcauuuaugggaauguugaaaggagaaaaucuggggaagaccauagugaaagcaugaaaauaaaaauggcccacggaucgucccuggaggguuagcuuuuuaccauucagugcaaguguauacuguccuauguaagauguaacagcaaugcguuugaccuagcuaauaaaacauguguguuuuuuuuuccccaucugugauagagaaugaaaucaugacaaccaaugagcaggcauguuucugccuaccucagcuccuccugggugaccgugacaaauacugccuuuggugucuguucugauuuuauuucuguuguaaugaaagcaauuuagaggaggaaaggguuuucuugacuuacacuuucaggucacaggugucaccaagagaaaugagggcaggaacuugaaggaaggccugcuuuguauucuguuaacauuuucucuaaccugggaacucaguaaccaaggacauacagcagaaaccacgguggaggacggucugccagcuagcucgugcaggcugguguucagcuaauguucucauauacauagaggaaaugguaacccacucuaugaggauggcuaagcccacugugggagguagcauuuccugggugcagucaccugccacaggggucuuagccuccuccacugucacaggccagcccgaccgaugcgggucuucaguuaaggcucaccacucaggugauuugugagacaugccaaggcagagguuaaaucuaacuaagacagugaacuugguguaaugugaaggcaaaagauuucucuuccaacuguuuauagauacuagggggggggagccacauugcugaucuaugcaguucucagggccagcccgcacuggugugcuguguagugacgcuaacagaucaagggaggaaucugucacuuaccacagcugggacugaggaguguuaggggaagagacaaacuguucuguacacugguaccuucugaguccugaacauucuggaaacauuuugcugacaaauacaguaaaaaacuaauacucuacaggccggucagagcuguuacauagagaagcccugucucgcucuccccccgccacugaaaauuaaaccuuuuaaagcuuuggguccauucccuaagcccauucuuuuucaagacagggugucacuauguagccauggcuguccuggaacuuacucuguagaccaggcuggccucaaauucacagagaucugacugccucugccuuccacgugcuagcauuaaaagugugcauuaccacugcuggcugugccuucucuuaucaagccauuuaguccuaaagauauaaauuggaacagcaggugcuugccagcugagauuuggacuggggaagcugccauggcucagagcagagcucacugauggaggcuggcugccaggcauacagaguccaagagugggguggggucagguugggagugaaugaugaagaggccuggaacacuaaagcaaugugauuaaacacaguacagagggcuuuuguuguugguuuugguuuucugagucaggguuucacuguaucccuggccauccuggaacucacucuguugaccagguuggccuugaacuaaaaaaagaucugcuugucuccugaguggcgggauuaaagauguaugccaccacugccuagcuaaagaggguuucuugucucagugggccuuugagagccuacaagagaucgagaaagcagucagugugauugggggaacauggaugcaggccaagaagagugagggugguguuugaacaggaggguggccuggugugaggacucaaagacagcagaacaaggggacaccauacacaaggacaaccuaguaacaaaguucagguagccuaugcagugucacccauaggacgucucagagggagauauguggucccaagguggauggggcagguuuucacagggaaaugaaggaucugguacaggcagcuggaucccaggcaggaucaugcacauguggaggucagagccagaguagagcuacuguguggcuguggggccuagugggggcuguuggagauauuugucaaggaacacaguccccgaagucuuagcuggagaggagcaaggagcaccugaugagagaguggugggacacaagaugguuccaugaagguuugauccagcaaggacaauagaaccuggagucucuuacugucaaguaaggguguaauaagcuggggugaugcucacagugguuaagaugcucgcaguguaaucgugaggacuugaguuuggauccucaggaccuacugaaaagccaggugcagauguuggcccuggugcgaucccagcauggacgagggggaggcacggacuccccagagcaagcugguuagacagacuagcaaugucacugagcucuauauucggugacagcccugucucaaggcauaagguagagaaagaucaaggaagacaacugggaggggcuggcugcuccccaaggcaggggaaaagugauagcauucuguuuuaauuaaaaugcaugaaagauuuaaaagauugcaugaaaaauugaaacaaaaauagacuuuuacuuuaaaaguuccuccaaauguuaaaaggacccuaggacacuauccugggaacacccugaagugcccuggagcacuuugucaccuacauaugacgaauggcucuaagcuguuucugggcuguggggaggugagagcugauugaauguagaggugcagaugaagucuugaaugugacacggccacgccaaggaacccuagugccccagacccacaagagugccaaagcuuuccuggugagguucagagguauggcaaagucuuucuuuaguccaagugugaauguugacaguccauggaaguacgagugcuuaugaacuauugagcaguguauugcaaacacuggcaacuacugcuuccuccuccugggugagagcaaccugagccugguggacuggagagaccugcagagucuagcuccucuccacucccugggcuguacauaacaaacacgcagagguucugggguguugugguaguugguggugcgccaguggagugagcauggccaccugauccuagcucuucuguccacaucuacucugucauucccucaccuucccagaccaguuucuaggauuagugugugcaggacagagcacuaggucacaguuuaaaggcuuuggacacugcaucucuccuuugcuugccucuuggaacuugaaggucacgugauguagauggaauagcugcaagauguugcagagcagcaagguacuggagaucagucuggaaagccguccuuuacugaaccaagcugcugcagcucacugccuucucuggcuaacauuucuuuccccaacccuccugucuaaucugguaacccauggaggcuauugagaacugaagauaugaauggcacgucuuuaaaaaaaauagcuauggcuaaugucuuagcaaguaaaaggucugccaccaaggcugacaaccuacauuugaucccuggaaggcacauguggaggaagagaaucaacucucacaacugucuucuggcuuccacacacaugacaugacagguguguucacacacgcacacauacaaacaaagaaacaaaaucuaaaaaaguuaaaaacaaaaaccaaaaauccauggggccuagcaaacacagaaguggaugcucacagucagcuauuggauggaucacagggcccccaauggaggagcuagagaaaguacccaaggaacuaaagggaacugcaacccuguagguggaacaacaauaugaacuaaccaguaccccggagcucuugucucuaguugcauauauaucaaaagauggccuaggcggccaucacuggaaagagaggcccauuggacuugcaaacuuuauaugccccaguacaggggaaugccagggccaaaaagggggaguggguggguaggggauuggggggggaggguaugggggacuuuugggauagcauugaaaauguaaacgaggaaaauaccuaauaaaaauuaaaaaaaaaaacaaaacaaagcaagagguggaaacccaaagcaagagguauucuucauuaaauacaacuuuauuguuuagcugugauucacuuuaacuaccgcaccauacagggugcucuuaacacugcagaagaggugcgcucuucagugauacacaaauacgucaccaaucuagucagcauugacaaaccgacaaaugacauuugucucugcacagaugggauaucauaaaggauuauaucaacacgcuaggcaaauagcacagugagguguuaccuguacaguucauaaccauaaaucaaagugcuucuuacuggagucaugaguauucuauagguaaaaauacaugaaaaauauuuaaaguuucgucaaaggcauaucucuaaggcaggauucagugcagacacagaagcucauacuguagguguccccguagggaaagaagggacuggaagaggguccaaugcacauucacugaugaaugccaguugcaauuuacaguagcagcagcagcagcagcggcggcaguagcagcagacacagaguucaaguauugaagauaacacaguaggcaacacugaagacgguguuucagaucuacgucguucuucagcaacuuagucaaaagaaaauuccacaaaaaaccagcaaaaugaaaucuaaauuucuaaccaaaauaccuuaagcgacuuuuuuuuuagcagguuucggauucuaagugugccaguuauacggcagcuugccccuugcacaugcgcacacgcgcaaagagaaccacagaucagaugaaaguaaagccaaguauugcacucuacucaaaucacuggagaaacgauugucggaaagauacccacggaaacaggaaacaccacaccaccgagcaauucugcucagggucaacacgagcaaauuacauauuucucacagaauauauacacuuauuucuaucaucgaaaaucaguugacucaaaauuugaaaaauuucaaguacauuuuuaguuuuagaugaucuguguaagacguugcccagggaaaacucugaugaugucucaaagaacgccuacauuuacaaagagaagccaauucauugccucaagucucagacaucugaauuauuagaaaagcuuuucgucuguuaaggaauuccagcuaagcagaaagauucauuucuuucaagaagauagaauuguagcugaguuuaaagaccagaugggucguccuuuuaaaguaagagauaauagggcuuuuuuuuucuuucucauuacuugguuacagugugugauucaugcugaaagcauucuuacucaguuugcuaaagcagacuccuaagaggaggcagguacauagucucagguucuucagugugaaugggcaggugauuaguuugugggaccagugacacaggggacauguacucugcacuaggaaguccaccugaagauguccuugaacgccuccaauggucuacccaagugagauaagccaaguauugucuucuauaugugugacgaaugaauggacaagagccaggugagggaaggaaauggaacugugauggcugggagagaugaggacggagagccaaucuccaaugaggugagugugggaggacggaaaugagcgauaaguucacacauggacaccacagaacggaacaaccuaaaagcaacagagauggcucauuuuauagcacacauauuuuaugucuaaaguaaaaagaauaaaaguuaacucacuggcagaugcuugguuguuccaugaugggaaagaaaucucuauauggaaacucacugugaaacauucuaaagagugaggacuucgucuaaaacuauagaugauuaaaauccuuaucauuauaaacagacaaaaaugcuaaaugaagcuuuaagaagaaauucuaugaggagucacaaaccauaaauuaaaaauccuuagaugcacugacaaucucaaaauugacuuaaguacaugggugcugggacagacugaauagcuuuugugcaauuuauuagcuauugauaaauauuuugcaguagggguuaaaguuucccucuaguacacagugauagaaagcucauauuggaugagggguuguauggacauaaagaacuuauuauaacucaacuagccugacuuuuaauuggauaaggaaucugaaaaaacuccaaggagauauaugaaaggcagaugaugacgucagucaucagggagaugcaaauuaaaagcaaauaaaaaugccccucaucagagugacuaacauuuuuuuaaagauuggcccagguguaaagaaaauggagccuucacaugcugcugccagaauuuaaaaggauguagucacacuggacagcaauguggcgguuuccuacauagcuaaacaaaaauuuacaugacccagaaacuuuacccauagaugucuacugagcaaaacaauuaaaauuauugucuacacagacuuacacauuacauucacaguguuguuccuaacagccaaccaccuaaggagaaagaagagaauguccucucauagguacaugggcgaaguaucauauaauagaauauuauuuaacgauaaucaauacugacauauaacaucuuaauaguaagaaaucacauaggcuagaacgugcauaaaccuaaaaccacgaugguaauaaggaaauaaaggccaauauaaaaugacuagaaaaggcuauucuguuaauacaagguuagugguuaccuggggucagagaugagaccaagaauuauguauaaauggguguauccaauggcuacucuuauuagggugauguucugaaaaacggauuaugguaaugaauguguacuucaguaaaacugaugaaaacucauacaaauagcaaaccuugguuuuaagcacauguauucuauauuuuaauaaaauuuaaaugagguuuugauucuaauccccaacugagauugggauaaaaccauccucuuguaaaauccccuagaacauucuggaacaacucucaagagugguuuuauguacuucauuaacuacuucaauaaaauauacuguuucagaaaauccuuaagcccaugugaaagguucacauaagccauguuccuuuggugucaggaauguguuuacuuggucuguuuacugaucaguuuaucaugaagcaaugucugauucuuuagggcuuuaguaagaaccacccagaaggacccaccuuauauccagaaguagcauuucagaccuaagcacauuacauuagcaaauauuccugauauuccugaacgucagaucaacacuauagacccaucaugcccauaaggccagaguccugcuuuagcucccuuuaugagcaauugccuccaauuucaacuuuaggaacuuauuuacaauaaucaggcccuucuggaaucuaaugaugugagacccaaaauagcucauucacagucuuuaauuccuuuuccaguuagaaauuaagauuccaucugcgacaaauuuuaggaauauccaucaauacccguauaguccauuccacugaagacucacuucacaaaagaaucuaucaacuacaacuuauuuaaguguucuuuuccugacuuucacuucuuaucaauggcgucccuugagauuuuaguguauguaucauccaaagggcaugauaacaaaaagaaaaaaaaaaucacaugccugccauaagaaagccagcuauaagagaaacauggcaucuaaaguggcaaccacgacccaggaccagcugagcacuuguggaaauaauagacuaaugucgucagcucuuguacauuugaaaagacaaacucuacuuucuucaacacaugagauuccguauuucuaaguagugaaagcuuuguauguguauacauauuccacuccacaacuaaaaaacagucuaaggccccaaucugauucaaccugacauccugugacuuuugucauacagaauuuuuacagaggugcaggaggcugggcucacugcagggaaguaauccacccuaaacagcuaguuuugguuucucuccuagguccauuaccauuaggacugagcuagcucagguacaagcucucuggauuuucaacccacugaggcaaaacucaaaagagguugaggugacuugugcaaaaauuagaacauucucugaaagcauacuucauggaacuuccuugguauguucuguucaucacauucuaggaucccacaccaaacaucccacguucucacuaaucuagaaguucacuaaccuguaagaagggacuuaucuacugggugcaacaauuccaaugaguuaaaaaugcucaaacuauuucugcaguaucauaguaucaaauaaaaaggaaacuuagaagucuucaucucuucaacucuacugguaaagaaaauaauauucagaggguccaaaugacuuguuuaaggugacacagugguuggcuggcaaacuggguuagaacccagguuaugagaguccagguauggucuuuuccaguauggcagugaaagggagaccaaaaggagaauuccuugaaggaaacuuaaguuuggcuucucagaaucguuucacaucacagcuuucuucacgucaacaugacuuuaccagguuuaaucaaaacugaccacccucaagaagaggaccaaaggggaagaagucuauuccugguugggaacccauugaggcugaagcuucuaaucaaugcaguggguaguuuaucauucgagcuuuuaaauaagcacacgaucugaauuaaccaccccucccccauccuccauccccaggauuacuguguacagugauguuuaagacuggucguacggcuuuuaaaugucuuaccacacuucuuacauucguauuguacguuagugugaguuuugacauguucaaugaggauugugcuccggguaaaggccgcuccacaguaaucacauuuguaggguuucucuccuguaugaguucggauguguaaauuaagcgacgaacucugucugaaaguuuucccacauucuuugcauuuguaugguuucgcaccaguguggcaccucaaaugccgacugaggcgggaaugagaggggaaaccuuucucacaguguguacauuuguagggcuucucucccgcauggagucuuugaugauacaugauacuacuaaagaggcggaaagacaguccacaguccuuacacaaaaaugguuuuucuccaguguggaucuucugaugucgaguaaggcaagaauuuugucuaaaggcuuuuccgcacucguuacacuuauagggcuucucuccgguguguauccucugauguuuugaaagagaggagcugugagugaaggauuucccacacuccuuacauguauaugguuucucuccagugugaauccucugguguugauaaaaugacgaguagucgcugaaaggucucccacaguguuuacacacguagggcuucucuccaguguggguucuuugauggugagugagaaaguauaacucggcgaaacgcuucccacauucgucgcacuuguaacgcuuuucuuuccggucagcuuuguuguguggcuugggugaggcgcuagcuuugggggccuuucuacacucgagacacacggagcgcuucguaccaggcucaaaggccuugccacacuucccgcacuuacuggcuucuucaggaucaggcuccuugucuugauuuggggccucaucuugaaacaaauucuuccggcauuuuucacacugagagcucucaaugcaauucucuaagauuugaguaaaggcuaccccacacuuacuacacgucucggucuuacucaaggaaccaauuuugggaugucucuugcguucagcaggagauagauggcgacguggguccuucucggguucaccgcauuuccucgacuuuucccuccugagcucucugcgguuuacgagagcugaaugaaagcugaagggcuucuugccuuccuuggaccucugagacaucuuagauaaggaggcuuuccgauguuugagugugucagaagucugcuugacucucuucccagaggaggucccuucugucucagauucucuauucucauggcuacuccgcuugccaugaucuuucuuggguuugccaugucgccucuggaauucugucuucaagccauaaccaccaucccugaagcaguacuccacuguuuucucuaaagucaagccuuccauaaaagcauccaauucacgucuagacucacucucuaaaagagauaacagagcaaguauuucccauuugcaacaaaggaaaccgcuguaguugggacagacacaggaacacaguaaugauuuaagaacuaugguuuagauaguuaucaguuacagcugcagaaaacagacaagagaaaaagugauauagaaaagcaagaucaacacagaggcucggaaaaacaguggacaaugaaaaccuugugcuuuaugugaggaaaggggccagucuucacucuucuuuccaauuucuacaccagguucaaaccugcuuaaucucucuauacucaggccuuuguaugcuuaccaaauggcuggucccaaaugagcacuguauuugcacuguuuuucuuaauccucacaacaaccaaugaaguacaucuugucauuuguuuuauggacgacacagcuggacauacagagaaucagaaacuuguccaaagucacauguauuggaagugguaaaagccagauuuaauauucuuugauuuuaauuuuguaugaguguuuuaccuagauguaugucuguguacuacuuguguguaguguccagggggaccagaaaacgaguuauagaugguugggagagcugccacgugggugcugggaauccagguccucuggaagaacagccagccaucuuaacuucugggucaucucuuuggacccuaaagccauauuuuaauuugacgccacagucuauccuuuugaucccuauauuauauagccauuccucaaaacagacaaaugcauggauuuuuauauaaaaucccaaucacuucaccaacaugcaguaccaccuauaaauaagccuuccaccacuaccacugucuggcucugccaauccugaacccauuauaaccagguauccauuuauuguuccacccagaucacaaccuucuuaauccuacucuuugggucugaaaaccuaugaccuagcauacagugccccagcacauuuuaauaaaucugacaggaucaaaggcucaaagucccauaaucaaaauggaacuuucuccaaaaccauauauuccuuguguuugucuuagaacucugaguucauuuacuaacuguauuauucacucugguuucucccuuguaguguguguguguguguguguguguguguguguguguguguguguguguuugaguguaccugugccugaaugugggaaugcacaugccuauuguucaugcaugcagaggucagaggaggaugcuggguaucuuuugucacucuccacuuuuuaaaaaaauacagucuuuggcugagucaggggcuggauguuucagcuagccuagcuggccaacaauugcucaguguacccgugucugcugcaaggcugggauuacaggcacagaaguucaugcuugguuuuucuauggguccuggagauucuaaucugggccuucaugcuuguagagcacuaagcauugcacuaagacauuuccccagcuccaacccuggucuuuaaucauaagaguguacaucaucuuccuuauuuuuuuucuuauuguuuuaacagauaauuauggcagcacacaugacuuuaacccuggugccugaaagacagaggcagguagaucucugugaguucaaggcuagccugaucuauagagcaaguuccaggacagccaggguuacacagagaaauccugucuugaaaaauaaaaaacaagccaggcaugguggcguggaguggguggguaggggaguagggcggagggaggguaugaggaacuuucgggauagcauuuuaaauguauauaaagaaaauaucuaauaaaaaauaaagaaaaauaaaaaacaaacaaacaaaaccaaccaaccaaccacuccaaagccccccaaaccucaaaauccuauuauucacaaguuaugugaauuguuuccuguagaauagaaaaauuaagauguauuguuauuuuucuuauuuaaaauuuuauuuauuuauuuuuauuuugugugcauugguguuuugccugcauauaugucugugugaagguaucaaauucucugacacuggaguuacaggcaguuaugagcugacaugugggugcuggaaauugaacccagguuuuuuuuuuuuuuuuuuuuuuagaagaacagccaguguucuuaaccauggagccagccccaaguucuguuauuuuucuuuuagauuuccaggcucauugauaauuuuugaaaaugguauuuuuaaucaguuacauaauaauccauccuuccuaauuuacugauuuccuuauugaauguuuaucaaauuauaucacuauaguuagggguauagcuuaguggaagaauguauguuuagcaugcaugagacacuggagccagguucuguacuguguguguguguguguguguguguguguguaacuuuacauaauaccuaauggauaaaaaugccucacuacuuaccacggaucaaugauccuuaaguagcuacagauucaauucauaacaguacugcuacuuuaaauguauguuuaugagccacuuuucauguucaccagccauucauguuuucaauuuuaucaguucucuguucaaauugcuugcuuguuauuucuaaauuauguacugcuagcucauuacuaacugguauauguuaaauaauuaucacuacuaagucugcuuuucccuuaauauaaauaacauauuuaagauguauaguacugcaaaacaaugcaaaacccucucuggggauaaaucucuaaaccguugcuuaagcauaauaaaacaauuguuuuuuauuuauguaauuauaauagaaacagcugagagguugacuaauauaaaugcuuuagaaaguagaucagaaaaggccagcuucaaguuuuuuaaagguuacuaauauauguaauugcauuuucauuuauuaaaauguauauuaaauaguuauuuuuaaauuuuaggaagauacagagaaacauaaugaaagacaacauaaucucuggaagguuagcauaccaaaaaugaacauagauguuuuccagauguuaaacauccauaaguauuuaacuuaaacauuuagacauacauuuuacucacacacacaaauguaauuauuauacgcauuuacuggcggaauucccaccuaccuuuugagauuaaguccgaguacuaauuaaauuauuguuccuuuauacagauacuccuugauuuacaaaggaguucuaucuuggucaacccauuguaaguugaaaacacccuagacgaaaaggcauucggaauacccagcacacccuggagcuucugagucugagguuccaugcauaugggcgcauugagugaugccagugcccagcccugcaaggcuucucagaucccacacugcuggucaagcacagucucuacuaaaugucaucaauguaaaaacauaauccuaagacaagcgacugugggucuccucuauacucccgcaugcguccauagcuccauucacgugccgugcuuaacgguggucauuaccuuacugauauacuuguuuauuuggccuauuaaaugucgauaauaugugcuuuucagauccguggggagacugccuguugccccuggggcaguguccacauccggccacugucccacacccucccauugucgccggugaaguacucagauccaggaccauuucugugagauguggaggccucucaggugacuuguugccccaggccuaugaagccuuaccugaauuuuacaaacuaucuucagcuuaagauccuuccuccucagccuccuuuccuucucccucacugagggguuacacccacacuacgcucuugcagcagcaaucccaacuacauuugucuucacuugaaauuucuccccaacaaaucccuaucuuggagauacacgucuuggcauccacuuuuuggaggacccaaaccaguggugcccccauuaacaugaacacccuaggaaggcgaggcucuuuccuaauccaucaaccguauggucuagcauuaggcucacccagccagucaguuuucauuuccuucuuaccuuuuaccaacucuccuggucuggggucuuuuaagauuucuuuuuccaguacccuuggcaauuuaacccacuucagaugggaaaucaagucaaguuuggaaaccggagagccugcucagagaagagauagaaaaugguuguuuacauauagaaaaaaaaggugaccuaacauucauauuuagccuguuucucuaagaaagauaaagaugcuaucaaacauagaggaggaagaaaaacaggaagacauaacacuggggacaaggaagugaugccccaaauauccccugaagugaagcaaaaacuuccugaggaggaaguaucacacagaaaguacauuuuaggguccauuuuuaggaacagucaugucaggucccagaugcccagaagauacaguuaaaauagucacauggcaguuaucuuucagauaagacaacagaggauaaagaggcuaccuuccuaggugcuagaucaugaagagaugucuuuacccaaaaacucuagggucccuaaguuuuccagcagcacuuccuuauauagcucucuuugagaugguuccaguagcuuccacucuccucuggagaaauccacagacacauccucaaauguuacagauuccuagaagaagaagcauagcaucugugagugguacugguuccaauagaccuuaaggauucagagaagcaguuaggagcucuguguguguguguguguguguguguguguguuaguuggaaaccaaacucagggacugguaaaugcuacuaaguguucucucuaccucagccuucuuacuuuuugccguuagguaguucuuacuaaguugcuuaagcagguucugaacuugaguuccuccugccucagccucccaguagcugggauuauaggaccauggccaaccaggccuggaaaauuuuuuauuuuuaaaaugauuuauuauuuuuauguacauaaauguucugcuccauauauguauguauucugcaugugugacuugugauucuagaggguaggagagggcauuggauccccuggaauuagaguggaggacaguugugaccugucacgugguugaugggaacugaauugaggucccuugcaagaacagccagcaagcguucuuagccacuacaccaucucucuagcacacuauacacacuagcagcuguugcgaacuuuagucacgugaaguaacguagugaugcuuguuauuacagagagaauguuucucucuucaguccaggcuagccucaaacucacaggaucuccugcuuucgugcuucuaauacuggacuguagguguguaccaccacaccuagcugcugcaaugcuuuaaaauacgcagccaaagagaauccaguuugguaauauacucacgcucauaaguacagucacgaacauacuaacucauuaaaaucacguuuccagauuccuuacuccuuuguaacuugcuuggaacccacacuggcuucaaaccagccaucuugacucagcuuccugaguucugagguuguacaggugcaugcuaucguguguggcuuaaaacuuuguuuucuguacgacagaaucuaaaucauccccugugucagggaggcaggacaguggugucuucaagagcuuggaauagcaucuugucaauguuauaccauccaaaauauaccaggacccugagacuucaaacaagagaacuauauccucucacaauuccagaggcuaggauaggagaucaaggagcuggcaggcguguacucucuugagccuguuucugggggaaaauccacucuuugccucucccagcagcugccagcaucccuugacugugggaagccacaugugccguugcagaguggcacugacuacugcuggccaccacgcauaaguuuggacaaacaaccaauguguacauaugcaguaaaguuuuuugcagacacugccuggcccgggcaugauaaugaggcuuugagaguauaaccaaucagaugugagacaugcaaaugagguaugauaaugaggcucugugagguacagagagagagagagaguagccaaucagaugaggaacacacaaaugaggcuuagugcauaaccaaucugggugugagacacgccucuccuaggccuauauaagcagcaccaguucugggcucagggucucuucgccucugcaaucaagcucucccaauaaauguguacagaaggauccuguugcaguguuguucuugcugguugaguugggcgcgcgcaagacuugaccuuccuggauugugguccaguaccuuuagcugccucccucucugcaucaccgccaccuucacucuguguucaauuucucuaugcuucuugaaugaagacacucaaggccuacucccauaacccagaaccaacuccucaucuuuucaauucuauuucauuuuauuaguguuguucaaaacaggguuucucuguguagcccuugcuguccuggagcucacucuguagaccaggcuggccuuaaacucagggauucaccugccucugcuucccagugcugggauuaaagauguuugucaccaaugcccagccaucuuuccaauuuuaguagcaccaguucuucaucuuaaaacccauaacuuaacuacaccuguaacgaauaauuuuucuucaagcaaauaauauuuacaagugccagggccugggaaguagacauacuccuagaacucaugauuguucuuguauagaaguauuacguguaacugugauuuccccacccccaacugguaauuaugagcacuggaaacuugccgcuucagaaccaguugcucuucccagcuacuguuugaguucuaguccuccucaguugaacccaaggucuuccaaauacaccauaacauugccuguaaauaauaugccuuuguuucucacacuucaacacaucucauuuuucucuuacuucacuugguugacuaauauguucaggaaauauugacauuuuccuuucacugugagcccugcuuucuuucuucuucuuguuuuaaucuccugagucuaccuauguggagauguucuuuaccauauuaggaaacuauaauucuauauccaccugacucauuucugucaagacuaacuuuugggauuuaguaaaugcuucuggccucaaauaauuugggggguggggguggugcauuaaguauguuacaacaugccuguggaggucagaggucaacccucuggaguugccucccuccuucgacuauauagaugugggggggggggcgaaaucagacucaccugcuggagccuucgcccaccccgccaccucacuggccuuaaaugcuuucaguugaacccaaggucuuccaaauacaccacagcauuagaauuuuguuacagucugugaauccaaauaaacagcaaguacacagugaagcacaaguugcccugguugauuuuguaucuuuaugcuccucacuaauaucucaguuuccauugaagaaugaaaaccagugaaagcagacuuacacguggcucaggaucuggugacgccaucaccaccaccaccauugcaucuucucccaaauccuccucuuugcaaacugcggaagccugagugcugagaucugggaaaaggaaaaaucagcuccacucuuugcacuaaaccagcacucaccacaacccacucaagcuggauucguuucccagaauggcucagaggaaaccuuuauuugccuguuuaauauaaaggauaguagaaaggcugcaaacagccagauaaagcuacagaggacaaagccugcuucugaauguaccuccagccuggacacauccagacagaaacuccuuccaugcccuccccaugggaaaccacccucccggaacccccgugugccuagcuuucuugaagacaacugcaucauguaggcacgaccaaugacaucauuggugauccucucuacuuucagccccuccccucucuggaagugggagcugugaguucuauccuucuauagcugcacuggaaaucagccuucaugggugacuauuuauggacauuucaaauaugaccucauuaaauucaggcauggcuaccaggggcuuaugauaaaugacaagacaacugucuuucacguuaucaucuauugaggguucuggaacagauuucaggaaccaaggaggaaaggcauuuauugcucuagucacuugggacaugacaaggguuccaggggcugcaggccuggggugugugugaaaacccaaauacuuauuuuauaauaccacaguguuucaugguucucuggagccgaggaaagaagcaaguuuuccuucucuuuaggcaggacugccacagaggucacuuuauauauaggcuucccccacuauuuucucaaaagaucuuuucuguugagucuacauaacugaauuccuuccuuugauauaucuuuagcuauauagcacucuguauaauagaguuuaggaaaaaaauuuuuuuuuuggggggggggguuucgagacaggguuucucuguauagcccuggcuguccuggaacucacuuuguagaucaggcuggccuugaacuuagaaauccaccugcuucugccucccgagugcugggauuaaaggcgugcaccaccacacccggcuaauauuuuuaauuuauaagaucuaccaagguaaaccagcuuugcucaaauauuauuuauagcuguugacugaauacuaugauaaccccccccaaaaaaacaaaaaacaaaaaaacaaaugugccucugggauugcuagcugauuucuacagauaauagcuaagaagcaagaggacuucaggggcuggagagauggcucugaaguuaagagcacugacugcucuuccagagauccugaguucaauucccagcaaccacaugguggcucacaaccauccauaaggagaucugauguccucuucuagggugucugaggacagcuccaguguacuuacauauaauaaauaaauaaaacuuuucuuuaaaaagagagagagagagagagagaaagagagagagagagaacuccagugugaguuugagggggaacagcagagggugaggucuaggagcuccaacucacagugacuaaacauacugaacaucuucagaugacaauucuucuucaaguaaggggaaauaauuuuucaacccauucucuaccaucuuauaacaagaacuguuggcauuuuuuauugaccagauagcuagggggaaauuauauaaagaaagaaguauauaaagaugcaagaggauuaauuuaagaaacuuguucuuccuuacagauggcuguuagcaauggcuucuucauuguaggaaucuucacacagaggcagcgaugggcagacuggguucuaccacaagcucuaagauggcuaggagaaaguacuguuuacugccaccuuuugauuuuuggucacacagauaacuuacauaccuaaaaugugggcugccugacuccucucugauuuguguaucacugcaacaugaucaacuucuaaaauuagggucccuaacaagagaccccacaaacugaucagaaguaaucuguaaaauagaauguuucccuuaaaucaguggcucccaauguucuuaaugcugugacucuuuaauagagcuccucauguuguggugacccccaaccauaaaauuauuucguugcuacuucauaacuguaguuuugcuacuguuaugaaucauaauguaaauaucugauaugcaggauaucugauauaugacccccuaagaggucuugacccacagguugagaaccgcuaccuuaaauuguccuuuauuuuuaaauauauaguuguuacuuucaaucuuagcagcauugcuuccuuugagagguuuaccucauaucuuagggggccccucucaccccccaccccacccccacccuccaccuguaacucucaccuuccuuuucuucaaguguuugguucaagucuucuaccagggucaccaccuccacacuacucccaggaugcugagaauucacccaaauccucaucucuccaggcagaacccucaggaacugcucaaacacuaacagcucuaagaucugcucuuuggugugaaugucuggucucagccacugcuugcagaguucccagaguugauucaggguuuuucuggguccuucuuccugcgaguaacaaaaccaccugaacuucugccugaaagacuccaggucaucaguauuuccucuuaacauacucuccuggacccucagaguauccacucuggggacccugcucuguucacucaaagccaaagcugaggggccugucgucaugucugagggcacuaaaccuugcaucguaucagcagcaggaauccaguccucuuuaggcuaucugaguaucagugggaucugccaacagguacuaucuaugcacggcaaacuaccaaaggcuccaggaauccaaauuacagucuugaaggaacugucaagaagaaacagaagacacuaaaugaguaaagggaucguuaauucugaaaacauugauuuuuuuuuuauuacacacgaaccccccuuccaccuauacccauauauuuagagguucagaaaagcuccgcccaaccaacuauucuacuaaaagaagacucuuuauggaauaaaaacugaagaguuaaauaaagauaauuaaauauacucuggccggguagugguggcgcacgucuuuaaucccagcacuugggaggcagaggcaggcaaauuucugaguuccaggccagccuggucuauagagugaguuccaggacagccagggcuagacagagaaacccugucucagaaaaacaaaacaaaacaaauaaauauauucugcaagcagacaguuacuucagaauuaauacuacucacauacaaaaugaauggaagaucucccugguuccaagugauucgggcacaaaccuauuuaacagguccuguccucuuucaacaaacacauuuccuaccagucacucaacucugaaaccugauuucauauucuacuaccaaauuucuccucccuagucuuacuuuucauauaguaaauaacacacuagacucucucuaccuuaacauuuauuuuaugcgucugaguguuuugccugccugugugcauguguaccacaagugugccuggugcccauggaggucaggggguggcauuggcucccuggagcugaagauacagaaggcugugagcugccaugucugagaucggaacuggaucugaguccucuggaagagcaacaggugcucugaaccuuagagcuucucuuguaagucuaguugucuucaauccacucuugagcuguagccaaaggauuucuccuaauucucaaaagccgauccugucauuucccugccuggaagcccuuaacaggguccaccaagaccaaguucaaagcagagggcacaaagaauaaucuuaagauuugccuggauaccucauagaucgacacugcagccauacagaaaccacacacaaaaaaccacacacagaaauaccacacacaaacucucucugucuuuuacaccagcgagauucccgcccccucaucacuuggaaugaugccuuccuacuccuaacaauccuuugcucauucuucccaacagggcuccugggucucaggggugaagagcauugcggcuuuagcagaggaacccauaaucaauucuauuccugucaccuauauagcagcccacaaccaucuguaacuccaguuucagggaauccaacacucucuuuucugacaaucgcacagugcagauauacaugcaggcaaaacacucauaaacacaaaauaaaaccagggcuggauacugcucagugauagaacacuugccuagcaugugguuucaacccucauuaacccccacccccacccccaccccaccagcgguugggggaaccucacaggaaccauaucaaaaacaaaagcuccgacucuucucuguugacaggccaccaccaucgagugaaauuccuuuugaucucuaaaugaucuuuugcacacagccuagccugugcugcuugcauucauucauaccauaaaugacugggaucuauaaagaugggaaugggcacuguggggacaggccuguagagaucacuuacaucucagaaauaggacccgagauguaccacuauuuggcaggauauacuagccucuuauugcaauuaacauagcauuaaccauccaccucaggacccgacacccagcacgcgagaugucauuuauuucuuugcuaaccaucaggcgcccaccaugucaccuggcaccccuuuggguaccugggacuccgcagugacugagacaugcgcagcugcuucaacagaggcucugugaaaaugugacgcagguacugguucccaacgcguaggagaaagucagcggcaauuuaccccacaggugucagcuggcaaagccuggagaccuccagcuuauuaggaacgcggaggaaggacgauccagguuucugauugauacagccagagacgcuguucaacaucuaauaaaaggaucaaacgcauacacauacauucacgcgagcagacacaccaaagaauuauauggcucaaaauaccaaugguggcgaaguuuucaagacuugagcacagggugguauggaaggacgggaaggcgcggugcugcugaagugcacgcccccgcagcugcagcugcagcgcagcgcgccuggugcgagggacgcucugggucccaauccgcccaaggcgugcgcucggagcccacaacccgcgcagccccgaaccgaacggcggaaagcaccaauaccugcaccagcauccgcagccagcugcaccgcaauaagcguucagaaccuugucccgcagcagcugcgcgcgcaagacuucgggacccacugcgccugcgcaaaggcuaggaacuacgauucccgggguccgcuggccuggauuucagaaacuccagugcuuuccauaggcuauuaucuggccuguugcgcauggucacagaaaagcgucuggggggcucagcugcuaaauuauugcugcgccagaggcuuagaggccuagaacacacuuagguuuuuagaucuaagcaguccggcauccacaguaaccuuaaaucuuccucagcuucucccagcaccacuguucauuagaaugcaaaguugcaaaaaauccacugaggaaacauuagggaugccuuuaauguaaaccauaaguaacacagcaaaaacacuauacaaaugucauccucuggcuuccacaccugccaccaugguccaagggcaagcacccuacacaaagcuuugccugcacuguugcaauagcuucuucguuuccccccuuguccaucacuuauaccaugucuaggcagauuaugucccucccaaggaaggacugcucaaaacgcuaguaucuuaguuacuugcucuuuuacugugauaaaauacccugacaaaggcaaccaaggaggaaagggauuuauuucagcucgcagcucaagguacgguccucauggcagggaagucaaggcgucaggagccugaggcagcuggucacguggcauccacaaccaugaagcaaugagcuguggaugcaugcuggugcucaugucccuuucucuacuuauacaaucuaggauuuccugcccgggaaauggugccacccacagcaggcaaucaagauaaucccacauaggcaugcccauaggcaugucuaccaagugauucuagaggugguuuaacugauaauggaagauagagccguggcaucccaguaucccagagaugauaguaguacuggaauguggagacauacagcagccauugaugggcaggagcaaguuaacacaagugaggcagaucacauuuaguaaagaugaccacaucagcaucuauaucuacucuagaagauuguccuacaaguauacugcugauguaacuccuuugagagcaguuucuagauuuuugaaauuagggugacggcucuuagcucauaaaguccagaaaugggccgagggugcuguuuaaugguacugcagcugccaaagagcaugaaguuugcuucugcguuugcuucagauggagggugggguguucauuugaauguuuaaaagcaggauccauccaucauacaacccaaguuuuuuuguuuuguuuuguuuguuuuuauuauuuuuaaaagauuuuauuuauuuauuuucuuacuuauuauauauauauauauauauauauauauauauauauauauaugaugagugcacuguagcugucuucagacacaccagaagagggcauuggaucccauugcagaugguugugaaccaccaugugguugcugggaauugaacucaggaccucuggaagagcagucagugcucuuauccacugagccaucucuccagcccuuguuuuuaacuuauaacaaaguggaauuguuauuaucuccauacccugaauuuuaaauucuccuaacuagaacagauaguguguacucuuuauauaaagauggcuucuuucauucacuauuaugccuaugacaucugucaaaauuguugcuuaugguuaugaacuagcugaucucauugcugcauggcauuccccugugauuaguuauuuacauuaguuuccuguuuauacagcucauaacucagcaccuguucugcuacauggauagggaaggaaguacauauguaugcuuaugugugucuuuguaaagggcugacugguuuucuaaagcccuucuagaacagugguucccagccugugggucaagaccccuuuaggguugaacaaccauuucauagggguugccuaaaaccaucagaaaacacagauauauuauuauucauaacaguagcaaaauuacaguuaugaaguagcaaugaaaaugaauuuaugguugugggucagcacaacaugaggaacuguacuaaaggguggcaauguuaggaagguuaaggaccauugagcuagaucaaccugaaacugaaaagccaagggccugccuacuccucccaccuauguuacaggaaaaaaagauguuguuccaggaaucguucgugaaccccaaagaccaccaaggagccguuucugauguauuaggguuucuuuauuacaagcuugggcuugggcucuccuccaaccuaauccugacacagcaggaugggcagggaaggcagagcagccucgaacccucagcaggacaagguuuuauaggaaaauaggagcaaguaagggggugaggagggguguccagucuggcaagcaucuaauaaaaugacuauaaaccgacaggugggugcucugaagcaagacuguauacauucacaaacggucuuaaagugcaucugaaacaaccagacuaaucuuugauuaacuguuacuaggaagucguuagggaguaacucuggccaaggacaagccaugagguccuuccugguacgugggucagcuuggguucuguuguaggucaaguucgcaggauuuuuuuuuucuuuucuuuuagauggaggcuggucccaagauagaguggguuuggccucucaaagacagugcagaaaagaggcaugcccaaggucacuuagacagcagcaaaguggcagccaaucagcucugcacagaaaaaagccuuuggggagaggaauccucauccauacuuagaaaaaaaaggacaagacuggaucuuagucgauaguauuggacaggugaguuuuauuuguuggcuugcuuuaaaaaaaacuugcuuauuuucauuuuauguuuauggguauuuugccugcacuuuuagugccuuugaaagccaggaaaggguaccugaucuccugggacuggaguugcagguggcugugagcugacagguaggagcuaagaacagaauccagguccuuugcaagaguaacuagugcucguaacaacugagccaccucuccagccucugcuugcuuuugugguccaugcuggccuuuaauguauagccaagggugauaaucauaaacuucugacccucagaccucuaccuccugagugcuaagacugcaggcaggugccaccaugcuggguguaugggaugcuagagcuugaagccagggccuuauguauacuuaaaaaaaaaaaacaaaaacaaaacacucuaucuacuaagcuaccucccuaguucugcggcaguuguugcaaaacuugauauuaguugaacacaguggugcacaucuguaauucuagcacucagguugcagcagaaagaucauguguuugaagcuagcuugggaaacauggugagacccuaucucaaggcaaaacaaaacuccagcuguugcuauuguuugcuccaaaugcugucuaauaaaguagagugucauuucuaaaugacacguugacauagcuuaucuuaggcugccucuuagguaucuccuuaggacuuggaggguucauggcauccagucuguaggcccugagcuuggaaggugugccuccuccugggacacagguccucauuccucuggcuuugcuggcacuccaaggaucuuagugacagcaggaggccaugcuucccucucuaggagaaauggagaacuuuccucccuagcuguguaaagccuuauaaagggugacuaguucuggaaacagccaacaagccagauguaaacaguggugaguggccacuggagagaggugagaugaaggagcagaccaagauggaucuuacaggacugaagagauggcucagcaguuaagagcgcugacuguucuuccagagguccugaguuuaauucccagcaucuaccugguggcucauaaccaucuauaaugggaucugaugcugucuucuggugugucugaagacagcgacaguguacucauauacaugaaguaaauaaaucuuuuuuaaaaagauacaucuuacaaguaaagauucuggaggaaguacacauggagggcuaaacccugggcagcuagaggcaaagcuaacucuuccucagaacagaaagaagggaggcacuugcaaggaaauauguaauagaaggcaucugagggauuccccacugagaucgcacagcagaaggaaggagggaaauggggccuaaagccuguggagagaucaguuugugauaguugcugggaagaggauugcugagcggaaauacauagauucucucacaguguuaagggcccauuugagauuagaaaucauccauccgugucucaugacugauuuuucucaagauacauaaaguagcccugcagcagaccagaguaaaagagcagugggaugggagcuugugagugaguuugacaggaggacagaaggaugagcauuugagauuguuuuauugaagugaagaggguuagaugagggagaggaagaaguaacugauuuaaaaaugagaaaggguguagcacaaguuuaaucuaggcacuugggaggcagaggcaggcagaucuuuauaaguucaaggccagccugaucuacaaagugaguuacagaacagucaaggccaaacagagaaacucuaucucuaaaaaucaagaagaagaagaaaauggaggaggagaaggaagaggaggaagaggaggaagagggagaggaggaggaggaagaggaagagggaagggcaaaggggagggaaaauaaagucuuacuuaguucaaaggguuuauucacuacuaugcaacccagugguuucacucuuagguauuuagucaguagaaauauaagaaucuagcugcaaaaaggccauugggaaaaguuugaguaugcuuugcuaaugauugucaaaggccgaggacaauuuaaaugcuaggaccuuucucaaagacugauagcuguguauacugugcaccccaugugccagggcucugugaucagaggauaagucugaggggucaguuuucuccuuuaacuaugugggucccccgucuugguggccagugccuuuacccacuaagccaucucacuaccccauguauuuggcuucucaucacugugacaaaauaccagcaggaaaaaaaaggagaaacaacuuauuucuggccaugguuucagauauuucaguccauggucaacuguugcuuuaggacaacuugucuccgccucccagugacgucacuuuacaaauccauuagggaaugaauccacagauaaggugagaguccucaggaugcaaacacuucuccagagugccacgugagucuuuggaggacacuucauaaccaaacccaaacagauaaacucccacauucacaugagauaccacucagcaguaaaaagaauagacuaccgauaaacaugaccauaccccacaggcagcauguaaggucacauaagccagacacaaaagguacauccaauaggauuccacgucuaugcauuaaccaggcccgacccugcucggcuucugagaucagaugggaucaagcauguucagggugguaugacuauagacaugauuccauuucucaaaagacagauguagaggcagaaaucacagaguggauggcaaggacugagagagacaagaaauauugugguggaaaguccuuacauggaccaguguuauggcuugacaguggugguaagugugugacacauacauuuguuaaauagaaauauacacauuagauauguggacuuuguuucuagcugaucucuaccucaauagaaaugaaagcacauugcuaugguuugauuguggucugugcuccaaagguuuuuugguuacaaucuugguccugaguguugguguugcagugguaagaucuuuauaagguggggcccagggggaagguaucucauuuaguuaagcacauaguuguggauaucgcccccacaggcauuaaugcuugucuguggauuguaugaauuccucauagaguguauuguuacaguaagaccaauuauacaucgauggaauaaccuggugugucagaggccaaacagaugugcaugccuggucuuggacuuccauccugucaguaaaguaaauuucuuuuauuuguaaguauccaguuccagguacuuuauuacaucgacaaagaagaagcuaggcagugguggcacacaccuuuaaucccagcacucaggaagcagaggcagcgagaucucugaguuugagucuagccuggucuacagagagaguuccaagacagccaagacuacacagaaaaacucuguccugaagaaacaaaacaaacaaaacaaauacacauauuuucauacaaagacucacagcaucuuacuuguaaugauaaaaaaacuaacucccucugaggugcaggcauuggugaaugggugaacaauuguuauauauauguucuugcaacaaacuacugcgcaaaggcaagaugcagucuugauacaugcugcagcaaggauaaaaguaacgucuaagccccauaugcuuagcgagcaugaagcucccagauucaaccauuacacaugucccagagaccucagcagagagucugggggugcaggugggagugagguugggucaacccaggaaggagacacaaaaacauggagugugcagugcaggaauggaacuauuagaccucuuuucaguggugguggugguggugguggaggguuugguguugaggaccucaagguaguccucgcgugggauaaauucaagcagaucuuacuuuuccucugccugguagcaucaacugcacugucauagcugcgguugcagcucagugguagaguaccugccuaacaugucugaggccuggguuccugguacaccaaugcuaguucccauuuguuuguagaucuuuucccucacagauggguccaucucguucaaaagccaacaggguaucucucugggaacuuuuggaauuuauucuuugaacuuuuuuauguguuuucccuguguuucaauugucacaaaccagagucaguucccaugcucagggcugguuggccgaucugcaaaggccucauugggugggcccuggucugcaggaacucaauacacaggaagacucaccgaccgcugugaugcagccaugagguuuucuguguugcucucaccucccagacuguguuccccguuuacuguauagucugcauuuuccucccugauaaucucugcuucuucuguagccuuccauggcaccucuauuagaucuuugagaauaacucugugugugugucuguguguguguguguuaaaugcuuauuuuagaaggcucaacauauuuaaaaucuauccuagccuuucuuuggccucuagcccucucuaucuugcuuagugguuguaucuacucugaguucuacacuaacauacuugagaauaggcucuuguuccugaauguccuuguccuagcugucuuugaacugucucuugacuuuguaacugaucucucucucucuguuauuuccaucuggaauguugccauagcugcugaaauaguugcuuuucuuuguccuugcuuuccugccuuccucaaagacucacaagcuccccggugugugcauaaacugacgacaaagcaauggaucacacuggaucucaacaaagugaagguaaaaaagaaccacuaauagacuacuccauucuuacugucucauaaaagcagccaccgagauuuuccugagauucaaauuuuucuuggcaguaaauucuagaaaggcuuuuucuugguaaaagagcaucaaaaaauaaaauggucgauuuacuuagguauaucaucauuuugggaggauuuuuuuucccccaaguugaggaagaaacuuaggguuuagcccugggcuauauuucaagaccuuucucucucugaaauuaaaaacaguguguguguguguguguguguguguguguguguagaaaacagcuauacaaaucugacugagagcccaaagcaggauccuaacacccaggaacuauaaagguagcuggacuacauuaucuaggcaugagaaucuucuaaagcaguauuuccagagcuguagguuaggaaacacaagacagacaaagaagaaaggaagaaacaaagaaaaaggcaagcucgcuuugcagaggucaacuguucauucggcauuuguaaaaugaggaaaagcuggugcugaaauaguucaaaaacgcccuagcucaccacccaggcagguugugucuguagccaaaggaaagggagugagauacagacagccccugcugguuacagcuuguaucuaucuacaaacaagguuggccucguucacugcuggugauuggcugagacucagcuacuccuugccagaguggugcaaucuguuugcacaucaaguuaggcuccagugcauucacuaggaccaguagaaagaguuugaagagcucuuuugggccagaguuaauuuggcagcuuugggccacgcugaacaauuccacucugcuuaucuucacagugauugucucaaacgucuugaugggcacagacgccucaaaggagaaucuucugugcgucccacugugggaauuccuagcauccccaaccugcagugcaccgcgugaccaaguggucaggcuuccuuucugcuguauuugaaguggaacugccucgacccagcuguggugcccugcgcagagccucccucccaugcuuucaugucacagucuguuugcuucuuuuacguucaccagacgacugacccucccagacuuccuuuuucacggagucugaagacaaagucugauacaggcaaaaccuguauuuacuuuuauuuuuauuuuuuuacugacacauaaaauguguacauauuuaugggguacugugauaguguggggcuuuucuauaccugccuaugucccugaauaaugacacagagauguauauauuuauuacuagucuaggcacuauagcugggcagauccugagcuguucuaaccugacugugcuuccagccuacguccuagucacgugaccuacuaucuuccauuuuagucucuuccugguugcaccugcucuauccauguccucauggggacccucucacggcaacucccuccaggagacucccucauggccucuccucacgauucccuccaccugggacccccucauugggcucagaagccccaucuuaacucuccuguccagcuauaggcuaaucagcucuuuauuaaccaaucagagguguugggcaacaguuuuuacacaguguugagagagaagaugcuucauuagcgacaaugccaaguuuggaccgcaaccagaucuuuuggguacagaaaucagcaucugaauacccagugcacaaaaccaucccccaacaggguacaguauaauauucuauuuauuuguuuauuuauuuacuuugaaauugcauuuauuuauguagguauguaugugugggguguacuaugucauggcauguagauagaggucagagaacaacuuguggggauugauucucuccuuccaccauguagaucccugaaauugaucuuggcagcaaguauguuuacuggacgaaccaucugccuggcccuagugcaaugcuuugauguauguguauguugcauauacucauauuggagugagcauaucuccacucacguaucugucaugucuucaugugagacauucaagacucuuucuucuaguuuuccugaaaugugccauauacuaucauuaucucuaguuccccugcugugugcuagaacuccauggccucuuguagccagacuuuggcuacuuugugaauucuucuuucuuccaccuuucuccacccccuuucuauccacucaaccccacuagauaggagagaaaacaaaggauagagggaaaagagggcaacuuuaucuuaggcuacucccugcugauuaggggcaucgaguuccuuggggcaaguuuaaucuuugccaucaguucuucuucuuucuucuuugugcaugacuacuuaacaaauuaugaugaauccaaccaacaacccagcccaacuccugggguccuagcauuuauacacccucagaauaguccccgaaauuccaaaugucacacaaucacagaaacuaucugcagcuggaaaaaucaugccccugcuacagcaugaagcaaaucauagucagcugcuauggauagucugaagcagccccauauccuauaccugggauuaaaaugaaaacauauccccauaauacuucuguauuuuucaaagaaaccaaaacguucucuacagccucucuuuguagauuaagcuucacuagaacauaacuguguuccuuugccugggaauugucuguggcuggggaguugugagagacaggucuaaagaguguaaauuauauacccagcccauauaccccagcccuuccuagaaaaugucuauuagugcugauauguggcucaguggcagagagcucaucuaguuaguauucaguagacucuggcuuugacucccaccaggaaaaaaaaaaagaggaguaaaccaagacaacacagagcaaaauauuugugagggaugcuaauagucuaaucuacugaagcaggggacagaauguuccaggaguauucccucugaaagcagaaaaaaaaaaaaacgcaggaagaaaaggcagaaggaaauaaaagaaagaaacaacugugccugauguuacaguggauguuuggggcuuugggggaauuaaaggacagcuagguagaaagugaaacagcgaguugaaacaauugcaaacugauaggaagcagcuguggguuagaucgauugaccgaggaaaacagcauugacuuaacugcaagagccaagcgcaguggcaaaugcuugcaaucacagaucauagcacgcaggagucuggggcaggaguuugaggccagucugggcuacauagugagacucuguuucaaagcacgcucccacacaaagagagcugcaaaacuacaugguagcuaagucaucuaggacuuuauuuaaccuucacuaugguugaaaacuucaguaagaaacugagaauuagacugauaugaagaggaaagacagaagcuugaagaggaauaguuuuagucagcuucgguccccucacuaugaugccauccagagacuguagaauccuuaagagguuauauuuaggggagaacaaugguguggagaaugccuuugaagggggcguuggaaccccagcuuccagcccguuccuugcugcuguuaggugaacagccucugaccaggacacucucgcaccugagacaggccuugaaaugccaggcagucaacuggcuaaacugugagccgcaguaaagcuucccucccuacaaggugguuaucuuaggcucucuuccaugaauggaaaccaaccaaugcaacauugcaucuacuguccccguuucuuuaccaucccacuaaagucacaguaaaggacucacuaaagcauagcuucacaaagacuugggaaguaaaaaggaaauaacagcaagacagcuuugugaggaaaacaggcagguggaugaacgggcaagaauuuaccaacauuccaaaaaaaaaaaacaacaacaacaaaaaaaaacgcugauuuuuuuucaucaaggagcauggagaagggaugcuagacaucuauuucaugugucuuccucggucauucuaccuuguuuuccaaggcagggucucucacugaaccuagagcucacagcugagcauauaccugcugguuugcaagcccuagaauccuccugugucuguuuuccuaguguccuucuagguucccccccccuucuuuugugggugcuggggauugaacucagguccucaugcuugcacggcaagcccuuuacugacugaucuuuuuuccuuaguccauagccuaauguuauguuuucuuuugcaaugacaaagccucacaugcagaaggcaagcgcuuugccacgggaccuucucuaccuagucacucugcucauguuuuacagacauggaaagccagauaauuugugucacuuucccaugcuugcccaguuuauaaguagucggguugguguggaaacccaggcacucugacuccaaagccugcucuugaagucaccacucaugcagaggcucacucagguucugugucuuaaaucuucucacugugauuucagaucacauccccuucuaaucagugacagacagugguggcaagagcaguccuaggugguucuagaggcugcaaagucaaugaucaauauuagucaucacacauaaaauugaacccagagaaaaccaaccacacaucauuaacaggcaacagggcugaaggcauuacaaaggaucuccugaaaagggaaagccugugaccagacugguucauugcugaacacugacagaccuuuaagggcuaacacuaauguuucucaaauuaucugaugaaacagaaaccaaaggaauggcucuaaacccauucugugaagcuaguacuacugacugugaagcucaaacaagauaagaacacaaugaccauagaguaauuuucuugaugaacagagaugcuaaaauucuuuugaaucaaguucaacaacuuacugaaaaccaugacugacuugguuucauucuagggacaaaaggauaguuccacauaugacaaucaacagacauaaauuucauauuguauaaucauuugaauagacacaaaaugccucucaugaagucaaacauuccugaagaaucuaaaaauuuaagguucauauuucagcacaaugaaguccauguguuuauacagcgagccuauaacuaauauuauguagaaugaagagaaauggaaagcaggcccucuaaaaucaggaacaacgugagggugagggugucuucucucuccauucuuaucaguaucacauuuacauucuuagccagagcaauaaaggaagaaaaaauaaaacggauauaaugaaauacaaaagcaaauaaugaaaauuaucauuuuuugccgacaauauggucauaaaagaccuuaaaggcuucaugagaaaucuguuaagucugguaaauauugaaaagucacagaaacaaaaucacugcacccaaagcaguacuuucucuauucagcaugaaugaacacacugggaaagaugcugagaaaacagucccauucaauagccuugaacauacugacaaccugccugccuggaaacauaaccaaggaaguaaacgacagauauaaaacaacaggaagugaagguguuauuagcaguuggaagagaccucccuuguucacagauugucagaacguugacgaaaaugacccauaucaccaaaaugcacucucagauuuaaaccacuccucuuacaaacuccgaugacauucuucacagagcauguauaaauacgccuaaaauuaauauagaagacacuguguggccagcgcgagcgcacacaaaaugaccguugcuggagguauuccaacaccccauuucagauuauacuagagucauagaauaaaaaaggcaggauccugacacaaaacagaaauguagaugacuuaaauagaaucuagaacccagaugucaaccugcacaucugaagccaugguacuccacagagccaccaaagccauauuuuuuuuugggggggggauaagcucuuugguaaauggugguggaggaaagacagguuagccacaugaacaagacugacauaagaucuuuuugacucuguggaaaaucagacaaaaauggaccaaagaccuuaauguaaaaccugaaacuuugcaaguuuuucaggacaacauuuuaggguauggacacuggacacaacaaaauaggacucuaaaagccuggaaauacagauuguaucaagugagagcuucuucucagccuaagacacaaauaccagagugaacaggauggcggcacacugggaggguaccuucaucagguggccauccgacaaggguuaacaugcaggacauaagaagagcuaaaagcuaucaacccccaaagaacaaaugauccagucaguaaacaggggaauaaaaugaacagagucuuucaaagaaguaccagugacagguaaaaauaaggaaauuauucaucaucuugaccugcuagagaaaugaaaaaaaaaaaaaaaaaaagcaaaagucaagcuaaaaugcccugucucuggcucugccaugccugccaccaugccacagugcagaaguucucauuaaagaagcuuccagaacuaagaagugggcuucuucucuuuagaaaaagaaagacaacaacaaaccuuggaaaggauaugugggaaagagaauccuuauaugguguugguaagaauguagauuaguacaaucacuaaggaaaccaguauggggauucuucaaaaacauaaaaaacuaccaccacuccuggguguacccuggaggcuaucaaaucacaauaucacagaguucaccugcacaucuguaucgggacauuacucauaguagacaagugaaggaaugagcuaaaguguccaucaguggcuaaauaaggaguauguggugugcagguauacacaguagaguauuguccaucuauccauccagccagccagccagacaagugugucuuuuagaguaaaguaaguaauaaugucagcauacuaacagaaaccagccagaccaggaggacaaacacagcuuguccucucucacaugaugaguccagacucuaaagagaagacuaaagguggacuggguccugucugggaagaggacuaauacaagaggaaaucuggagaacaggugaggugagaauacugccaaaguccauuacagacgaguaugagaaugccccagggcuugucauuuuguacaauuaauguaggcuaguaggaauggaaaaaauaaaggcuaguagaaaagaaaaaaauaauaacaguuucuucuaccacaagaaacggacagagcguuaagcacaugagcagagauggaauaaaagugucaugcugggaucugagauguaaagcuagcaacacauaccuguuuaucuaaccuagaaaaugcuugcagacauucuaauacucugugcauccugcuaguccaaucuggccccugggacaacuccauuccggaggagcugucuucugccguuccugucaccucucuugcuggucuggguuucuuugcuaguucauucuuucucuagacgaaaucaugccauagucuaccuucucgccauucguuuucuuccugcuacgacuucuuccuccuccccuuuuccauuuuucuuccuccuuuuuccucucagcacugggacuugaacucagaauuguacacaugcuccguacucaguuccuuuuuauuguuuacuuuauuuuuaaauuuaauuguaucaccuuuuacuaauuaaauuuuauucuuuuacuuauucauuuuaaucccucuaacugccccccuccugaucacccucuaccaccauccuuuccccuuccuccuuccucuucuccucugagcagguagggaccccuugguuaucccccacccuggcacuuccucuuccacugaggcccaacaaggcagcccagcuagaagaacauaucccacagacaggcaacagcuuuugggauagccccuguuccaguuguucaggacccacacgaagaccaaguugcacaucugcuacauaugugaggaggcacuuuaauauguauggguaauuuugccugccugcaauacuuguggaugccaguagagggugucagaccccuuggaccuggaguuacaggugguugugagccaacacguggguguugaaaucuaacccuggucaccuacugggccaucuuuccagcccauuauacauauuuuuuucaacuuuacaaaaguucucuaugugacgagugacugcagggaccuguggaguugccuuggccuaugccuugagaggcaugcgucauagguuucucagguuagaguccaugguucuaggggcacaauguaccuuccaguuccugagagacugcugcacccuuucaugcagugaagccuucaggccaaucuauguaucucuguauauucccuuagucgucaaggaagcacugaagccugaaaggacaauuggucuuagacauuaaucuuauguacccugcguagcuuguaaacaucauuguauccuggcaaccacaacuguauugaucucggcaauugccacuauauuuuguuuccgauuaaaaagucugacugugcucaauaaacuugucacagcuucagucuugcuguggccccuccaaccugagccuggucucacuccuugcaaccauagcacuugaccuuggccugguaagcaagcacaggugcuuacaaaugguuugccuugguauguuuaaguguguacuguguaagugucuggugccuguagcggucggaagugggcugcugccugcugaccugugaacugaacugccgauuuccagacaguacagacaggaguuucucuaaagaaccuuccuaagcagguccacuucuccccccucccccccccccauguccuuucuuuccuacugucucuggugagugguggguuacaaggaagguuuaaggguuuaagaaccaucauuuaaaaauaagauuuggaaaaaaauuaaaguuacccugguaucuuuugguggcucaagcgagagaagcuggaagcaacaaugcucucgagacaggcaacacccugcuucuccucuuggcuagggacucggaaugcaauucaccuuuucagacuuggacuuguuuaggacuccaagagcccaaaugcucagugcugucuaucgguuuucuuuguguuugacuuccacuuuccuuuguuuuuuaaauuuuguuuauuuuuuauuuuuggugccucucuccccuauguaagcuuuaacuccuucacuaugggauauuuaagucccuuuggugggacaucugugucucuucccucuccuccccaacucuauuggcuguccuuggcacgccagucugaccaugagugucaauguguguuggcaguuucguuuagucauuugguugcugcucuauguuuuauauucagagggaaaauaaauaguuaaaaacuucaucugcuggccauuuaccccuugacuuagcuuuagcucauuucaaggauauuuaggaaaaaauggcugaauugggacaacaauacuugauaaacuggugcugcccuugaagcccuguaccugcugcuaggagucuagcccugcaggagaagcccugccuccugccuggaucaaacaagccaggagcuguugggggcuugaugugggcuaacaugggaauuugcacaucugcugcaggucccugccaacagucggguuuuuugaugggucaauaaagagccaauggccaauggcugagcagggggacagaggcaggacuuaaaggauuccccggcaagaaacacagacaagagaaggggcagaagagccuugauggggaagcagaaaggucagaauuaagagccagcagacacguaagagucagggaaaguggccccaggggccacuuccccaauuaggucugggguagcagagaugaaauauagauauaucaaauauuaacucaggaauaucagaggggagugguguuagccacguggagguucaggaguggcccagccauugagcuaguaaggcucauuaaaaauaacacugugugugugugucuuugucugucauucgugaauccagagcucuuggguggguguagagccacaccuaccuagcagaagcgcagaacggcuuaacagcucaccacuagaggaagccgcuugaucugcacaagcugcucuuaaaugggcaccagaggcuucucagccucucuaguaagaaggcugauggcuaguccugcugacagcccucugagcacaugaggauuggauucagcagguggccaggugcuccucccuggaaacugaagcuaaaagaagggguguucucuguguuuuaaauguauaaauguaugugaccacuaugucuuuauuucugacugguuuuaaauguauaaauuuucuauguucagcauaucuugguuguagguuauuggacuauaaauuauuggguaugguuaaaaaucuguaacauuuguaagaaaaaguuagcuuaaaacaaguaacucaggguaggagccauucugggcaaaacacauggcaugagccagccuaggaaaacaggucucuaaagauacuuuuaaauugggauaaaauuuuuauauaauuccugaccuaaaaacagacuuauaaaagauagugaaaacuauucugaacaauaaaagaacuucugggggaaucaccaucccugaucucaagcuguacuauagagcaauaguuauaaaaacugcauggcauugguacagagacaggcagguagaucaauggaauagaauugaagagccagaaaugaacccacacaccuauggucacuggaucugugacaaagaagcugaaaccauccaguggagaaaagacagcauuuucaacaaauggugcugguucaacuggcaguuaucauguagaagaaugcgaauugauccauucuuaucuccuuguacaaagcucaaguccaaguggaucaaggaccuccacauaaaaccagauaugcugaaucuaauagaggagaaaguggggaagagccuggaacacaugggcacaugggaagauuuauaauaucuaaaagguuaagaauaacugucucuugaaaccuauucccccaccuuccuuuaaguuugccugaccucuggcaaggcucagacaguccucccaauucacuugcuauugcuuccuaaaacuacuuuaugauaacuaccucucaaucaaaguccuugccauuuuuccccaacuuguuaacccuuuccuguccugacaguguuauguucuauaaugauauaccauauaaaggucagaagaauucccaaucucuuuauggacuauguuuauggguuaaaaaguuuuauuuggauauuagaagagcuucaauucaaaacuaugaguuuuaaggcucaacccuaacaacuuuauaaauaaucaaauccuuuaauguguucagaaauauauuuugggucauacuaagaacugaugcaguuaauuacacgauuaagcuuuauuuagucucauguuuuguguuuguaagguacaguuuagaguagauaacuaaaaacagacaaaggcuguuuaacucagauaugcuugguaggaacuagcccucaaaccugucagagaucugcugaauauggcauuuguuaguuuaaauuuuccaugaagaacagagacucccagauccuaacagugacacccccugaggucuccaugaagauaugggcacaaugauaaagggcagcaucuggguuguggugccauaaccacugggcauaauugccucaacgcuuugcuugcugccagggcccugcaggaacuguggacagacagaggacagcuggaggauugauugcuguguguugcuuaagaccaggccaggucagucucuuccauguuccuccuccacagaaagccucuuccucuucuaggcuugauagccaaagacugccaucgcugaugugugguucaguugcagagagaucucuuguaauaaugggaagcauagauuaacauuccuccaacuucagggacaagccauaaaauaggagauguuccugauaaagauguugaaaaauguuaucaagaacaauaaagaagacacagcagaugcugauucaucaccuuuauaugggggagccaauucuggcagaacaccaaccauccucccacuaagguagaugauugauaugguauguuuagguagaacaacggcuaugaaaaaagaaaaauuacaggcacuagaacagcuaguuaaagagcagcuggaggcucaacauauaaaagaguccaauauaugucucuaguaaaaugaaauaauuuuuugcauauuauaacauaaagccauacagguauacaaugcaauccuacaggaugagcaguugaggacugaucuaaucauacuuuaacagagauguuuaauaaacagaaaggguuacaaagacccccagagauagaguacauagugcuuuauuaccuuuaaauuuuuuaaugcuaaugaacaaaaaauaacugcuguugagagacauugaaaaaugucugcugaucccucuacauggucugaaaguggcugagacauguaugucuuuagccaggacuguagcaaagcauaaccaauaaaucuaguuggcuacagaguccucaggacuuauaugccaaucuuugaaauggaauggauuaauuuuuuucuuuuuucuuuuuuuaaagauggaucuaucuaucuaucuaucuaucuaucuaucuaucuaucuaucuaucuaucugaguacacugcagcugucuucagacacacacuagaagaguguauuggaucccauuacagaugguuguuggccaccaugugguugcuaggaauugaacucaugaccucuggaagagcagucaaugcucuuaaccacugagccaucucuccagcccauggaugaaaauuuauauuacacuuugauuauacagucugaacugacuuauagagaaagacagaugccuugaacauaggugucaauuagucauugcugugaagagacacuauaaccaaggcaacuuuuauaaaggacaacauuuaauugggacuggcuuacaguugcagagguucaguccauuaucgucauggcaggaaacauggcagcaugcaggcagacauggugcugcaggaguugagaguucuauacaucuugauccaaaggcaaauaggagaagauugacuuccaggcagcuagaaggagggucucaaagcccaccccccacagugacauacuuccuucaacaaggccacaucuacuucaacaaagccauaccaucuaauagugucacuucccaugggccaagcauauucagaccaucauaauguguuaaugcagaaauauuauauugccuuuaaaaguuuacagagcaaaaggaucaaguaccaaagaagacaagucaaguaguccaggagauaaagccucacagaaucccucaauuacuguuuccugaaagacuucgugaauuuuacaggaaaaaagaauggaacuugagaauaucauccugugugagguaacccagagccagaaggacauguauggauguacucacuuauaauucgacauaggcauaaagugcccaauaaccaugcugcaauccauagacccaaagaaacugggucguaaggaggucccaagggaggaugcacaaaucucacuagaaggguaaacuaaauaguuauaggagguagauggaaagagggaacuguguaagagaaggggugaguaggggaacagggaugucaauuaggugugaggagacagagggcgggagagggcuggaagugugucuuagucaggguuccuauuucugcacaaacaucaugaccaagaagcaaauugggaaggaaaggaucuauucagcuuaauuuccacaucgcuguucaucaccaaaggaagucaggacuggaacucuagcaggucaggaagcaggagcugaugcagaggccguggagggauguuccuuacuggcuugcucagcuugcuuucuuauagaacccaagacuaccagcccagggauggcaccacccacaaugggcuccuucccccuugaucacuaauugagaaaaugccuuacagcuggaucucauggaggcauuuccucaaaggaggcuccuuucucugugauaacuccagcugugucaaguugacacauaaaaccagccaguacagagugagaauggaaaucagcagggucaucucuggugacuaguuggaggccuaggggugggagaggauauggggauucuaugagggugacucuagcugagauuccuaccacagggagauauagagacugaaguggcuaccuccuguauccaggcaggacuuccagaggagggaaggaucaucaauccauccacaaauccuucaacucaaaauuugucuuacuuacaacauguguagggaugagauggagcagagaccaagggagggcauagucaaccaaugacugcccuaaccugagacccaucccaugugugagaguggaccacugacacuauuaaugauauucugcuaugcuugcagacaggaaccuggcauaacugucuccaaagaggcuucauccagcagagguuggaggcagaugcagagauccacagucaaacaucaggcggagcuuagggaguagaacgggagguagaagugagcaagauggaagggucaaggacaccacaaguagagcucuacagucaacaauccugggaccaugggucucacagagccuggaccacuaaccagggagcauucagggacuggaccuagaccccacacacauuuguggcaaaugugcaacuuggucuucauguggguccccuaacaaguagagugggggcuguuguggucucuguucccugccauuggagacccuuugggucucagugggagaagauguaccuaguccuagugggaccaaaugucccaggauggggugguacccaaggggagggaaucccccuucucugaggagaaggaaaggggacaauggguggagguauuuguaaggacugggaagagaggagggagcggguugcgaccgggauguaaacugaauuaaaaaaaaaaaaucuggauacagaauaacuucaaaauggcuaagacuguccagucucacagacuguuccagccgggacuucaguuaagcccuggacuugcccaucacauagacacuacuagacagccaauguuacagcuagcuuucuuagggcuugaccauuaucacaauuuccuuagggccugcaaaagaugccaucaccccccagacagcaggaagcaauuuuaugagaacgaugccccauucccaagaggugggugggugguuuuuggucauucaaugugcgauggauguuaaggggaggggggugggcguugaucgcaaguuguuaauggucuuggucagggaggagcaaaggaaaggagguuggacucaggcaucucuuuuucuccuuuuuauuucaucuaucuuucucuccuaucugguguuaagaggaaagaggaaagaagggauggaaagagaaaaggggaucuaggggugauacaacaaaucauucaaacuaaugagucuacuuuuaaacuaaagagguuaacaagucaaauaguuuacaucaguauggaauuuuguguauugauagaaauuuaauguuacauuuugcuacaacacgcuaugcauauauguuuuuacucuuagguauuguaaaaauguaauguaaaguccuaguccuugaaagcuacuauuacaaaauauuaggauaauuaagaaaugcaaguuuguagucagccugaaguggaaacuuaaggguccuuuggaagucaguuguguugauaguguuuuaggagcaaacaccugaagggcaaacaccugaagacuuaggcagacuugugaagaacacugaagcugacacaggagaaaggauguucugcuaaagcaagcacgugaaaggacaggugaugacggauucuucacuaaugacacgcauguauuggucugcuuuacauuguguagcugagcuccauuuguugggacuccauagagagaaaugcaccaaaaaacuucugguggugugcugcaguuuucuugcuauuuccucugacuugggcugauuggcagagugaugcuagcugcgacagacaaacagcugaggcgagacacguggaggacacaugauguuugaagaucguuuaaauagaacuugauggacagugacugaggcugagcuuggcuuguuuauagagcuagcugugcaacgcuuguggcuucaugucugcugaucuucgcuucacugagagaggcacagcugugccuggcugucucugcuaggucaggccaccgauguugauucauguuugcuaucccgacucuaccaaucucgacugcugguguaucugugaaguguuugccaguggaccaagcuguugcugcuaacaagugaacugaacugcugauuuccagucaacacagacaggacuugcuccaaagaacauuucuaaacaugucuacuucccuuguagcuuuucuuucccacuaccucugguuaaaacguuuaagaaccgucauuaaaaauaagguuugaaaaauuaaaguuacaucagucaaucaaacuuguguucauguauuaguuuagauaaugcauuagauaauuacagauguaagcuuuuauagccuccuguacaaguuuucaaaguuaagcagauaacaaauaguuagacacaaguaauguuugccuauucagauguccuauagguagaugguauucaaacacuucagagaucuaaagaauauggcaucuaaagauuuuuuauuaacaaggcuuuucaugagagugagacacaacugcuccuggcagcacccccguucuacuucaaagaagauaucgggcaucgaagaaccuccauauggaguuuguuucaaauguggcagagcuagccacugggcaagaaacugcccuugcuucaacuacugacagaaugcuguccaagcuguacacaagcaggacacggaggaagcugacugccaaacuuugcuaagacaaaguaggcaaguccuucaagauucuugcuucacagguaaguuugucugguguacugcgccagaagacugaaaaauggaugcucugacauuucagaggacucuugggcgacuguccagguagccaccaacccaugucauuuuugugguuuuggaggcugcuugcucugcacuuccuguuuauucagguaacauuuauuuuucucaggucucugacaggguugaggacuagauagcuuuagucucacaauuaaauuguuuaggauuuaagaacauguuuuaaagccuaaaaggauauuuguagguugauaaauguaggcuaugauagaaaagguagagagccuuggacucaccaagacagaauagaucuuagaguacucucuccaagguugcugucauagucaggguuuccuugcugugaagagacacugaccaaggcucuuaaaaaggacaacauuuaauugggaauagauuaccguuucagagguucaguccauuaucaucauggugggaagcuuggcaguguucaggcaaacauggugcuacagaaggagcugcgaguuaauagaucuugaucugaaggcagacagaaggaggcucuggaucacacuggcuaggcuugaacacauauaugagaccucaaagcuccaccuucacagugacauucuuucaaggcuccccucuuccaauaaggccacacuuccuaaaagugccacauccuaugagccgaacauauucaaaccacugcaguugccaaauacaaauggacuagacauugucaauguaguucuuaccugacaguuuucauaauuguucuugcuguauauaguuuauugauauuuuagaaauugacuuuuauuggacuaaaagguggagauguuggagugauguuuuaugcaccguguaaagauugccuauguauuauauaaaugcugauuucugauucagcaaagaucugauuacaggccagacuuuguuauuguuaaguaucaccugucucaguguuuuguaaacacucccucucucacguucugauugguuaaauaaggagcugaaaggccaauagcugaggcaagaguaagcaggaauuccuucagagacagggaggcuaggaaagaaagagguguggccagagaggcagagcaagcagcaaccaggacuaagacugagagauaaugagacaugggacauagaccagggcaguauugucggguuagaaaagcugauaaucuguccagcucuagugccuacgcuauuaaaaauauauuaugaacauauuuaucauuauaaauauaagucucagaacuggugcuggcacagaaaagccuacaguuauguguauguaccugcgcacaugugcacacaggcagugguuguaagguacacaacuauguagaucugcaaaaagucccaccauucuccaguacagaaauacauaauugcauaaaaaacuucugauagcauuacucacaacaguaaaaaugaagaaccuaagggcuuacaaaagacaucuuugcauaugcauaucugugugggaaggcgugagugugcauuugugucaguuuucaggcuagaguucaauggcagaugucuuucccaauugucuccaccuuaucguuuuugagauagggucucucacugaaucuagaguucuugguuugguagauuagcuggccaggaaaccccagggaaccuccuguuucugccuacccaggaauggaaauucuaucccuauucugugcgucuggcuuuuuauguaggugcugaggcuggaacucuggucuucaugguugcacaacaagcaauucacugacucagucaucccccagcccugaaagcacaguguaaaagccagccuacaaggacaauuuaaaaauauaguuuguuauauauuuaucaagcagacguuuaacagaaugaauacuuacguacuuucuggucacaauggguaagaaugcagguuugagcaggugugguagcacauguacucccagcucuggggacacuaagguagauaauuguagaggacagccuggucuacacagugaguucagaguccucccgguuuauacaaguuguccucagaauaagaguaaaagcaguaugguagaucugaguuucuauccaugugacagaaugcauguucccuggcuaccugauuaaucagacugaaucaaguaagaaaacaaaacacauucagaguacugacagcauaguucagugauagaagccuuuucaauaugcaccaggcacuggggccauucccaacccaacacacuauaauacaacgcaacagaauacaacacagccagaugaaaccaaaccacucuaauccacugucuagacucaagucuccacuccucacuuacuugcuaguuuguggugcuguggcuguaccccugaaucccucugugccauaaagacuccacuucauaaaacuauugagaggaguauaugaguccaauucuuaguuuuguaucaggaagaauuaguauuuuauuagccaugauuauuauuagugauauauaaaaggguaucugugaugcuuuaauugguacaaugauaacacacaauaauauguauaauaagauuccacuguuuugguuaaaaaucucuguacacacaugcaggugauuuguacauguggagacuggacuuucuauauacaauagacuaaguugcuaauuauucuugucuaaaggcuaaaaucuccucaguugcuguccuuaacucauauuugguuuuuauuugacauggcuacgaaagguuccacuugaaauuauggaaagacacuuucccuaaccagucauugugagacagauacaaggcacucaaaucucuuugagcuuccuuucaguagagguugaauaagguuaaacacugugagguaaguacuaguucacaauaggccuuuaauguagauacucuuucaugucuuucccuuuuaaaugaucaaagcugucuugauugagccacucaccauuugacagacaacugucagacucuucccaucgaaaaugucaaucaagcagucccuuuuagggggcuacagcaggagugcugcuaucaugguggccuggcugcuuugaacauugcaugggaacugagcaaauucaacuguaguuuugagcaccauuaugaugauagcugcuuaagaggucucauuuuugucaugucuguccuagucagcuugcaccagcucuuggagacuucacugucaucaugauaagucucagggacaucuugaugaugcuaccuaucuugaguuauagucugcuuaggccaaggggaacacguucccuggugacucagcaaaaaaguucuugauugacacacacgaacuaggucaugauugcuaaacaggcaaagcucugacugauggagcgaggagcugcuccuacagaugccacacccccuuucuggcuuuauaagcagccugcuucuuagucucauggggucaguuuugaagccuucuuuuccauguacuaucucuguacuaucauacuaggcuccaauaaaaagucucucuugaguggccuuucauuugcccauacauagucuuuacuauagguagaguggacuaaacuuguugcauggagagaagagagcacuggggugguguucagccucagcauggguacuaacagaggugguggcgacagcagcagcagcagcagcggaagugagaaaauagcccgagagcuucagagagcaggccauggcaggagacuguacagagaagagccgaagguaagaaacagugaaggguggagucagugagguugaaagucccauccaugcaagacuuccagagagcuggcggggguucagagccaaggguccugauaauugagguuugcugcuguaacaccagcugcuggguucugugcccagagugauagccucuguccggaguuccuaagguuccaagccuggcugagcaauuuuggagcaaaaagccccugacuuugagggcuguggcuugcuuugaccugaaccacuuacauguacuuauauauacuuacauauacuuacauguauaguguaagccucugccuuuuaaagcuuagagucauauaccucuaggccuguacaccucugacuuaguaagccucugcucaagagcucagagaugcuaacaccaaggaaacuauucuugccacuauuuuuuuucugagauuuuguuuuauguguguggguguuuugucugcacaugcacgucuguuccccacacgcaugcagugcccgcagagguuagaaggugucagucagaucuuguggaacuugaguuacagaugguuaacugccauuuggacccugggaagugaacaagggucuucugggagagcaaccaugcuucuaaccacugagccaucucuccagccucuauccuugccaucucugaacaccuaaauagauaaaaaaaagacccuuagccagccuuucaugacauuuagaguguuuuacuauagaguacagaacuaggagaguucguaugcaucaaacggcugacaaguuuugaauccuuucugaggaguaguggacaaugguacugggagggguggagagacauuucuguacuuuaguauuguuuauaaauggucauugcauuuauuuuggaagaaaugccaaaccaaagagcaagaauguccacuaaaaaagcacugaggcucagagcacuauacaaaucuagucaguuucaaguccccaggagggagaggguggaguuagucuggaguuagucaaucuggagaguagggugagauuggggauaugggaauggggcuggggagaagguacauauacuauuaagucauuaacaaaugguaauguaguucuuccaauuaauagugaaaguguuuguggggguugaaaacauuuacccagaaccuggacuccaccuguguuugcuuuucugucacugugacaaguuuaugaccauuuaaaaugaguaaaaaaacaaaacuguauuuggcucacaguuucagaggugugguacauggucacuugguuccauugcuguggacuugagguggggcuggacacguggcagggugugugugaugaaauaaagcagccccucucacggcaaacacgaagcagacagcaaugacaggaagaggccauugcaacacagucccuaagaacacaccuccagugauauacuuccuucaguuagccccaccuccugcuuuuccaugggcaauggagcugugcaaucaguauuaaccucugauuaggccagacucucaggaucuaauuauugucccaaaguccagcauuaggcaaaacaagcagcagggaaggagugugugugugugugugugugugugugugugagagagagagagagagagagagagagaaagagagaaagagagagagagaccauauccaaguuuuaucacuaugaaccaaacugaaccuggggcuauacaugugugcagaacuaggucuugaagcaucaacaaauucuacauuuaauaauuuuucucuugggugugagaugggugagguagcugaacuaggaggaaggacucuuauuuuuaugauaaugacaaagauaauguaacuuucuuuguaaauguaaaauuaauacaggaaguaacauggucaguguuuguugcuaucucguacuugccuaaguuacauugggagccgcauguauucaaauuucaaggcauuaucuagggcccuagggauuccauuuugcgggaauauaugcaacuucaguucauuuagggucucgauuauuuucuuuuccucuaaaaaugucuuugaucuggcaccuaauuucuuucuuuuuuuuuuuuuuuugguuguucuuauaguaaccauauaagcccuugauuugaauuccauuuugcagcuguacacgaccucauggaccaacgagaggcuuaaaguuaaaaguugggauugccacuaaacucggguuaagaagaaggacucuaaagcacgucuugguagcucaaauaucgugguuuccggcccuucccuggcucgcagcucgcucgggaggcuaacguuaggggagcaucccccagggugagcccucggugcaggucccucugggcuuuaacuucggggcugcucggaggcccggccugagucagcgcggcggccgagaaguugggcgcgaggcgcagggcggggcuuccuccucuuccuccuccuccuccuccgauucgagccccgcucuacuuuuccgaguccgcgucucuuccuccguccgggcgcguguuccuccagcuccgaccaggcggacgugacagccgcagaccuuuaacgccacagcccggggcggggaagcucuccgcggcagccaggacagcccggcuccgcucggccgcacgcaggcuccuccggagcggccgcgcgucuccucgggcccggcccguccuccaccucgcugggucgccgcagcaucccgggcuauggagaccggcuccgacucaggucagaggccgcgugcuugcgugcggcugagggaaugaggcucagguccagggguuggcccgccgcgucugcgucucccgcuccgcgccggggaagcuuggcggcggcaggugggcaggacgcggcgcgagcgaggcagcgagggcgggcgagcgggcgcgcgaggggccggcggaggcggagggggaggggggaggauggcucagcucuuucuaaauauaagagccggcgugaggcuagcaagccgggcgccgagccgaagagccgccgcgcggucacucggccgcacgggcggcagcggcuccuccgaggcgcgaggcugagagggagcucccgagucgcgagcucgcgaggcgcggcgagagcgacgcucgcagcgcagaggacgcaggcagcgggcgggccucgagggcgcagcgcggcccgcgugagagacccgaggcggcuccgggccccugcggcacggcgcggcgcggcgcggcaccgcacggcacggcacggcgacggccgcgagccccccucgccggccgcccgcccgccccucccucgcucgcucccgggcgcaacauggcugcggccgccgccuccgccucccaggacgagcugaguaagugcggcgcggagccugcagcugggagcgggauuuaacuccacgcaggaccggggcugggcccggccagacacgggaggcugggggggcgcggggccgggcaagugggugugcgguggucucggcacggggcuccggggcucaggccuggcgggagggcgggcgaacaggcgcgggccgccgccgcgggcgcucguaggccgcagguuugcaaugucacgucgugaaauugaaaccagagccccgggcuuagcuaccccugcucgaaaucugcuucggcccgggcuuuggggggaucccgggccccuggcuugcuaccggagcuggcgcgcggccugucgcccccaggucggacuguguccacccguccguuccgucagaccccccgcaugucccuugauucugacugacgggcgaauucuggacguggagcuuuggggaaggggagaggguugccuuucccgcaccuccaaggaaucggcagaaaggucacagaugggagaugacuuucagguugaagcuguaaaggccaauagggccgcuguuaauggcagaaaaacaaaacaaaacaaaaaacaaaacgagggugacggagcugucagaaaggagagagucccacuccaugccaagcguugcgauuuuccaggggaugacgauccaagcucgcugggagcaguggucgcccuuaaugccaggccgcccagccugcugcccguguuccacucuaugcuuugugggaaguguaguucuaggauguugucagccuauucuggggucauaaauauucaguuuucgugagauauguaggauaaucgauugcguuuugggugguugguucaaaugcuuuaggguauuuacgagaaaccuacuccccuauguugcccuucaguaaagacuaacaaagaaagguguuauuugaggaugauguguauuuuaaaugccagcaugggugagguguuguaagcguauguuugugaagcuuauguuauuaaagcgucucaaucgccaugugaaaguaguuaaacuuaauuuauguuucuuuggugcuuggcauuugaaagcuacuuuuaugaacgugaucucacuuuugcccucauaacaaccuuguguggcagguagguaggaauuaucccuuguuucaaagaggaggcauaaacguuuagagggauuaaguuccaugcugcuuugaacugguggagcaggagugcuaguugcucgguuggaagcugaaguacgcguuugguuuggcucugggaagaaaggagacucugaggagagcaagaagagggaggucuccgguacggagagguagauggagguggccacaguguugaguguuugccucacagucccaauggaaccaacacuugaccuuugaagagaccaauuucucaguuuuauuuuucaguguuuuuaugguggugugauacgcaucacaagauuuaucauccuaaccauguuuuaagugugaaguucagggucauuguguacauggacucuguugugcaaucaccaccuccguccaucuucaggauucuuccaucuuucaagacuaaaauucuguaauuguuaaacaacuccuucccuccucuuccuugaauccccuggcagccacuuuucugcuuuuugucucugaacuucaccauauaacuuuucacuguuugucucccccccacuccccaccccguuuuguggcuguguuuuuuuuuuuuuaauuuaguauaaugucuucaaaguuuauccuugcuauaacaucugccaugauuuucuuucuaagauugaauaauucucucuugcauguaauacauuuucuuauccauucaucuuacuauggaugaaugcuuccaaauuuuaguugccauccauaaugcugcagugguccuccuuucaguucuuuugggaauaacccuuaacuuuugaggaacugccgcuuucuuuguuucacuuuugugguucuggggauugaagccagagccuuugacauuaguaugaagugcuaguaugugagugcucugccaccagucacacucccagccugccauuugucuuuuucccagugaccaugccauuucacacucccaucaacacugcauaaaggguuucacuucuccauauuauugucaauaauuauuaguuucuguaaucucacuaguaccauuuuagcagacaucaggucaucugauaucaauuagaaauaauauguauuuuaaaauugacgugucucaugguguuuggguuucuguuguaacacuaacauuaacauuucaguuacugguagagaugggaaagaaaaugagaaagaguuaacaauuuggagugguucaaguguuucuguaucuacagugugcacuuauauaucagauaccuguuaagaugcugaggguauuucugguuaagagauuuauuggcguuagcagcaaauguuaaaguuaggaacagauagucccauucuagcuguucuguuuucuuuggucaaauuacuguaccgaagaaauuuguugauuuagcuucuguuuuuauucuggagaaauuaaagacuugguauuugguaccuuagaauaacuugagaccaugcacaugugugcagguuaagacauuucaaaagaggauggugacauuuuuuggcaaucccaaacauguauaaagcugaagcuagagcuauaguuugaggucagccugaaguguauggcaaaagccacccccuuacccccaagcauuuuuuuuuuuuuuuaaagaauggcuguauuaagaggaggugaaugguaaaggugcuuugaauguuccaagaaaaaggagcuaauuaucugaacaucuggugguauuuuacuguuuuugagauugguuuuguuauguuacacaugcuagucuccaacucuugggcuccagaaauccuccugccucagccuaacagaaugcuaggacuaaaacuaacuacagucugcuaacuacugugucugccuuacugucauuucuguauaguagauaguagaagcauucuucuggguggcagcauuguuuuuuacccuacuaguuuauuauggaacucaacacucagaaaaacugaagugaauauuuguguauucaccaucuauguauaccaccugguggccuacuguucaguuauauuaaguccucuaucuuuuauauacacagacacuuuuaauuauauuaucauaguacacuggaggagcuccugaguagcaacaauugacuguuagucacuacaucccuccuuccguuaucccuuuuucuuuccccucuccccaccugagacagguguggguauuuagccaaggcuagccucaaacuauugauucuuucuguugagauuauaggcuugcacuaccaugccagccuuugauugauugaauugauauaaaaucuuugaacuugcaagugaccaaaagagaggaaggcaagauaguuuucaguuuuguuagauuuuauguucuuuuaaaaaaauuaaauuuuauauauuuuacuuugaaucauauggcuauaacagagaaauaguaaaacuauuuuuuuuaauacucuagagagguacccuaguuuguacuuauguucugacuccucagaguaacugugaguuuggugcuaucaaccaaaugguaccaaaugguaucuuagggcauaguuagggcuugaacuuagguucuuugauuuaaaaaucacuucuguucugucagcuguuaacuuccuuacaguuauagaaagaaguaguuauauuuucaauuuuuuucauuuuagucucucguauaaagaucaaaaucagggugaguauguuggugaaggguucuauugugguaguguucuguguuugaugaguagaauguauuuuuggauagaaugcggaaaaagagauuaguuaguuuauauuaaaaguguuuuuaaaaucucguuuguaauuacuuaugucugguuuucuuuguauuuaggcucauauuugcaauuggagugaaauucaauagagggcagauagcuagacuuuauuaguuuauggaaaagccagcaaugucacuguuucaguaacuggaagaggugcuucugacaggggaagaaaggacucaaguguuuuugcuuggucagcugcuuaguaguuucauggucuuggcuuauaacuguuagguggcauucaaaccugaucuuuguuggguucuggacaacucuugaagaagcaacauauaaucucgaagcagggacuguucaguuugauuucaagcacagucaugggaaaccuuagugguaucagauaagcaacaugccagcaaucuucagaggguuuuuuuuuuuuuuuuuuuuuuuaagaggaugauauguggcaagcugguauguaguuguguaguugaacaauuaauuauuuggcauuauggaaauaguccuucaaagauaauaauuguaaucacagauauauagacuauugaguugaucuuuguagaaaggcugucaagcucauauuguuaaauuuugguuucauaagcaaauaggaaguuaaaauggaaaauaacaacagaauccccuccccccaauuccacaguuuauuacuacucuauucuuuuugaacugugcuuccaguaaacaauuuuaguaaaggccaaugccagaaguuggcauggagauacuggucuuguucagaagauagauguuacaacuguaggcagugcuagugugcucaaaugcuuugauccgguugucgauuucuccuuucacuccuggccaagacuuugcuuugaugacugcuaucuuguauuacauguuuuaucuacauacuuuccaauucaguaagaagacuuuuaaaauugaguaauuuaugguuuguccucagagugcuuauaguuaauuagacacagauuuauaugccaauauaaauagcugauaugaagcaugauaugaaaaaagcuuaauauaugucuuuagaaacuucaaugaauaaguauagcauucuaggcucuaagggauaguagcuuaaauugaaacguggagaagaguaauaaucaugcauuuuaagaaaaggcuaaauaaaucauaugagaguaaugaagauguguuuacuguggcugugugaagaacuaggaaaagaaauaaacuugguaaucugagacuugguauauagugccuucauuaugugggaucuagaacaaauuacuuuccugaauauucuuucuuucuuucuuucuuucuuucuuucuuucuuucuuucuuucuuucuuucucguaagaaagggugaugacaagaaauacuccagugguguuaagaguuauaugugcaagugcucuguucaaacaguuaaggaaucuauggggaacggcgagagcagaagacacugggaagauaggauggggccaaggcauaggaaagccaaccaauguaaagaguuugaacuuaguucuguagacaguagagaacuaacagaguuucgaaagggcugauauacaacaugagaaagucuauuugauaagaauaacagauaacaauggugaaauaauuaauugcaagcacccacagaucuagagcacaagauuuacaaggaggggaucaaauggguaaagaaauguagagucugacuugagacagugaaaauggauuuggcacgaagauaauuuuaauugaaguccuaaaguauguagaaaugauuggguuguuauuauauaugugaggguuauuaaagagaggaaagaguuagggacgauucuaagacucuaacuggagacuguaggauagagaaauagggcagaaaguaguuuuuaggcagacuuagacaguuggaaauguagaggaaacaaaaauaagauuguauucaacaaaugaaugaaugaaugauggagaaaucuuuauugaauaguuuaaggagaaugguuuggguagugaucagugucucugaaauuauagucaaagcugguuucaaauucaucacuuuaucacuuuugguugauguguccuugaacacaaaacugccuaccuuugggcuuugguuaucccauuuauaagaggggauuacaauaaaacagcuuauaggauucuaagaaugggaagaaaugauguaugaugcauguuaaaaguuugguaguauuuggcacauggguugcacguccaugugagaaauuugauucuaaagcuuugaagagguggggacgaugggaucauaggaauggauggcuugcucugaagacagcucuuuggagccugugaaauguagggaggguugagaugacaauauucaaggagaugaguccugggagaagucaugaguuaguagaguuaucuuuuguuuuccugaguuuugagacaaagucacacuauguagcccaugcugacuucaaauucuugauccuccuguuucagcuuccuaaguacuuaagcauuuauauuucucaguuauauuacugguaacguguacaggccaacuaacccucuucuuacaaaaccacuguguagcugagauacuuccuuuaauuuuaaaguuuuaauauacuuaugauaugcacauauuuauaugauaaauuacauguauugguacuggaguuuuaaaaucuuuagucaguuaucaguguaucuuuugaagauuuauguaggcucaaguucuguuuauguaauacccuucuucaucaaauuugauaaucacuuuauuuuucuuuauucugaaugcaaaggagggcaucaaagauguuagcaagaaauuaaaagugcuuauuuuucuuaaaaugguagcucuguguacaagucuuaauuguauuuuuuuugguguucuaaauaauagauucuuuauacaauugcauauguacgaguggaugaacauaccauuggugauccagaggacuuuugucaagauuggauaaaccauguaucacauugauuguagagguuaguagauuuaguucaugaggauaugugcauuuuuauagcagauuuaaaaaugcauagauuguuagguagcaauuuuccucuaagaucuucacuccccccacccccauuuuuccuuuuuccuuuccuaguuaccugagagaaccagugaaguucauguuaguuuguaugugccugauauuucuauuucuguggugauaaauauaaaagaaugagcaaaaaaagaagaaaaaauccaaaauuugaaaauauuaguuagcaaugugcacaggcagagacaauggaugacaguuuauaacugauaaucugcuauacaaaaaaaaccauuuuauaguuucaggaacauuauuauggaaucacuuauuuuaacuucugaaaaaagguauuagaggagucaucuuuaugguaauuggguauucuugauucuguuacuuuaauaugcacugugauuuuuuuuuuuaaagcuguuuuauucuguuaguauuacaaagagugugauucuaguuuuguuuuucgaugauacuggauaguucuuugaaacuccaugaauucaguacuagugaauacuugggguuuggugucaccaguccaaaagucuacugugugccugucuuuacuauaacucuuagacuaauuuaacuauuauuuuaugacuuuuuuguauguauacugcuaguuacaguauauaauggcuaauucauuuaaguggaauuuugagggcugaaauguuuuauaaaucagaauucaacuucagaauaaauuuuaguuuauuuuugcuguuucuuaucuuuuucccugugguguguagaggaauaaaaauugggagguugaaagacuuguuuaguagagcaaugagggcauugcuuauugcauccuagauucuuuaauuguuuuggaacccaugagcaauguauuaaugcuuuuauacuauacugaaggcaagcaguccuaaacacaagugcuaggauugaaauugugacuuuuuagacaggcaugauggugcaugccucccuguccucgggaggcagacacaggaggaucaccacaacucugaggccguccuggacucgaauuccaggguagcuaggguuauagugugcuauacugacuuaauaaacaaaacacaagcaaacaaacauuuuagaaauuuucacaucgaaaugagcaaguaauuaacugcuuuugguggauaguaacuauccuauguuggacuuuuaugaauucuuauguaguaucucccucaagcuugcuuuuguaagccaaagugauccuucugcucacuaucuuauuaaaauuaauuucuaccugguugccugccagcugcggguucugaggagaaaggccauuuuagaggagggaguguuugugaacuuaagaguguuuguuuauuaggaaucuggcacuuaacucacugcaucuuagaaguugaugaggacucuuguuaaaucaucugguccagcuaucaagcugccuucaugauuucuuugcuuuccuguguguaugugugaagaguuaaggaguugaaggcaguaaggaaauaaucuuguaggcagcugaggugagcaggaagggggauccuucuaauggaucauacuguguugguagggaguuuaaagcggucuggcaucuuauaccgaaggcuaggauuugaugcauaccaggaaauagauucuuaacuuugccuugcuugaggaguuagcuacuaguucuuguagauacaauacccaugacuuuuccugaggaaugcaauaauguuucuccacaccuuaacaugaaccaauggcaagccaaagaaauucugcccagguuuaucuuggcgaaacaaggaauuuauuugggcuucuuacuggagccugggugagggacuacuuacaggaaugacucaaagguaccugcuggauugcaaagcaugucaauuuucaugacaguucaugaaaaucaaguucuuagagcucccugacagacuugggccaagugcugcauggauacucuccuuuucucuguaauuguuuacugcuuauguaacuggggaagaaauauaauguuuugggcuccugagccuccagaguuucauuagcuucgugagucuuaaugagggaauguuuggguuuggagaaaauaacgauauaacaaggacuuucuuaauugggcauuugucuuggcccugaggacagagggacaaacaugcuuugacugucuuaguucuaaggggcaggaguacuaggagugcugccuagguaaggacccaggaccacgauguuuccccggacuguccuagcuagagguaggcagcuuuugcagaagcugugauggauuguuucauucugggauugcagcauuccuuauuuccaacauacuacuguauuugugcuuacuuugggagugccuggcauuuguuuuuuaaaaaaguauauuugcauuuaaaaggaauugaguuccuuuuuaaaaaggcuggaguaggggcaaacuucuauuuuaaaaucuuaggaaugaagaugggaguucugauuucugguauuuuaugaagaaaaguuuugcuauccuuauuugggucuugcauguguuagaaugacagucaaugacuucaagugguauuuagaaucauaccacuuucagagcuaguacuaguuagauuuauaagagaauaaucuagauaccagucaggucuuccuuauuuuucaguuuuagccucaaacuaauuaaaaugguuuucauguuugaagauucccauucucuucuuuacaugucucuaucaucacuuccaauuguauaauucaguucuacuuuuccuagcuuguagggucccauuucugagaaugcugcuuugguucugccuauuucagguugacgcgagaaccaacucugucugucauacacucacuguuuucuucacccucaaacauuuccaaguaaauuauugaaguugaggugagucacagggcagccuuguguuucaagcauuugauuuucuauacuucaguugguccccuugucauuucccuuuuuuuucuuuuauccuuugauguagaaauggcuguaacuccucugauuuggauuaguacagcuuugccacacaaugaggaaucuuacuuuauugucaugguauuaaaacauaucucauuuccauccuaauuauaaguuaucacuaguuucucuuuuuauuauaguguuagaugcauaaacuucuaaauaucuuucaugauucauaaagaauuacuauucucugcauucaaccaguauuugaacauuuacuuucuaaaggaacugaguuaauuaaguuuuuggauaaaagagacucagucauagguucugaacuuaagcuggaggaagauggaggcaugaguauguaguaggguagagucuuaucaaauuggucuagaaaaggaaagauugagcaguuauauaauauguagcaaacgaugguaaucaucagaaguaaagaaaauguaagugguggggcaggagcuaggaggguguugaacugagauguagcuccaggaugccuccuguagcugcguucagcagaagcuggaaguuuugaauugcccacagaagagaauuuuaggagacaauaugaagcagaauuggaguucauuaagaagagauuuuuaacauagauuuaaauauggggaucauuagaagagaggugcucaguaaaaauauaagacagacauaauuguggguguggguuacucaagagagaguugcaauuacuugucucuccaauaauucuauagcugauuuuggugggcucugaaguuacaucuaauaagguuguuaagugacuuaaauguggucauagaugguuucugaugcauguguugagcagaauuauacccaguagaaguaaaccuugggucacagguuucuucucuuccccccugauuuuucuuaagccucuguaguuuguauccuaccagaaaaggacuauagugagcccuaggaccaggaugaaagugguauguguguauaguggcuuaugaguuggaccucaaguggcuuggauuuagauaaguguagauagaagaacggucuaguguguuugggagaguguaccauguuggaugacuugcuuggucaaaagaauuggacugggaagaacuggaugugguggcacacauuuugauucuaguacuugggaggugaaaggaugagaucugggauuugaggacagcggccuagagcaaggaugucucagaauauuuggguugggagacuuuauggucuauguaagaaacaguugggccuuggauggcuuuggggagugauagcauacauaggugaggauguuccucuaggguaaacuggccuacucccaggaaagauuaccuuucugauauuaauuacaaugcauuggaagcguuuuguuuuuuaaauguacuuuauguagguguguuuuucuuuucuucuacaagaucuuuauauuuagaucaaguugaaagcuggcuuaagccaagaaugcauuugcagugaaucaaaauacuuauggaaccgagagggacuuucaggagagucuuggaauuucaauuagaaauuguucagaucuucuugcuuuuccaagccgucaugccauuccuucuugaguccaucuuucucugauuuugcguuugaugggauaggcuugagauaucuguaucguguuuguuaguuuaugcuucucgauucaaccugucagaggaggcuuggcuuuugauuuauaaaucccaguucugaauacuugaaaaaaguugcaucagaaaccuguccugauguaguugauacuggcugugaucaagaucaaauuuauacuguguauacuugucgcaagaguuaguaucgucucugucuucuuucucugcugaaaccaagcuauagcucagcacacuggaaggaacauggugcuuggagaugaacugccugccacuuaguagcuuuguaaucgugaucaacauaguuucuguagauguuuucauuucauauaaaauggagcgacuuuuuccuacuugaauaaauagugguuugugggagagauacuucuaugucucauuuagucaccuuuggcaagcugguuagggcaugaauuccgguuuuaauuuuucaucuauaaaugcaaaugucucuguauuacaucauguuuuucugagacccaaaagaucccauugccaucuuacauauaaaaaauuuuaaaaaguaacuacuguuaagaauguuugugaaauuauuuuauuauagucugggauauuuuugugcuaauuaaccagauaauuaaaaauaugcuguagcuuuagauuaguaauugauuuguuauauggugagacauggucuagauauuuucagcuuccuuuccaaucucagcuucuccuuaagcuucuacuucuguguuggguacugagcugaguuuuuacauaugcuaggcagaugcacugccacuaagcugcaguccagagcuccucauuuauauucugaaauuuacuuucauauucauaaaacuugauguuuuuguuagaaaauuauauaaaaauagacuuauuacuuggaaauagccuuuuuuugguggcucacacaaaaccauuuaugcucuugaauuaauaauuaaacaaauggcaggcaguaugcuuuuuuuuucuuugcauacucuaugaggaguauuguaacaagcagguuguccugaaaaggucucccuuucccauucuuuuguguaaugauaugacuuggaaauauaucuuuacaaucuuuuuucuuacauggauauauaauaguuggcacugcugagcuagaaacuguuuuuguguguguguauguauguguguguguauguguguguguguauguguguguauguguguguguauguauguguguguguguguguauguauguaugugugugugugugagagacacuuuaagguuguucuuaagguuuuggcacuuucccuuagaccaaauacucuuauuuuauucuuuugcauuuaagauucuuuaaaaguucugugauuaagauucuuuccuuauucuugaaauagaaauuauuuuaauuguucuguacuuuuuaaauaaagaaauuuauuuuuauugaauauuuaaagauacaaagaaacaccagugauacauuuucuucccccuuuuauacacauauacacuuauaaauaaaauuuuggcguguauguaauauuuuuaaaacaaaaauguuucaaguaaaaacaaaagaauauuaugaagaaauuauggagaacuguccugaacaguauacauauugcauuuagaaacuuuauauaagugccuugugcaugccuaucuuucugauuuguuuucuugccaugaucuuaagauguuuccaacauaaugcuauuuauuguuuguguaaauauaacucuuguuuuuaucacuuuugacccugcuauauuuaauccauucuccuguuggcugaguuuugguuacuuucaguuuccacucuuacuaaaacccugugacaaugaaugguuuuaugcacauguccuugugcuuagcucuucucaggagaaagcuccucccacccccaagaucaugcuguauaaagugccauaccuaucugccugccugccugccuaucuuuucuuuuucuuuccuuccuucuugauuuucuuuggauuuagggacagcauauuuggagcuuacuacacuggcuucaaauuugaggcagcucucuggaguccuuuaagugugaguaccuagcuuaguucucuaaaguauuucuauucagguuuuuguaguuaaaaacguaggagauauuuguaauguacuccucuuuuccuuuuuacuuuacagaacuaguuuuuaaaaauauuuuguugguauuuuaugcuuugugcuaaauguuucauugagaguguuucaauuuuucauuuucagauuuucauuuaaagcuuaaaauaccuuaguuuuuaauucauguuauuaauuuacacaaaagugauuuuuaugauauuuauuucugguuguuuucucuauucucuuucaauuuguugauuugucccucuuaaauacuuuuauuauauauacucuuaaugauuguaacuuuauaauaagucuuacaauauaguagagugacucacuuuuugugggacuuauugguuaucuuuguuugauauuccauauuauuucuauucacauuucaccugaauuuuauaauuaucuuuucaacuuucaugaauucuuuucuauagaaaauauuugauuuuguuauauuguacuauuuuuauaaugcuggguuuauuuguggacauuuuuacugcuuaccagauaauuuuuacucuucugguacaaaaaaagucuggguggacuuugguuagggacauggcgugguguguguaaaaggcauugagaguaguuaaccuguuuguagagcagaaggcuugagguuauggagccaggcagccaaguuucacuggagguggcccuccgagcugagugcugagcagagaagagccuuccuacugagcuuuggaugacgaauucuguggaaguuaaugucaguguuuaaacuguggagacuucggcaucucaaucacagagucaaccaaccuguuccaucugacacagaaaucugaauauuucuagucuccuuauucuagucauuagaauuaaguuauaguuuagaguacuauuuuuuucuauaaagaacuuugacauguuuuguaggauucacuuccagguuuuauaccuuuuuuuuguugcuguugaacaaaagcacaaauguuaauauuuccauucucgcguaucuaaguuggcuucuuuacucugaccuguaugcaacaugaacuucuugcuccacauacucuucucauagcuauuauauaagcuaugaaauacugccaguuaaaaaaaauccuguuuauuuacugcauuuucaugaaccucaguucaguuuuuuagaauaguguguacuuuuuguguuguccagguuuugcacgcaauaucauauuugcuuuagauuuuacagagauauauuuugucagagugguaauuuccuucuaugcugguugcuuucaaaucuacauuuauaaacucugcucugugauacuggugguuucuguauuuuccagacuccucuacggauuaguuuccuguuuuaaggcuccccuuuccuagaguuuaggaagaacccaggggcuuguuuauauuacgcacagacuccaucacugacugccuuuagcuuuucaucuuuagauuuaugacucaccagaaauuuaucuucuuucauguuuggugugaugaaguaggaguuacaguuuguuuucccauaguacaaugcaauuguuagugcaguucgcugaaauaacaauauuuacuuacucauuucauucauaacuuuguuuuaaagcaggugacuuguacaaguuuaccucuuaaggacuuuuuguauuuuuucaacuggucuguuuuuguaccacauuguacuuuuaauuauuggaguuuuuggcaagguuugaaaucuugucauauaaauuguuuuuccucuuuggcaucaagaggaugauaaauacuggcauuuuuuucucugacuuuuucuuuuuuaaucuuccaggucauccuuugcaaaucuuaguccuuuguagaaaugguauaaucaggcuuuuacuuaguauucuuuaaauacuuuugaguugauauuggauaguauuuucuguagaucaguuugaggauaauugacauguuguuaguauaaauuguaacucuuaucugagaggcuuagaaacagauaggauguuugauuuuuguuuuuagauuaaaaaacuucauguauuuauaaugugguagcuuauggaugagacccaagucuuccauuuacuuauacaauaggcuuaauaaccguguauuuugacuguaauccauguuaguucaaguguagcaucaguagucuuagaguguggauuucagauuuuaaacuauuagaugaagagauuuguuuuauugugauccaugauuauuguauacccuuucaguuuuccucaguuucuuacagcacaguacauuuugguuuucugcuuagaugucuugcauaauuuccucuuauuuucuauguacuugucacuaaaaagaauuuucucaaguuagauaaauugacacagucuugcccuacaacucaaccuggccuugaauacauguucuauugcccuagccuccugugugcugcaauugcuaguaugugcuaugugccuggaucacaaauucuauuuuuuaaugauuuguuauugguauguagacaaucaacugauuguuauauauuguuauucuaguaauauaucuguagauuaauuuuuauuuucugugugcuaauauaaucuucagauaaugaaaauauuuuuucuaaucuaguguauguuauuuauuuuugucuuuuuuauuuauuuucuacacucuauuuuugucuuauuuuguauaaaauuugcagcaaacauuuuaguagauuuauuuauuuauuuauuuuuccagugcuagagauuaaacuuggggccuugcaagugcuuuaccacugacuuacauucuuaggccuugaauauaauucuucuuaaaaauuuuuuauuaguuauuuauuuacauuuuaaauguuauuccccuuucugguuuccccucuguaucccaacccccgugcuucugugagggaucucccccacccaccaacccacucccaccucaccaaucuagcauuccccuacauuggggcaucaaguccacaggaccaagggccuccccucucauugaugcuggcaguucucugcuauguaagcagcuggagccaugggucccuccauguguacccuuugguuagugguuucgucccugggaacucugggggucggggucugguugguugauauuguucuuucuaugggguugcaaaccccuucaguccuuccccuaacuucuccauuggggucccagugcucagucugaugguuggcuucgagcauccacaucuguauugguaaggcucuggcagagccucucaggggacagccauaccaggcuccugucagcaagcacuuguuggcaucaaccauaguguccggguuuggugucugcaaacgggauggaccccuaggugacacagucucuuuguccugcauuuucuuuagacaggaacaauucuguguuauauuuuugagauggguggggauauauauauauauguguauguauauguauauguauauauauauacacacacaccccauauaauuauauuuuuaauaaaaagauuuaucuuuguuuugugugugagugcaugccugcauacauguaugcgcaccauugcauuccugguggucacagagggcagaagagggugcuggauccccuggaacuccaguuacagauggcugugcguuuccaugugggugauaaacuaaacccagguucucugcaaguucagcaagcagucuuacccacugagucgucucuccagcgucuggauggaguugauacgagugaacuguuuccguguuguuccucagaugacggagaauguaguuaguauuuuaucauuaaguacaaagcuguaaauuaaaaaguaaaauccuuaucagauuaaggcucucuuuuuaaccuuauucaacauggauaauuuauuccugucuuauuaaccugguaccuuuuaaagauauauugaaauacuacaggauuuaaaauuuuuaauccugcuaguaugguuaaauacaaugauuuuaaauguuaaacuuuuuaagaauuuuugaaauaagcccuccuuuagcacaugauguauuauuauuuuuauguaacacugucucugcuuuguuauuugacuuacaguuuuuauuugcuuuuguguucaaguaaaauacauuuuauuuacugcuuuuuugggauauacauacauacguauuguguuguaugacuauaacuuuauacaguguauguuaucucuuacucugggagggauuacucaguagguaaaggaacugccgaccgugacaagcuuggauaugacaguuugaucccuagagcccacaugguaggaacagagaaccauuucuagcaacuugccuuaugacuuccaauaaaugugcucuuuugucuguuggcacaugggaguucucaggccuggcuuaguuuucuuuugguggugguaaauggagguguugauauccaguguacgauuccuguugccugugagauucuacaguuacucuuagcugaaaacuuguucugaaacuaaaagcuuggguaaauguuuuauucauauuauuaagaaccacuguaaccauaguugcucuugaauuaugacuuuggcucuagucaccucuucaaacaguuuguacucacucuggaguauuuuuuuuuuuuuuuuuuuggccaugacaguacuuggugauuuuuaggugauccuaccuguguugcugcuauucucagaacaugaaugaaaccauuuuuucuuguccuuuaacaaaagcugaauugcuagucuguacacauuuaaagcuugucacugguggaacuagaauccauauacaaguuugcucuuaacucucagccuauuucacaguuccauugggccagucucaggcccuucuauguacagcuacccccuggguugcaacuuuugacuccaguaaaauuuuuugucugucucugucuuucccuuugucucuguuucuuccucuuuccccccucccucuuuccaccucacuuucuuucccucucuucuccuuccuucucccuuccccucuucuuuuuccuuccuuccccuucccuuuuucuuucuugccuuccuucuuggauuucauauaguucaggauggcuuugacuuucuggaaugacagguaugugacacuauacuuagcuauuagaugugauuguuuuauguuagaugauauucuguaaugguuaauauugucaacuugauagaauuuauagucagccaccugggagacaaaucucuggacguaccuaugaaggaauuucuagauuaaguuaaagugggaagaagacagauccuaaguguggauagcaccauuccaugagcuaggguccugagcugaauaaaaaugagagagggcuggagaaauggcucaguguuuaagagcauauacuauuuuugcagagaaccgaauuuggauccuagcacccauuauggguagcucacaacuaccaaccagcucuaugggauuuguuacccucuuuuggccucuauaagcagucauacuauaugugugggcauuugcaugcaugcacacacaaaauuaaaaaaaaauuaaaguauuauuuuuaaaggagaaugugagcugaguaccaguuuucauuauucuuuguuuucugaauauggauucaauuugaccagcuuuauuauacucuuuauuaacaugucuuuccuguguugauagaugguguccccauacugauauccaaaauaaacucuuccuucccaaguuaauuuuugucauguauuaaaucauagcaaugagggaaaaaaaaguccuuuccgacucuguaaguauaguaaaguuuuuucuaucuuuucuuucuuuuugaugcugagguuugaaccuagguuuuuguacauaguauaugcugugcccuauacuauaccugcagcccucuaaaucuauccccucccagacagccuccuuucuuuuuuuucaucucuucccauccauccuccuuucuuuaaacagggucucacuauauuucaggcuggccuugaauuguuuauucuuuuacucuuugaguacugaaguuauaugcucuaucaugcuuggcucaaaucuauuuuuaaaagguuuauuuauuuauguauauggguacacuguagcuguacugaugguugugagccaccaugugguugcugggauuugaacucaggaccuucggaagagcagucagugcucuuaacugcugagcuaucucuccagccccucccccccaucuauuuuuaaucacauuucaaaaucuauuuuuccccuccuaggcuuggauggcagcuaagugagaguuucuaacaguuaauugaacuguguguacuugugcuuuacauguuuucuuuguguuuuauauuacaaugaacaaaucuuaaagacuccagaaaaaaauuaauuuccuacauucuuccauaugcuaaaggacuauuuugaauagauuaaaaacuugaauacagaaagcaaaaucauaagguauaugaaaauauagauaaauauguuuuaggucucuccaaggcuacugcuuagguucaguacuucagagucuaggaggacucaaugcacugaacaaauaaucguacucucagauuagcuuuauuacagugaaaccaccaaagggaagaaaagguguauggagugaaucuggaggaaaccaugugcaagcuuccaagacagucacucaaaacaggcuuucaauuccuaguuccuguuccauugaguucaugacaugagugaaaugguaucuacuagggauaaucaucacuaggauuaucauuagagauucagugucauuuuugucauuuggagcuggucagauugacaccuuuugcccaacauguaccacaauucuccaagaaguaaagcuuguguuuaucauaaaguacauuguaaaaccaauucagauguggugagucauucuuaccugaauggugagaaugcucuugcccauguuuccagauaucaguuagcucuacuauguuuuuuucccccauacauuguaauuuuuaaaacaauaaucuuggcaugauaaaaagaauucuaagcaugaaacuaaauauagccauaaaguaaaguaauggcaaauugaacuguauuuaaacagugagaucuggaaaagaaaaaaaguccuauagaggauuagaggggaaacugaaaagugauuuauuuacuauaugggggaaaaguggaaguuauuugucaaauauguaaaagcucuuauaaaggccagcaagguugcuuaguggauaaacuugcucgcugugcaagcuugaugauagcauuuugauccccagaaccugcauaaagguggaaggcgagaacuggcuccacagaguugucucugaccucgacaccugcauuguggcacacagcuuucccucccugucgucaccuccucuccccucucuccuaucuucucuccaccucuuacucucucacacacaguagugauaacaaauacaauuaaaccuucauaagucaucaauaaacugagcaauggguuugcauaccuauacuccccagauguaggaagcugaggcuggaggauuaguuucauuguuugcuuaaggcauauugugaguuuugaaauguauaucuucuaugcuaugucuguguaaaaucugaaaaauucugaguuauaucacucuaaagggcuaagauggaaauuuauguuaauuaaaagagggaaggcaggccagguuugguagcacaugccuuuagucccagcucuuggaaggcagagauaggcagauaucuguggcuucaaggcuugccuggcguacagagauccaggauggucagggcucuguagagacucagacucuaaacaaaacaaaaagagccugucucaaaacaguaaaaagagaaaggcagaguuacaaauuaauauguuauguuccaggguugagauuauauaauauuaauauaugaauaaaaauagcugugaaaaauauguccccaguauuugaauugggggagagaugagccuucuugagugaaaugcuugcugugcaauaguaaagaccuaauagagauccccaucacccacacagaagccagagggugcaaggaguuguaaucaaaugcugggcugacccagcaauaucacuggggcuuacugaucagcguggugcacugaauuggugagcgucagauucagggagagacuuuugucucagaaaaugacauggagaguaguggaggaagauaacugucauugaccucugaccuccacacacagugggucugcacaugcauacaccacacacacccacacacacauguacacguacauugaaucaauuacuuuuccuguugcuauaauaaaauucauaacaaaagcaacuugaugaaagaagaaggcacacaggauuugagacagcuggucacauuguaccuacaguugggaaguagaagugaguggccauauuuaacucacuauguccuuuuucaacuugggaucucaguccauggaaugguaccaccugcauuaaggauggaguuucuaacccauguaacugaauuuagaagcucuuucauugacaugcucaaacuuuugucucuuaggugauucuagauccugucaaguagacaauauuaugucuuucugucacauaugcacuaacucucuucucccucccaucuccccacauuuaacugauuguuuaaagagaaauaguaaugucucuaauuuuuugauaagcaaaacagugggaguuugaguagaaaacgugaaaagauggagcuugcucuugucucaaauucuguuuaucaucuguuagaaucuaccaugauaauuuggagaguaucacuuagagcuaauagcuuaugaaagaugagugaguuuuagaucuccucuaaaucuucagaacauaugguucucucucuuucucuuuuugagaagguccuuuuaugacauuugucuauuuuuguugccauaacagaauacuugagacuagauaauuuauaaugaaaagaaaugucuuucauuuucuugcuuuuuuuuggccccucuucuugagacagaaccucacauauccuagacugaccuugaacuuguuauauaaccaagaauguccuugaaauuaaaauccuacagcugacagcuccuaagagccaccauguuugauauaaugugguacugagcuuucuaccagugaauccauacacacucucccaccccaguauccuguuguuucugaaagcuccauacugagaggcuuucaaauguugaguuuuuccuuuuucuuuuuuuaugucauaccacguggaagaauagaagugcaagagggucacaaucuuaggaagaaaaauaccuguaugucuucccucauauguggauccuaggugugugugugcgcacaugugugugcauguauguguuuagggauguacuuaucauaucacaugaucacauauauggaguucaaagacaacuugcaggaauuaccuccuuccacuuugugauccugaggcucagcucagguugucagucuuggcagcagucuugguaccuuuucccucagaaccuucucugugugugcccuacccucucuuuaagcuagauucuugguaugaguaggguggccuugaacuucucagcauccugacucagucuucaucaugcuaggauuacaggaguauguuaaccacacccagcuugauuagcguuuacuuaaaaguacauuaugucucuaaaagaugaccugauuaguuguacauugauccuuucucuauugaauguggaagauauaauucugccugcuugagaagcagugcccuuguaugauguuuggugguuuuuguauuaucacauugcauuacaaaugaguauauuaaaaauaaccacaauauaucucccuuuuuaacuuugucauagauuuuucuagguaaauuuguuaagaaaauuuaacuuuuugucgugucuguggacaguuuucuccugccuaagagcuguaaugcacugaagaauaugcuuguuacuuggagcuuucacagauguagugguugaauucaacauuccuaaggagcaaguucuaggacagccaaggcuacacagagaaacucugucuugaaaaaugaaacaauuuuuuuuucacaauagcacuccguguuuauuaaguagagucaucugguccaguauucccagaguuuaccugcccacuuuugauuguuuguuuuauuuuccuuucuucaacuaaacuugaacuuuacuuggaauuuuacuagguuuuuaaaacauuuuauugauucuuugugaguuucauauuguguacccccuccugcucaucuccuuguccccucauaucugcccuucacucuugcaaaacuccccaaccccccaaaauaaagcacauacuugugcucgagcacacgcacccccaacaaaaccccaaagcauaaaaaacuuaucucggaggaagcuguacuaugucacagugugucccacaguaugucccucugucuacacagcuucacuuguaaauagcuuuugcagugagucauuggucugguuccagaucucuggcuucugugacaccaucaauauuggcuccucauugggacuccuagugguuauccaguuugcauuuucugauguuuuaccagcaaauagacuuggaugguagguuuuagaaugaauacaagagugcugaaaugucucucuuguuacauaucaucaugcacacauuauauugggugagagcauuuuuccauuguaaaguuauuauuuccuucuguucuaaguaguaacuaaauccagaguacccugaaaagagaaagaggaaggaaggaagcuauacuuccuuuaggaauauauuauuuugaguucuuccauaagaaagacuuaccuuucccuuuaguuuauugacaucaauaaagaccuguguggguuucuaguuuggcuuuuuaacccagccauauacuauuuauuguguucuguuaguccaguguagcaggaguucuuucagguugauuucaauacauuuuuuauauuuucauuucaucucuaguacuauaagauguuucaggcucccuuuuaaaaaucuuuuuuccuguccuaagcucuaguauucccaagaaucucucuccuuuuauuacuaaauuauauuuaaaguaagauucauguuggauauaggguuuauauguuucuacucggguguugcugcauuugcuuuuucagagcucacucauugauggaucuaucuacuuucuuucacagauggaguauuugagguaaacaaaaaaguuaaucuuggggcuggggagaaggcucagcaguuaagagcacuguuccucccagcacccauauggcagcuuacaacugucuguaacccuaguucuccgggaccugacacccuuacacagacagacacgcagauaaaauaguaauucuuaguaucuguuauaacacuugccuaauuaccagucaguggguagucuugaguuucauuuguaugacuccuuuugccugucuuuuggcuaaccuuauuauuugaaguaaauuucaguaacuguauuaguucaucugcauauuuuuucguuuuuaucacuaaguaauaaagacuuuuaaaaauacauuuuaaaauugagguguacuuggcaugaugcacuaaucaagauauaaaauauuuucagcucauucuuacugauaauuuuugcaagugauuuguguguguguguguguguguguauguguggguguauguguggguguugugugguguaguguuugcccguguguauuuuuguaaaucuguacccucaugcauagggagaccagaggcgguuuugaguguuuugcuuuauuacucuacgccacacucacuagagauacgguuguucaucagcaggcccagugcuuguucacaguuauaggcuguaaguaugcaugugacugugccaggcuuuugccugaguucuggugguuugaacucagaucuucauccuuguaagaguuuuuacuuguagaggcaucccuaacucuuuuugagacagcuaguuaucuuguuucacagaccagccuagccugaaacuuagagugauccuccugccucagcuuuucaaauggugagauuacagucaagcaccacugugcucagugucacucauaguuuuuauaagagccuuugagaaacaaauauuucauuacagcaccuuuuuuuuuuuucuucagugcuaagguucaaaccuauggccucauaaaugccuaguaccuaaaaaauuaacaguaauuugcaaccagguguuuggcauucuuuccccucuguauauaguacauuggucaaagauacaugguggcuuguuuaauaauuacuaucuacauuuuguugaacacauccccauagucuuguccaacaugguucucacucuagcuucccugugggauacuugucucgguccccacauaguaguggucagugauucugacuuuggagaaacuucaucaguuagucccugacaucuagucaaaguuccucuguuguggucuccuagcuagguuuagaucacuuuaaaaaacaaaaacaaacaacaaacaacaaaaaacguauaucuuuucuuaggaccuaacuccuucaggaagacuaaguaacugaauuacuccugguuauucuccuuuuuagagauuaaaugucuagagacagguguacaugauuagcuaagagacccuuuuuuaauaguacuuucuggugugacacagucauuuguguauggggcuagucugguuuaaauucuugacugaaggaucugcaguacagaaaaaagaauuaggcuauaaaaauaggcuuguuuauguuugguuugccaaguucucuuguuuucuuuuauauuauagaucagcucgaacgggucuuuuuacgacuuggccaugcugaaacagaugaacaguuacaaaauauuauaucuaaauuccuuccuccuguucugcucaaacuguccagcacccaagaaggaguacggaaaaaaguaagcauguuggggaccguuuggggaaauaauugaugaauaaguggauauauauauauauauauaugugaguuuuuuauucucauuguugaaauguagguuccugauccuaauuacagcuuuccaaauguaucguaagucuaagaacucaaaugccuaccuaguacagcugcuaucacuacuugugugcuuguuaccagugucagguaauuuaaucaagauaauuaauuaccuggacugaucuaaaaccaaauaugaaagccaguuuagaaaggggaaauagucuuuaaucaucaguugauggugaauauauccuuaaauaaagguaauaaaggugaucaaauaaacugaaaacgaacuguucuuauauaacuuacauccuucaaaauacuguuucaaaaagcuauguaauuauaauaucacuauuuuauuuuuaaauuauuguauauggagcacuuugcccuuuaauuuguaacauaguuuuuuuuuuuucccaguauuuuugugauagaccuggucuuuuagcugucaucagguuucaucucuugugauacuauaauagguugacauugacuugacugucuucucuaagagacucugauuugaguucagugguaaaguaucucccagaaugucuuuguugcaggaaaggauggagagucuugccauacauauacuugcuauuuucauuugcuguuaauccuuauuugcugagguuaugccauuuuccuauuaaaaccucucaguggauuuuucuugcuuucaggguaccaaaggccuuuuacaaauugauguauauuuacuuauuguuaucagucugguuacuuacugaauuaugauuugugguaccugcugcauuuguuuucucuugcucugagacaaaauaccuaacagaagcuaguuaaggaaggaagaauuuauuuugguucagaguauaaaaggauaguuaggagguauaauaguaagaauaugaggguagaugcucauauuguguccacccaguaagcagagagugcaugggcagggaggccugucuauauaaucagaacacuugcuccccagugaccaaccucacucagugagacggccucucuaaaaacguuuuacuuuucaaaacaaucgcuagcuguggaccaaggaauaaaauauaugggcucauaggaggacauuuuacuuuugcuaagagugaagaagaaaggaguagaugagaacaugaggacgugguuauagugggugggagaguucuugguuaguaagaucaccagguuaagagaugguggacagaaugugauccccugggaacuaaagaggccacgguggaugagagggagggugaggggcaggaggaaacaggauucuagggcacugauuugaaaggguguuagugauaucuuuacuuggcugcuggagauauuuagaguggaagccaaaaagaaggagcuagagaaccauccuuuaggcugaguauuuuuaguacauuacaaaaacaaacaaagaaaccccuaaaaacccaaacuuguuuauauaagaucuuucuacuuuauccuuuuuuggguagacaaucaucuguuccuaucaccuacuaauuuuuuuuuaaagauuuauuuauuuauuauauguaaguacacuguagcugucuucagacacaccagaagagggagucagaucucguuagggaugguugugagccaccaugugguugcugggauuugaacucaggaccuugagaagagcagucgagugcuguuaccugcugagccaucucaccagcccccaccuacuaauuuuagugccauugaguucuguuauacuauuuauccuauuuucaguugggacuuugauucuuguucucagguuucccuguguguguguuuacauguuuguaugugcaugugaucacacauuuaauggcuaaagauugauguugggugucuguccuaguuguauaccaccuuuuaaauauguuuaaauauuuuuucaauuuuuuauuagauauuuucuucauuuacauuucaaaugcuaccccgaaaguccccuauacccuccccucugcccugcuccccuacccacccacucccacuucuuagcccugguguuccccuguacuggggcauauaaaguuugcaagaccaaggggcccucucuucucgaugauggcugacuaggccaucuucugcuacauaugcagcuagauguucaaauauuuuuaaauuuucauuuuguuugcaugguuguuuaccugcauauauguuugucuguuccauguggaugccuggugcccacugaggcuagaagagggcaaucagauccccuguaacuggaguuacagaugguugugaaccacuaaguggguucuggaaauucagucugggucaucuaaaagagcagguuauggcccccaugccaucuuuccauccauuucuuaauuuuugaaggaugcaugaucucuuaccacaccuggaccucacugauuugacuagacuggcuggccagugagccuccggggauccuacugacuucauuuccccaguacagguauauguggcaucauguccagcuuuuuuucuuuuuaaaaaaauggauucugggagguugagcucaguccuguguagcuagcacuuuauugauugagccauauucucagcucuuaucucuaacuuuuauugguuacuauuaucaaaauuauacuauuguuuacuuguuugcuugcuugcuuauuuauugauugauugauugauugauugauuguucuggucucuaacccagugguuucuacaugcuugacaauuaauaugccacucagccuagccuguuuuaauuugagcuuuuuuuaaaaaaaggauuuauuuauuuuauguauaugaguauacuguagcugucuucagacacgccagaagggugucagaucucauuacagaugauugugagccaccaugugguugcugggaauugaacuuaggaccucuggaagagcagucagugcuuuuaacagcugagccaucucuccagccccuuaauuugagcuguuuuaaaagacaaaccagugauuagguauuucuucuuguuaauugcauuuuucuguuuuacucaaauuguuuuucuuuuucucauauaagauuuuuaucuauaugauaguguaauaaugguuauguguuaagaaaagugcuaagaaguuguaaguuuauauaggguaauaugaacuaguucuuucuuuucuacauuuuacagaugaagccaaguuuagaaugaucaaugaacuuuuauuuuuauuuguguuuauauguagcccuggcuagccuggaagucuagacaaggauggccuugaacucacagaucugugugccucagcucucaauugcugguuuuaaaggugugucccacuaccacccagcucaauuauugauuccccaccccccuacuauuuagccuugacugucccagaguucccucugaagacucuccuagacgcuguagacuuuccuagaguucccucuguggucucaaacucacagagaucugccugccucugccuccaaaugcuuggauuaaaggcaugcaccaccacugccuggcuaguuaaugaauuuuuaaacgaucaaauaaugaauaggugagccaagauuuaaaauuuaaaauaaauuuucuuucacuaauuauguuuucaagaaugcucaggaugaauaaaagccuguuuaugaacuugucuuugguguucugguuauaccuuagaguuauacaguaugcaguguuugcuuuuauuuuugacuuaauuauuaguaagaacauugguuuuaguuuugaaauauuuguugcaaaaguuuccuuauuacauuguggacugagaccacuguaaacuuuuuuuuuuuuuugguguguguggugugugguacuuugguuagcuaccacguacgggcuuuuguguaagagaagcauguguucugccauugacuuacaucucugaucuaaaguguauucuguguucugagaaaaauccuucauaagauuaaaaaauuauauucuuguuuguugaauguggaguugagcaugcccugagacuauuugcuguuaacacucuacaguuauaucuugagaaucugucuucuagucuuauauauugguaguuacagauuacagccuucucugguuguaguuuuccuguuuaauauuuuugauguacaaguuuaacauuagugauuauaguauguuacauauauuuauguauaucuuuauuagcaaagggauacuguuaagcaaacuugaaaacuccugggaaaaaggaaacaauaguuaaagcugauagacuuuaacauugugccacucagauagaucuuuuuuauucaauccuguagcuuugaagaauugucauuugaguccuucagauaggaaaaaugauccugaaauuaauaguaauagccacaauuauugguuagugucucaauuuaauaauucugugagguauaggugcucuaaucauuccuauuuuauagaugaaaaaacugggacucaaaguaaguugccuuauaucacaugacuaacaauauacuuuauaaaucgagacuuaauagauaaguaauuucaaaauuaaucuggcuucugcaagguacuccuucuguguaaugguuacacauguuaauuuuuuuuuuuuuacuauauuuacaaaaguaaauuuaauucauccaaggccagccaaaguaaauagagauuaaaaaugacucugaaggaagcaguagaacuuuuuuugugugguauuuugauuuuuaggcaguggagucuugauagguguuuuuacuuuuauaguauauguuguucacuguuaugccuuauaaauuuuagaacuaguguaauaauaauugucauuugaaugguauugcuaauaaaagauacagauauugagcacaaauuuauaaugcaguuuuccucuuucauaacuauauaaaagagaucuuggauuuauuuauuucuuuuaguuuuuuaggacagggguucacuaugucacagcccuggcuauccuggagcuugcucuauacaccaggcuguccuugaacucagagaucugccugucacugucucuugagugcuggaauuaaaggcaugugccagcacugccuggcuagaaugcauuuuuaauuuaaggaaaaugagaguugcuaagucgaauuccguuauaauuaacuuuuuuugguaagcauuauuagaauagaaggaaguuaaugcuugacuguauuugauguuagcuagcaagucuguagaacaacuugagcucuuaaauacuacugggagaacugaaaauuauuaugcucauuuuggagaguaagugaaagcaucuguucaaacugggcaugugcagaaccuacugaccaaacacuuuggucuuggauuuauauccaacaaaaauaagcacauacauauaccaaagggcauaucuaaaaacaucgucucagcauuauauuuagucacucaaaaugguagcuuucacuaaugugugcuuugaggcuucagugcauaucuaagaagugauauaucauagaugcagcccuuaauuaaaauguucagucguuccuuugggagagauuaaaaaaaaucucauuucucaguguucauuuucuucuuaguacauaauauauuggaguaagacuguggucauuuaucagaaacuuguauauuuuccuuucuuuccacaggaauugcugauguguuaauuucuacuuuuguuucuuucccauuuuaggggaggagggagguuuuauguuuuuacuuaaauucucuuagugguuuuagaugauuuuucaggauaaaauaaacauacuucaguguuuugcuaaacucuguuauaauccagauccuaauuuuaugaauucuuaccacucuggguuucagauagauauaauuugccauauucuauuagguccaguuccuuuucugaaaccaauuuucuccuugaaauuuauucccuagaacucaguguuccuacuacauuuucuuacaaguacgccuauuuggccaaccaaguauaucuagagacaguagaaucuuauauuuuacauuguaauaaucuugguaucuugcaaaaugcagauacuguguuucugauucugauacaucccuuucugcguuauaaacuuuauguuccuuaaaagaaagaaguagcuacuuuccacuaagacaaguaaugucuaagaaaugaauuuauuuuuaagauauaauugauaauucuaguucugucuuuguuuuagguaauggaacugcugguccaucugaauaaacguauaaaaagccgccccaaaauacagcuuccaguagaaacacuauugguucaguaccaggacccugcugcaguuuccuuugucacggugagaguuaguuuggaauuuuuuuugcggggagggggguuuacgucagucuucucaguguuuaguugaugccaucaauguuuauuggcaaacuuaaaaguuucauucuuagaccauaccuaacugaaacaguuguuuuuuuuuuuuuuuuuuuuuuuuaaugcuguguuauuuuuucauggaguacugauucacagguaaugcugcuucaaagaaguuauaggaacaugguaaugaauggccauuuauugggcaaagaaauguuggugaaaugacugugagguauuuaauauaaaaaagaaugauuuuacuuauacagaaucugaacaaguuaauaucaaagacauuaagaguagaguaccgauuaucagaaguugggggaaaauuaauugcuagguacuaagucuagagaacaggaacuugugaugugcugugcuugcgcaguuggaaugacuguagguaauggguacuuucugcaaacagguguuuacaggcgcccagugugguguaggauugcaguuccuuuggcuuguuagguugaggcaggaguauugcuugagcucagaaguucaagaauagccugaacaaauuaugggaugcucuucuugaauaugaacucugaaacaacaaaauaacuuacagaaagcuagaaaaagggcuuucaaggucuugccuuaauggaaugauagauauuuaaggguauguuuaaccuaauagaagcaacauauaauguauacauagauuuaaaugucacauugguacucuauaauauguauacuuuucuaaaaacaacuuggaacuggggauuaagccaggggcccuuugcgugcaagguaaaccuucuacugagccaggccccuacccaaugcauguaauugcuuuuauguaaguaacaguaauuugauucuuaguaucugagauaaaucugaaaagagagaagaguuagcaauacucuuucugauguguguacucagaagcuauccuuuuuuguaguggaguaaaucugagacuggcaaguauuccucuucauuccguuucaugaaaacaaaauuuaaaaaauguugauguuauaugaugacagauaguguuuuuuucuggcucuuguaauuuuucacaguggggcaaaauuucccagauuguuuuaucaggagucacaguuuuauuuggaggugcugugucuauuuucuacauauaauuucauuauaagacaguaucuuuccuuuaaccaaauacaaauauugaggucaauaucuaugccaaauagaaggaaggccuucugaugccuguucauuucugugaagaauccuucagauuagcaacuaucuuauuucuacaucuggauuuauacucaugaguuuacuugaguuguaaauuuugcaaagguuguauauagugcuacggauaacaucugcagcccucaguuucccuggauuaccugccauccauugcugaguuguuacuggauugagggaccacauagugcugcaguuccuaagaugguuuuaguaauugaccugugaaauggaagcuugggauuuguuaacaugugaucuuggguuauugcagcaaaccgggagaucugcugauaauguguauuauaaagguuuagauaggcuaaaugccuuuuuucuuccuagcaguaguaauugacaugugacuguuucugguuaaguuaccuuuuuuacauaaaaagcugacuuuaaaaagaaguugugcuuagggucuuccccgagaugaguaauuuggaagcuguaauaaacagaggaugauucuugugaugguuguguuauaagaauaacuuucuguaauugaauuuuucccuccauacucacuugccuucucuuacugcauuagaauuuuacuauaauuuauguuaagaugggcuauccucgccugccaguggaaaaacaaugugagcuggccccuacgcuucuuacugccauggaagggaaaccucagccacagcaggauagguaaggcuuccucgcuuaccuguucccaucuguaagagucaacaacuuuugccuuucagauacaggucaagucugguuuuacuuggcaacuggaaaggcuugggcuuguuuaccugaaggauaguugaauuuucuaugauauuuuaguuacuguuuuauuaguggcauuauaaaguucuucauaugaacacaaaaaaauauguaagacugacacuuuccuaaauuuaacugcuucacguuuuuuguugucuuuuuaaaagugguuguuuuaugugauguuaaaaaucuauuucauugauuuguuuuccuuucaucucaucuggagagaaggcacuguuguuaagaguacugucugcucuuucagaugacccagguucaauuccuaccaaccacauaauacucacagccauuuguuaacuccaauuccaggggguccagaacccuuuucuggcucugggcacuaggcuaucuuuguuguguauagauuuggcauauagaugaaauacccacgcaugcauuaaauaacuaaaaagaacauuuuucauuaaaacauuucugucuugauggauaaaacauuucucaacaauuucuggaagcaauaggguaauauaggcacuggaaaaaaaaugaaggccuuuuauaacaucauuuauuugugggcuuagagaaaauaucuuuaucucagaucugucaauuagaaaguuuccaguucugguuuauuuaucagucaaucaguuguuugauaauggucuuggggaucaaaugcagggccucagaagccuugaauaaaagacuacagguguuuacaaugaaauuaauaauugaagcaaauuuuuauugaaagaacauguugaacuuuacuuuuaucuaaaauguaacaugaaccuucugguaaccuucugguaaaaucaaguuuauuuuauauacauuuuucuagauucuuaaagugaugaaccauguuggcuaagagccaguuaucacuuaauacuuugagaucuuuguucaaaucuuugagauuuguuguuuuuguuuuuguuuuauuuugagacaguuucucuguguaguucugugugucuuggaacuugcucuguuagccagccugaucucaaauuacugagugcugggauuaaaagcauguaccaccaccaugcccagcuuaauauuugagucuuuuuaauuuguauuuuuacauuuuuugagacagaguuucuuuguguagcccuggguauccugggacuaacccuguagaucaggcuggucuuaaacucacagaaaucuaguugcuucugcuuccugaguacuagggacuaggaaaucaagguuacucccuaaauuaagacuuugucccuaauugguauaaaaaaugaauagcuccugauauaauugccaauuuguauuaaguauaucuuuuauuugcguguauaaaaaucgauuuauaaacuagcugcaauaaauuuaauuuuucuuucagcuuaaugcaucuuuuaauaccaacucuuuuucacaugaaguacccggcugaaucaucaaagucagcuucuccuuuuaaucuugcugagaaaccaaagacugugcagcugcucuuggacuuuaugcuagauguccuucugaugccuuacgggugaguuaaaaaugacagagagccaagcaguguugucuugagaguuuacucuguggaaauuguaugcuacuuuaaauggcucagcuuaugugugaugcaucucugaggauuugcagcaguacuaaaugcuaaaguccagcucugcuacauauuggcuguauagauauaguaaugcuguugucauuuuuagauuucaccaguccccagcugaaguaaauguugagucuccuagcucuguguaccuuaggaaaucaggaaaucauauccaguuuuccuuguucuguuuuccuugaugucuuggaauuucuuuugcacuucuaccauuuaguaguggaucuguuuggcucuuccuacaauuuuguucucauagcuuuguuuuuugauucacuuucuuuaguguacaaaaugugauuuacauucuacaggcguaucauuggacucugcuuaucccucucaugucuucaaacagugcuguagaguugccugauuuuuagcacagauuuuaaagcacaucuuagaagcauggguucucaguagccaucauuacauguauucagugauucauacuccccuccaaguacuuccaccuuauucuuuaagauaaugcaguacuuuaggauauuucucuacagagaaacaaagucaccuuggaaaauaucucuuacuggccagaugucaacucggugucugcuacagacauuucuuauuuuguguagacauauuugcucuauuuucugugucccucauagcccccaagaacuaccuguguaguacuuuguguuuuuaucacauuguugacaucuuccucuuucuuaaagguuuuucagccccuugcaguguuuuaucaggcuuuugaaucugguuuccagauuguggucugacacuagccuacugauuuggucuugcugcuagagauaguuucuaaacugcuacuuuuacuccguuuuccccugaucuugaggguauauguacauagacgaccaugcacauggaguugcauagcaucuauccucagugcagagacgagaagguuaaggcuguaugguucuuucucuuccaguuggcucuccuucugccccucuaguuuaauagcuugauuuuucagggccuuuacuacaggcaagaagcugaaauagugaacuggaaguggggugaggcuauaaacucucauaucucacccucagugacuuuucuucguccagcagaauugcaucuuauggcuauggggauauaaucuccccuagaagcgccagcaauugggaacucauuuaaaccaauacagcuuccaagcuucucauucuuuaaugagaauuuuaguaucuauuaugaucuauuaucaguauagaauuaauaucaguauagaguuaaagggauuucaacuaauguuuguauaaaauauaaauaugauuaugaggaauaauaguuuuaauuggaugaaaaauaaauuuauuagaggucuuauuucuauucuacaagcuaaaaaguaugucagauaacaauaacaaggagacacauacaaggagcuuugaauauauaaugagaaaauucuuuuuuuuuuucaaaauuuccuacuuuuaaaacuuuguuauuauucuuuguauguguacagaguaugagugaaguacaguucuguggaguugggucucucaccuuuaauggguuucaggacuuaaauucagguugucaggcuuguguggcaaaugccuuuuaaccauugagccaucuugccaggcccugacugaugccuuuuacuuuaguuuuaacuuuuagaauguuacaugcuuguaugggaggcaguuugugagaggcuucagugaguuuucuaaugugaguuacaaaguaagggaaaaaaccguaaaagcuuuguuuggagcauagaacaauacuaaccauaagccuuguggggucaauaggcauaugucuguauuugucauuaaaaaaucaaaauguagugaguguaaacuaacuuaucagauaauaauauguaccuggaaauggcauaaacauuuuguaguucacuuauaacugccuugagugauagguucuucugauuaauuugcugacgauauauauauauauauauauauauauauauauauauauauauauguauauauauauauguauguauaccuuugagauuuuuuuuuauauugcuggacaguguugcugcaugccuucaauccuagcagaggcagguggaucucugaguuucaggccagccuggucuauagagugauuuccaggacagccagggcuauacagagaaacucugucuucaaaaucaaaauaaguacaaaagugauuuuuacguggaaauuuuuauuuucguuguugcucuagcacaguggugcuaaaagugacucuuuaguagaguuccucauguuuugaugaccccuaacugugauauuacuuuuguugcuacuucauaacuguaauuuuacuauuaugaaugguaauguaaauagcuguguuuuaccauaguuuuaggugaccugugagagagucauuuuacucccaaagggggugcgacccagagguuaagaaccacagcucuagcauaauacuguucaacgacagagugaguguuuuauguauauauguguagauauacacaaauucacaugcuuuuauagagaguuaaaguuuuauuuucuuuucagauauguguuaaaugaaucccagagucgccaaaauucaucaucaucaucacaggguucuucuucaaacagugggggagguucuggaaucccacagccucccccaggaaugagcuuuuaugcagcuaaacgaguuauuggugacaacccguggacaccugaacaguuggaacagguaucaucacagcugcucuuuauaggaguacugacccugaacucuugccccugugaaguucauggaagcaugugcagagcaauuccuguaauuucaaguucucuaaagaguauguuggaaaggagcaaauucuuuuccucugucauuuauuuguuaaagcccuagggauggggggagugggaaaugagcguaugucuuucuaacaguguucacaucuuucaaguacuaugcacaaccuauuuuauauugagcaaauuuaguuuucucucauuuuaauuuauaacuauaggucuuaauuauguaguuccuuugaugcaguuaaaauacaauuuaucuuucauuauucaauauuuuagggcuguacauuuuguguaaagugaggaaccucuauacuucacaagugacaauguggggaaaagcaugacucccuuuuauauuucuucuugggguuuuaaaauuggcauuaagaauuuuauucuggauuuaaacaggacacagauguucucugagcagcuuuuaaaaaugacuggugcucuacagagaaggugccucccugugucugucaucaggcaccucagggaagaacagaaaucaguauguaauuauuuuggaauucaagcaacauggguuagucuuccaauccuuccuuuauuucuccauagcagucucaaugauuugaucuuuucuuuuugggaauguaagugaucauugacaaaaguguuuucaggagagagaaaaagaagcaaauggggcauucuugccacucaaaauuuaguguucuauucaaugaggguuauaauugauuagauuuacuucaugcuuauacaccuuuuaccuccucccuccuccccuuaagccauagugugaaucuagaaaccacucuaaugagugugacaugaccuauggcaggcacuauacuggguacuuuuaguauacuaucucauuuaauccucacagcaacuaaugagguagcgaaauuuucuaaagcuccuuuccuaaaagguauggaaguuuugagauucaccagggucucuuuucugauaccggacucuuagccuagcccuuugugaggcuuaaagcugaauauacuggagaguacuaguuauugcuauuguucauuuauaaucuuaaguuggucauuguuugcugaauuuaaagguuucuguaucuguuuugucuguuucauaaucuggugcugaaaugaauaguuuagcuuuaaaaacaaaaccuuuuuaauuuugaauacuuuuuuccccccaaguaaaucaacuuacuuucucuuucuuucucucucucucucucucucucucucucucucucuguuuuucaagacaggguuucccuauguagcccuggcugucuuggacucucucuguagaccagacuggucucaaacucagaguccaccuccucuuccuccuuugaguugggcuuaaaggugugugcuaccaugccuggcuaaauauacucauucuuauuuuaauuaaaacauauuuuuuauuuuuuucugauuauaaagguaaagguuuuaguagucaggaauagaauugaggguacgggacauguagcuuaguugagagaguuuaccuagcaugcauaaagccgugguugaguccuggcacuccgugacuaagacauggugcaugcuuguaguccagcacucaggaggagaaggcaaggaaauacaagguguucaaagucauucuuggcugcauaguucauuugagacccugauuuaaaagaaaggaaagaaaagaaacccccugcccugcccccaaaacaaaaccucccaaaauaaugcucagugauagagccuagcagccaggcuuagggcggcgagcucaguccagagcaccucaaggaaacaauagaacaauccgccuccaguucugccucugucugucugucugucugucucucuuccucugugugugaacaguuuuauagaauacguuuuuauuugccacauuauaguuuagucuuugaagauuaaagaaaaaucuguccuuuuacugcuuguguaagauuuaacuauguuuuauguuuuaacuugugauuuauuguugagacucuugucauuuuugguuuuuaguacacuuucauuauguauuguguauuugacuuuuauaaucauccccuuugcaguuuacguuaaugacuccuccaccuuucaaacuguauuucuuauuauaauuaaauuauacugagaaggccuuuuugucaucagcuacacuuuuuuauuggcauucuuuuccauuuaauuuuuaaaaaauuucuuucucauuuaauaauuguauauuuuaucauuccuaauucauacaucugagaauuauuauguaacugguuuuuaaagugaggauaaaauuuuacuuuucagguguauuugucccugaaugaugggcagugaaguucauagcucuuucacauuucagaaaguccuuuuuaaaaucuauugugcuucauugaguauguuaguuuaaacacuacucuuggauugaguugcacuuggagugacuagaaaucauuuucuuuauuuuuagucuuaaaaauauguauauguuaacaguagaauaaaacugaaaugugaguuguucaaaauguuucucacaagcaucuaucagacacuuuguucguaauguauugcuucucaccuggagauguggacagagauguuaaguccuuaucccucuaggaaggucguguggccuaguagggagacucuuguuguuuuguugucagagacuugucuuugaagccuacugucaucauuuguuguguaguuuaauguuuuaagcuuugccucaguuucuucaucuaaaagugucuguaauuauaucuaccucauagauugugaggguuaaaugaaauugugaauaguuaagauaguguagugucuggcacauuauaaaccuaaguaggagcucuacuguugcauuaauccauggcuuaugaccguguuguuauguuaacuagcuuuagugcgugcucuuuguuucccugacccuucuuucuccuucccuucacuuaucugcagugcaaauuggguauagugaaguucauagaagcugagcaggugccugaacuugaagcuguucuccaccuggugauugcuucuagugacacacgccauagugucgcgacagccgcagaccuggaguugaaaagcaagcagagguaauuacuuccuuguuaagcuuucaaaaucaaaaggcagaguucuuaaaucuuugcaggguuuuaugaaaugauguauucagcuuaggaaacuaggacacauucuuaguuguaaguuaauaaaguuuaccaacgagcaaaaaucuguguccaaaaaaaaccuauuugaaaauguauuucaaagcuaaaauagguuaggaaugccauuauaauuaauaaaauuuuccgcuaggcaaauaaacugaaaguuaauguugaaaacaauagacccaagaaauaauuaacuuuugauuuuucucucgucucagaccaguuaagaucccuuuuaauaaugaauguguauguauugugguuguuauaguaaaaaccaggcuuauggaagaauuacugaguaaaacuuaaaucuacauugaaaagagauacaaauaauagaggaauaaucuuuguaugaaauaaaaaucaauggaaaaugaguaguuuguaccuaugguuaaauacagguauauugaagugguaaauccauuuaaguuucugaggaaguacuguaucuuauaucuuauuugagcagugagucauuaaauaaauaaauauauacacacacauuuauacauacacacacauauacauauacauaguaaaucugggaauucaugaucuaaccauucaaaagaagaaaauauauuuagaaauguuauaacuuuagucauuauagcaugucuuacaguuauugaaaaauaaaaaccugaauaccucaugucacauaacccagcacuugagagacaggagcagcagaucuuaguaguucaguagcucuugcuacacagugagguccuguauauauauuuaaaauguaaauccugagguauuuguaacuggcuucuuugggaugguuuuguuagauagcuuagacugccccaggcuuucuacccugugucucugccuacugcggauuacaggugugugcuuccguguccagaagguugaaugcaugcagguuguuaaaauaacauuuauaagacagaaauagcgaaaaugccauaaaacuuuauaacugauauaugcauuuuacuuugcuuccucuaagaagaaagugcaaggagguauaauaaaauaaggaaauuaauuuaauggaccuuaguuugcucuauugcaguguuuggguagauaauggcaguggcugagaguggcuuccacugggaagcauaugagguggcuuauagcagggcuucuuaaacuuuucuaagugauccuuuuguuugaaauccuuuuuguuugagaauuucuuuaugugacuauggauauauauuuugugauucuuuuuguuugaaauuuuuuaugugacuguguauguaugaaauagauauggagagcaaacauuugcugguaauaaaucaaacucauuuaaaacaguuuugcuauacauacaucuuuuccauuuguuuaugaggaaaucaauuuuuuauuaauaagauggauaggcuuguucaaauuuacacauagaauuaaaucuuggcuggauauuugauacucuaaggcagaacaucuuuaacgugcaugcuuuaggauuuugguuuuauaaugguuacugcuaagaacccuugcuuuaccuacucagcacaaaauggcuggaggaaauuuaaggcaucuagaaauuauuggaaauucuguccugauccuaugccaaaacucuugcaaugauuuuguuuuuuaaaguuaaacucaagucagcaacucagcaaguuuuaauuaaauauucuaacaugauacaauucaaagauagacucuuuugauauuugcauacuacgaaugaugguaggaaaaaaagagaaguuuuauuuuauguguuuaacucaguuucuauaagagguggaguguacaguaggaacagugacauuuacaaccugugcugguccuuaguagguuuccgucaugcuuguguaguguggacugaugccagauucagugcacagucaucauguuugcauucagagccaaggcuguggggaagcugccugacgcaccauaagucagcgcagccagaagcaaacacgggauucauuacaguugguuuugaguaaaguuuugguugucucauguuagaaacuuuacuucucaaaauuuguuaugaccccauauuuagugaugugucgcccacauaggagucuugacccacaguuuaaggagaggguaaaucuuaauuuuacucaugucuuuuauugguugaauuugagaaccuggcuuaacuuugcuagacuagauuaagagaauugaaguauauuuuccccuaacauucuuucaagucucauuuuuuucuuuuuucuuuuuuuuccuuuuccuuuuccuuuuccuuuuccuuuuccuuuuccuuuuccuuuuccuuucucuuuuucuuuuucuuuuucuuuuucccuuucccuuuuucuuuuucuuuuucuuuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuuccuuuucugagacaggguuucucuguauagcccuggcuguccuggcacucauguuauagaccaggcuggccucgaauucagaaauccuccugccucugccucccgagugcugggaucaaaggcgugcguuaccaugccuggccuuuuuuuuuuuuuuuuuaaauagauauuuucuuuauuuacauuucaaaugcuauccuaaaguucccuauacccucccccugcccugcuccccuacccacccacucccacuucuuggcccugguguuccccuguacuggggcauauaaaguuuguaagacuuaagggccucucuucugacuaggccaucuucugcuacaaaugcagcuagagaugaacucugggggguacugguuagugcauauuguuguuccaccuauaggguugcagacaccuucagcuccuuggguacuuucucgggcuccuccauugggggcccuguguguuucauccaauagcugacuguuagcauccacuucuguauuugccaggcacuagucuagccucacacgagacagcuauaucagggucccuucagcaaaaucuugcuggcauaugcaauagugucuggguuugguggcugauuaugggauggauccccauguagaguagucucucauuuuuuucuuauugcuuauaacuuagaguauuucugguaucauuuaaaggaaugaauuuuggaguguuaaaaaaguucuucuuucaaaauuuuuaaguuugaacuggccuuauucuuuauaucauauuguagauuuuguuuuuggaagcuuaaaugugauucuuaguguauuuuaauuaauuuuucuuuaggauaaaaaaaaguauauaccauaaaauuacauuaagauuauaaaauucuguggggagaacacauagguuaccauuuugugggaaaaaaaaaaaaaaaagaaaagcucaaaguacagguaucucuguaucguuucuguucuuuuucugccuccuagcuguacugucaagugauuagaaucuggaaaaggauaucaccacagucaguggcugucauaaugaaaagacagugccaggugacaggugguggcacaggccuuuaaucacagcacuggagaggcagaggcaggcagaucuuuggaaguucaaggccagccuggucuaaaaaguaaguccaggauagccagagccacauagagagacccagucugaaaaaaccaacaaguaaaauguuaacaacaacaacaacaacaacaaaacagucagaaaaguaaaccuuaaaaaagaaugguaaagcaaaauaagaggaauagugcaaucuuuccucaguggaugagagagauggaucagagaagcaguuaagcagcaggacacuguuguuacacaaaugcagcaucaguggaaagcagagcgagugaguguuaggagucagagagaagacagcgcgaccagcugucagcagucagcugaaaucaaagaucuauuaggcuuguaaaaugggugagugaggcccacugugcuggugauggugggauagauacuuacuucuuauccagucucuaaaucccaacucaccuuuucuuuauagaccccagauaggggugcaucucugugacaaauggcguugugacuucucagauuuagauauugaagcuauuggguuagaugaggguugcauaaugcccggaaucagaacagaacuggagaaaugcagccgcuucagaguuuccuagggugugagcuuuugaagcauaaaaccauuuuguuguuuaucauuuuaaaauucugaaugguuaaaaagaagcauccaccacccaccuaagggcguuuggaacaaguaaaguguaugugugcucugcgaguugcuccaugguguuagcccuaacccaccuggguaggaacuuuguucaauuuuuuuucccuccaccaguagugccaaguugggccauugcagcaguaaacuguugagucaagaagggagagcuagacgagugagcuggaguugguggguuuuuuguuguuguuguuguuuugagacaggguuucucuguauagcccuggcuguccuggaacucacucuguagaccaggcuggccucgaacucagaaaucugccugccucugccucucgagugcuggaauuaaaggcaugcgccaccacgcccaggugagcuauaguuuuuaaagcuaaguuugacaguagucaccuucauuucuucucuuccacaguaucaguugucaauucauuugguguguuucugccauuuuucuuugaugacaaauauuaggguauuuuccuaaucauugaaauaggaacaaaaauaauuucaaccaucucucuugaaaucuuccauagcuuaauugacuggaauaacccugccaucauuaauaagauguacaagguguaccuuggggauauaccacugaaaacaaaagagguaagcugcuuugauuuagucucaugucagcauaaaaaguauuguguugacaugaauuguguuuauuuuuucccuaguuuguaagcugaauccauguuuuuugaauuacuaguuuuaagccauguuugucuauaugaauuaaccgccugaaacgugaguuuaauagaucugguauuuucaguguagauacauaaauaaugauaguacauuauauagaugaaggauccacagacuuucugcaauuauuuugggcauuugaggcauuaaaguauuugaggcuauaacuacucaguuucuauaacaugaaagaagcaauaggcaguauuuaauuuaaugaacauaguuauauuucaguaaaaaugugaauacugauacuuggauguuauauaauuuucaugguuuacaaaauauuauuucuuuaauuuuuuccauuuaaaaauauaaaagcaaaaaauauaaaagcaauuuauuaaagucucaguccucguugaaauaaaugaugggccaugugugaucuaugaguuauaguuuacuacuaucuggcuuagaaucuagaacaaaagguuguuucugcagccucagaguaagaucauugcuuaauaaggucuuuucacugugccaguccaaaacauacagugugauuuguguauuuuguugcuuucuuuuaagaacauaaguaggaguuaauaguucuuuagauuauuagauugguuuagcagaaagaacaaugaauugagaccccuggauuguaacauuaagugucuguacacaaacaaauguguuagaaggagagauuuggcuaaucagucaacuccccucugccucauauucuuuguguagaacaugcaagaauuuauugaauagaguacagucuguugaucucuuuggagucauaaagaacuuuuuagaggauccguaaagacgagguuauuugucaguuuuuuuuuuuaaaguugauauuugcauugaugucagagugguggguauauauugugugggcucauacuacagaucaaagcaaaaccauaccauauacuuaacggaggaagaagagagggagagguauaagaugggagaggaggacacaaaugaagaaggagagagagagagucagaaagggagaguggagguagaguaauuguauuuuaucuuaauaucgccaugaaucauuagaaauuauuuuacuugaagaauagguacauaagcuauauauauugugacugguauuuugacagaccuuuucucucaaaagaaaaagaacauaucaaugaaaacugaagugacuuuuccccccuccuuuuuggaauguuaaaaguugaccucauaaggaaauauuagaauuguaggaaauuugaacucauugacguaguaacuuagcaauauauuuccugaagagacugguguugcaagaaauacuuuaaaaaaauaugcauuggggguauuuuaugcugauauguuuuuaacucaguaaaacaguauuuuccagauagccagugguauuacaaaagcauacaaccuaaggaccccauccaaacuguaugacaguggaauuuuauuuaaacgcaucugccggagcucaccaauuuggcuuaaacuccaaauuacaauuagccuuuaagaaaccauuauuuauuaaguuuugguuuagaaucaaagauccacaauuacuuuuuaaaaggacaaaaaucauccuuacuuucucaccgugugucugugcaagcugggacuuaccuaucaagcaaaagagcuaccacagcaauuagaauagaguauggaaaaacccaguucuuuucuaguuacuuccaaaaaauagaaaugauucuguucuucagugcaguuuuuaaaaguuugucuuuuaaaagaaaaauauuacuuauuaaaauauauuaauuuauugauguuucagauugucuuaaucaguuuuucuauuccugcacaaacaucgugaccaagaagcaaguuggggaggaaaggguuuauucaguuuacacauucacguugcuguucaucaccaaaggaagucaggacuggaacucacacagggcaggaagcaggagcugaugcagaguccauggagagaugauauuuacuggcuugccucccuuggcuugcucacauugcuuucuuauagaacccaagauuaccagcccagggauggcaccacccacaaugggcccucccuccuugaucacuaauugagaaaaugccuuacagauggaucccauggaggcauuuccuugagggaggauccuuucucugugauaccuccagcuugugucaaguugacacacaaaaccagucaguacacagaugucucaguuguauuauuuaauauaacaauugcuauuaggugacacugauaagagcuuuuggaaucuuaaguaauuaaagcaauuuuauaaaaaaaauauuuuguuuuauguguauaaguauuuugccuguauguauugugugcuuaccaugugggugucugcuucccacagaggcuagaagaaggcacugaauucccugaaacucaaguuauggcuguuuguaagccaccauuugggcccugggaaucaagcccaguuccucugcaagaguaacgagugcuuuuaaacuccuaggccuucucuccaggaccuaggaaucuucaguacccuaaagaguaaaagccacaaauaauucuaaaauguuguuauaacuaaagauguuuuucuuagggagcaguucuaaagccggagcugaaaagagacccagucaguacuagagugaaguuaaagauuguuccucaucuccugcgcucuagacaagcugcugaaacguucccagcuaacauucagguaaucuuuauugucuagcagaggaaaagugguuugaacaaauagcuuuaauuaccgggaaaaaaagaagaauuaguggauauucaggaaguaggcugauguauguaacacgacuaacaaguuuuauuucaucuuaauuguagcuguauaaauuauuuuauaaaaauguacuuugaaaauaugaugguaacuucauccauacuaguuuucugcgauugcccagcaccauaagaaaccacacuuaugcugguggauggugugcacgccuuuaaucccagcuuuugggaggcagaggcaggcagaucucugugaguucaaggccagucuggucuguagagugacuucaaggacagccaggacuacauagugagacccuguauaaaacaaacaaaaccaaaacaaacaacaacaggauagaacaaaacaaauaaaaaaccaaacaaguuaguguguguguaucuucaaaaauauuaucaucauaaauaguuauguaaaucagaggcagugggcagcuuugacuuugucuucacagagucuuugcuuucugugcuuacagaugauaucagcucacuguugcuucuggauuuaguaacugcagacguuuucucccucaucuucuggcccccauucagucugucuucuguauugacaccuacguaucuugguaguggaaaauuauuaaacaguguggaugggucgguacuggguggguaaaggguauuaaauccuucaaaaaagaucuuauuuuuaaccaaguuaugucuaccucaacgcugguaaucgaauuuauuuauauuguuucuuucuuguuuaaaauugugauauaauguacuugacauuugcugucuuaguuauuuaauacaguuacacuggcuuuaaaaacuucauugcuacaauucuuuucaucuugugaaacugaaacucaguauuuauaaaauguugucauuguccuuugccccccuggcaaucauuauucuggcuuuugucucgaaauuucaguucucuaggaacuucuuauaugugaaaucuaauaguauuuguuugugacuagcuuguuucacucaguacagugucauugagaucugucugcuauggcauucauuugucaggaguucauuguuuuccaaaucuaaaugucccauuuauuuauuuggauccuggcaugcuuuacauuuuaguuuucauuuauaaugcugucaugaacaugaauguucagguaucuuuuuggaacuuuguucuccauucuucuaugaauaaauccugcuucugaauugucugacuguacgguaguuuucaggguuugcggagcuggguuucuuguugccuguuugugauucaggcuuucuccauauccuuaguaacacuuaguuuucauaggggcuuccuaaggagacgguagucucccuagugaauaugaugcuguguuucuuuguugugugcuuuuuuauugugcucuuccucuccuucucccucccugcugccuuccccccaacccccgccccucaacauuuuccccuucuaguuuguuuuucagaugggggucuugcuaccuugcuuagccugguuucuaacuuaagacuuuccuagcacuuacagcugcuagggaaggaggagaugguuuacucaagaguguagcuccugcuaagucagcuacucucaaguagucuacuauuauacuuccagaaauauuaaggcaagacaaacugucuugaggauuuuuuaaaaaaaugauacaaaguuaagaggauagggaagcaaaguguuggcucaagcuauccucucugcccauucucucaaguauaauuuugaaguuuuuguuguucacauuaaggagucugucuguauccagaauauuagucccuuaauuagauuuaugacuuacauuuucucuuccaugcugugagccuccauuauuuacuuuaaaauuauuuauuaguucuuugagaauuucauacaauguguuuugaucauauucacuccaccaacucuccccagauucucuacugcuucucuacucuugaguaaaccaucuccuuuccuaccagcugauaauugcuaauagcuccacagguaggaguagaauugugugcucaacucccuucucucugcugggauuuggucucauuuuggcuagcacaggguuugugcaugcugucauaaccacaguggguucauauguguagcuugcuggguuuauagcuagacacaauucgugauuacuuucccaguagcuugcacaacacuguuuuacaaaagcucucugguugggaugaaguuugcaggucuguuauaagcuugauuuuugccgugcccuuguuacucagguauguggugucuucagcaauacguacggucuuacugccaaguucugaagaguuauugagagcaaugacaguagccuguaauguuugagggucuaugggacuucuuuugcuaaucuaauggaaacagugagagccuuucuuuccagucaagucuauaaucaagacuagccauuauacuauguugugguuugaaugaccccucagcucauauauaaugagugcuugauccuuaauuggugggacuguuuuggaaaggauuaagaaguguaaucuuguuggaggagauaugucacucugggggugggcuuugagauuucuuaagcccauacugggcccagucagucaguuggucagucagucucucccucccccucccuuuccuucuucccucaccccccuuccuuuuucucccccucucuucuccgucucccucucccucucucuucucugucucccucucucuucucccacuccuuccucucucucccucucugugucugucucucuaacuuguggaucauauguaagcucucagcaacugcuucagcgccaugccuaucugccugccuuuaugaucccugucaugauggucauggacucagccucugaguaagcccccaauuaaguguuuuauuuaauaguuugccuugucauggugucuuuucacagcaacagaaaagugaucaagacacacuaggaagucugcucuuagugugcugucguugauaguagaagacaauucagauugguuuauuccauauacagucuuuuguguauugcucaggaagaagcaggagaguaguuaauagugauggacuuuuauaggccuuuuacaggggccaggguaggacagauuccucaucuacaccuaucagccuaucauucaggcacauugggguuuugccaagcucuggaaagaauaauggugaaaagccgcucuuuuaguuguuguuguugaaguugcuuuuuuuuauuuuauuuuuuuuaagauuuauuuauuauuauaucuaaguauacuguagcugucuucagacacaccaggagagggugucagaucucuuauggaugguugugagccaccaugugguugcugggauuugaacucaguaccuucagaaggacagugcucuuaaccgcugagccaucucuccagccccguugcuuuuauuuuuuacaguccaguuguugccccccccuacuggucugcccucccacaaauuccucacccauuccucuuccccacugucuucaagaggauguccuguccccacuagccccucaggccaggccucuccauucccuggggccucaagucucuugaggguuaggaaucuucucccacugaggccugaccaggcaguccucugcuguauaugugucaggggccuuaaaccugcuuguguaugcugccuaguugguggcucagugagaggaucucagggguccagguuaguugaaccuucuggucuuccuauagggucgccuuccuccacaccuucuuccagccuuuuccuaacuuaaccacaggggucccugacuucacuccaaugguuggauguaaguaucugucugaauuagucagcugggggaaaacgacucuuaaugcaucugugccaugccuguggccacuagugcugucacaaugucauuucccaagccucacacccuguuaagguagugauacuuacaauacuaaaggaagggcguucuccacauuguuguggucuggcucuugcucagguggauggacugguggugcaagacugcugcagucagcaguaggugauagggcuggacuuuauaugauuuuuuagcauuggcuuguccaagagccuccaucagcuaacaaagucuaggguggacugcuuuguucuauacagcaaaugagguauuauaccauauuaugcugccugaguuuuggguagcauucacagcagaauuccuuugaugauguacuuaagccagauagcuacagggaauugcauagucuugggaagcugugauguauacuugaggccaaauuuaggauggcagugaugugaggcaaaauuggguuuuccuuagacucagucagggcuuucuuugccuuauuuugggacagguguaauagacccagaguauacuccagaucaggaguagugguuacggagcuuuuaauuucuaccacuguggccauggaacugaccuccaagauaucuuaaaguagcuuugggacucuugauggaauucugcuuccugcugugcagcuagagguugcagggcugauaaagauuuucaguuguaguuccaguagcucaaucugaaguuaauaauuuaaucauggcauuaguccugggcuucuugagguugugggccuguuacuggauuuuaaggccuggacuuaaucccuuugacuuaccugaagcaagcaagcuuucuaaacuccauauuuuucagguucuaguugaaaaaugaagcuaauaaguacuucucucuugccuuuuucauugcaccuccuccguuuccuuguugucuucuucauuuuuguuuuugaguuacaaucaaaccaggcacugugggcacccucuuuccuuaguucuuccgaggacaguuuugugucuguaaggugauuugaaagaucuuaacucaauggccaucuuccucugcuuucuucagagauuacuuuuagaauguugauguaguuucuuuuuauuucuggccgaaugucuuuauuacguaaagaugaagaauuuuauacaccuguauaaauugaaacaaccgugcauuuucuuuuucuauucuguugacauggauuauuauagcgaugauucugucugugaaacuuccuuaucuucaaaagcuauuuacguugaaaagacuuauuaaucaguagaaagguacaugagcuauguugcaucuguggacaucacaaagcaccucaauggaguccuuuaugugggcuccugggauugaacuccaguugcuagguuugcauggcaagugccuuuaccugcugugcugucaacagucuuauucaguaaugcuguauaguaacugaugugaaguuggcuuauuaacuaguugaguaaggaguguuuaucuuuucuauuaauguucauaaaaagauauugguacauagcuuucuuaugauaucuuuuuuuccuacuuauugguuauuugggaguuucacauuauguacccuggucaucuucacuucccaguuuucccaaguccauccucccauaccuuugugaccuuaccccucaaagaagaaaaaaagaccaaguccaauuuuuauugcucauauacucacugaagcaugaucaaccucccaguggucagccccuuaaagaaaauaguccuccuccacuccuccccgaaaaccaucaccugugaagggcuaugcuucagaaucuccaccacuauuuaagagucuuuuucaaugacuguuuuuuuuuuuggcggggaugaggugggggagagagaucauagaagccuucuaugucucucauucucaacugagucugcagucauugaucgauaccacugcaaaagaagcucccuugcccuuuacagucaucugugauaggaaucuuagacuuccaggguugccaucaugggccuuaguggcaacacagacauggacaucaacaugaccuuuggcugcagcauggacagaccauggaccucaguaugaccuucgauggcagcaugggccguagauagauaucaacauucaguagcacaggccacacacaucagcaugguuucaggcagcacacgugccucuucugguccccaacagcaggaccacagacaucagcauggccccagguggcagcauaguccauagggauccacguggaccuugggcauugacauggcuugggauggcagcaaggacuauggauagcaccaacaugucucuuaaguguagcacagaucauagguaccagcauggccuccagaagcagcauggacucaggggaucuuucaaggagucccaguucagaaaaugaacuauucuccaucuuggacauccuguuguucagagccugggcgaucacgcauguuugagagcagagccuuggagagcuccagacugcugcacaccacccugccuaccuuacucaguaaugccaugcucuccugcccacugcagccuucucccacaccugucaucacuguugcaucuaucucuaguucuuccucucucucccagcacacugguuuuuccaccucuccuuugcauauuuguuuguugaaauaacauugcaaacuguaguguaucacacaguguauguguguauguguauguauguauauauauaaaauauauguauauauauauuucuaaccaguuuuauauguaaauacucagugcauuggucugguuuaagauuucugguuucuaaaacacaguaaacaccagacugucacagaaacucauuuuggauauccuguuguaccccagagucagaguggucuuacugcuaugcuaugcagggaaucuggggacagaaaauuaaagccuuuaucaccuagaagaaugaaauggacacauaaacaccaagccauagacuggagagguacugcaguagaagcugaugcccaccagauagugagagcacaaagaagaguguguucaguggaaagagaggugggaucuggaacacuagauacaguggcacgcuuuagugaauaacaggacauguggagguguuuauuaugggagaggggagucugugcuggguauggguagaagcagcagcaugagagagaccuagccaugaaaacuguauuugagcuuuuauucacagacaagaugugggggaagggguggcuagagaugggaccagaagggaaaaaaaccuaacuauucaccauuuacugagaacauaacaagaguaccagcuucuguacucuaagcuucacccauuauuuuagucuuuggaauauugcuaugagggagguguuaaaauuuuuguuaaaaagaacaaaagaaaaagaaggggccaaaaccacggcuuguaagguaaaggagcuugcugucacacucaagaaaccugaguuugauccuuggaacccacauaauagaaugagaauggauuccaaugacuuguccgcugaccuccaauuaugugcuuuucugucuauuggcacaggggauuuuuaucucucagccauggcuucauuuucuuuuggugguaguaaaugaagguauauuuaacaagugaucuuagcugagugaguauucugaaacugaaaaacuugauaaauuccuaacuuauauuaucauuguugcguauauaaauaauauuuuagcuuuugaaaguggucagcuauuauauucaauauagaaauuaaauuaguuuugaggagcaugguguagugcagagguuuguuauugaaucuugacuguuauuugaaaaugccagauuguuauuuguuaauugguaucuuugacuuuguucauuuuacauaggugguauaugauggacuuuuugguacaaauacaaacucaaaguuaagaacacugucccugcaauuuguacaucacauuuguuuaacguaaguuuuguuuuauuuuuaaagcuaauuaacuauucauuauuuagaguaaucaaguuucagguauuuuucuauccagcuuuccuaaaaauaaauuuuuguuuaugcaagagggauuccauucuuuuagauuuauuuuuucucauuuaaaaugguguguauauggaugugucugugugggcguguacacguauguugugguuccugcagaguccagaagaaauuguggaguuuccuggagcuggaguggcagccugugaagaguuuguaaauugcccaguguaggugcugaauaacaccuggguucuaugaagcgagcagcacaagcuuuuauuguugaguuguuuaucuaaucuccagaaagagucacuucuuaaauauuguucagcuucauuuauugcuaauauuuuaaaugaucuucugaaaagauaucuugauuuuuguuuuuguuucaaguugcccagaaaucaagauuaaaccacuagguccuaugcuuuugaauggucucacuaagcuaauaaaugaauauaaagagguaagugacuuguuuuaaauuuuaccauuuaauuauuuaaugugauaaaucuuccaggcccauccauugauaaauguuugacauugaccuuuguuucuuaacauuuuuauuugaagugacaauuuuauauacuauugcaauuuuuuugucuuuuaaaaaaugguuguuaaaacugauaacaucuuuaaggaugccauuacuuuaaaccauguauggcagcgaauacauuuuaugauacauguauguccuaugugaaauugaaauuaaaacaauuuuauguuuuauuucuauauggaacuauuuagaguugacuuauaguaggaaauaguguuaauucuuaaggggcucagauuuuaccaauuuacaauuuuaucaaaauacauacauucaguaaaguuugauucuauaaguuaagugguaggauuucuuggauuguagguuuccaauaucugauuuucuuugcuauuuuuucacaauaucuuaaauaucuugauaauaugcuaaaucaauaaaguauuaagucuagcuaacauugacuuucucaggcuuaguuaaacauggguccaucuuugcaguacagggagauaaauaucuaaagcuagaguugaauuugcguccuaggucuauucuuugacgagcugcucaaguuauuuggacucuaguuugucagaaaaaaggauaaauuaccuuauuguauuauucugaaaaugaaaugacuuagcaaaguuguuuagcauaggcaggacacauuaguuagguauuacagauuaaaacuguugauuuguuuacacaauuugggaucuagcuuuuuucuuucauugaauaaugcuugccuguuuuuguuuuuguuuuuguuuuuuugagacaggguuucucuguguagaccaggcuggccucaaacucagaaauccaccugccucugccucccaagugcugggauuaaaggugugcaccaccacgccgggcuugccuguuuuuuaaagcauaguaaauuuuuuguguuguuuuugaacccugacuguccuggaacuugcuuguacaccuagcuggccuugaacucagagauuuaccugucucugccucccaaauguugggauuaaaggcgugcaccaucccuacuuggccacuuuuuuccuuuagggucuaauacauuuuaacauuauuuauggcauagauuaagagauaaucaugugcuuuagaaugacugguagaaauaaaaaugcuuuggaauuuuuggagagaaacuauauugcaaaauaaguuuuaggguggguucagcccuguggcuuaugauagguauguauguaggguaacccaaaauuauaaacugacuuaaaacguguguauguguuucccucccucccucccucccucccucccucccucccucccucccucccucccucccucccuccccucuucuuguaacucaauugcacacguuagaugacaauccuguuaauauguuggacaugccugacccauuccagauaaaacacagaaucuagucuuacuuccaaguaucauuuacaaaccuucccaacagaugugucaauaaguggguguucaguuauuggaugcugaauucuagguuaaauggacaagauugaucuuacaggaguuuuacuguguucugaguaaugcugauucucaguguuugugacacuguaaagcuguguaucuuagguggaggccacuaauuuccauaaugacuaugaucucaguaauuuguuaacaguauaagaaaugaaaagaagccauuuauuuuauuacagguguuuagguaauuguacuaaugcuuauuacaguuuuguugggggaaguuaagauaauaguuugucagagcagggauaaauuucccaauaagucaaguguauugguaauuaauuugcuguugacaggauacaugguauugaaaauaacaugaagcuagugcaagauaagagaaaucuuucacuugugaccaguguauuuggagugaauuaaggauuuuguuugugugcucuuuuguucuggguuuggauguuuuguuguuuugauggcauuauuauguaggacacugugauugagaagucaaauaacaaauguuguuguggcaaagggguuugcuguuuauugcauuuuuuugugugugauuuuuguuccuuucuaaaaauuuuaaggacccuaaacuacugucaauggcauauucagcuguugggaaacucuccaggugaguaaaguuuuuucuuccauuuuugcuuuuuuucugugggagacaccuguugguaauugagaaaaauuuaucugguauuaauagauggagaauaauuugcuaugauuccaacaagaaauguauuuuauggcaauaagcuaaugucuucuuuuuuuuuagaaaggauauaaaucauuuaaguuuacauuugaaaauacagucuuaaauuuagucuugaaauuagcuuuuaaacuuaauugugucaaaauaggucaccauuaugguugcauaagggauuacaaucuagacaucuaauuaaccuuaaguguuccuguugcuuuuuaucacuaaaucuuauaaugcugucugauauuaugaacaugaaugauccuguuuucaaagauauaucuauuucccucugcucaauaugauuucuucauuccaauuccuucuggugucaucuuucuucacuucauacuagagggaaaagagaugaaauguuuucaguggucccauaugaugcuuuggcuucacacacaggcugugagggaaagaagcuucaggguucagaggaaagucacucaagaucaguuuacagcacaggauugucacaaacucuguccuuaucucuauuagcaaaaaguagcaaaaccucuuacuaugacagauuuucauuuaauuuguaauuuauuaucucuucacauuaaaauuaggaauguuaacugaguauuuggaauauuauagaaggaauaucuugaaaacauauguuaaugaggauuauauaauugaaaaguuaaauaaucacuuuacaaaauauuuggcuccuggagaaaguuagcuaaugauacugacauuguauuuagaguugugaaagagugaguugaggaauguuucuauauauaguuucuuuuucgcuccuuuucaucccaugaagauuuaugcuaaugauaucuuacauucucuuacagucgaaugccccauuuauucacuaaggauauagcucuugugcagcagcucuuugaagcccucuguaagguagggaaacaguguauacacuccuucauggguauguuccuagaagucagcagggaggaaaacaccauuuuacugucuucacaggaagaaccggagacucggcuugcuauucaggaagcguuaucuaugaugguuggagcuuacaguaccuuagaaggagcacagagaacuuuaauggaggcacuuguagcuucauacuuaauaaagguaagucguauauauauuuuacauuuacuuuuuuguugauaaauauaaauuauacauaaagaguaucauuuucaguaaauguguacaauuauauaccauuccaaucaggauaaaugaaaaauccccuuucugguuuucuuuuaaauaugcaauauacuuuagcaucuguaguuauucuuuuauacacuaggacaccagaacuuaauuuuuuguaucuaacuuauuuguggaccuaccuuuucugaucuuucccuguccucuucuuuaucuguaaacugguccauuuucaguuucuuugagaucaacuuucuuagaaaguuguccuagacucgauagaagucugagagauauggagugagauagaguggcauuuguuuuucugugccuauuuaaccuguuuucuaguccauucauguugcugcauaugacaguacuacuuucuaauuauuuuauaauugugaggauugaacccagggucuugcucaaauacaaauacaaaugcaaauacacuucuacugagcuuauugccauauuguauaguguuuagaaggaaauuugaauuguuuuuuuuuuuuuuuuuuuuuuuugguuuuguuuguuuuguuuuuuuguuuuuuucgagacaggguuucgcuguguagcccuggcuguccuggaacucacucuguagaucaggcuggccuugaacucagaaaucugccuaccucuuccucccaagugcugggauuaaaggugugcgccaccacgcccggcuugaauuuuuuuuuuccaguaaaauuuugauuauuaagagguauauuugcugguuugcauuuaugacuuugaucauuuaaauucuucaugauggaaaugugguuuugggucaaaguaugcguaaggacuuauauuuaagccucuaugugggaaaacuaaucuucaugcuguguuuuccaagcugaaaguuuuuugucauaacugguagcugaacacugccauaagagaucugugguaccacuguuagacaaaucgcauuugucaagaugagucuguaagaagaagccuagugccauccaucagacaugcccuuccuucacuuuccgauuugcuuuucaagggaauauuuguaggcguuuuggauaucgacaguguguauguguaguauauaauacauauuuauuacaaacuauauguauucauauuagguauauauuacagguuauauguauauguguguuauguuauuuguaacauauauguauauguuauauguacauauaaccuguaauagauaauaaaacauuauugaauguuugccuuaguucuuuuucuuccauuauuagagauagaggaaauuggaagagguaauuauuagaauauacuggugagauaaacaaauguauuuuuuaaaaaauuagaccaccaugauauauucaugugauggaauuauuaagauagucagaaaagcaucuggugccacugaauuaugaagagcaaauuguaccauuguauguguuuagagcuugcuguauguauaugugagucuuguccuauaugcucuuggugucuuguuugugugcuucauggucuuauuucauagcaaauucuuagaccuaucuggacacucauuagaauacauaaaauuuuuccagaaaacuuuacgagcaagagugauguacgcauaaugcuuguagaugcuguuuauacucacauaaaugcaaucaaguaguaguauuaccaagacaaagauaaauuuuuuucucauagacuacuuuuaaaccaaaccuuagauuaaauuguuuaauuuaaacuagucuuuaauaucauucuucuuuuuuuaacacagggaauguagauagcaugaauucuaaaagaauaaggcauauguuuuuaaauuucucacauauuucacuuagguuuguggcuggaggaauauauuuagggaagcuacguaaaaguaagccauuagcaucaguaaaauuaaaaacuggccaacuucauaaauuuuuaaucaaagugaauauauuugcauuguugaauuucugaucugaagucaguguuaacuucagaacaaaucugagaaugauagagauauuuuuguuucaaaauuauaguaaauaaggucagauuaugucccugguaaaacauuugaauuucacuugugagcuggggagaugaggguagugaugaaaaaccucacagugacugugccucccuccauguuugcacuggagauguguauauacagagauccuuuguagcuagggucuuuguagaucuuugguuuguuugcaggauucuuguaagucauaaaagagcucauuacauaaugucaaauacuucuaagcagaucuugaacaggacuaagugguagaccuuguauauaacaauugugagguccuggguuuaauagccagcauuuccuauuccaucaaaagagaguucuugaacaaaugauuuuuauuuuuuucguguauauuuauugauauguuaaauuugaaugauauacaauuagcuugacuuaugacugaauugagaugcugauaauuaaauucuuuuuuggggugugugaguggaugucuuuuuguguauguccaauagccugaaguucaaguucggcaaguugcagugaaauuugccagcacgguguuucccucagaucauauaccuuccagauacuugcuccuacuagcugcaggagacccguaaguuucaaaagcugucaauuugaauuuguguuaccuuuaaguauauuuuaaaaguaguaaaauuuauguugguuguuggguuaauuuuaagaauauuuuaaaauuacucaaauuuauauugguuucaaaguuggcuuaugaaauuuagaaguaauuuauuaaggaauucaaaguaaaccccuucagguaaccugcaauuaauauaacucuauacuuauauauugaauuauaaguauaucuauaauauaugacauagauaguaugaaucgaaaauucuaauuagucaaauguaaauaaaaccuuauaauuguauaaguauuauauauauguauauauauacauauauauauauauuuauccauauaguuccucuguaggagcaaaaagaauuaauguuauugaucaauacauauuuaauauuucauguuguugauggaauaucauuuuaugucuaauauaccaauauuuaaaaauuaaguauauauauauauuuuuuaacuuguuagugaauuauauuaugacaauucugagguauauuuuuaaugagaccaaugugcuacuaucuauacuaauuaaggcaucuuuuuucauuuauauauuucagaauuuuaaaucauauguaaauacaguaaaauauacgugugcauuuacaaauaauucuuaaggguccuguuuucuguuuuauagucaauggcauaucuuauaauuuuuuaauuuauguauuuguuuuuuaauguaugcuuacucugucugcacguacaccuguaugcuagaaagggcagagauggucauaagccaccaugguggguaugcugacauuugaacucaggaacuuugaaagagcagccagucuuuaccgcagagccauaucaccaaccccuagucagugacaucuuaagaugugugaaguacucugauaucugccauaauaugugguuauuccuuuuaaauuagauuacuguauuuuaaagccacauuuaugaugaagcucuaaauaaaauuaagcuuccuuuuaucacuugcauauccuuucuauaaacucugaggucuguuuaaaaaauaacaagaaguuacuuuuuuuuuuuaaauuagguauuuuccucguuuacauuuucaaugcuaucccaaaggucccccauaccccccccccaauccccuacccacccacuuuuuggcccuggcguuccccuguacuggggcauauaaaguuugcaaguccaaugggccucucuuugcagugauggccgacuaggccauuuuuugauacauaugcagcuaaagacaagagcucccgaguacugguuaguucauauuguuguuccaccuauaggguugcaguucccuuuagcuccuuggguaaauucucuagcuccuccauugggggccgugugacccauccaauagcugacugugagcauccacuucuguguuugcuaggccccggcauagucucacaagagagagcuauaucuggguccuuucagcaaaaucuugcuaguguaugcaguggugucagcauuuggaagcugauuaugggauggcucccugcauauggcaaucacuagaugguccauccuuucaucacagcuccaaguuuugucucuguaacuccuuccauggguguuuuguucccauuucuaagaaaggguaaaguguccacacuuuggucuucguucuucuugaauuucaugcguuuggcaaguuguaucuuauaucuuggguauccuaaguuucugggcuaauauccacuuaucagugaguuacuugauaacuguuugagaauuuuaaugaguucagcuuuuugccuuuacuguucaucuucaguucauauugauaugauuucuuuguuugauauuuuacagauccuuuacuccugauuucugaucuugauuuuucuccuuauuuauuuacauuucaguuuggcaccacugguuucggauuguuaaucuugauuuuguugaccuuuccccaccccaccuccuaccccucuuuuucucccuuuccaacuacaugccagauugcuuagggauuuugagcuaauguagcaauugauguuagaacaagauuucaauccaagaacuuagacaaaccuuagccaguauuuuuauuuacaccacacacacacacacacacacacacacacacacacaccccaaaacaugacugauucaguauuuucccuuuuuaguuuaauaaaauuuguucuguugaaaugagaacuccugacagugugaggcucagccuggucauuuccauccggucugcuauuuauuagacccuguuaggaauugaggacagcccagagguagcuaaggacuucagaagacuugugugguguggaagcaaagcugugaaggcaguuucuagguguucugaaagagauuacuagugcuaugcauuugccaguuuuguagaauuguagacaaacuaccaagaggagucagaauugaggugggaauacagaacacaggauucucuaaugauuuuuaauguauguuauaguuguuugugacuuaguuuuaauaagaguaaacaugcaaauagaaauuuacauaaugaguuguaauuagucuuguuaaugaugcaagccaagugacucagcagauaucacuguuaugaaaaggauauaauuucuuacauuacuuuuuauuuauugcuuauauagccaagaauauacucaagacauuuuguuagaauccuagcugucaaauaaaauuucuguuuucauucuucaagugaugacucugcagguguuaaaauuuaauuuuuacuucuuauuuguccaucuaaaagacgagaagaaguccauggugaagcacagcgcguauuacgaugucuuccugguagaaauaaaaaggaaagugcuucuaagcagaugccaucuuuuccagaaaugguauauuacauucaagaaaagguagggauuguaacuauagguacuuaguuugaaacauuuaauaaauguuaaaaauaaaaaucaacauuuuaaaaguacagaugcaauaauuaguaaaguuccuagcaauuauaguauuuacacuaagaggaaaccacuaggcaaggagagaaauauaauuuuuacaugcaguuaauuugcuuuuccaaaguaugaaugacuuauaauuccuuuaaugauuguaaacauuuucaguauguucaaaaacauuuucuuugguaugacauaguuaaaaaaaaauuucuuuaaaaaaauuguuguucuuaaggguaccaggugucaucaauuuaaggaugcuuuagagagcaguugagauuuuccaugauaauuauuccauauucuguuguaaauucucacuuuguagcguguuucugcagcugaaucagagcaucgggagcagugauccucagugcugacugacugucccacuuuuuacauugguguucuuuugauuaugucagaggauaacuaucguuuuugugagaggugcaugcccuaggacaguguuuuguuuagaaaagacaagugcauggacuggaggcuuagcuaagguuauguguggcuuuuguaguauaucugaauuugauuuccaggaccugcguacaccuaccuugaguagucuugcguauaccuagucuugaguauauuuuugaguauauauugugacuauugcuccagaggauccaaugcaucuguccucuguggacaccugcacccagucacguguguucauauaauuuaaaaugauaaaauaaaucuucagggauggagagaaggcuuagcagucaagaguauuugcugucuugcagaggaucuggguuugguuuccugugucugcaugaugccucauaauuuguaacuccauguucaguggaucuaacacccuuuugucuccaagagaugugcaugcauauggcacacuuagauacauucaggcaaaacaugcauauaaauaaaacaagaauaauuuuucugaaaagaaaaacucuuuaaaaaggcaaauaaaaaguguugagagcuggcucagggguuaagagcacugggagcuuugccagaagaccugaguuugauucccagcaucuacguggaacacacauccuucuauaacuccaguugcagaggauaugaugcccucucuggccucaauaggcacuguuugaauaugaugcacacacacauucaggcaaacaccuauacauauauacauauauaucuacauacacaucuauaucuacauacacauacauauaaauuauauaugaaacaaaacaaaaaaucaaagauaaugcaaauggauaacagugauagagcuagcaguaaaguuauuuucaguugaguaagagaacaguugguuuucaaaaauuuauuuguuuuggaauuauuuuuauuaggcuucccaucgaaugaaaacuccagucaaauauaugaccggaaccacaguccuuccauuuaauccagcagcauuuggagagguaggacuucagcaucugcugugucugauccuuuugcuuuauagguaaacucauaucaugguuucauugugcuuuuaggguauuuauuuucaaaaaacaagacccaguauuugguaauuuguuuuguuuuaauuuauaguuaacuggcgguuuucuacccacacucagccccuguacugggaaucaaauguggggccuuagacaugccagggagguacucuacugcugagucacacucccagauuccgccccggcaagaguuuuguuuguuuuguuuuauuuuuuaugacagaacauuugguuacuguugggcuuuuguaguaaguuggauuuaacuucuaaagccaaccuacuauugaaguugcuagaguuuucaaggcuagaaaacaaaauaagauuuaucacacuuuuugagaggauuaacucagcacauccauuaaggugaauuuuauguuuuaaauuauuuaaacuguuaaauaauaaucuuguuuagagugagacaauggcuagggacagaauuccuugguagaauauaugcucagcaucugaaaggaaauggcuucaaucucagcaugaagaagaaacaaaacucaagcuuuuuacuucccuuaaaaacauaccuggaucugugaaauguuuuaauaccuuuuguuaaauuauaauaauuuacuuagcauauugaaccuugcuuccuggcuuccauuaagauuuuguaaaguuuugugaagaaggaugggaauguaaaaacugaaaauuaucacuuugaagaauaugccucaguucugauuuuuuuaagaaucugguacuuuggggcuggagaggaccuggauuuaauucccagcucccacauggcagcuuuuaacugucuguaacuccauuuucaagggaucugacauccucacaccaaugcaaauaaaauaaaauuuaaaaggaagcuguauuucucauccuuuuuguuguagauaguucuguacuugcgcaugugccuggcucauagugcaggggugguacccacuucccagaguuuggcugauaugcaagaucaugcuccggcuauuggacgguacauacgggcuuugaugucaagcagccaggcgacagcuucaucuucuaauaagaguggagaaaccaacccuguucagaucuacacuggccugcuucaacagcugcuagcggggguuggagguaagaagccaaucauacuaagaaagaauaucaaaacaaguaaacagaaaguuaauuuacccuuuucuucaguauuugcccaucuggcucaguggguagguuccaaacucauggucucagagaugauccugguuaaacucugggccucaaaauaaaagacauuaauuugggagagauacuuguagggaggagauggcuauacguguguaugugugcgauaauagggaugagagaaauaauagaggguugagggcuacacuagucagaauauacuauauagacaugaaauuaucaaagaaaauucaauaaaaaucuacaguagaaguauuccaaccuucuugacuucuguaacuaaacauugaccuuuguuuacauucgaagccuaccugauugaucuuugauaugcuuuucauuucagaaagaaaauguugguguagauacauacuuuguuuuugaaaaugcacgagaagacagggcauccuuuugauaauugaacuuuaaucuauauuuagaguguaaucuuuugauuuuucagaccagaauuuguagcauauuugagggaaauuuaggauuuucuuuuucaugaaaguuaaaaugguucugaauucuuauuuagguuugccagucauguacugucuauuggaagcugugucaguguauccagaaaaauuggcuaccaaauuuguagacaaaacagaauggaucaagguauguccucaugauaaguuuuuauuuuuuucucuauggacucagauauuuuaaacuaauugaaaggcuuugguuuuccuaccagucuuaugccuuucacuacuuuuagguuauuuuaaacuuuccuauaaccaaauacuuacugaaaagaauguaagcuaauauuuuauaauaauaggaacacauauuuugaaaacacacuuguauauuugucaauaaaacaccucuuuucuguaauuguguacugccuccuuaaaucuucucaguguucuacccuucucuugccucugacaaacaugcaaaguacauuaauaguuuuauggggggaacuuucuguuugcuuaugcauauauacauaaaacaaugcauuuuauuuuuauuuauuuauuuauuuuuuuaaacaaugcauuuuaaauguuuuucuuuuauacaaaagauagcguacugcuggcacaguuuuuuguuuguuuguuuguuuuucgagacaagguuucucuguauagcccuggcuguccuagaacucacuuuguagaccaggcuggcuucgaacucagaaauccgccugccucugccucccaagugcugggauuaaacgugugcgccaccacacccagcccccgcuggcacaguuuuguacuuauuuaauggauaguagagccuguagcuagucuuacagcuauggagaaaacuccuauuuauuuuaacagcuucaucauuuuccauuguaagguuaauucuggguugcuauugcugaucguuuaguauugcuauguaauucuauuuuucauacaaggaaaugucagguuuuuuucuuucuuuuuuuuuuuaaauuaaauuuauuuuuuacacuccagauuccauuuuccgcccccuccccauccaccuuccgacuguuccacauaccacaccuccuccccaccccaccccugucuccacguggaugcccccaccccccaccccaccugaccucuaaacucccuggggccuccagucucuugaggguuaggugcaucaucucugaaugaacacagacccagaaguccuccacuguauguguguugggggccucauaucagcugguguaugcugucuguuugguauuugagagaucucagggguccagauuaauugaggcugcugguccuccuacaggauugcccuucuccucagcuccuuucagccuucccuaauucaacaacaggggucagcugcuucuguccauugguugggcacaaauaucugcaucugacucucacugcuuguugggucuuuuggaaggcagguaugauaggucccuuuuuaugagcauuccauagccucaguaauagugucaggccuugggaacuucccuugagcuggauccugcuuugggccugucgcuggacuuucuuuuccucaggcuccucuccauuuccaccccuguaauucuuucagacagaaacaauuaugggucagagaugugacugugggauggcaaccucaucccucacuugauguccugucuuccugcuggaggugggcucuagaaguucccucccuacugucugggauuucaucuaagguccuuuccuuugauuccuaagaauaucuuaccuuccaggucucugguacauucuggaagguuccccccaaccucuuauuuccugagguugaccguuuccagucuuucugcuggcccucagggcuucaguccuuuucccucaccccgcggccccccccccccccccccccccccguguccacuuucccucccagguuccucccuccuucccguuccacuugugauugcuuucuucucucucccaagugggacagaggcaucaucacuugggcacuucagcuuguugaccuuuuugaguucuauggaguguaucuuggguauucuguacuuuuuguuuuguuuuguuuugcuaauagccacuuauuagugaguacacaccaugcauguccuuuuggaucugaguuaucucacucaggaugauauuuucuaguuccauccauuuaccugcaaaagucaagauguccuuguucuuaauagccgaguaguauuuuuuuuuuuauagcaaagaguuuuauuguauuucauggaagagauguaauagugagaaaguauacguuuaaguucccuagauguggaagauacagugucuauguuuacagugcccacccuucauguggguaguacuaaguuauauggccagcuaggugagaguuguucuuccaggguaacaccaaaaauguuaucagguuuagcaaauaaaaauguaaguuaaauuugaauuuuagauuagacuuuuuagugaaaauauggcucauacaguuguauacuuauugugcuuuguaauacaguuuuuuuuuuuuuggaaacuagccugaguuacaggaaaaucuauggaugugaaaauaggaauauauuuugucaagagauacuaguuuuguauuuuucuugaaaaaauuuggucuccuaaaagugcuucuuguuuuagaaggguuuucauucuuugugaauauuuuuuaauuuaagcuaaucuugugaauuuucaucucuugguagaagguaaaaguuuucuaugauaugaagagagaccagacuaugaguuugauucuagggcuuguuaugcugugaccuaugaacaaaaaauacuguuugacuccucauuuuauggucuacacgauaauaaugcuuuucacuuuguuaaaaaaauuuaugcugaauuuuggaaacaagacuuugcauauaguagauagguguuucccucugaucuacaacuauagccccucuauaauuuuuaaauaguugacaaaaagauaacagaagacauuauuuuaugacauagaucucaucuuauuggaacacagcuguguauuaucugugccugcuuuugugaacugcaguggcauaauggaguauucucaguagugacuagauaaaagguugcugaucucuauucaaaaucaauuauauuuauuuuaucuguuuuaaaguuuuauaucucuuuaugaaaaugcaacuaaacuaagauuuuuauauauaauuucagcucauaaaauuuaauuaauuuuuaauuaaaauuuaauuaucauucccccuuuuuuucuccuuguagcccuuuccauguuccuuucuaccuuucaaauugauagccucuuuuuuuaauuacuucauacauauauauguaugugcauguauauauguguacauacacauauauuuauauaauuugauguuuguuuuuuauguguaugugauuucagggcugaccacuuuguauuggauaggcagucagggcgcucaucccugggaguggguaauucuuccucagcaaucauugauugcuuguagguuuuugucuagggguaggaccugguaagauuucccucuuaguguguuagagucucuguugauagugucacuguuugugucuuguuuguucaaucauuugaagagaggcagucuugguauucuggcucuuucaacaccccuacucaucaacccuguuguuugcucuuaugugaguuaaagagacaggaacugugcugcagauguauccauccauucaugcugagcuccccuacaauccagugaugcuuuaugugcauuguguucagucaugguuuucuauaauggccuccauuuguuauagagagaagcuuuuuugaugagacaugauagcuguacuuaucucuggguauaaggacaagauuuagaguguaguuaggaauuauccugguguaagugguuauaguagauucucuuuuaaaaucuaugaccccacuaguccuagguaguugacuagguuucugguaccagggauaauuucccuccuguugaacgggucuugaguccaguuaggcagcucgugcuuggcauggguguggggagugcagcugcugcaccuuuaugcauaccuuguccugcuggucauuguugugauugacaggugucccagcugaguaggacuguucuuucuuucccuuuguagcuuucauaguacuucugguauuguggaggcuagacugcaggaagaaggauuucagguuagauccaguuccaauauauuaagcuuguucuuuuauaauaucauacacauacauaauacuuucugauauuucucucccuugcucucuuuuauuuccucccauccguauuaccaucccuuugccagccucuuuccccuauuuauuauuuuuguuuuuguuuuuuguaaacauuuaguuuaaccaaggccauauguauuguaacuguccauugaagccuugcagagucuuuuuuuuaaaaaaaauaauagcuuuucacauuauuuuuuauggauaucaauagauugaguguuagacuaucauuuacuuuuauuaagugucagauaucagcaggaagaugauuaugcaucauauaucuacuucuuuucucuauugcucagagucugaugaguagcaguaaagaagaaaugcgugaauuggcggcuuuguuuuauucugugguugugucuacaguguccggaauugaguuaaagucaaugauagaacagcugauaaaggccacaaaagacaaucauguauguuaucaguuuaucuuuacucuucuuuguuauuuaaauaacuuuggaauuaaaaaaaaaaacccgcaggaaccugucucugaagucugugcacuguuauaaucauaaaggugagguuuguuuuuccguuccuacagauuuaucacacuucagagcuaaguacaguuauggccagaacuuagguuugcuagaaaacaucaguuccuccuuugagccuguaagacagugaaaaaauauaugaaauuuuguuuuucuuucaguucugaaaauaggugaaucucauaggaccaucuuccugaauuagggaauuuacugcuaaggauggauuuaccugguuguuagaucuuuuugagccugcgucucaugguguagcugauucugcccccagacuugagaucuuucugccuuagcauguuccaucauagcuuggccccauucuuuuucaguaggugauaggguuuuacaaaguauuuguacuaguuuuuaguuuuccauuuguaaaguaaacuuauaaauucuuagccuuuauaaguaauacuugagauaaaugugcugacuuacucauuucauuuagcagauuuuaauacuuugucugaaaaguacuguuuuuaggugcuguacacauugugguagguaauuaguugggaaucccuaggacuuccugccauucaaaguaauuagcucucccugccccaucacugcuaccacuuaaucacaguaccuacaaaaaaagcaaacuuuauuaguauaaaguuuguauuugaagauuuuaacaacuagaaaaaggacuguucauuguauuuuguuggcaguauagagaagagaaauuauccuugaacgugaugauaguuagcuauauagugauaucaauaaaaagacagcauuaugggcugaagugaugcacaaugguuaaggauacuggcugcucuuugagagagccucgguucaauuucuagcacccucauggagauugaaaaccauauguaacuccauguaaccauauguaacuccauguaaccauauguaacuccauguaaccauauguaacuccauguccgggaggagaagacgacuucugguucuggaggcacugcaugaacaugauacaaaagcauacauucaggcaaacacucaugaacuaaaaauuaaauaaggaaguauaaggacuauagaagcuuauuuuaaaaaucccuguuccauagauggagguuaugugaauuaagguaucuaacucuggaugucaguaaagauucagcuuaauuucucagcauucuuaaguuagaaacucuuguuauaaauugccauugccuaauuuugauucauuggcuuccaguagaggccagaguaaucauuuucuuuuuuagccuuagguuuaucaggggcauuauccuaacaaguuauuucaguguaucuuuucaugugugaaaaagaaacagugcugucacauuguuaaauucagagcccugagguucaacauggaucguugcuugccuugggauucacuguuggaagauacuuggcuaagaagagagugaggauggccgagcagcaugaccuagagacagaugcugaccucuugccugagcaagaggagaucauucggagugcuacagaaacaauaggucagugugugaacuggcuugcuuggcugcuucaaacuuugaguuuuuaaaaaauuuuaauaugguauuuuuguuucuucuuguaggacuuuaaaggaacaagcuuuucuauaaaauaauuucuguuuuuuaguaaaaaugaaaaucuguguguguguguguuuaacauguuuuuauauuuuggugccacuuauggggaaagcacuaccauucaaggacacuaagcguuauugccaugguggcuuauuagugcauaaaugucaacaaguggucaaucagaaaacauuauagaccuugauuuucugaugcugccuuaaaaaaaauuaauacauggcuaauugauuuaaaucauaagaauaauuaguaugucacugucuuguauuuaaauauucuuacagguucauuuuuagacaguacaucaccucuguuagcaauugcugccuguacagccuugggugaaaucggcagaaaugguccucuuccgauccccagugaagggucuggauuuacuaaacugcaccucguagaaagcuuacucaauagaauuccgucuaguaaagaaacaaacaaggcaagccuuuuuauuucuuucucuucuagaauucuguguuuucuguucauaguuguauaaacuaacaaaaccaaguuaugaguauagucaucuuucuauauccauccaggcacacugcagcuagaguaagauguacuaauguguuaaaaaugauaaagaugaaacuuugauaaacuuugcauuugcuuuugaaucagggagauauguauaaacuauuuuauauguuaucuuuugaccuaguuauucuaacuccuuaacaguuaggcuuucaguaaaauuaaaaauucauugaagaaucauuuuggucauacaaaagcuggauaauaaaauaaucaguuucaugauuuguauaauuuuagggcaguucucaagcuuauuuuucuuacagccaguuucuuuugaagcagaaugaauaaucugagggaaagaacaguggcaguuucaguugagauaguuguuuucauagacuuuauggcauucuuuauaauuaaaguaccugauguugaagaggaagauaauuuaaugaguagaaaaguaccaguuuacuauaaguuaaagaauauuguaguuauauucuugguuuagcuguuacuuaaaaccaaaauaaucacaccacauaguuuucuuuuuacccagucaucaucagccauugaugagcacugcagugugcccaugggguaugcucuaaguuucucauguauuaaaaccaagacuuuaaaaagauagagugaaauaggcauaguuaucauuucucugugagauaacaccgaaagaguuucagagaguuuauauaacgugccuaaaggcuacuggguagaagugauaauuuguuccuggguccucugggcuugcaaaccacauuugcaaccuugacaguuuaaaugauaagccuaaggcuuucuuuuucguuuuaauuuuuguagguauggguacuuaaugggcucaauuuucuuuuguuuuuaaugucuuguagauauaaucuuguaaaauuggaugcuuuuguaacagcauaggcaucaguauaugaggcagauugucucuuccugucaucuugggaguacuguuuugaaauaaagcugcuauuuauuuaaaauuaaaaaaagauuuugugcucuuccagaugaaagaacgagcaauccaaacacugggcuauuuuccuguuggagaugggguuuuuccccaccagaaacuccuuuugcaaggucugauggauucuguggagguacuuauauuuuuaauuauucaaauaaaaugcauuuuuaguuguuuugcuuauuaucagauuuuagacguuuguuauugggagguuauuaacuuacuuucugugucuguguuaucacccgcaugcagugccaacagauaccaaaagugggcauuggauccccugaaacuguaauugcagauggucauuugcuaccauguuggugcuugucuuagucaggguuuuuauuccugcacuguagccacccguggccacacacgaaauggguuccugagugggaggcuggagcuguaugggaggaaccagagagagaagaaagagaucaagacagauuucugaucaaggcccaguguuuacuaagagucugugcuuauaaagggggaaugcccauccacugccacgccagguuucuugaugcuuuguuaccaaguuguuagcacuuagucugcuagagcuguuagcauuaggucgccaauuccacaggcggucagcuaucucaggaauaucucuggaagacagguucagccucauaucaguuuaauuguaaccucuuggaaaaaagcuuaauuucgcugcugccgccgcccccccuuccuccugcuccuccucuuccuugucuuccucuuccuccuccucuuccuucucuuucucuuccucuucugccuccucuuuuaaaauaaugccaauuccaguuguauuuaaguuaaugaaagcuccuuagauuuuauuuauuuauuuguuuguuuguuuauuuguuugaugcacauugguguuuugccuaccuguaugucugugugaggguaucaguuaguucuccuggagcuggaguuauaggcccuugugagcuggcauguggguucugggaauugaaccuuggcccucuggaagagcagccagugcuuuuaacugcuaaaccuucucuccugcccgcauuguuggauucuuaacaugauuuuaaugucauuguuuuauucacaugaauacaaaaguagaauaacaaagugaugacuuccccaugaacuugcuuuauuuaauuacuaauuuccuguuuccucagaacauaguaaacuuagguacuuuuaucauuccuaaauauaacuauaaaguuuugauuuuauauaugugugugugucuauacaaauuaugguaucaaaaauaggaagcguguaauuaacagguagguaaacaaaucaauuauuaaauuccugaugaagauucuuaaaauauuuuuccuagcucuuaagguccccagagaagcuuuugagcagagaugaugagaucuaagaccuucagcccuauuuuucuagauuaagaagcaguagauggaugcuccaugaagauugacacccuaaauuaagaauugcaguggccuaaccuucuguucuguguagucaucguggucaugucccacaugcgcguuccauucuuuaucgcauccuuguuuuucuuauguuaaaauguuugacaguaaacagaaaaaugccagaggguaccaaggcagauccacuuccguguugauacaaugauugcuguuuguaaaacaucaucagaauuucuaaaugaaaauguaaauauuugaguauguaacuguacagaauucuuaauauuuggccuuugaaauaaugucaaauuuacagugacauuuuaagaauaaugcagagaacuucuguauauacccuuugauguagauuuaccaaguuuuagcauuuuauauuuguuuuaucauucucuaccuuuuuuucaggaccuuuuggaagagcaugaagaguuuuuauaaaaauauaguggccacuauucagugugaaauuauuacagugaaaguguuaucuaaguuaacaucauuugcuccuuacgggccgaugagggacugaugguauugugcucauuugaggcccagagcaguuuaggucagacaugugagagacugagcuuuauaauguucauugaugccucugaggcuuuaccuuugaauuuucccaaccccuuacauagaccuauuaugguucccaaaauuaaaaaccaccacauagcgauugugugcugagggggagaagccauuuccugaaggugagaaaucugcaacucuuccuuaguucuccauuccuuuauuucacccuccuuugcauuacugaguuagcuucaguguggccaaaaaauaaaaaauaaaaaauaaaauaaaauaaagccugcugagaggucaagcagcucuuuuauagaaauggauauuucucuuucuuucauuguaggccaagcagauugagcuucaguucacuauuggugaagccauuaccagugcugcaauaggaacuaacucuguggcugcccgagaugccuggcuggugacugaagaagaauauauaccuccugcugguaucuaauacuuaccuaauugauuuacauuugcugagugguuuucuucucuguuaguugcaaaaguaauguuuuccccaaaaauugauaccugccuuacuaauuuggucugccaagaaggauuaaagaagauugaacauagcugggcaugguggugcaugccuuuaauccuagcauucaggaggcagaggcaggaggaucuuugugaauacaaauccugccuagucaauguugcaaguuccagccagagcuauguaaugagauccuguuggggggcaggagggggagggagaaaagaaaaaaaaaaaaaaggaaagauugaacaugaaaaugagaacuuucucagccucuugugucuaauuccuuacuacauaaugagccuucuuuguccucugcuaguccuggaaguacaacagaauuuaguuacugugucauuugagagaccauacauguaugugguucuugagcauaugguaacagauccaaagauuucaaacuaagaugauguaugcuuguaauuccugcacuuggaaagcuaaggcaggggauugcaaguuggagaacaugugggauauauaaugauaucagagccagucugggcuacacagugagacuuuaucucaaaaacaaagcaaaacaaaacaaaaaucaacaacaacaaaagaaaaauaauacaaggucuagugagaacaaucagcaaguucugccaagcuugauggccugcguucuaucucuggaccccauggugcaggagcagcuuuugcaaagcugaccucugaccucugaccuccacaugcaugcugugucaugggcucucauguaugugcacguauguguacauguacacaaaaaaugugaagaaaccuaauguuaacaauuaaagaaaaaacaauagugcaaaacaaaaaaauccaaaacacagacacaaauauuuuuuucaguugauuuaaauuuagaauugaaauauauuuuaguaucaaaccaggauuuuuguuuuuacucuuuaaagcuaaaagaaaaaucagaaaguauuuguauuuuaucuucuuagcugggaaaauugaauaagaauauuuucaugguaacaguacuauugugaauuguauccauagugaaaaauaguugcuguacuuaguauuauaguuaacauuuaacacuguaguaauaucuucaucuacuauuuugucaucuaucauagagagaccuuaaaagaaauagggaaaaaguuuuucuaguaguauauguagggugacuguacuaugauugguggaagccaaacuaguucucugaggcuucuguuugaauacauauacgguaaagcaagucagcauuuuguugggauugcgaaacugcguaguaauggggaaagagacaaauauguuauagcuggaggaagaaaugaaauccaaaguuauugaucagcuuuuagauggaaguuuaguuuagaaagauucaauaaaaaaaugcugagauugaagagacuaggauacauuuuuuuauccaauaaacuagagucauuugaauaauuuaaaagauuauuuagcuuacauuagcuucuggacuuucuuggucacuuggauuuuaacauuggguuauugugugauuguugauguaaauaugauuuuuaaagaaaauuauauuugaauauuuuaauuguaaucuuucuuugcuuauuccucaggugccaaagugaaugauguugucccauggguuuuagauguuauuuuaaauaaacauaucaucagccccaacccacaugucaggcaagcagccugcaucuggcuucuuucucuugugagaaaacuaaguacccacagagaagugaaggugaguuuauaauacucauuggauaugugaugaacucaggaaggaucccaaaguguuuaugaauuaaaaguaggaagaaaguauaugaaguauggaaucauuaaaaaguagcagaaauuuugaaauaauuaccaugugaggcacugaaggaugaugauuugauuaauacuggcaagaaaaugaucuaaaugugaagauguaaaaucagaagggauaagauugggcaggcucauucugggacaguggucagucugaacgcuuagacaaccuguguaugguacaaguuacggugauauggacgccuguaacguucacugcauggaaaggucaagacugccuugguccuaagacucucuggccuccauguaccuuaccagcaagaugcauguuuuccugaagaggagguagaacuucagugcucuaaugccuuuacuuuucuuucagucccaucuuaaagaaauucagagcgcauuuguuucaguucugucagaaaaugaugguaaguuguugguaaauauuugauuugucaccuucaguguacuuguauuuuaaacuuuaaaagcgugagugagugaauuagagcacaaaaacuuuugagccaugucacuacaacagaacuagccacaagccuuuaaccccagccagcgcgugggagguaaagggcaggaggaccaugagcuccagaccauccugaguuagagauaguaaggcucucugcaauagaauuagaaauuaauuuuuuuaguauuaaagguaauuguauuaaggcaaaagccaauauuaacuaccacaguaccaucuuuccacuaaaguucuaaaguagaggaaauagauauucuuucuuauacauaaauuagaacuuuacauuuuuuaauggagcuuaggccuuaacauuaguguuaaaguuuuccugcuuugaauuacuuuuuccucuuuauuaaagccaggagaaguugaauauguuagaaauuuaaauaauagcuuuaaaacaucuuauucagaacacauggacuaguauugccucuauuuuucuaaaauuggauaugggugucuuaaaguccuaggagaguauuuuaucucuaauauaaacaauauauguugauacucugauacugugguuuuuauagugacacuguaguucauugguauuuuauuaguuuauggucaugauucucaucuuuauuaauugaggauuucuuguccauugacuugauuuaguuaauugagagugcuucuacuuuuuauaucuuuacuuuuguagcauuuuagaguaaagagaauuacuugaaagaaaauaauuggcuacaagacaaauuucuuuuagaauagcauaauuuugucuaccuuuuuuguagaacucagccaagauguugccucaaaggggcuuggguugguuuaugagcugggcaaugaacaagaucaacaagaauuggugucuacacuuguagaaacacuuaugacuggcaaaagguauagugaauuuaacauuucagcuaugaauacuuaagacauugggaauauuauguggaagaaggauaauuccaccuucuacuuauuaaggcauuacauaucaaugauuguaaacaguuuaauuaucccaguguauacuguuuacuucagaaaauuucauacuugaauguccuaugacaguuaaagcauuggauuagaaaacauuuuaauaccuuuggcuaaaaaaaguuaaggugugguaugaagaaacuugaauguuauucauagucuaauguugaugaguacacggaaggagauugguuuuguaauugcuugcugcuuucuguuaguuaccuccaugagggaaggguaguuuuuaugugugacacauuggcuguaauuaaucugagaaauuuuuugcuuauauuugauuuuagaaaauuugcagucuaguaggaaagaauaguuuuauaucuuuuauacccuagacacagguuuuuaucaguuugcaaauggauuguauccaauuguuuauuguugguauggaaaaauugaagcuaauuuaaauucuuucugauuuguuuuagagucaaacaugaaguuucuggagagacagugguauuucaaggggguggccuuggcaaaacaccugauggguaagugugcuaaaucuaaacacauugaucaacuaagggagaauaggaauauuguuuguugauggauaaauaaaaaugacauggaaaaaaacccuacugucuuagauuagguuuucuuggccucugagauagagauuuguauguuggaagauuauuggagaauacccuuaggauugucuuugggagcagugagcaguguuggccugaagccauaccucacuggacacuggauuccugaggagcuucaggcuaggauggcguggcccuucaggggugucgagccacagagccugggccucuugccauacuucuuaggccuuuaugccuggccagugaguaaucauuuguggcaggcugcuuugugggaggccaugaccucaaagaccaaaguuaguucucggacugauacuaggucuagaacugucugcuucuaggaagcugaguccugaauagacaucuugcaacauagagcuacguuaaauucaucuaaauuuuuucugggaauacuuucuguguuugacuagucugccuguuuaguauuuuaaauuaauuuugauguugucccucuuuaauuauuauuucaguguaguuauauugucauuuuuuuccucuuaagaauugccagauaacaugccacuugcucugucuuccugugacauuuggaacaagagaauauuaauauuguaggugguuuaucuguccugugcuauccuauaucuuacuguuuucauauucaaaguucuuuuuauaugcuuguuuuucuaaauucuucugagcucuuuguuuucuucuuucuccucuuuuuuuggguggacaaggucucauuaucuuuguuguuuuuaaacuaguuggcucaguugaauucuuugguacaacuacagagguacaaaccacuguacuuggcuucuuuacgaauuaaaaaaaggugcuaauuuuucacaaugcuauauuauaccuagaggaaauuuagcauagagauacuuucaaaucacucaucguuaugagagauugcauacaacaugaugaacuugcaaggugucuccagagccaccaagagcuucacuuccauggaacaugcaggcacauuuuagguaucauguuuguuacuaucaaauaacugauaaaaagcaauggagaguccaucugguuuacaguuggaggcuguaaggucugucacaaaagggaaggaauggcaguagauggcugcauggcugcaggggacucugccuccuaaccuccuuccuccauacaccaaagauccaccucuuguagauccugccgccuuccaaaacagugccaugaacugggagccauaggcucaaacacuugaccuuaugggagguauuucacaauuaauuugcaacagguauuuacuggcagaaagauuuagaaauuauugauaauugagguauaugacuuuuuauauacuucucaaacuaguuuucagucuccucagugaugauugugguauuaguaacugagggaaauagaauuuaaaagagcccuguaauauugaugcugaaauuuaugucaagccaaagauagcuauaaaaauauuuuauuguguuuuucuuuuuguuucuaagucagggccuuucuacuuacaaggagcuuugcucucuggcaagugaucucagucagccagaucugguauauaaauuuaugaaucuggcaaaucaucaugcaauguggaacuccaggaagguaaguuguuauuuuauuucauuucuucaauuuuugcuggagaacaaacucggcaucauguauauaugacaagugcucuacuacugaauuacauaccccuaucucuuacugagguuuuauucuuuuacuccaaaaccagacuuguuacauuagccuuguagugccaguucauguauaguuaauuuugaaaaucugcaucugagagccagauuaccacauuagucauuauuugguaaagcuggaauacuaaguaagguucuauuuagggguaaauuugagaaagaguauuugaagccuuuuuguauuugcuauguuaacauuuuauuaugacagccauguauaaguuagucuuuauuguuuucagggugcugcuuuugguuuuaauguaauugcuaccagagcuggagaacaacuggcuccuuuucugccucaacuaguuccucgccuuuaucgauaccaguuugaucccaaccuuggaauucgacaagcuaugacaagcauuuggaaugcauuggucacugacaagucaauggcaaguaucugugagccuauguguuaggaaaacucuguagcuugccuguggcaccacacaggauuuaaaccaaacacccguugccccuuguauauuuguuuccuuucauugcucguuugcuuuuucuuucagugauucuguaauauuuacugagaucucaaaaaugaaggcaaucauaauguucacugguuggauagauagauaaaagaacaauagucuaaccucuggauaugaucucuacaguuuucccuccucuuuguugggcauuucagcuaaucucaucucuguuggguccugggagccucuuauuuuccuggcaucuggggcuuucugguggcuaccacagugggaagagaagcccuugguccugugaaggcucgaugucucaguguagggggaugccagggucaccacccugggugggugggugagcacccucauagaaucaggggcagagggaggagagaggggguuuguggaggggaaacugggaaagggaauaacaguugaaauguaaauaaauaaaauacccaauuaaaaaaacaauaguguauuacaaauggaguacuauauguuuacagggaucacugaugccauggagagugggucacaaacaugcguaaagaguuauuuuaguugggaagacaaagaaauaguuaauugccuacacuguuuuccucgguucuguaaucugacuguugguugcauucaauccuccuuucagauaugaagguuucucaggaacuuucucugaauacuguuguccucuuagcuuucuuuuacuaacuccuggacacauaaaucuuccauuuacuguaaugguauuacucaguucuucccuggcucagacaggaccucuacuccaucccuauuuacagaguuaacuuccugcaucaugccuucacuggacuguuacucacauguaccauaaauguaacauguccaguaaaaagcugaaaagacaccuuuccuuuguucucacuguucauguuauuuguccaagccagaaaacuuguuaucuuccuuuuuugucucugucuuauaaugcccccaaucucacaucaaauuuagccacaguuucuguugauucugcuuuucucaugugucccuugaaccugcuccugucccugauucuucccgaugaauagaucaccaucauccuuuccuucucugugccgcauguuuaauuaucuauauagcagcaaaaguaguuuuaauaguauaaauuggauuuugguuaaaauucuuaaauggauuuuuuuuuuuuaguucacauuucccacccccuacccccaauauuggaauuugaucccagguucuuaaauguccuaggcaaguguucuaccacugauaauauuucccuuuaaaaaaaaaaaaaacaacuuauuuugauacaagaucuugaucuguuucaggcugggcccgaaccuuuguguuugccucagccacucgaauagcuuagguuauaggggugcacagcuacuuuuagcuugcagucuacucuuccaaauuaaucugccauuaauuuguuaucaccaaagcuuagaucaaacucacuuuccuucugaaccauuauauauuacuuuuguaccagagugcagaccacugagauaccaucuugccauugaaguccaguguaguagagcagugcaguaaugaguugucagacaugauuuaccuuaagaggaugguuggggacauggaagacaguagccaaaauucucugaguggugcucacuccgaauugucauggacaaaagguuggacugcagagguauuguauguaugccaaggaacagaacugagacuaaugagaagccagaguggcaagaugagucacagugggcuuuguguuguauaaagcccaccugauuagacuuuauuuccauacacuauggaaaagaaucaucaaguuacuacaaaauggugagagauuugcagacugagagacucagggucacuuuaauaaugaagugaucaguguuguuggaagguaaauacuggauuguuggauuuuacaguuuguauuuaauccuuuugcuuucauuagguggauaaauauuugaaggaaauucuucaagauuugauuaaaaaccuuaccagcaacauguggagaguucgagaauccagguaucacuuggaaacugauuagcuggaaaauuucccuucaaauuucuaagaauuuuuuuuuuauauaguguaauaaaaaauuaaguuaaaaccaucauauuuuaguugaguucuucaacuauuuaacucuacuugauuuucuuaaauuaguuuauauaaacauuauauuaaaaauuugugaucauuuguuaaauugguagacaucaaguuguauaauucauggcuuuauauuguaggguguacuuauauauucaguuuguacacauucagugcuuguuauguacucagugauaagccagacauugagagcacauaguugaguuaaaagugauguauugguguaucauuuaaagggacugaauuauaguuguaggaauugucguuagugauuuguaucauaugugauagauauauuugagguaauacuagaauaaucaugauugucuuagggugagagguuaggacuagaaauauagguaggagucuauuauuguuuaguaugacuguuugguaguaaaauacuggacuugcuugaucauauauuugaaaucaaguuuuuauuuucagcuguuuagcucugaaugauuuauugagaggaagaccuuuagaugacgucauugacaaacuuccagaaaugugggaaacacuuuuuagaguacaagaugauauuaagguauuauagaaguaaaucuacauuuauacauguucguuuauauauauguguguguguguguguguguguauauauauuuauauauuuuuuuuuuuuuacuaacugaaaucauuaaaauauacuauagcuuuuuucaauguauguguuucaaaauucucuagcuagacaauuuuaggaaacugcuuuguuucuaaauuucagcuuugauguaauuuuuuauguaaaauuaaaaguuugguuaucuuuauuuaggacucaacugaacagacuuaaagugguggcuacagccugccuuuuucaauagaaauuucaugaugcuguagaaacaauuaggagcaaauccccguuuugaaguaauucauaaugacuaaaguuuuaaauuuuaggcauucauuuccaaauacugugauuaaugcaaaaauauaucaguuuuucuagguuauuuuacuuauuucauaucacuauaaaagugcuuaggguaauuauuuggaaagggaaaugguuugucuuagcuauuuuggagguuguuauuuuaccuagagggacucuguuguugggucuaugaugacugaggcagucugucagggccaacgucugaaguggaagaaaacauuuacucaggauaaagagcagagagaaggaggaagacucugaggccucauaauccccuucagaggcuugcucucagugaucuagacuuucuucccuauugcuaagauucuaguaacgccuuucacgggauccagccuuuagcauguaaaccuuuugaggacagucaagauccaacugaaguuaaaucuguacuaaaggauauaaagcuggacuaucagaauuugaaacuauuuugacauucuuaaaauuagacuacuaggcuuguuuuucuuguugcuuucuuuauucauuaggaaguuuuaauucuuugagacucuucacagagauuuuuuauguauuuacuuuuagaacauaucuuauuuuugacuguuacaguuaauagcuauauuuuuacaugguuaaaauagaucagauacacaugucuuucaaugggcaaagaggcuaacagaacaacauauauuuaaaccuguuacugaaaguuauguuuugcuauuuuauauuaggaucuaauuagagaguggauaagaaugaguguugucuaauauguauaaugguaggcuuuucgcauguuuuaggagucuguacggaaggcagcagaacuggcucugaaaacucugagcaaggugagaacacuaaucucacagugagaugcaguaggguagggucaccaugaacuugacagugcuuuuuuaguuuuuauguuuuugucauaugaaguaguguugcguuguaauuggcuucuuguguaguuuacuguucuuaacagugaauaagaaagcgggucuccuuauacuguguuuaguguauauguguaguguaucuugaaccccuuuugcuuuugguuccuuaaauggugagcaucuguaggaugccauaugagguguacuuuugcuuugacccugaagaacacaugacucacuuaaaugaagcaauauaugucuugcuuuuaauaucuuuuccaaauugagaaguuggcaagcuuuuugaaacuauagucugccccuuagacuuaauuuuguaauuuacacucuaaugcuuaagcuuugucaucgaucacauuacagagcaguaaaaguauauuuuaaauccuggugccuuucaugccuagguuuguguucuuuaucagaauauuuuccugcaaucuguagugaugaaaugguuauauacacagaacauuuuuaaaaagugcuuucuuaaauauuuuucaccauauuuuuagcuccuuuguuucucacucuacaaauuagaaagucaaaaauuaaagaauagaauuaucaucagguucuuuguuuagauacagcaguccucuuggacucaauacuggucauuccucuaucucccuacaaccgccauaguggcauagaaaguaaacuuauuuuucauugcugauagugacauuaaaaaaaaaacaaaaacacuuugucagagaaaugcuuuaauaguugugaggccagcuucacuaaugucccugcucuuuguaugugagguuugugugaaaaugugugacccugccaaaggagcagcuggccagagaaccauugcuguccuccugcccugccuucuggacaaaggaaugaugaguccugugacggaaguccgagcccucaggugugguuugguugaagugaauguacuggaauuacuuaguuucuagccaguuuguagaaaauguguucucuugaauguuagauuccuaaacauaagaaaaaugggcugaggagaauccguugagguaacuuaagcauuuaugaaaagaugugggcuaaaguauuuuauagucauauuucauggggaccuuaguuugacgaauauucugaguugcauauuauucuauuggcaucggccccuuuccuuagcaagugcacaucuuccuguuaugccucaugucuucagggccuugcuuguugaguauaaccaacuguccuuggaaaacuaguauauauggugacuauuaauggcuucuaaaucuacuagcuaaaaggcaaauguggaaauuaaugaugguucaggcuuuccaaaccugaacucuauacuauacuauacucuaauaggauaaaaggacacaacaggaugugcauucugauguggugggauaggauauauucagcauugcuuaugaaagagccuugcaugguuucagaggcaaagucuacccauauuugcuauauaguagcucagccuggccucaaacuagugauccucuggccucauacaucagaauguuggcauuacuggcagaagccauauuuuuaaaauaauugaaccuuuacuugguuuaguguguguauguauguguguguguauauauauguauacauguauauauauauauguauguauguguauauauacauauauauauacauauauacauauauauauauauauauauaugauaugcuaaauaacacagcugaaauaggaucaguacaguuaaaugagaaaacaagagaaagacugggacugaaaguuucaagaaucaagcugggugugauggcacaugccuuuaaaucuacuaacucauauauagaggccaucagauaucugugaguucaaaaccagccuggucuaaauagcagguucuaguuuagccaguucuguauagagugaaaccuugucugagaaagacaaagaaagggagaaaggaaggaaggaaggaaggaaggaaggaaggaaggaaggaaggaaggaaggaacagggggagggaggaaagaagggggaagaaagaaagaaaaaaaagaaaagaaaggaaaaagauaguuagauugaagaugguaguggauagacuuugagcucugaauuuggauucuagcaaacuaucauuuuuuuuucaccccucuauguguauguaugcuugcuuaaaaauaucuguaauugccggaugauggcaguacaugccuuuaaucccagugcuugaaaggcagaaacagucagaucucuauuaguuugaagccagucuggucuacagagcaagcuucaggacagguuauucagagaaacugucucaagcaaaacauugcaagacaaaucuguaauuuuuuaagugccaagagaugagaaacccuacuuuccaguugccaaguuaggcuuugagccaugaguauauaccugaauacaagugcaaaccauccucgugauuagauuguaggccuucucauuuguggugaagggaaugagaugguguuuucugugugucuagcauuaacacucuugugaagaucagcaaaagugcaggagccauguugaaaccacacgcacccaaacucauaccagcacucuuagaguccuuaaguguguuggagccucaaguucucaauuauuugagucuccgggcuacagaacaagaaaagguaaguugauagcagaaguauauugguaaguacugcugagguaugaucacuaaccaucuacaaaaugccuaaguaaaaauuuacauguagacuuugaucugaaguugcucuguugucuuugaucaguuauuaccgggaaggauagaaaggaauccccuagaggccuccucaaugaacgguuuccuaggggcuuuuaaaauucuuucauauuuauaagucacaaaccccccaaauagccaauuuaaaaacaaaaucaccacuugagaaucuuuucaaaaucuauugguugcuguuuuauccuaguaaccuuuuccuuaaagaagcuuuccaguuucaagugguccuauuuaucaauuguugaccucagacccugagccauugguguucuguucaagaaauuuuccccuuugccaauguguucaaggcuauuucccacuuucucuuuuauuagauucaguguauuugcuuuuguguugaaguccuuguucuacuugcacucgagcuuuguuaauaaauauggaucaauuugcauucuucuacaugaagacugccaguuagaccagcaccauuuguugaagaugcuuuuuuuucuccacuggaugguuuuggcuucuuugucaaagaucaaguguccauaggugugagagcuguaguguuauauuuugaauguuuuuuuuuuuuuuacauacauuguacauuaucucuuuauacucuccuaguuccagucugcucaucuccucccaccugcccaaacugagaccuuuugcuuggaacuguauccacugagcuaaaucccuaacuuuuggaucuaaagagauauccuagcaguuaccuacucuuacagaggacuggaguucaauucuuuuuuuuuuuuuuaagacuuauuuauuuauuauaugugaguacacuguagcugucuucagauacaccagaagagggcaucggaucucauuauggaugguugugagccaccaugugguugcugggauuugaacucgggaccuuccgaagagcagucggugcucuuaaccacugagccaucucuccagucccuggaguucgauucuuagcacccacauuugauacuuuucuguaacuuugccuuuugugaacaugcacagucauuugcacaugccuauccuuauacuuuauaacucuuguuaaccauuuauauauuucucugaauuucguuucuauuuuauaccuaguuuuuaauauuuaugcuuguuuagugggaugauuaggccuauauaauauguaauguggguguguucucucaguucacuguuugauuguuaauuuuuauaaucuacucuuauaaauuacccuuuucauuugccuuuuaauacuguuguuucuucuuuacugggcauucuuuccuguuucacuagacuugccaccugcuauaaaauguuuacuaguauuaaaaauuaggggacauaaauucuauccaucuuuuugugaaccucagcaaauuacguuuuugugccuuacucucuggauaguaauaaccuuuccccuaguguaauuuugaucaaacuaucauuguaaauaugaauccacauaauaaaguuaaaggauuaaguggauuauacaaacacccaauuuuguuuuguuuuuuuguuuuuuuugacaauguuuuaaacauuauguagaaacgcaauauauucucuuuuuaaguggauagagaaccuggaacuaaagaaugcugaauagcuugcuuagagccauaguaucuuuauuaauaaauacauuguuacuuaauuucuuguaacagaagggauugaucccagggccuuguucaugcuaaacuacuagugaggugcaccaccagcccucauauuuuguuuauuuuuaacucuugucuaaauuucugauuuuuagagauaugcuaacuuuacaguuaaauuguuaaggaaggucagcggaaauuagaauuugacuuccaucugauuuacauauugauuguuuacuuaaaagccuuuaguuuggaaauaaaacccuuuaauuaguguuucuauggcuaauucauaauuaguugaauauucugaguaucuugagcuucugcuuuucaggauguaauggacagugcucgacucagugcugccaaauccucucccaugauggagacaaucaacauggugaguuuccaaacacaacugaaauacaaccccuuugcaucucuuugaguacaguucuccagaagagcucaugcuguguaacaugagacaaaccuaaggggcuauguugauaaaauacugugacuacaguuguuucuuucaaaauucuuaaguuuuuaacuggcauauacaaauuuugcauauuuauagacauuuuucuuaaccaguaauaaaaguaaauuuucugaauagcagaauuugucaaauuuuguguuagauuaaaaacaacauauuaguagaucuauguauaacucguaucuauuaauuuuggucuuauuuuagguucaguaauguuauuuuauuauuauuuuuauuauuaucaucaucuuccgccuaucucugcuugagaaauuucuuuguuaaagauuaugaaggugugagaucagagagauuuuaaugaaguagcacagaaggugggcagcaggaauugagccauagugauguauaucuuucagaugcuggaaacguagugaagaguucguggcacuuugaggcucugggagucuuugcagagucaccuucugggcauuuccuguagugauuauuaagagcuugcaagcuaccagaaacuguuugcuaagcagaucacaaaugggacaaaagucagguuuuaguguccaauggggacugcuaagagucguauguuuuaguuuuacuauuggggcaaaugagagaaguauuuagcaagcaucauuuggaaauauucauaaauaaugaagugugugcccguauuuuaaaaaaauauaacaggcugugguaaaaucaucuaagaaacugacuuauuuggggucuaguaggcucgacuuagucuggaaggucaguuuuaaucuagguaauuugcauuugccauagauugauagagggggauugaaagagagguaaccauuuauuuccucuuaguaaauuaaugcuuuucauuauuuuguuuuucuauuuuuaauguugaaccaucagugagugaauuuucuguuuguaguacuguaguaguuuaauuuuuccagagcaaaaucaaaccagugauuuucaacuuucuauuaaaacuaguagguucauauuuugauauagguaguuuuuaaauaaagauaugguacugacuuacuuguuuaggcuuacuuuuauauuuauucuuuucucaaagugccugcaauaucuugauguuucggugcuaggugaacuaguuccuaggcuaugugagcugaucagaagugguguaggucuugggacuaagguaagauuuguguguguguguguggggggguauauugguguuuaugcacaugcauguggaggacaagaguaucuuuauuuuaguuuuaccuuuuggguaucucccacuauugcuuuccacauuaucuuuugagaaagauucuauugcugaacaaggugcucacugauugccuaggcuggcugccagcaagcucagugaaucuagcucuuccugcccccacaguucuuaagacuacagauauaugaacccagauuuguauguggaugcuaaugugauccuggguccucaugcuugcacaguagauacuucaccuacugagccaucuuccuaguccauagaaguguacuuuuauaagagcaaauauguguuugugauaaguuuuuuaaacaacaaaaaaugaccaccauguuuaacacuuaauguuucuggccgggcagugguggcgcacgccuuuaaucccagcacucaggaggcagagacaggcagauuucugaguuugaggccagccuggucuacagagugaguuccaggacagccagggcuacacagaaaaacccugucucgaaaacaaaaacaacaacaaaaaguuaauguuucuguuaaaccauagugcauguuaaauauuuuguuucuaugguuacaugaguagccuaaacuguguaacugauuuuaaaguauguauguauuuauuuuagauaaggucucuuauagcuuagacuagucucaaacuuccuauacugggaggaugacuuggaacuuuugauaguucugccuguauuuccuggugcagggauuacaaguaucuuguuguguacugucaugcuuacauguuaucaugcucugcuugucuugcuguuuuuaguacaaucuuuuaugguuaccaugagagugcucuuaaauuuucugauacuaccgguuaauggacaagcucacuuaucuguuaaagcaguaaucauuuuagacaguauuagaaguuuucauguaagguuuaauagauguuuggauagaaaaauaccauuuguuuguuugagaaucuuaaaaaggucagauacucccuucaucugcuuauuuuuuuccuacuguuaaauuuuaguuguuguuuuagcccaaaucucaugguguccccuuuucucuuucgguguuuuucuuuuuucuauauucaaucccagaggggcuauuagauuucauauguuuuaucuuuaaauuauuaaugccuaaaaguaguaguuugguagugcauagagacaucaaauuuagaccuuuguuuuugugaccuuaaaggggggcugugccagugucaucgugucuuuaacuacucaguguccccaggaccugacaccuuacucaggugaguuugauauguguaggagcacuguuucaugauugguuauuucagaggguuuuuuuuugguuuuuuuuuuuuuuuuaaaucuuguuuuuguuuuuuugagauggguuucucuguggcucuggcugcccuggaacucucucuguagaccaggcuggccuugaucucagagaucuuucugccucugcuuucugaaugcugguauuaaaggcgugcaccacugcugccuggcucuuucagaguuuuaaaaagaaaauuacugggugauguuggcuugcuuugccucuacugaaaucucugacccaaucauucuguaagcagacuuuuauugugucaucagcuaaguuugucagugcauaaagauguaaaaguaccuuucauucugcagaacuuuguaacuguucauagcuaauuuugcaugagugcuuuucuaaaaauuccccuucuagauaggcuucuaggugggauuuuguaucuaccucucauuuuuguaccuuuuucacaauauucuggacagaaguuaaauuuuaauuuuugauuuaaaugaaauaaagaaaggagguagcacaaauaauauuuaaaagaccuaaccuacuaugcaguaaaccugauuaauuucaggguuaugggguuuuaguccuaggaauauaacauaauaucuggccaaccacacaauugacugaauuuauuauuucuguagguaaacuuaugagugcuuugcuuaguggucugacagaucggaacaguguaauucagaaauccugugcauuugccaugggccauuuaguucgggugaguuaacuuucuuauucaguuaagcacaacucugguaauuauacagaaaugaguaagaaugcuugcuuuucagacuucacgggauagcagcacugagaaacugcuacagaagcucaauggcugguacauggagaaagaugguaccuuuuuuuuuuuuaaucauucuaaauuuagacauuaacuaaauaagcuguauauuguuuugguggaaacauuuuaaauuguuuuauuuagaucauuuauccugaaaaauaguuaaaugcuaacaaaauuuugguuucuuuagaaccugucuauaagacgucuugugcuuugacaauucaugcaauuggaagauacagcccagauguauugaagaaccaugcuaaagaaguucugcccuuagcauuucuaggcaugcaugaaauugcugaugaggagaaaucugaaaaagaagaguguaauauguggacugaaguguggcaggaaaauguaccugguuaguaaaugguggaugcagaguaaacguguuuccugagaaacacagcuggaauguugacucguguugucugcucauaacgcucccaagaacuugagcaagcuaugucacauuuugagugacauccuaauuucuaaguuugcaaagugccacgcagagcucuugucuuugacuuguuacuuacugugugagggaguauaaacugucuaagcaaaggagaccuuuauguguagguuagcugaguguaauugugacuuuauguuggcuuaggguaccuuuauagagcuguguuuuuaaccuugauacacauuaugaugaugaccuuuuaaaauaacauuccuggcaguauguccaaguucauacauuccuacuguuacaaaaagaagccauacuacccacugucucucccauuagcaggugguauguuucucaguugacagucagugcuuuaaugaguaacacugacuuacucacauuuaaaaauuaucuuuucaauuuuuuuuucacuuaagagguguuauauaacuuuuuuucuucuaaauguaggcuccuuuggagguauucgauuguaccugcaggaauugauuacuauuacccagaaggcuuuacaaucacaaucuuggaaaaugaaagcccagggugcaauugcuauggcaucaauuucaaaacaaacaagcucucuuguaccuccuuaccuggggaugauccugagugcauugaugcaaggccuggcuggaagaacaugggcaggaaagguaaaggaacucaugccgaagagcugggccuggagcuucuuguagacuaggaaucggauuuuacgugacuuggauuauuuuugcagcuagguuuucuagcuaguggaggacuuugcuugauuaucuaugauauuuuauaucaaagagugucccauauguucuuuuuuuuuuuucuuuuccauuuuuuauuagguauuuagcucauuuacauuuccaaugcuauaccaaaagucccccauagccacccacccccacuccccuacccacccacucccccuuuuuggcccugucguuccccuguacuggggcauauaaaguuugcguguccaaugggccucucuuuccagugauggccaacuaggccaucuuuugauacauaugcagcuagucccauauguucuugaauaagucuaaagauugauaauguuuuuacauauucagcuuuacacgucaccucuuaaaguggucaccauuuuguguccacugaccuucaguagagccaaacuggucauaugagugcccugagcugcuuuuaauccuaacaucaaagaugcucauuggggaggcuugagaguugggaacucucaaggacuauagagaaguaugcauagugagcauccuguggggaacaugagauugggguaguauguuuucuguuuuguaaaggccacuauugcccaccauaguauuguggacauaguacugaauagccuguaaucuugguugcugguucuuggaccuuuauaaauuaaagauucaugugcauagugcauuaaaggugagauaaauguuaguuuguuguuauggucguaaaauacucauaggguaguaauaauguagagaauguaacauguggguuuaauaguauuucuucaucuuuaacuuaucaggaagaacuauugaaagccauugccuguguagugacggcuugcagguaaauauucuuuuguugaacauaucauuuuuugaaaugauuaaagcuguagcuuuucuuaacuauucugauguuuuugugugaauccuguaguacagaguuggaaaagucugugcccaaucaacccaccacaaaugaaauucuucaggcugucuugaaggaguguugcaaagagaaucucaaauauaagauuguugcaaucagcugugcagcugauguuuugaaagccaccaaagaagacagauuccaggaguuuucugacauugucauaccccucaucaagaagguaauagcuaacugugucaucauucaggucuucagcuguccugucuauauguuuuuauuaggacaaguuuaguuguaaaauagcggaaaaauccaaaaacauuaugccucagacaagauagaagaaguuugucucuuacuugauagauggaagccccauaaaguauucagggauccuauucuuagacauuauucucauggucuauaguuuaucugggucccaggcagaugacagaguagaugaaguuagggucacagugagcucguacuuucucucaagaaaagcucuggaaauggaaacaucauuuugauugaugucccacucacaagcacuuaaccacauagucccaguuggcagcagaugaggcuaggaaagguaagcuuucauguggacauuugaguuuccaccuguuggaggaggaugaguaccaauguagugagugagcagccuugaaaacaaggaauacuaugugcuguaaaguucaugucugcauuguccugaggaaaauuuugguuagaaaaaagaugacuggccuaauuugaaaaccacuguacucaguguuuuguuuuguuuuaauaaagugggcaucauaaggaaggaggaaugucguuggucuuuuuguuuauuuguuuugguuuucugagacuggcucuuugauuuauuguagugcuagcuauccuggaacccaccauguagcuauguagaccucaaacucacagagauccaucugccucugcaucucaaaugcugggauuaaaggcauauaugccaccaugccuacuuauuuuuaaagcaugaaauauuuuuaaguauucuuaugucuucuguugcuccuacuucauauauuuguuuucuuucaauaauaaggcugacuugguuauuucgcugauaauguguaggagauuuauauuuuaaguggauuauauugccuacaagcugauugaauuacuugugaccuuuuuaccaguuuauuaagaauuuguguuugaaacauugccaaguucuuuccaucuuuauuuaauucucuuguuccaaauguaggucuuuuuagguuaugcucaacauacuacauaauuuuccaacuuuuauauacaaaauguuuaaaaguauuccucagccaggcagugguggcgcacgccuuuaaucccagcacucgggaggcagaggcaggcagauuucugaguucgaggccagccuggucuacagagugaguuccaggacagccagggcuacacagaaaaacccugucucgaaaacaaaacaaaacaaaguauuucucagcuuuauuagauguguauaauuuuaauacaaauggagaacuccuguuagagaacucagcauuuaguucuuggucaauaucuccuguaaaacacucugcuuguuuuaauaguauaacuguaacuuuauuagaauucccuccccuccccuccccuccuucuucuccucccuacuccuccccuucucucucuuuauccccuccccucccucuccucugauacauucuagaacucacuugaaaguaugggaguccguaccaccaaagcugaagaugaaaaugagaaggaaagagagcugcagcuggagucucuacugggcgccuuugagagccugggcaaagcauggcccaggaacccagacacccaacguaagcacuggaacacaaauuuuuuagaagugcuauaaccagaagucacuuaguaacaacacauuuuuuuuuucuguguggcaaaguaauauucuuuagauggucugaguauuaauagugagaauuucucuauauccauuuuacucauucaucagcaaauaaguacauggaucacuguauuguuagggauagugcaagaaaguaucacaggagcuagagagcuagcuuagcauucaagcauacuuacuggcuucucuuccagagaaccugaugaguuugaugcccaguacucacauacuggcucacagcugucugaaacuccugucucagggcauccaagggcacuggacacccaugugaagcagaaauacacaagcagacaaaaacacucauacaaaaaauaaauaagauuaaaaauaaaauaaaucuuuaaaaguaucauggacuggauaacuuaaauaacaaaguuccccccucccccccagcucccaguucuggcgaguagacguccaagaucaagucguugguaggguugcuuucuucugagauuucucucucuagcuucugaaugguugccuuuucugucuucauauggccucccucuguguugcugugaccugaucucuuguaaggggauuggauuaguauccacccauaugauucuuuuaauaguuuaucuucuaguacaguagaauaauguugggaugcaguugagugcauaacaaccaugaaguacuuuauguagauaguuugacuauaaaaagaguuuuguuacuuuucuuuguguuccuaacuauucucugauagacucacaauuaccucucaaaaucggucuucucagaaucaccagccuugacaucaugucuucaguaagcuagugauaucuguuuuauugagaaacucaugacagagauuuucagaauuaaacauauauuuauagaagauuaauuaagccaugauuauuaguucaaguuguaguuauaacacauugacaaggccauuaaguuugaacagaugcuauuugucuuguucugcgaagacauuccgucccaaugauagucuuuguguuaauuauuuguaaacucaggcauaacauuuucuuugagcccaucauucuuuguuuaacauaugaagaauuuuucaaaagaagucaucaauuugugagugguauuauggacuguaguagaaacugcaugacaccauuagcaugaguaacucuugcuuaauagccaaagaaaguuaaaauaaggaauuccguaagaaggacaucacacacaaagacauaggaguuguacauuuguuuaacaguuaccgaggagagccaagcauuuucucuaagaacgucaguguugcauacugacuucucacauuucacagugucagcuguaauuucugguuuuguccuuuuaaauuagagaaauaaauuacaagguguuaugaagcaaucucaagguagaauuuuuaaccccuuccucucauguuuuauauuuaaaccuuauuaaauuuuauaguagguguccauguuauggcccauuggccacaugucaccaggguagcuaugaauguggccugauguugacgugauagaagcuuggaaagcccuguucuaagcauuuaaaaucaacuucuauuuuuauuuuuguugaguuuauacuccuaucaguauaguauuaauuguauaaugauggugacaauugugauugggacuaauuuaugauaaaagacuacuaacuguugauaaaccuacaguuggcugaguacuucagggugcuuaaggguuccggaucuuuuggcuuuauaaagggaauuuacaauggaaggggaguguagcuaagcuguuggcucuguucugaggaggacaaaaugccuuaagagcaaacuguuagaauagguguguguguguguguguguguguguguguguguguguguguauauacuaauguuaacaguuuggggaaaauucugugucuuuaguuaaauugucccucacguuacuccacuuuugucuuuguuuuaaugcuacuuucuguuuucucuccaccucuugucaucucccacucuucacauacuucuuccucugucccacuuggucaucugggcagguuguuaucggcaggagcugugcaaacugaugugugagcggcuaagacucagcacguggaaagugcagcuagguguccuccagucaaugaacgccuuuuuccagggguaaugugcuucaugauucagguuuuuauuuuaucucccuguugaacgguuuucucauacaguauauccugauuauaguuuauucuccuucuacuccucucagcuccuccccacuuccccucuccucuuauccacuccuuuuaugucucucaggagaaaagaauaggcuucuaagagauaacaaccaaacgugacaaaguaaaguaagaugaaacagaaaccaucacagcaacccaauaggaggaagagucccaagagcuuucacaagagucagagacccacuuguucucacagucaggagucccauaaaauucuaagcugauaacuauaaaauauaugcaguggaccagguguagacccauauagcccuguacuuacugcuucagucuucgugagcucauaugugccuuacuugauuuugguucuggggucuuauucuccagguguccuccucccuucuggcucuuaacaauuauucuaccucuuccuagguauuuccugagcucugaggggagggauuugguggagaccuccuauuuagacucucuuuccacauaaugucuggcugugggucuuugcaucuguucccaucugcuucugauggaagccucucugaugaugacuggauaaggcacugaucuauaaguauaacagaauaucauuaggagucauacuuuuuauuuucuuuuuagaccaguaguguuugguuuuacacugggucucugggcuaucugggucccugguucuugguuacccaagcaguguuggguauggguuucuucuuguggagugguccauaagucagacauuggaugaauauuccuacaaguucugugccaccauugcacuagcuuauugugcagggaggauggauuuuagaucaaaaguuuuauaguuagguuguugacuuuucuauuuugguagauugcaguguaccuucccaaaccaaagagacaagaacguaggaugaacacuucauauagacaccagcuuaucuucaccauguuuaaugacuuguguggguauauccucuccauugggccccugcuuucauuuugcauugaaccacccuucgucuuagcagcaaccagguuguuuggggauuuccaugggauccccuugaccaacagcucgauugaguacagcccaguccuguuacugggauccuugccuggcuacaagagauggccaguuaagacuugguaucccccauuacuaggaguccuuguuaggaucgccuucauaaaguccagaugguuuccacugcaguagguuuccacaugaccauccaggugccccccaguuccagcucucucuccccauacuuucccuccacucuaucuccccuauaccaugccuuucccugccugcucccauccucauucuccccaagucugccuauaaaaccuauuuuccccucucagguagauccaugcauuuccucagaccuaccucuuccuuuaccuaaccucucugggucuauggauuguagcuugguuaucauuuacuuaaugguaaauaucuacuucuaagugaguauauacaaaauuuaucuuucuggaucuggauuacuucauucagaaugauuuuucuaguuccauccauuugccuucagauuccaugaugucauuuuuuaaacagcugaguacuccauuguguaaaucuauacaugcuuguaaucaauuuagauauuacuaguaucggaaguaacaugaugauauguacggauagaaguuaugcuagaaaaguuuucaauuguauauaucacuuucauacuugaagguuaaugcuucuggaagaggaacacgcagauccugaagcucuggcugagauucuucucgaaacaugcaaaucaauuacuuacucuuuaggugaguaaggaaccagaacuugagugauuugucauuguuguuguugcugcugcugcugcugcuguuuauuuuguuuuuggugcuggugaucaggcacaguccuucaugcuggacacucuaccacugagcuacauucuuaccccuuuuucauucucaguuaggucucucugugcuaccuuggcugagauugaauuuauggcuccagucaucucaggaucuagacuucuggaacaacuacugacuguucuguuuaugugccauaugucccccaacaaggguauuuuauguagcauuacaguagaacuuuagaucguaccuuuacaucaguauuaacacuuacuuagaaauacuugcuaguuuauaaaacaguuguuaaaauagguuagguagugccuguguauacuugguuuuaccugagauguuuaaaaacguguugcuuacaacuuguccuuuuauuacuaaauucuucagaguauguuccuuuuuauaacaucauuaugguaucaaaucuauacaguuuugcuuagcucugcaucucuccaccuacccucaacuuuaguugcucaguuacauguaaucccagcuaaacauccccaaccgcucucuuguaggagcagccuagggccccacugucugaggucucacaugguugguuggucaccuuuucucccucagaagcguagcaaacucacacacacuaccucacucacucacacacacacucccucccuccucccuucaucugccucuuuaccuaaggagacccggaagucccaccuauucuucccacucagcaauugacucaugucuuuuucauugaaagaucaagaaccaauuggggaauggggccuuagcaucagaaccaccccuacaacauacuuuaagauuauucaaauaaucuccucuucaaaagugcaucuaaacaauccauaaaaauacacuaaggccauguaaauguacuucucuuccagggcuuuugcuuuagauuuuuacaugcauugaugauucuucuaugagcuguuuuauuucugugaugaauuuuacaacuuuugcccuucgucacauuaaccauuuaguagcuggcauuuuauuuugaacaagauucuuuuaucuuuuucuuuauuuaugcaucauuaacugguauuaauuuauaccccuuaacuucucagugcuuuauauuuacuuuuaggauuuauuuuuaauuauguuuauguacaagugaguacuaaugucaacagagaccagagguguuagguccucacugaaauuacaugcaguugugagcugccaaugugaguacugagacuugaaaucuuggccucugcaagaggauuacgagcugagccaucucuucagccccugauuauuuuguuaauuaguuuuuuuuuuuagguguccuagcaucagcauguuuucaagcugauucuccuguccuugugaugggucacuaucaguuuucccaauacuucuucccugccauggacuagacuuggauacauauuaauuuuuguuagacaguugaucaaaaaauuugaugccuuuuauaaaauaguguguaccaaccaaacuuguuuuauuuauaaucuuuggaaauagcuugcuuuuguagauacagaauagaaagcuaacaaaauuguccuuuuagguuucaaggugucccuagaugauauucuucaguaaaaugaggagaaucaugcagaucaagacuugucuuaguuguaacauaaugauuguacauuugggauaauacuuuugaaucucgaaucucucacauaaaaguuuuaacuuuuuaucauucaguaacauuuaauguuggaaguuguguuuuuaaagcauacucuugaauugcauauuuuuuuucauagaaaauaagaccuacucaucugugagaacagaagcuuuaucugugguagaauuacugcuuaaaaaacuugaaggugaguucuucauaaauuugauuagagcaccauaaauccaggauaugaaacacuuagaaaauuuuuuuauuucuguuuuugcauauaugguauaaaauacauauuaauguaucugcacauacaaguagacuauagagaacuaaaaucauuaaauuuuaaagauuucaaucuguucuuuauguuuauguauuucuaaugaguuacuaagcuauauuaucucaaaguaauaaaguuuguuucugcgugaacucugacauacucuugguuaauuacaagaaauuguuggcagugauagcguagacuuguuuguguguaaauaauuagacacagcaagaagagagucaaauuauuuuaucaaagacacccacuugaguuaccauauuugacaacagcuuguuuuuaguccuauuucuuuucuuucuccuuauucuucuuuuagaaaccuuauaaauuuuguguuaugucagugguagaagaaaaacagcuuucuuguuuuucuucccagaguuauauaucuguuacugguuucaaaagagaccccucuucuguguucacuuccuucucuuuuuccuauuccuguuccuucaguuaauagugaagaagaugaaacaguuuucaucacagccuugugacuuugguauuuguacuuuccccucuuuuuucugcugauacuagauaucauaugaucuauuuuuuucuugauaaaauaaaacagcauaggcacuuagccauauggcugaauucucaguuuuccagguaaauacuauuauuucuagaugacaaaagugaggguaaaccgcuuucuugaagcuggaaauggugguacaggccuguaaucccagccuugaugguagagauaggaagauaggaguuuaaggccagcuugaacuacaugaaacccugcuacaacuauaguacuugcuugaagucacaucacuagaagauaacagagcuuuauaaauggaguuaagauuuccugugcguucuuguuuuuaaaaauaucuaguauuuacaugguucucuaaagcuuucuuguaagaaaggaguaauaaaguguuaaacuauacaauuauaaaaccuuuuaagguacuuuuuucauguauguuacuaaauagcauucuguuguggcugagguaacugucuugcucccaugccuugauacuccauucuucccucugugcugugguauaguucaucuccccaugccuuacccacacaagggacaggguggaacucucugaccugcuuucaggcuguugucaggaauugggcuuggacaucugucuaaccugugacuguuauauacuguucuguuauuauagaguugcugugugguuguuuggggaguagaauauauggaaauuuuucuuuuuuuuaauucuguaaagauuuucuauuuucuuuccauucagaagcuaaacaaugggaaaguuugacagcagaaugcagaggacuucugauugagucuuuagcuacuauggagacagacaacagaccagagcugcaggagaaagccucaguauugaagaaaacacuugaaagucuggaaugaaugagaaggggaagaaacaaacaagugccauguucuuuugggauuggaaauggugguauuuaaaaaaaaaaaaaccaagugggggaaaguaaagguuacucuguagcaugcaucauuccguggcugaaauaaaaagaaaaaaagccuuaaauuuugcuccuuauuagcuuuauuuuacuugucuuuaaagucuguggguaagcgagcuuauuaacuuggguuuuugauaugucuggcaaccaucauugcuaaaagaacugaaacuacuauaaaugaaauacaggacaaacaggauuaacaucuuagaacuacauccauguuaaaauccguguagucagggauccuguaagucacucccuaugaagcaggauuggggaugacaaagcagcuuucugaggccaggagccaaggccacagacccaaaguuuaauauccugucuuggauauuuucucaaccuguuaccaaaccaguguuuacucugccccuauccuagaaacucccaaagugagguacauuuagggagucauacaauacuuccuauacuagagcuaaacugacccuaaucacuggauucuugaagucacaugcucugcauuucucgugcauauagguggucaauuuuuaggaaaugguuguucaggauguuuauagguugagaauaauuugaguuccauaaaauuuugacagauguccuuuuacuggaagaugaaaauagauuggagcaagauuagagcaagucugucuguauuugugaucauguauuuuuccaaaaucuaaaacagcaguaaaaauuagagauuaccuugauuuagaccacuuaaaaaucuuaaaacuguaacaguaacuuaacauuuucuacuccuaacugucaugcauacagugugacuuggaaggacagauggaaagucuuuuagauaacugagaauuucuguuuuuuaagugcccgcucucaaauuagcaugauaccacuucaaguaaacuguuguugccagggucuuuuuccugcuuucugcugcuccuguaccugcugaagggugcaggguugguuuaacuuaggugucuauaguaagcuaaaaacucuagcuugucuuuuuggagcacaagacugauuuauauauucaauacuaucuccuugaugacaucaacaccuggaaucuuuauguucacuauuuuugguagaaacuccauguuuaguuugguagucuccagacgaguguauuucaaaaaauuuuuaacugugacucacaauaaaaauaacuuaacauuugauucauaaugugugugugucugugugugugaguguugguguauguaugugugaauguaaaaccuuuaacugaaauguuucaugaagaaaugcuuaguugcuaaguuugauagacuuucaucucugugucucacuguuguaaauguucuucagacucacuaaaucauuuccugauucacaaacuagguugcuauuuaaguuugaauaauacugccacugauaauaccuaaacuucuacuguauuugagacuguuucugauugaaaaaggcuuucuaacuaaaauguucauugcucacucaguaucaucuuggcugauacugggcuguaguagugaguuuguagaacaucaugaauuuuaaagaaucuguuguagaauugcauuuaagaauggcuuucgcuuuagugaaaaacaaauggcuucaaauguuuuuuagaaagcucuggccucucgggauaugauggguuuuggaccagcauuggaugcacuaaggaccuaccugacuuuaauuguuguauccaggaugcuuccuuggcaaggaugcagugcaggucaaguuguuguugaagaugagaggguaagggcaagaauaauguacuugguuuguagcaaguguugaaaccucaucaaauuuuaugcuuuuauaguuucuuguuauuuaacauuggggguuucccuuggugcugagauggugcuaagacaccugaaccuuagugcaauugcauuacauuucuuuuacguuccugagcacuaauuauauacuuaauacuuaauuauauacuuaauuacauacuuaauaccuucauguucgccagccccaucauuuucacagcuaguaaugaaugcuguguuacuguuucaaauacaguuuauguuugcgauacauauauauguuuauuuuaaucaggacucucuaauuguggaacacgugguaaaaguaccuguacaugcauauaucaucaguccuuauuugccaaagcuaucucgaaugacuugauuuccucucucuauucauuucuguuugccauacaaauauaacuaguuuggaggacuuguuccuuauuccugccauuagugcaguaacuguaucuuuauugagacauggaaaagauaccuggauuguagcaguuggauuaaccaugaaaauggucuacaguuuugguggucaagaguagcuguuugauugaauguuugugucuuauuuauaguuccuaggggauuuugucuauaacacaguccacuuaaguaaaaggguaccaaauccccauugcuuuguccuucuuuuuuuuuuuuuuuuuuuuuuuuuuuuuuuuaacucauguauuuacaguaagaaaaagaauaaagaugugaccucacugguuggugcccuaucagcaguugugcugugugagcacuaccugcccuuguggaacauuucuaccugcugcugucacaguaauucaugcugcuuguuaaguucagggaguuauuuugacauuggcacuuacugaacugugcaaucugucauuaaauggauguauauguaacagauuuuuguauuuuauaugcaacuucauagauccucugcaauauguacuuagcuaccuaagcaugaaauagacuuacuggaaagaaaaaaaccucacuccccaaagauauuaaaugguaaauaaaagcugcaugaccugguguuuugaag

SEQ ID NO: 1922 - RNA, 3905 nt, Mus musculus
uuguaucaggaagaauuaguauuuuauuagccaugauuauuauuagugauauauaaaaggguaucugugaugcuuuaauugguacaaugauaacacacaauaauauguauaauaagauuccacuguuuugguuaaaaaucucuguacacacaugcaggugauuuguacauguggagacuggacuuucuauauacaauagacuaaguugcuaauuauucuugucuaaaggcuaaaaucuccucaguugcuguccuuaacucauauuugguuuuuauuugacauggcuacgaaagguuccacuugaaauuauggaaagacacuuucccuaaccagucauugugagacagauacaaggcacucaaaucucuuugagcuuccuuucaguagagguugaauaagguuaaacacugugagguaaguacuaguucacaauaggccuuuaauguagauacucuuucaugucuuucccuuuuaaaugaucaaagcugucuugauugagccacucaccauuugacagacaacugucagacucuucccaucgaaaaugucaaucaagcagucccuuuuagggggcuacagcaggagugcugcuaucaugguggccuggcugcuuugaacauugcaugggaacugagcaaauucaacuguaguuuugagcaccauuaugaugauagcugcuuaagaggucucauuuuugucaugucuguccuagucagcuugcaccagcucuuggagacuucacugucaucaugauaagucucagggacaucuugaugaugcuaccuaucuugaguuauagucugcuuaggccaaggggaacacguucccuggugacucagcaaaaaaguucuugauugacacacacgaacuaggucaugauugcuaaacaggcaaagcucugacugauggagcgaggagcugcuccuacagaugccacacccccuuucuggcuuuauaagcagccugcuucuuagucucauggggucaguuuugaagccuucuuuuccauguacuaucucuguacuaucauacuaggcuccaauaaaaagucucucuugaguggccuuucauuugcccauacauagucuuuacuauagguagaguggacuaaacuuguugcauggagagaagagagcacuggggugguguucagccucagcauggguacuaacagaggugguggcgacagcagcagcagcagcagcggaagugagaaaauagcccgagagcuucagagagcaggccauggcaggagacuguacagagaagagccgaagguaagaaacagugaaggguggagucagugagguugaaagucccauccaugcaagacuuccagagagcuggcggggguucagagccaaggguccugauaauugagguuugcugcuguaacaccagcugcuggguucugugcccagagugauagccucuguccggaguuccuaagguuccaagccuggcugagcaauuuuggagcaaaaagccccugacuuugagggcuguggcuugcuuugaccugaaccacuuacauguacuuauauauacuuacauauacuuacauguauaguguaagccucugccuuuuaaagcuuagagucauauaccucuaggccuguacaccucugacuuaguaagccucugcucaagagcucagagaugcuaacaccaaggaaacuauucuugccacuauuuuuuuucugagauuuuguuuuauguguguggguguuuugucugcacaugcacgucuguuccccacacgcaugcagugcccgcagagguuagaaggugucagucagaucuuguggaacuugaguuacagaugguuaacugccauuuggacccugggaagugaacaagggucuucugggagagcaaccaugcuucuaaccacugagccaucucuccagccucuauccuugccaucucugaacaccuaaauagauaaaaaaaagacccuuagccagccuuucaugacauuuagaguguuuuacuauagaguacagaacuaggagaguucguaugcaucaaacggcugacaaguuuugaauccuuucugaggaguaguggacaaugguacugggagggguggagagacauuucuguacuuuaguauuguuuauaaauggucauugcauuuauuuuggaagaaaugccaaaccaaagagcaagaauguccacuaaaaaagcacugaggcucagagcacuauacaaaucuagucaguuucaaguccccaggagggagaggguggaguuagucuggaguuagucaaucuggagaguagggugagauuggggauaugggaauggggcuggggagaagguacauauacuauuaagucauuaacaaaugguaauguaguucuuccaauuaauagugaaaguguuuguggggguugaaaacauuuacccagaaccuggacuccaccuguguuugcuuuucugucacugugacaaguuuaugaccauuuaaaaugaguaaaaaaacaaaacuguauuuggcucacaguuucagaggugugguacauggucacuugguuccauugcuguggacuugagguggggcuggacacguggcagggugugugugaugaaauaaagcagccccucucacggcaaacacgaagcagacagcaaugacaggaagaggccauugcaacacagucccuaagaacacaccuccagugauauacuuccuucaguuagccccaccuccugcuuuuccaugggcaauggagcugugcaaucaguauuaaccucugauuaggccagacucucaggaucuaauuauugucccaaaguccagcauuaggcaaaacaagcagcagggaaggagugugugugugugugugugugugugugugugagagagagagagagagagagagagagaaagagagaaagagagagagagaccauauccaaguuuuaucacuaugaaccaaacugaaccuggggcuauacaugugugcagaacuaggucuugaagcaucaacaaauucuacauuuaauaauuuuucucuugggugugagaugggugagguagcugaacuaggaggaaggacucuuauuuuuaugauaaugacaaagauaauguaacuuucuuuguaaauguaaaauuaauacaggaaguaacauggucaguguuuguugcuaucucguacuugccuaaguuacauugggagccgcauguauucaaauuucaaggcauuaucuagggcccuagggauuccauuuugcgggaauauaugcaacuucaguucauuuagggucucgauuauuuucuuuuccucuaaaaaugucuuugaucuggcaccuaauuucuuucuuuuuuuuuuuuuuuugguuguucuuauaguaaccauauaagcccuugauuugaauuccauuuugcagcuguacacgaccucauggaccaacgagaggcuuaaaguuaaaaguugggauugccacuaaacucggguuaagaagaaggacucuaaagcacgucuugguagcucaaauaucgugguuuccggcccuucccuggcucgcagcucgcucgggaggcuaacguuaggggagcaucccccagggugagcccucggugcaggucccucugggcuuuaacuucggggcugcucggaggcccggccugagucagcgcggcggccgagaaguugggcgcgaggcgcagggcggggcuuccuccucuuccuccuccuccuccuccgauucgagccccgcucuacuuuuccgaguccgcgucucuuccuccguccgggcgcguguuccuccagcuccgaccaggcggacgugacagccgcagaccuuuaacgccacagcccggggcggggaagcucuccgcggcagccaggacagcccggcuccgcucggccgcacgcaggcuccuccggagcggccgc

SEQ ID NO: 1923 - RNA, 28350 nt, Mus musculus
cauacgcccuacccuguuggccccgccauguucuguuucuaagagguagaagugagauuuuuuuuuuccugauaaugaaaccugcuaaaagcuuugcuuaggauggagaauugucaaauuaaucuaauguucuuugaucugucuggaaggcuuuaaaggagaaaugguuccuagaugaguccuccuguccgagacuggguuuugcuggagccggaacuucaagguuggugacgcuaacugccucccuuccccugccaggcaguggggacagccgcucuccagaacaagcagcagcuguugggaguuggccucucagacuguuacaauguaugagguguuuuccuuuuugucugcugauuagcaccguaagagugggggagcugugcaguuugguuuaguucagaugucaguacucucagggaggugauuuuagcuucuauguuuuacucccccuauccgcucccccacucgcccccaccucaucagccauccucugagagccuagcagaaaugaagcagccucuaccuucgccacaccuuccuucccuccuccacaccuccccuccuccacacugugugcagaugaauaguucuagaguaaaccacacagccuagacugaccugacgggugucccucuaaucacaaacaacacaggggcacacaagaauuccacaugcuuucucccaccuggguucugcuuucgcuucugcucucagcagcugaucuggaccuugugcuucaugagcacaucaaagccguggaucaaaaaucucagcuuuuaaugaucgagaucacaaacuucuuugcaccuguguccaucuuucugccacugauaacaggaggcugcucuccugaaaggacugcgucuucaucuucuaauuucacugggcuacuuccgguauuccuucucucuugcaaagcaagaaucgguuuugauucuguaugaagcuaaggggcucuacacaagaaaauggaauauuucccacuucuaaaacuaugggccacacuucguauuaagaggaaccaucuuagccgggcgugguggcgcacgccuuuaaucccagcacucgggaggcagaggcaggcagauuucugaguucgcggccagccuggucuacagagugaguuccaggacagccagggcuauacagagaaacccugucucaaaauuccccccaaccccccccaaaaaagaggagccaucuuugucaaggaaaagcuugcuaaacccgacauauagagucaaagcugaaguuucuuuagaaaugaauauuggcagauccaaggcaucaaagaaggaagugaacuacuuugagagaaccuggauggaguucccuaguucacccaaaagggaagaagggaacugcugagguggcucaguggguaaaggugcuugcugccaagccugccauccuggcuuggaccccugugacccauggguauaggaagagaacugacucccgcagguuguccucugaccuuaacacacaacagaaauaaggguaaccauucuuuuaaagagaagagacuauaauuccuugauaauuagaaaagucauuuuaaauuauuucuaaauauugggaugauucagcuguccguggaaacuggugaaggggcuaaacucaucacagcguuaccucaggacaaaucggaaccccacagauaaaaacagcuagaggaauagaggaguguauuaccugguuuagugaugcacaccuuuuaucccagcccucaggagacagaggcaggaaggacucugaguucaaggcuagccuggucuacagagugacuacauauagaaacuccauuguaugguuugaaagaaacagaugggguuauagaacuauaacugugggccagugcaagguuucaggucagauauuucaggcaaaaaaaaccugaaugguucuaaaucuaugggguccuuucccuagggaaauugcaggggaaaaaaaauaaaucaaagauacaugaagaagguaucucauaaccuaauuccuaacucagauuuuauuauuacucuuuuaagcuuguuuccagaaaaagcagccccagugggugggaggaagaggagggugcggaggaugcagggcuaauacacagauuauggcagccugggcucuaagcugggaauccacaguagauccuaggauagaaagaaccugauguacugguacagggcuggugauaaccagaaugaaaaugagugaggaaugcacggggcaggguucauggaccggccgggcugugggggaugggagcuccaguguguccauauuuaucaucaugcuuccuccaagccaaguuucagcagggugcucaaucacuguggaagaaacuucuguugaauuuagcucccucuuacccuaaaugggagccagggcguuagaaagaauuguuaccaacauguuuccuuuucuguuacacaaugccuggaaaaccugacguucacuuuguaaguguaacaguauguuuuagaauuuucuuuucacaccacuuaaagaagacaaauuuaacuggguguugaugggguuuaaucccagcacuggggugguagaggcaggaagauuuuugugagcucagggccagccuggucuauauagcaaguuccaguccaaccagggcaacauaggaagaccuuaucucaagauagcaacagcaaaccacaagacuaauuuaauuuacucucuuauguagaaaacaaacaaggacuuuuguacuauguccaaaugcuuacuccgugaacacaauuugauuugucuacccuucaagcaggaaguccugcacaggggcuggcuguuacuguggaauuagugacuuucagggaguuaggucaccuugauuugcuuuuuucauguuauuugugguuuuugccuugggacuugcacuccaagaguuaggucauuuuuuuaaguuuaacauuuuuaaaugaauuguucaucaauuaagaugauggcucagaacugccugccauuucagcuucacugagauuuggugcucucuucugggccuccucccacacacagggcacacacacauacacacacacacacacaggggggggggguggagaggaggggggagggggagagaugcauuucuuuacuaaacugggugcugggugucugggcaccaggauccaucccgaucuucccacuuacccccucggccuuuaacuguuccuaacccugggucucuccauucaguguuuucaggcauaugauucuuuuaaauaucuucaccucagauggugauguuuuauuuugugcugguauuuaaauggucauuucuggugguucccacuuuacccuugcuuuuguuuugcuuugauuagucacacagugcgcuaggagguucccguagcacuucuuuuucagcuuaagccguguggcaccgaguccugauggcauagccuccuccucacauccucacccuugaaaauacccuuugucugucucgcugaaacuuuuauuuugacaguggugacaguuuaugcuucacguggucuagguugcuuacauucaauuagacgugggaucagagccaaagacuuugagggcacagggucuuucaggagaaaaaaaaucauauuguguguguguguguguguaugugcaagcauguacccuugugugcaugcacauucacauguguauuccacagcauucuuguagaagucuuuccuucccugagugggucucagggaucaaagaaguugucagacuugguagcaagugccgauacucacugagccuucucuaucaccagccaauaaaauuuucuugauaagcaagggaucuggcaaugacacagacauggcugaaaagcugaaucauuuguuguucagugauguggauauccucuuaguauaucuuuuguuuaucucuuuuuaagaauucauaucucuuuucauguuccaggcuuguuuuguuucagaaggauacaguguuuaacagccagggcagauuucaggaaacugucaccaaaucugauuuaauugaaauuaggagaucuuucaaauaucuuuucucuauuaaaccugccagaguuuaaauaguauaguuagcuaaaacuguaagacccccgaagcugggccucugcucaagucccgggaugagcuggccagcaccccaaugacucgagagaaaaccacaccuaaugcaaacuccuuccacugugcagggcaggggaguucaacccuuagcggugacaguagggggcuuuuaacagcuagcugaggaauugggaggaguugggaggagugggagaagcugggcagaguucugcucuuucggguguccuuggugaaauuuaugaggcagaaggaguggggagugaguucuuucugaauuuuuaucuccguguccucggcacaggaagccaggcaagugccuggcugggucuuuuacaauuauuacaucucuaguuguaaaguauagaaacaaaaaggcuuuuugcuagcuauagagaacaaagagcuuuuuucuagcuguauuuuuagagaucagggaaaacaagcuuggggaacguccaggggcuuuaccuuccagggagaaacacucuaaguuggggucucacaaaacaaacaaacaaacaaagaucaaugcuuucagcuugauagaagauuuuccaggaguaggcacuggguugauuuuaaauuuaaauuucuccuuuaauucauuugacucucuuggaauuagaaaaguaguucauagauucugaguaagguuaggcaaacauuaaaaguauggauuuuuggcagaagacgugcaaaauugugcaggagugauagcacccucugguggacaguuugggaaccagcaugcugucuguugggugcaugggaacaagcugcggggaaacaggaccaggaagacuccucuucaaaaucucugccuagcucuauuuuucuguggcuuucuaguggcaacaagcaagaagccauaguccaggggauacaguauauagaugcacaauagggauggguuguguggacuaguauuguuuugcuuauuccaaauaugaaugccagaagaguggggaaaucagaaagaccacuugcuuccuguggugauuaguuaguuaaguggugccaaaugcuggauaugaggagaauugcaguuaacacagggagaauuuucuccuucuuagguggauggauuucaaaaacaauaggguaaaauacaaauuaaccucuuucucccuuccuuccuuccuuccuuccuuccuuccuuccuuccuuccuuccuuccuuucuuucuuucuuucaaaaagauuguaccaaguagcccaggcuagacucaauaucucaauccucuaucuuuauaucuugagugcuaggauuacagggaugcacaucacuuacaacucuucccucuucauaaaaagugggcauguguugagaaggccaaagagauuauguucauacaagucuggcuaaauuaaaaaauagugcuagcuaugaaauugauauuguuuccacacuacuaaccaugucucucgcaucauuaggacaguuauuagucaacuugcagugagguacacaugauaaauaucaccaggaagaaguucaaaacaguguucaagccagcuucuaaaaaauacuguuaaaaauaauaacaauaagggcuggagagauggcucagugguuaagagcacugacugcuccuccagagguccuaaguucacuucccugcaaccacaugguggcucacaaccaucuguaaggcgaucugacgcccucuucuggugggucugaagacagcuacaguguacucacaucaaaaaaaaaaaaaaaaagacaggcaggauagcucaggcuuuaaccuuagcacucaggaggcagaggugguaagauugccacaaauuaauuuaaggcuagcuugguguacaacuguaacuguagaucagccaaaguguguguguguguguguguguauauauauauacauauauauauauacuuugaaacuuuuuuuuaaaagauuuauuuauuuauuuauuauauguaaguacaccguagcugucuucagacgcaccagaagagggcaucagaucucauuacgggugguugugagccaccaugugguugcugggauuugaacuucagaccuucggaagagcagucgggugcucuuacccacugagccaucucaccagccccugaaacuuuuuuauuuuacuuuuuuuuuuuuuuuuuuuuuuuuuuuuuuuuuugagacaggauuucucuguguagcccuggcaguccugaaagucauucuguagaucacucuauggucaaacucauagagaucugccuaccucugccuccuugagugcugaaauuaaagguauggugcgccaucaccgucugguuacacuuugaaaaauuuuaauucugagacauccugcagugguccgaauuagcugucuuagucgcuguucuauugcugugaauagacaccaugaccaagacagcucuuauaaaugaaggcauugagucuugcuuagaguuucacagguuuaguucucucucucucucucucucucucucucucucucucucucccccccccguguguguguguguguguguguguguguauguguguguguguguguguguguguguguguguguguguaugagagagagagagugggggugagggggagcagaugugggcuuuugaaaaacucaaaagccuaccuccaacaagaccaucucucucaagucuuaccaagaauccccucacucccuggcuacuaagcauucaaguaucggagccuguggcaaccauucuuauucaaaccaccacagugugaguacucgucaaaccugcaaaugugacuauuaauagaaacuccccgucuugaaagagguauugguauuuuggcucacuuugaauuuauuugaaaugaaauaauugagguuuauagaggcuaaaguccauguugauacuagaaaaauuuaauuguauucuuccugaauaucuaacauugucuaucaaaucuucacuugguguacagaccaaucccaauggauagaucccuaucuauuaguuguuagccaguugccaucauagaccugggaaacuauaaagucagucaugugggauauacuggucauucauuaucaacccgacuggauuuagaaucaccauggaaacacaucucugagugugugugaggcuguuuuccagaaggguguaacugagguaagaacaacauggacacaucaccaucauacauagugaggcauuggaucaaauaaaaaggagaaaauaaauuuggcacccuuuucauuccuuuauucuaauuucagauaauguguaacuagcaacuuuguugccaggccuucuggacugugggggccguauucccuagaacccuaaacccaaauaaauccuucaucuuugauguugcugcuugcagguauuuggucacagcaacaaauaaauuacacauuuaaaaacugugguuuaucugaaauuuaaacuuaauggagcacguccucuccccacuccaccuccugauuucccuggaggcauuugcaagaucuuaagcuguauuuugauugucacaauuagggauaaugguguuacaggcacuuuuguggaccguauggggguacuacuaaacguuuuacauccuccgggcaaauaauuguuugcucuaaaauauaaauaagcagagaaacagagaacaaaaaggccacggucuuucagggcuccugggagagagacagugcaauugucuaaguucaucuucaguuuggguuagagggggggcaauguccaggccuggagacaggaugccagugcccagaguuccuacggcagcggaugaaguagcgaggucgagaagguggcguguggcuaguccugcguguggacugugccgcacuaggcggcuaggagcgcuucagacagacagacaccuaccccugccucagaaaagaccgcugagcuacuaagacuaccaggcuccacaacacacagaagccgcccgaggcuaaggcguccuucucuccuagcaacgcgcggggacggaaguggcugcggcgccacgcccccugcgccugcgcacaggcgcggccugcugacguggaccgggcugcggggccgagcccggcgccgaggagagcagccgcggccgcugugcuggcagagcggcgagcgaggcggggauggcggcgcggcucgcuuugcgcgggggacccggggcugccggccagcgcccauggcugcugcuggcgccgcugcugcuggucccgcugcuggcgcggcccgccgaggcccugguggaagggcuguacugcggcacgcgcgacugcuacgaggugcugggcgugagccgcucggccagcaaggcggagaucgcgcgggccuaccgucagcuggcccggcgcuaccacccagaucgcuaccggcccgagcccggggacggccccgggggcgcgccgccgagcgccgaggcuuuccugcuaguggcgaccgccuacgagacgcucaaggugaggcucgcgggcgcugauggguggcuggggauuugggucuccuagccgggugaucagguccucuacgaccccagcacacugcugccgccuggacuuuuaggagguccacguuucccacguggccguggaaugagccaccuuggcccgcuagccagcauggccaccuccucgaggacaguuuuggaggacagccaguucuguuuuuggacaguuguuaugcaaagcuuugcacuuauuuuauuuuugguguaaaaagcauucugguuacuugaggugcaugcucggaaagcagggugauugucagugcuaggaucugagauaggacauagaacagaaaagucugaaauacugaguauuaacaacugaucaugccaauuugauaggacagaaguuuggccucugggauaaugucaauaaugacauuuaucuagaagcgcgcgcacacacacacacacacacacacacacaaacagcgaacuaucaguccgaaaacuggacugugacuuuuggcucugacaacuccugagugaccuuggauaguuguuucugacuuggggcagaagauugagaauuccuaguaggaaaauaauuuuuggacguguguagugaucugacaaaggcuuuauugccugcugugcauguaggaggauuuagcuugacccccuuuucuuugauuacugcaguauauguaaaaaaaaaaaucaccuguuaugucaugcuugagggagguauuucuguuucaagagccccaucggaagacugcagcgucagucauagccguguuuccaucauagcugugucucuuuccuagguuuuuguuguuguuguuguuuuguuuuccagccuucuuguaaugacuacuuuggauagcuguauuaccauuaaugguggauuaguccuccagauuagcuuuacagaguuggcaauucggagucaaauucccuuucuuucaggcuuagagcaguuugauguuuggagcuauuaagacuguacuucacugacuaaauucucaccagcuagugagaguacaguuuuuguuggcacucaguugagguaugggcgagcaguuagaaagaaauuugaaggcuuaguccccauuauuagaggaaugagugauugagagaacaggcuucaaaaaaaccagaaagaacuugcucccccuggaaccacucagcacaugaaccccaaacuguuugcugaggaacgugugguucuaugcugcccgaccuuccaagggccucgaggugcacugggggcucugcugagagagccaggacagauaggagcagaagugcuggcaacugucgccuucgccuagguuuuguggggcaagagauggguggguagguuuggcgggggaaugguaaagguguucauaagaacuuugagaacaagugccaggacuaaaguguagugccagcagaugacauucucaauggaaguacuccuaggacucaaaauaguuaugcuauuuucuuagggacacuguuuccaaagucuaaucugguuguuuugguuguuugguuguuuugguuuguugcuucuaaagguuucuacucuaaaguuuagaacugauuuaucagaaaauaaaaaagcuagguaaaacaauguguccacucaaggccaaggggcuucuaggcaguuauaaaguguguugucuggcaugguggugcacgccuuuaaucccagcauuugggagccaggggcagguggaucucuugaguuugaggccagccuguucuacaaagcaaguuccuggauaauugggcuacacagagaaacccugucuccaaauacauacauaccaccaccaaccuucccccucuccucccaaauaccuagaguuccuagagaaaguaacauuuuacuugacucugacaagguguuuguaguagcucagaacacucagaacacucagaacacuucccagcagggaacuagaaacuuguggaguuuggcacuggaggagaaggcccuggggaguguucuagccccagcucccaagccgaacuacgucaagauacagcagaacucugaaaauaccuguuuagaauuuagaucugaacauagcuucagcuucucaauggaguacugauaagcucgucucugcucuuuauauugccuucagcuggaaaaggacguuaaaagcuguggugucaaagacaaauagguugccugauuuguguuucuguuguaauggagaacugagaaaguugccuaagaauaacacuucugaguaaugcaaagacuuaauaaagaugccauccaguuuguaggacgggcugaucuuccaguuauucuacggaggucaugcagauauaaucacuguuuguuuguaucauaucuuuaguguggaagaaggauuugugggggagaagaaauauagaugaacuuuacuaggaacuggucagguagacugguaggggaaauugagguccaggggcucuggacucuaggauaaaaaaauggcacccagaagccugucccuaaauguugagcauaaguacaucuuccacaugggaacugcauucguguuugacgucaguggacuugugguucugugcucauauugagagcaaggggagcaaggugggcuuuguuuuuguuuugcuuuguuuuuuguuuuuguauuaaaaauaaguacaauuaaugagacaagaagguaagacccguggucauuacuaauuuaggaacaagugaguccgacugugcaugaggagauugagggaaacccagagaaggggugggugauggagggagggcagaggccguccaugugcagaugcuaugcaagguuacacuugguuccuguuagcaaggccguucugggucacgacaugacuccagacaguugugaucucacacagugagugugauguggugugcuuuuauggcuguugggaauugagagaaauccuagacuuuggaagaaaguggacucacuggcucagucagcgccgagucuccugggguggaacacucuagucuggccgugggaacugcuguggcuauagcacuuaucacacugaguguaaauuucaggaacccuuccuucucuugcacuaaacaugccccuuugucauguguauccacaggaccuagcacaaugucuggcacaucagauagugaauauuaguuaaacucucauuuggagacaguugggacaggauggaaauuagaacuguucccgcuguuugacucaaacugugauuuuagaguaguacaaauaauaugaacuggacggcugggagugaagcagccugcaggagaggagaccugugcuucccacuuucauuguuuuuagggcuuuaaaaugagagcaaaaauaacugugaauguagguaaaaauuggauuaaaaaaccaaaaccaggagauagcgcagagugagcagaugcaggaacagccagaaaagauucaguuaacaguuauggucgguaagagaugaagacguagacgcggacaacguuucacaacccgacaagaacauaggaaaggucacagcaauauucugcugugaagguuaucugauuaaaaguuagagcguguaaagagauuagaucugucuuggaauggaggcuucaccagaacaaugcuuguuuuucuuuuugucaguggcugagguggcagaacuccuagcacuuagagagaauuuggcaaaaggaggaucuugcgcucccugcccugugcugugacucacugcagguuucuuaccagauuucugacuguccuuuccugagcugacaggaggugcuaguggggaggcaguggagguacagcucucucucccuguuuuuugguuuuguuuuuaaaccaagaauugaauuuuguauaugagcuauauacccagaacuuuuucuuuucuuuucuuuucuuuucuuuucuuuucuuuucuuuucuuuucuuuucuuuucuuucuuucuuuuucuuuuuucuuuuuucuuuuuucuuuuuucccuagauaaggucuuacuauguaacuuuggcuauccugaaacucuaugcagacaagauuggccuugaacucacagagauucuacuaccuccaccucuucauuaaaggcugugccacucuguuggucuagauuauuuauuuauuuugguuuggcuugguuuggagucagggcuuucuauagcuuaggcuggcaagccucaaacucucuuuguagcugagggugaccuugaacuccuuaugccuuggccucccgaggguuggguuuacaggcuguuccaugacacacaacccaucucuguuuuucaauuuuaguuuuuuuaaaaaauguaauuuucagcacuugugaggcagagguagguggaucucuaaguuugaggccagccuggucuacaaagugaguuccaggacagccaaggcuacacagaaaaacccugucuggaaaaauaaacaaacaaaaaaaauaauuuugaugcaacauccaucuaaguuacucaggccuugaacucacugcauagcagaaagaucuuuaaccuuauaaucaaucuuucuuagucuuccaaguagcugagauuacagguuugaggccccagggucagcuugacuuuaagcuuuuauuaagaauagacagauacuuauuguguggucauacuuuccuacaggucauauuucaguaugagaaggaagcaauuuuucucgggggauuagagacaaauaagcauacccuguuagcuaggucugaaagaaagucaccacuguugacagcagagggcauuccugacagaaggaaaacuuaagcaacccaacugcagaaucgcguguucaaggcuccaggacugaaguacuccccccuccccucgcgcccagagacugcuuuagggaggaaaacuuggcuacacauuuuaacauuccaaaucuuuacagucaugaagauuuuaaucagcaauucaugggaauugguauaacuagcugugccuguggguucuucauucagggauucagccaaacuuagaugcaaaauaucuggagggguggagaaaugucuggaguucuagauguagcucagucgguagacagccugcaugcaugcaugaggccuugagcuugaucucuagcacaguaagaacuuggugugguagcacacaccugggaaguugagagacaggaaggccagcaguucaaggccauccuugauuacacaagaacuuucaggcuagccugugcugccugagacccugccucagaauaaguguacugcccaugcgcaugcuuagcauuuccauuguguuagguauuguuaagugaggacauugguuauauauaaacguguugucuuauauaagggauuuaaguauuuacugagaccauggacucaaaaugcccccuccccauucacaacugaagcaugacuaucaugaaaauauguaaauaucuacuauaguuaugaugguaauagacagccacauuaaguaaccuuuacagagcaguguuucccaaccuuccuaagcuucgacccuuuaauacaguucuucauuuuguggugaccccaaccauaaaauuauuucuuuacuacuucauaacuguaauuuggcacuguuaugaauuguaaugugaauaucggauacacaagguaucugauaugugaccagcagggucaagacccacggguugagaaccauugcuauagaucauagccugaaggugguuuuaauucccaugucugcuuggacggagcaucaguacccgcaacacuugugaggacugugaggcccugccugugguuagucgcaaggugugaugugguuggugacuucccauggguugggaaaggcgugauagcauuuguacuacauuuacuuucaguucugaaacuagaacagaacuucucuuacuucccuuaacucgggucguuguugcccacucugucugaggcugaucuguauaccagaugcuuaauucugaugucucccagugugaccuugucagccgcuaaucaaagcacuugaucaacccuaacaugauauaauuuuagucaagaacuggcuacuugacaaacuaaccccaguugcucaggcugaauccaggaccucauuauacuaggcaaguaucccuccacuggcccaguaguuggcauuguaacauagcucaugcagguuuaucaugagggacuucugggauagaaagaagagugcaaagaccuuuacugagguuuuuguaaccuucuuuucauagaucuauuucuugauucuauauucuagaccuguagaauacaugggagggaacuacuuuagaagauucagacuuaguuugggguuagaugaugaacagccugcuccucucuuccccuuuugagauagucauuauggagcugaagaggugaccucgaacuuauuucugagccuccugcuuccuccucagaaguacuagcacuauagugcugcaccacugagccugcugcuucuuagauccguuauuguuguuguuguauaguguuugugguuuucccuuuacccacugagagccagcuccccgggccuggguuugcccuuuacccacugagagccagcuccccaggccggcuuuugugcaaugcuaggagucaaacgccauguuuugagcagucuaggcgagcacugccaacugagcugggcccucagcucaacucuuuaagcuuuguucaaaaguuuaaacuugauaguuugaguaguuacaauagguuuuaagauggaaaaauagcacagucuuauacucauuucagagagcagcucagggaaagugcugagauguguuaggggcuacaggcuuucaggcauagguaggcguugcuuuguggccaagccauuucuuauggaagcagcucuccugagcagugacugacuuagcagccuggagccagcagcauagcgcacuguggggucaaagcacugggacuaacuguccagcuucacugaagcuacugcacacagcucuaaucuucugguccuuggcuugugacuugguugucagggaaaauguuuuccaggaguugagcaucauuuuguaucucuuuguguguuaaggaaauuagaaaguauauuuacagcagaggcugagcagaguccucagccccuaauuucuugcaaugcucaauaagucuauuccaccucaguguccuuuuuaaagaguuuuggaaaaaaaaaaaaaaaaaaaaaaaccuguggcaggcuucgcaucuguaauccuccugccucggucuucagucgccggaauuugagaaucugcugcuccucugcucuuucuagccaugguucccaaugauuacuuaguuuuuuccaguuguuguuuuuauuauuaauauuuuuuggugcuggcgauuaaacugaaggcuuuggguaugcucggcaaggacucuaccauggaacuacacacugaaccuucuuaauaaaauuuuaagucuuuucaucccuaugcucugggcuuuacuuuuucuuaggcuucugucuuuguguauucuuuucuauuuuuaagcccuuuggguuuugggguguguguguacgugaacagaugcaugaguaacguguacggaugcacacgugugguacguguacacacaacugagugauguggaagcugaggguuuuucguuaauguuagguuccuuccuuaaucgcuuugcaauuuuuuguuguccuuucuucgagacaggguuucucuguguggcccuggcuguccuagaacucacucuguagaauaagcugucuugaacucacagggaucuacuuguuuugcuuccugcuugcugaguggugggauuaagggagugugccaccaccaucugguaugcucuuuaccuuauuuucugagacaaggucucuuccugaaccugaagccaguugauuuaaguccagccagcuggagcucccugcucugucccacauccugugcaucaggacugcagagcccugcaugcucacccacuccucuugugguugggguccucaugcuuguacagcacaggcccugcucacggagccgucuccccaggccuucugagcuccucaacuacaucgcucuuuagacauuuaaguguuggcucccacuccugccuguuuugccagcuuaguuuuucaacagccucuuaucuguagcacaaguaguuuugcuaucucuguuaaaggcuaaacuuuaaaagagaaugcuguuuuucacacagguaccaaaggaguguaugucacagacuguguggucuaacucauuaauugaugagaaaaccuaugagauacugacaucauucaacagagaaaagcugaaauauugcugaugugcugauaagguaguauucaguugccucucacuggauacaguuuccuuacugagaacacaaauuauuagcauuauuaccagguuuucacaaguuacuacugucuuggcauuuuaaagagguuauucguaaacaaagcacaucucuccaaaguaguaaauaaacaagcccugggggcucccaagaguacaaguauacccagucauuuucccuucccauuucccuaaucuccaggcuugcucccuaguccuucauucuuacgggggucacauauuauauauaauuagaagcuucaauaucauguucaguaccuccuuagauuuguuuguuuguuuguuucgguugguuuuuauuuuuauuuuagacagguucucucaacacagccuggccuuggcucuccuggaacucacuguguaguccaggcuagccucaagcucacagacauccaucagccucugccucuugagugcugggaucaaaguguaugccauuauacugggcuccuuugauuguuuuauacccuuuaacuacaaguccuccauguucuacuuaaucacuaaaagcuauuccuuauugauuuuuuuugcauuuuuucagacuauugcagcagaaaugucuugaaaauaaccagcuauacuucuugcaguuguccucauacugugaaacauuucacuuuugagcaucagagacaauaacuaacucuagucuugcuuucuaguucuuuacuacugcuuccuaaauauccucauugcuccacuguucagagcuuccguaccuuagcucuugguucuaaugcuugcaacagguuccaacacuucuuacccacuuuaaaagacccaguucuuaccucgcuucaucucuucugugaaccucacugccuguggaccugggcagaguuccucaguucuuugguagcauaaaauugugcuuuuuguuugcuagauucgucuaaaagggggacucuugaggcuaaggcuguaucuugcuuguguuuucaucuccccugugucuaacccagggcuaaucccuuguguuaugauuugcagaagaggaagauuaaaagcucagguggaguacacaccuauaccauuagcugagacagaaagaacaggcuuggguuugagcuugucaagucguagcuguuuaugucacauuuagaauaugcucaagacuguugagaguaggagaagccagggaaaguagaugugucacuuacacaucggcuguuggaucauggacucuguagagacauuagaaugagguaagauagguaagacagguaagauaguugcacuugugacugacuaggggacagggaacaggaaagaacauaaaacugauagcaguuaaguuuuuuaauccuuagcagauguaaugaccuggaaaaaaauguaagggaacaaguuuaauuuuugaagcaucaucguguguguguguguguguguguguguguguguguguguguguuuguguguuagugagcacacaugcguguguguuaauaagauuacuauguauuuugaagaaugaacaaaaucuaauuacauuuacauauauucucaauuccuguccuuuaccaucagaaaaugcuuuccccauucuguauaguagaacauuuugauguaaaacugucugcaguaucuuacauugcaauucauguugauugaaagaaagcagugcauaccucauuuuaagccgaggacgucaugguuugcuggggcgggggcggucauuuucgagagaggaggaaggcuuggugcugcucggcuuguggguugccuuugcucgcuuuugaucuagauaucggugguuguauuccaguccuccugcauaugcccaagaggauuggggauggauggacaccagcagaagcaccacuuaccucuagacauuagaagccaggaauguauugcccugcuugucgaggcucaggacaggaagaaacaaguauaaguuuugauuuuggaaagaaguuggaaucuccugacccugggaccuuaagauccacaauauugcugaaagaaaaaguacuaccuuauugaaagguaagauauuaaacuguucgacauguuuuagccacauuagcguacuuucauaaacuguaaauucaagcagucacuccugucaagcugacauuuugugauguaacacucauccagccuugcuggugagcugcagaccuguguggcuggagaaagauguagaaggaggagaccuuaaaacaccucucucugcuuugaaaugacacacugacugccaggcacugagcuaggcccugggucuauagagauuaaugaacacccuaccacuucccuccuaagaaauucccacucaaggauaagaaacccuaaugacuacaaugugauaagugcuauaauaaauaggaacucgguguaauggaguguucccggggugagggaggguaacucagcaguggagcacaugccuagcaugcucaacugccuagcaugcucaacagccuggcuuucguccucaucaccacagaaagcuguuugaggcagcagcacucaugacuuucaguagcucauaaggcuaacaaaaggaauaagcuuuaauuuagagaguguuaaauguucagacaugagaaaacacauggcauuggaagaguguaccaaaaccagaaauugcugucugucugcugugguaagagcuggguaggugaguugggacugguguggagccuuguugcaugccaaggaaauuuaaaucugaccgcgaagaaacauucauaugagaaaccuaggaaccucguuucuaagauguuuuauaggggaaagcuauuacauuaauaauguaccuuaguucucuaguaugguccccuaaaagaaagauaagccuucuuguucugucuuugccuauuuguucuuguuagcugugugucuuaaacuuuguagguuacugaaaaauaggauuuuuaccccugucuauugagagaacuuuguaccaacuuucaauauuuuuuaaauugcaugaaugcuuucacucaaauauuauuuucauuuuguagaagaacaaaaaggcuuugcagcgagaguuaaguaagaugaauaaaugauacagagaugaauaaaugauacagcucggagguggccagcgcuuggcucucuaaaaccagacaggcacaugcaguugugguaccccuuagagaaagacaccauccuaagacaaguuaguuuuggcccugugaccuuuucuaguguuguguagugucaggccuuaggaagcucggaauagaccuggggagagguggacacuaggugagcauggucacugcuggagcuuuggccaccacgcucucaggaguccaguaccuggagucauaagaagauggugacacuggggaaggucuggauguaaugcuuuagcaagaguggcaucuguguuccauugaaugugagcgucacuuagagaggaggagaaagaagagugaauagccauacacauugguguccauauaccagguuucaaagaccuugcucuaugcuucaacuaggagugcaacaacccaacagcuggacagagggcucuggagacuguuggcagaggguggcuggaauccgauuucaguguggcauuuaguuucaaaaugacaugaaucuaguuggagcacagaguucuugcuuggaugcaguucagaaaguaggucagcauuggaaacuuggguuaaaaucacguuucaggccuaauggggacauuucuauaaaauuagccaccagaaccaaaaacauggugggagaagagggaaauucuauaaagauaucuuaaagaaucaagugagaccccucaagaguugugcucagagcugccugugugacugcuguagagauggccccuuccuagguuaggagcugcggcuugguaaggaauagucccuugauggcagagccugccaugagaaagcccuuugacaugagaauguacaugcgugaauuugaagacuucgucagccugaucccacucuugcuuauacguaacagacaguucuuauccuggcccuccacauggugucggacagcauuuaaagguaccugugacuacgcaauacuagcguuccuacacuagcgagacuuaaaauauuuuaagugugaaaaaugugggauaacuuuuauugagcacucuuacuaaaguucagagguuuaaaaaaagauuuauuuaauauauuugagugcucuagaagagggcaccagacuucauuauaguuacaacccaucaugguugugagccaccaugugguugcugggaauugaacucaggaccccuggaagagcaggcaguguucuuaaccacugagccaucuccccagccauaaguucagaggguguuuguuuguuuguuuuauagaaaauaacacaugaugauuuuaguaaacacagggaagauuuuaucauuagccaacuuguuauuuuaauuauaagaagauagauauugcaggacucaaaaggagacaagcccuaaacagacccagggcauuugcccacaguaacaaggcacucaguaccgcuugaugggaugagcaguuuaaacuagaagggcaccucucagguucuuaucauuauuuugcaaugguuucuauuacacaccauauagaaaacuuugaaaagacuuugacuuugucuuagucuuuaccauuuuuguaaaaugggacaaguugaaaauuagguuucuuuugagauaaaacugaaucuuauccaagguagcucaauagaguguuuaucuguuagauacugacuacauaagaaaauuuuaaguguuuacugugaugggagaugcugagggaauuggaagugcuugcucuguguaagcaugaggcccugagguaagaugcccagagcccacauaagcaggcuguggugcugugugccuguaagcccaggcuucaggcuucucccacuguagaaggaagugagauggaagggagagauggaagaauccugcaagcaugcaggucaucgagcuuggugcacacagcagcgaacaggaagagucugucucaaacaagguggcaaguaaggacugccccuggauguuguccucugauggccacaccugcuguggcacucacaugccucuacucacacacacacaaacuuguguacaugcaaacccacgcacaucauaaacaaacaaaaagaaauacaugcaucccuaaaauauuucagaauucuuuggucagaaucuauaugaauaagagagauagguuaccuuaucuaugagguggcucugucacuguuuuaugauaguaaguacuacacaucuucaaggggauugugcaguguccucugauagcagagcagccaugggaaagauuaagacaggcgguaucuuuuuuacaaagaaagaaugaagcucagagaaaggccacacaucuagacuuugaccuuuguguuaucucagagaugucucaguguucuagagaugguuagguacagacuagcuuuaccuguuuuuugcuaucuuaaucauugcuuucagcagaaaacuuucuaggcaaagcuggaacuugauugaauauaaauaguaguagaugagccauauuuucuuucugugguuuaugaauaagugucagaauguccugaaguuacaggaacuuugcauuguauuauaguguuagcugaagguaauuuguuguuaaaauguugaguuuuccaagaauacuaauaauucuaaagaauuuggggaaugcuuuuauucugucuuuauaucuaacauaagguugguauacaugccucuaagaguauuggaaaguuuuuugacuugauauuuuauuaaaguuaacagauuacagacugaggcucuuaaugaaauaccauguaacgucacaucuucuucacuucccaggaugaagaaacacggaaggauuaugacuacaugcuggaucacccagaagaauacuauagccauuacuaccacuacuacagcaggcgccuggccccaaaaguggacguuaggguggugauuuuggucagugugugugccauuucaauguuucagguguguauucgugaauauauauaguucuguguguaaauauauuuuuguugccuagugccauuaaaucuguauuauaaauauacuuuguaaauugguuuccaguugagauuuguuuuuuuuaggauuuuuuaauuguacauauucauuaugcauugugcuguaucacaugaugcgucucuucacacacguguguuacacaugcgcacacccucuccaaggccccugcaggagaggcuuugucaucagggagucuaaggaacuaguggugacuagucuaccaguuguuuuucuauugcugugauaaaauaccagaacaaaaauaacuuggagaaggaagaauuagcuguggccuacaguuccagagggagucccucacagugaggaggcaugguagcagguggcccgaggaggaagccggcugaugacuuucaccacaguucaucauggcaaaguggagcgaggcuacacacucucaaagcccacccgcaggcuugcacuuacucuaguacagcuccacaccuguuucagacccucccaaacagggccaucaaacacuugaaguuacagggacaauuuccauucaaaccgccucaaauauugcauacuauaaaacaaacaagaaacauuuuuucucuucucccuccuaagaguauuuggcuaccacauaacagccagaucauaucaucaccuuuauagacuuuucagugauuucucauaaacuugggaaaaguuaagaacaccuugaccauggccuaauaaggcuggcuucccauugauugaugcuagcggugcuugccuucauuagcauucccaaacaucgcacgguccugcauccccggaggagccgcugcucacauucaaggagauagaggaacucuuggugugguucuaaacuaccacagagucugaguucagcuuggagugaugucuugagcuagccacgccuaucgugugcucgucuggagggagagggcuccucaggaagaaaacagucagcaacuuugagaacuacuuuuaguuuugaaaaggcuuuauucuuaugcguaucuguguuugccugcacguaugcagguguguguaaccaccagugugccuagugucuguggagcccagaagagggugucauauuuccugcaguuggaguuacaggcgguuguauguauccguuugggcuucuuaugugucugccucaguucccgaaucaugacacggagacuuaugaguuauuaaugccuaggcuugcucccuaacaagcuccuaaguggguuaauccauuuauacuaucgcauggcugcagcauggcugcuucccucuccucgguuucauacguccaacuuucucugagucuggguguugaaucuuccaauucuggcuaucucccagaguuccaaucucucucggaacuccacuuucugcuuccugccuuuugcuaauaggccaucagcuuuuuauugacagguguuacuuccacucaguacacgagacauucucccuauaguugugugagcuggaaaacaaacggagguguucugcaaggagauaauguguucuuaaucuuugagcuuucucucuagcccuggagauugcuucucuagguuaacugcuagaaacaauuuucgguuuauauaagaaaaauucuuauuaaacaccgaggugguauauuucaacuacuagcauuuguagaaguauugcccuccucuucuuccugcuguuucugguagaucccaggguguuacucgugugggaacugaaccaugugugugcuguaugagagccaaaugcauagaguucaaauauaccugagucuuuguuuuagaauaugguaagcauuccugucagacguguagauggcuuaagaaagagaaaaaguaauaguuuccugagaccacacccuguccaguuuuaaaccaaugucuuccuagcuauuaugcaguuuagucuuccucuggcaggcaaagggaagggagguguuuuacuaaugaagaucuuccaggucacugcuguuacugguuuucugagauagguucuuucuaccuugccuugguuggucuccagcuccugaucccccugccucccgccaagggcuggggcucgaacaggagacagcacaccugucugagguucccgcuuuccgucggcuggguuucuuggggcauucacagggauuucuguuguggcuuucuuuugaugagcuuugcuaguaaagugacuuauuuuuauuuauuuuauguucuaguauuucagcugguggaauagcuacaauaaagcaaucagcuaccuagccacagugcccaaguaccgcauccaggcaacagaaaucgccaaggagcagggacugcucaaaaaagccaaagaaaaagggaaaaacaagaaguccaaagaagaaauccgugaugaggaggagaacaucauaaagaacauuauaaaaaguaaaauagacauaaaggggggcuaccagaaaccccaaguucgggaccuccucuuguuucaggucauccucgccccuguucaccugugcucuuauauagccugguauuguagguggaucuauaacuuuaacaucaaaggcaaagaguacggggaggaagagagacuuuacauuauccggaagucuaugaagaugucccagucucaguuugacagccuggaggaccaucagaaagaaauguuucucaagcgggagcuuuggauaaaggagaauuaugaggugagugccaguggcugcccccaacacaugcucucugccacacugcagguccauagugucacuucagaagucccagaguucaaagaugacugcagcuccuacuuuuauugaaaaaguggcuguguuuuauagugggacaauggguauuuaacuuaaauuuguuuuuuugcuuuuucuuuucuaaagcaguacuuaaaacauacuaaucagcuaaucuuggugaaaaacuaagaguaaucugucagauuguagugcagugccugugcacggaaucuaacugucagauugcagugcagugccugugcacgggaucuaacugucagauuguagugcaguggccugugcacaggaucuaacugucagguugcagugcagugccugugcacgggaucuaacugucagauugcagugcaguggccugugcacaggaucuaacugucagguugcagugcagugccugugcacgggaucuaacugucagguugcagugcaguggccugugcacgggaucuaacugucagguugcagugcaguggccugugcacaggcgguuuuggugauuucuguucuuugcacuaauuaaaauuuuccuuuccaaaaaggaaaacagaaaaagaaggggaaaaaaaauaaauuuuguuaaaauagaaucuucugaauaguacugucacauuuuggaauguuauuugcuuucaguucaaaacaaguuauuguaaugucuuuaaaccugggccauuuuaucauuaaguauuauuuuuuauauuaucagcuacagaaguuauucagaggagcucagcuaucuagccacagugcugaaggcuccagcaauugcaguggccuguauuacggagacagugguuggcuaauguaagaauguaagcauugagcucacgaaagauucuccagcaauuuaagaaacauuagguguuguguucuuuuguagucagcuucauuuuguauguaauguucaagauagguuuuuauugagaacaaaauuaguagaaauugucagauguuuagcaaguaaauauauuccuguauauaaauuaccuaaaaaugggagguaauguacaauaauuuagcucuuaauacuauuugaagggauggguagcucuuggucaggucccugccucacagacaugacggcuucagcuugggcucucagaaaccgcaugaauuuggugaagacaaguagauccugggugcucauuguccagccagccagccagccaaauccaugagcucugggcucagugagagagccuguuuuaaaggcugaugauggcugaagggcugauggaaaaaagucuuaucaccucugcuugcuccacgugcucauaagcacacacaugaucaccaccauccacacgugcacacacaaccacagcacuuugaaagauuuuuauuauaaacccugacuuuucaucaucauuguauugggcugaauuauuauauuaugagguuuuuauuggucaucacuuacaauauuugaaagcaguaauuuuuuaaaauguggcuauaaaacugacuguaagaaguuuuuugguugacuaaagcuuuaagaaauaauugauucuuaaccuaugugauuuauacaacuuuuuuuugauaacuuuagagaaaaaaauaccuaauaauuaucuuugaaaaguagauuuaaauucaguuuggaggcaaauauauauauauaaggccaauuuguuccuugguuagggaaaaaaauuguuaauccaggccagguccaaggaugguauuugccuguguauaauccuagacauuagaagggcugagacagaggauuauuaauucaaagcuagucagaauuacucagcaagcuccaggccagccugggcuacauugcaagaccccaucacaaaaacaaaacagaagugguagcucuuguuuuucucacucuggauauucaaguacuuacuuuaguguuugagucagucuccaggaagcagagcaacacgcucaccuccagguuucucucuguaucauaaagucauuucguguuguguaugcucacaggucuacaagcaggaacaagaggaagaauuaaagaaaaaauuggcaaaugacccucgguggaagcgcuaccgcagguggaugaagaaugaagggccuggacggcugaccuuuguggacgacugaagaagcugaggugcugcugugccacacucuaauugugacgacacuugcauagcaguuacuugggaaacacgccugcugcucucagcaguagcuaacguucaaaacauaugauuaaacagaauaauguagaaauuucuacuuucccuuaaaacuuuauacagaagacauuuaugaugguucaauuuuuauaaucuauuuguggauuuuguuuaaaaagauuucacauggggacuuauuaguugccauuuaaaauuuuuauauguuuaguuaaauuugacaugaaauuuauuagauaccauuuaaaacuucugugugaaguguuucuucuucaagaguguuugcuuauguucucauaaugcuaauuuuccuccuuuccuggucuccaguuuuacaaaacaacaacagaauaaugacaacagcacuugaucagauuauugugucuuucuggacacaguuucuccaggagaaccauucaguaacauauuguccuuacuguaguccuuacagguuugagccuacucaacguauucucuaggagaguauucuagaaccucugcacuuccugcccagugauucuacucuugauaagaucagaaacucuccaggagaguggguuacaucauguccuugugggauguuuucaauuacagucucauuauaggacuaacuuuucucaaacauuucugcagaggggaccuuguaaaaaggucuuuuauaccaccaacuu

SEQ ID NO: 1924 - RNA, 966 nt, Mus musculus
ugcaaugaaaguuucuuuuaguauuugauuguuggguagaaaagcacucagauuaaaaccgugugaaagugaagauggacuucaguccugggcagucucaucuacuucauuucuuucccaaccacaccuauccguccagugcaggucucggaggucagggucuggcggacaggcuaccgucgcugcucucagguccggaaagaccacuguccaccccugccccguggacgucgcgcggguccccugccgugcugccagcagugucgcccgccaguaguaacucugcucugcuucaaaaguucccugggguccccaggcuuuucuagccagcaccguucagggcccuaagccugagucccgggagccggaaggcccgcgggcuuguaggagggcgagucgcgaagcgggaagcacaaggcgcgcguucccgcgaacgcaggcgcgacgcugggcggggggcgcgcacgcgcgcggaggcaugggcgggggugguggugucggggcggggcaaagaggcgaaggcgggaagagggcgcccuggaguccagccgagccccgggagggcgucgacgccgagggggcggggccaggcgaggcgggaacgcgcucgcgggccgggagggcgggggcgcggcgcuggcgagagcgugcccgguccccgccccuguuucccacucuuccuuccaccucugaccggccggagcugcggagcggcuccgcucgcugguuucccggagccgccgcccgcuuucuccgcccgcggugagcccgucaauccccgcacaacgcgcuccuccaucugggccauggauggguaagugccggguggccguuccggggcugcgcuggccucguuuccucucggcgacgcgucccgccgaggccggggagcagggcgcgacgccggcuagcggaggagcggcccggggcuaagcccgacggcagggaccuugggagcgcgggggu

SEQ ID NO: 1925 - RNA, 1336 nt, Mus musculus
auaauacguuuuuauuugaauauuuaauuagggcuagagagaugguucccugguuaagaguguugugcccagauuguaaaaaucccaaggagaggaccaggaaucauaccccacuguaaucgcaugagggucuuuauuuaagcucgagcuugggccaccaaccuuccugacagaacaggaaagagugaacccccaggccuaaguaaaggggguuuauaaagaaaaaaacccgcaagcggguuuuuguguuggcaauauaggagaggguaaaggaaugcuguccuuuaaaccugauaacauuuguucagacagcagggcagaaccguguagcugaaaagguaccuuucugaccugggaagaguaacuugugcuaucagaaccgcuucugauauguuuacaaccggccacagcugucugggaacguuugucucuuuuucauagucuaagagugggcuauuaucauuucaaggguauuggcuucgguuuccuucaacagcaaggagccaucugcacugugagaaauguugguuguuaaucaaaaggggucgaguuuaagugacguggaggcuaggguaugcugcuuuucuuuuguucucaaggcuggcauuugccuuuccccaccccccgcggggguggggguaucgucagggagagggagggaguaauaacugcucuagcugcgcagggucaggagaguguaggauuugaugugcagguuucucuugucugagcacuggcugcucuuccaaaagauccagcaaguuugacaauuaggagaguauauaccuaccugucuuaaguuguuuucugaacuaagcuuuagauaacaaccucguuagcaucuuuuucucccgcuacaaaauacaaaacaauuucauuuccuggguagcucaguuagguauaacuccaagaacgaaacugaaucccagacucgaccucauuccggcauucauuccaggacugaggauuccuucuccaaccuugauuucuguggcccggaucauacgaugaacgcuugcgggagaccuuugcaaagaucucuuccagaaacuccugucuccagacacuggaggucaggcuaaauuuagauucaguggcagcgaaaaugagagugaccggcuucugcaaaaagcauuuuucagaugucuacaaguguucuucggagagagcgccuuggcucggggacagacaggggaaaacgacgcccagcacccucaagucaguccccggagcgccccucaauccgccaucuggcuggcugggagccgucgaugcgccgaaccuaggcugaggaggaaaagccuacguaguaaugaugcucuagacacgccagugg

SEQ ID NO: 1926 - RNA, 2269 nt, Mus musculus
aggaacuuuccugaacaagugaguaucuguguuuauaauguuuaaaaaggcuugguguauuccagcuucacacacacacacacacacacacacacacauacauaaauaaaaugugauugaaacaaguaccuaacacuucuggcaaaaauacuaaagcaucucagggagugaaagaccccugggauccuucagacauccaaugaaggcagcaagcuguguauaaggaaacaggaaugucaggcuuccgaccucugcagcuccaagugcugagaaccaguaggauuuuaaagagaaagauuuaccuucggaguuuuauguuucaauaucuaaaauauuuuuuaugauaaaguccagcuacccugcagcuuacaaaaccuaaucuaaaauaaauaagucuaauuucagugucuguggagugauaaacauuaggucauuauccacuagaggagagagaggauagaagccaugcaucugaaaaugcccagaguccucuccugaaugugcugcuguguaaggugugucuaaagguaaagaugguguuacaguauugaauuuuuauuacugaaauaacucauggcaauuagaaauagaaaacccagauacagcuuuuuaaauaaaaucuaaauuauuuuagacuuuuccuaccaacaguuaaagcauccuuguggaaaagaccauuguuuccaaguggccaaagccagggaucacacacacacacacacacacacacacacacacacucucucucucucucucucucucucucucuguucuggaaucccugagagagcuaggccugcucgcuguaucacaugugcugcuccacucuccccaagucagcaacaacagguacaacauuugacaguuacagaaugggucuaugccucuuuuuaaccaaaugcaugggaagcuggagagguggcccaggggcgaaacacugacugcucuugcagggaauccagguucaguucccaacacccacauaggagcucacaacugucuguaacuccaguuccggggugucuagcgcccucuucuggcuuccacagucgccaggcuugcccauggugcacagauauucauguacacauaacaucuguuuagaagauuagaacaggaaaaaugguauguucuggaguggaaacauaaguuagauuuuaauuucaggaagcuggccaagguggugcuuuccuaaauaauacuuggaauucuagacaucuguccaaguucaaguguugugagcauggggguguagcucagcggaggaguacuggcccuaguuuuuuuguuguuugauaccagguuucacuauguagccuuggaugaccuggaacucacguagacugggcugguaucaaacucacagacacucacccaucugccuccuccaggggcuggggcuaagggcaugugccaccacgcccagccaggcccuaguggcaugggaagcacauaaggacagaaacguggaagacacauuccuucuggaaccuaagugucaguguuagcacuaaaaccgguucucuuguuuucauuugcuugcccaggacacucuuaaggacaggagugagggugcccucagccuccucacccagcuucagcagcagaguguguuccuagcugucaacuagacucucagugacccccaggaguccgcagauggcuuuguguuugcuuaguuuuucauucuggaauacugcaaacccuguccucagagacccgcaaucucuugaggguggagaccagguauaagcuuuccaggguuuucuugcuuagcugugauggacugagucugacuuuaccguacauaagugaucuguugucuuaagauuuucguguuuucuaugugacuguuucuucuuuuguuuccuuuuuuuuuuuuuuuuuguaacaaaaauguguuuguaauguuuuuauucuccuggguguuuuuaaacacacugucuuucuggcuauuguucauucacugaagacugauuuuuauuguacccguuccaacuuuuucuccccugguggccacacuugggaacacacagaugugcacagggagccgagagcugcaagcugugccgcugucuugucccugucugccuuggaagguuuuccugcccucugguugauggucuaguagaaucuguuacuacuuuggaauguuugggcuuuguuuguucguguguguguguuaaguuguugguugguuuuauucauggauaugcagcuuuacucuuuaacccagauuuaaaaaaaaaaauaaaaaauaauaauguac

SEQ ID NO: 1927 - RNA, 2269 nt, Mus musculus
guacauuauuauuuuuuauuuuuuuuuuuaaaucuggguuaaagaguaaagcugcauauccaugaauaaaaccaaccaacaacuuaacacacacacacgaacaaacaaagcccaaacauuccaaaguaguaacagauucuacuagaccaucaaccagagggcaggaaaaccuuccaaggcagacagggacaagacagcggcacagcuugcagcucucggcucccugugcacaucuguguguucccaaguguggccaccaggggagaaaaaguuggaacggguacaauaaaaaucagucuucagugaaugaacaauagccagaaagacaguguguuuaaaaacacccaggagaauaaaaacauuacaaacacauuuuuguuacaaaaaaaaaaaaaaaaaggaaacaaaagaagaaacagucacauagaaaacacgaaaaucuuaagacaacagaucacuuauguacgguaaagucagacucaguccaucacagcuaagcaagaaaacccuggaaagcuuauaccuggucuccacccucaagagauugcgggucucugaggacaggguuugcaguauuccagaaugaaaaacuaagcaaacacaaagccaucugcggacuccugggggucacugagagucuaguugacagcuaggaacacacucugcugcugaagcugggugaggaggcugagggcacccucacuccuguccuuaagaguguccugggcaagcaaaugaaaacaagagaaccgguuuuagugcuaacacugacacuuagguuccagaaggaaugugucuuccacguuucuguccuuaugugcuucccaugccacuagggccuggcugggcgugguggcacaugcccuuagccccagccccuggaggaggcagaugggugagugucugugaguuugauaccagcccagucuacgugaguuccaggucauccaaggcuacauagugaaaccugguaucaaacaacaaaaaaacuagggccaguacuccuccgcugagcuacacccccaugcucacaacacuugaacuuggacagaugucuagaauuccaaguauuauuuaggaaagcaccaccuuggccagcuuccugaaauuaaaaucuaacuuauguuuccacuccagaacauaccauuuuuccuguucuaaucuucuaaacagauguuauguguacaugaauaucugugcaccaugggcaagccuggcgacuguggaagccagaagagggcgcuagacaccccggaacuggaguuacagacaguugugagcuccuauguggguguugggaacugaaccuggauucccugcaagagcagucaguguuucgccccugggccaccucuccagcuucccaugcauuugguuaaaaagaggcauagacccauucuguaacugucaaauguuguaccuguuguugcugacuuggggagaguggagcagcacaugugauacagcgagcaggccuagcucucucagggauuccagaacagagagagagagagagagagagagagagagugugugugugugugugugugugugugugugugugaucccuggcuuuggccacuuggaaacaauggucuuuuccacaaggaugcuuuaacuguugguaggaaaagucuaaaauaauuuagauuuuauuuaaaaagcuguaucuggguuuucuauuucuaauugccaugaguuauuucaguaauaaaaauucaauacuguaacaccaucuuuaccuuuagacacaccuuacacagcagcacauucaggagaggacucugggcauuuucagaugcauggcuucuauccucucucuccucuaguggauaaugaccuaauguuuaucacuccacagacacugaaauuagacuuauuuauuuuagauuagguuuuguaagcugcaggguagcuggacuuuaucauaaaaaauauuuuagauauugaaacauaaaacuccgaagguaaaucuuucucuuuaaaauccuacugguucucagcacuuggagcugcagaggucggaagccugacauuccuguuuccuuauacacagcuugcugccuucauuggaugucugaaggaucccaggggucuuucacucccugagaugcuuuaguauuuuugccagaaguguuagguacuuguuucaaucacauuuuauuuauguaugugugugugugugugugugugugugugugaagcuggaauacaccaagccuuuuuaaacauuauaaacacagauacucacuuguucaggaaaguuccu

SEQ ID NO: 1928 - RNA, 957 nt, Mus musculus
acugcauauguuaauaggcacguuaguuucaaaguguucuguaaguguaugucuguguuuaguuuauauucuacucuauacaucuucaagggcaacaaguuugguuuuucucccucugguccuucguuggugugcgcguccagaacaaucccugguauguuggguaguuauaccuacuguuguugaaggaguaaauauaagaacacacccaaccuugguugccacauaagaauuucucugacuuaccuuuuaaauagagucucccacugaaacugaagcucacugauuuuguuagaccacauggccaucaagccccagggguccuccuccucuucaguacugggauuauaggcacgugccaggcuuuuaugugggugcuagagguuaaauuuagguccacauugcuuguaguguuacaauuugagucuucucuacuuucccaaaagguguuuguguauguguuuugcuuuuaacaugagacauggaagauaaauuuugacagccaccaaauaauugaaaugauaguacuuuuauggugccagaauaaaaccaaaauggcucaguaguuuuagaggcagguaggguaguuuuauuccuccuuccacgggaucagugagagauuucauuuaauuuugcuuuagcaggaaagagccuccugaguucaaagccucguuaggcaaaggcuuuggcaagauacaguucugagaacagaagaugaacagaauugguaauuugauucaaccccaccagcacauucucaccagugaccacaaguccuguugugacuuuuaaagccaaccaguuaggaagugccuucccuauuuaucugcauugcagugcugcacagugcgugcccuuggugauuuuuuuccccuccuaacccccccccccuuuuugguaacaaauaaagaaugaacauggaccguaaaggggauggagagggaacgcugucauugu

SEQ ID NO: 1929 - RNA, 31955 nt, Mus musculus
aagaagaagaagaaucugaugauaaugaugaugcaguaauugcuuguagguaacacccaacauccaccuccugcuuccauacaugcucacacacacagaagcacagaguaggguggggggggggaggcuagaaguccaccuucguuugggucuaugugugcagguuuacauguauccgugugcauaaacauggaaaccagaagaggaugucaggugucuuccuccuuacucucgugagccaggucucucagggaacuagaagcccaacaugucagucagccaggcuagcugggcagcaugcucuuaggguccaccugugcugcccaccuccagcacugagguuacaggcacucagcccaccuuuaauaugggugcugaacucaggucuuccagcaagcacucuuccccaccagccccucccacuccccgcauuuuuugagacaggaucucauguguuccaggauggacucaaacuucuauuuagccaagaacuucugauccucaugccucagucucccaagugcuggauuacuugaaccacacgcgguuuaagaggagcuggagaugggacagaggcuucccacaugcuaggcaaagcucucugccaacugagcugcaucucagacccacccucaaacuaucacagcuuguuuugguggugguuuguuugguuugaacauuuagcagguuuaaauuuuagaagaagucagguggugguggcacaugccuucaauccuagcacgccagaggcaaaggcagguagaucuccaugaguccaaagccagccuggucuaaaaggcaaauuccagagaauuacccagagaaacccugucacaaagagagagagagcaggugggaacauucagaugaacuagacugugagucaacuccuuccauaucucagcuuguggaguguaucacaaaagaaaggauauuuucuagaacucagcgguagacucuugguaggugcgggccucagcuggccauagaaaugcaguuugcugccauaaccuaaggcucucugcucuccagcucucuucaagcaaguguuggcugggagugagguagggauggacgugugcuccuuuguugugacugcucagcauagucuaggcuggagaagucauggagcuaacaagcauuuggaaaugcugacauugacuuggauuagcagugauucucugguuagaguggguauggcucaugaugacaucuucuaugacucaaacgucuauuuagccaagaacuaguuaagagucaugugagguuuuuuuucuaguuuuagcugccccucugcacacgugcguguguguguguguguguguguguguguguguguguaugcaugugugggcacgcaugugugaguaugagagcaauguaugugcauguguguauugaggcucaucacuaggaaaugucgcuaaaaagcaucuaaaaguugaacucucacacauuauaugaccccuauaaaacagaaaacauaugaauaaguauuacagcuagguguaguggcacaaggcuaugauuucaagggccuguggcugguggauuaugaguugaagaacagucuggacuacaaagugaguuccaggcuagucugggcuauauauggagaugaugucucaaaacagagaaaguucugggucuuggggacacaccuuuaauuccagcacucagaaggcagagguaggaggccugccugcaaauuccaagacagucaggacaacauagaaaaacccuauaucaaaaaucugaggaggagccgggcgugguggcgcacaccuuuaaucucagcacuggggagauagaggcaggcagauuucugaguucgaggccagccuggucuacaaagugagugccaggacagccagggcuacacagagaaacccugucucaaaaaaaaaaaaaaucugaggaggaaagaggagaagaggaagggggagagggaggaggaggagaaggacaagagaugaggaggaggcagagaaagagggacagauguugggcaggcauagggaggcauacauauacuugccagaagaugaaucacaacacuagguaauugugguagagacauggcucagccaauaagaguguuuguugcacaagcaugagggccugaguuagaacccagcugugugcuaccuauaacccuacacuauaggcaugagaguaaaaauggcuggcugcggcugguucgagguucagggagaggccuugucaagagaaucagauaagaaugauacaacagggacaccugaugucucccuguggccuccauaaacacaugcucucauauaucacacacacacacacacacacacacacacacauauacacacgcacauacaaagcggggcagcuaagacuaggaaaaagcucacaugacuuaccaacacuguaaugcauaaguaaacauggcauauuugaauaauaacauauuacauauccauaacaauggaaggaauacaugaugaaugagucucgcaauuauaaugaugauaaaagccaggcacaaaagaauaucuacuaugugauucuacuuauauaaaauucaaagcaggcaaaauuaacauauagugcuaagagaaaguuucuuacaccuaaagggaguucuagggguaccgauaacauucaguuccugaaccaucagguuguuauuuguaagaccuuuuuuuaaagaaccuugaauucuuuuuuuuuaaagauugauugauugauugauuauguguacacuguagcugucuucagacacuccagaagagggcaucagauuuuuguuauggaugguugugagccaccaugugguuacugggauuugaacucaggaccuuuggaagagcagucagugcucuuauccgcugagccaucucuccagccccuauuuguaagacuuuaaguagaccacuuaugauuugcaaaccuugacggucuguugcauuaauuuuauguuuuaggcccaggaagagucucagggggguaaagacgcuugcugccaaaacugauuacccaaguucaaccccugggacccacguggaacaaggagagaacugacuccugcaggcugucuuauaauccccauuauacacgccggggcacacgaugcacaauaaauaaaagcaaugggaaaguuuauguuuuuaagaggcaucuacucuguguuccucgcuuuaugaaugaagaggugaggccaucccagaaguacuaagccacuugguggaugucaaucagccaguacucuucucugcuugguuucauguuggugaacgccugagucugagagcaggcuacuuuagauaaagcuaggaagcugggcuauggcucagugguaagaguaugugcuuguuuuucagcgaugcaguccgaccccaagaggcgacccaugcgcaacuagcagcacugaguggauucagugacucucaaaacaaauacacaaccaacccugggagggaguaguaugaaggcguuaaaggggaggggagugaguggaccaaaacacaguauaagcauauaugaaauccucaaacaguuaaaaaagaauguguucuuagcaugugugagccugggugccauucccagcuaaaaccaaaagcugcccugucaucagucuccuacgauguuucauuaccuucuugcuuguaucaugccaggucuccuccuuucaaaugcaguccuguguagacugaugccuggugccacggcagccauccugugguccugacggagccaucccugauacccugaggauagcuguacguguaaguggaaaagcccagccuucaaugaugucuacuuugcuuucuauugcuguggcaaaaauacccuggccaaaagcaaaucagagaagaaagguuauauauauauuucaucuuagucuucuaggucacaguccaccauugagggaagucagggugaggagcucaaacagaagccaugaaggaauaauguucauuguuuagccuuuuguuuugcucagcuagauuucuuauucugccgggacucaccuaccuagggauaaugucucccauaaugcacuggacccucccucuucacucaugcgugaaggcacacucucacaguuauagccucagaucacuuugaucugggaaauuccucaauuaaaguucccucuuucgggcuggagagauggcucagcagguaagaacacugacugcucuucaaaagguccugaguucaaaucccagcaaccacaugguggcucacaaccaucuguaaugagauuggaugcccucuucuggugugucugaagauagcuacaauguacuuacauauaauaaauaaauaaaucuaaaaaaaaaaaaaaaaguucccucuuuccauugauucaagguugggucacauugacaauaaaaacuaaccagcacagacggucccauuguaccagugcggcuaaugccagacaggcuuacuauuagucaugugugugugugugugugugugugugugugugugucugugugugucugugucugugugugucugugugugucugugucuguguguaugugucugugauugugccacgguacaaaugugacaaccagaggacgacuuauaggaacugguccucuccuccuaccauauggguuucaggguucaaacucaggcugucagacuuggcaagaggugcuuucauucccuccugcucacaccagacuucuuaaccgcuuacacuuucagaggugcagucaauuaucaucauggcagagagcauggcaccagaguuguaggugagagcuauaucuugauguguaggcagagguggguggggagagcugggguggggggcuuuugaaagcuaaagcccaccccaaguagcaaccacaugguggcucacaaccaucuguaaugagauuggaugcccucuucuggugugucugaagauagcuacaauguacuuacauauaauaaauaaauaaaucuaaaaaaaaaaaaguucccucuuuccauugauucaagguugggucacauugacaauaaaaacuaaccagcacagacggucccauuguaccagugcggcuaacaagaccacagccuucaacaagaccacagccuucuuccuucaacaagaccacagcccccgacuuuucacaaauagugccauucuccuauggugugagccuguggcagccauucuuauucaaacuaccacagauagcaauaaggaaaaggcuguaagugugcaggaaaaguucuaaaacagaggagaaguggaugguaucucuggguucugagggcaaaguucuggcuucuuccccaagccucugaauuccucauucucagagccauggugccuguuccuguguguucugcucacuuccuccugagggcucuaacacaggugacagaagguucugcagguccacagaugagcccccacuacacagaccgggagucuagauauggcacaacuccuuacucuguguaacucuaaacaguggagcaagggcuguaggccacucuagaaaacuagagucaggggcugggcauggagcucaguugauagacuguuuaccuaggaugcccaagaccuuugauaccauuccuaacacuguaaaccagacagagugguguacaucuguaauugcagcacucagaggguggaggugagcagcucacaguucaagguccuccuuaacuacuuaaggaugaggccagccugggcuagagaccccuagcucaaaaauagucaguugccugauuauagauuccagcuaaggcagggcuucccauguacacauaugaggucauugauucugcaggcguuuuaggauucuuggacuuggugagaagcuugcuuugcccugucuccuccacugagagcauccuguuuugucccaagaacaccaucgccaucaccuugcagagcacgagaggaccaggaagcugccuuaacaugugcucacucaucugauuaccucugcuggcugaaacaguagcucugaacuuaggcuaauaaauggaaacuucuagaaguuuaaacugaugaaaugcucaaaucuucaaaaucaaacccaggccucuucaagacuuuguaaacgacgcaguccuaugcuagaaugugcacuuugcucccaauuuugagggcaugcuguauaucuuggauccuccagguuagcuucguagugagguucucaucucccaaauguacucauucugcaaauucuuggcaucaggucaaggcaggcugaaguucucaggaaacaccacauauccuggaggcuuuuuuaaaaaauauuuuuuauuacauauuuuccucaauuacauuuucaaugcuaucccaaaagucccccauacccucucccccacuucccuacccacccauucccauuuuuuuggccuuggcguuccccuguacuggggcauauacaguuugcguguccaaugggccucucuuuccagugauugccgacuaggccaucuuuugauacauaugcagcuagggucaagagcuccgggguacugguuaguucauaauguuguuccaccuaaaggguugcagaucccuuuagcuccuuggguacuuucucuagcuccuccauugggagcccuaugauccauccaauagcugacugugagcauccacuucuguguuugcuaggccccggcauagucucacaagagacagcuacaucuggguccuuucaacaaaaucuugcuaguguaugcaauggugucagcguuuggaagcugauuaugggguggaucccuggauauggcagucucuagaugguccauccuuucgucucagcuccaaacuuugucucuguaacuccuuccauggguguuuuguucccaauucuaaggaggggcauaguguccacacuucagucuucauuuuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaaauccuggaggcuuugaugcuaacaauuuaacacugaagagggagcaaguuucuagauucccccugaccagaggauuucugcagucucacacagcagcaccauugcuacccagaauucuuuggaauauugauacaugguguggugguuuaaaugagaaauguaccccgcaggcucaaauauuugaauacuugguccccaguugguggcgcuguuuuuggagauauugcagucuugcugaaggaaguucucacucccaccacaugggaucaagcuuagguccuuagguucagcugcaaguacuuuuaccacuggguucucuacuugccaggguucucuagagucagagaacuuauggaauuaauuuuuaaauauggaaucuaccuaccucuauuuauuaucuauaucuacaucugcacacacauguauacauaugcauacauacauacauaugaggaauuuauuggaaagacuuacaggcugcaguccaaauaacugaacaauggccagcuaugaguagaaagucuaagaaucuagucauugcucagucccaccagucuagguauuuucaguuggucuucuguauaaguuguaaucuugaagaaguaggcucagagggcuggugagauggcucagcagguaagagcacugacugcucuuccaaagauccugaguucaaauaccagcaaccauaugguaaucacaacacacauaaugagaucugaugcccucuucuggugcaccugaagacagcuacaguguacuuauguauaauaauaaauaaaucuuugggccggagcgaacaggggcucagacuggagugagcagagguccuaaaaguucaauucccaacaaccaccugaaggcucacagccaucuguacaacuucauaaauaaauaaauuaaauuaauaaaucuuuaaaaaagaagugcuagcaaaugaagcaaaugaacacaagcaaaugaagaaugaaggaacccuuccucuuuccauuguccuuacauaggucuccagcagaagcuccugucuuucaggcucaagauccaggucauaaagugugcccuccauuucuggauugaaguccauuccagauguagugacgaugacagacaagaauagccuucccaccuacugagguuucucuccagcccaaagcccagcuacucauaucuauacaccuccauauguuuccaguuuuagagaggauguucuuuauuuugaugagacagcuguugaucauauauggagaagcuacacauauccaccuuuuccaaugaaguuucagcaggguuugggcuagaaggacaagcaaagcugagugugaaugaaugucaucugucugcagcuccaagagguagugagauccaagguuguggaaggcugaauaaagugagcagccagaacuuagggagccaaaauaagaagaguggagacagagacgaagauauuagaaaugaagaacagagccaggguucgagaaucaggagcagcagcauccagggggcauugggaccacugagugcugggguggguacaugguguggccugggacaauugagugcuggacuuccacauggagagggaaggacaauuagaauccacagucacagagagugccucugagcuagcugugcugguggcaguagguguugacaaacgacuccucaaaauuccuuccugaccauccguauaauuuguucaaauuaagcacuagguugcagucgcauagacuauuucugaagcccaggcuuuugguucccucaggaaggauguggcuggcaguaggaauggagccccuccuccuucugguuuaaaauuuuauuuuagaaugcucuuuagauguccagaaaagauucgaaguuggugcagagagguuuugucuuacuugguaucucccauggucaacaucaucugucaucaugucacauucgucacagcuaaggagccaacucugccauuaacuggaccgcauucuccauucagauuucacuaacauuuucuuaauauucucuucccaguucaguaucacaucuaggauaccccauuacacugugugugugugugugugugugugugugugcaguguguagcaaaaauaaagaaaaagaagaacaaggcugucaguuugagagugaguuggcagguagagaaggcuggaaggaggggcacgagagagguuggagcaaggaaagguaaagagggaagugauguaauuagauuaaagaaagaaaugggaaaaagaaagaaaacacccucacagauuugcauacaggcuaaucuuauggaaguauuuucucaauuaaggaccccuccucccaggugaaccuugcuugugccaagcugacacaaaauuaagcaguacagagcucuuccagaggauccaaauuuagucccaguacacauggcaggcugaucacaaacgauuguauguaacuccaucccaggggcaccuggugcuaucuucuggucucugugagcauccaggugcaugugcacaccgacuuggaaaagaagagaaauggauaggauguccacacauauguaugauacaugcacacauauauaaaugucuauguguuggucaggcuccacucccccacccauaguggcauaauugcccgugaucacaaaugaguagcagaacauuggggggugggggaggagaauggccaggggaauggagaccucaggcagcaagugagcaugcugagaacagccucuugggaggcaggcuuccgcuccuuuaauugggagaacagaagcuauuuaaaccuuuagggaguagguaggggucuuugggggagaguguaaaucauuggccaggaccagggugcugaggaugucuuguauacauagggaagaauuucagauauugcuggacuuguaaagcgagggaguccauucuuguugccagucuacauuaugaccuucucaucuaggcauugcaaugaucauuuacuucuuuuuuaguucauaaauaugaaugaaaacuaaaacauuuaaauguaggaaacuuauaaagauaucuauagugccuccuucuucuuucccaaggcuaagcaauauauuaauauuugugaguuuuucacuuuaaaaaauaauuguuauuccaaagcauguguaugcaugcguguugugcaggguguguacaagugagugcaguugcccaggaagcgaguggaagccaggaaagggaucagaucucuggaguuggaauuauaggugauuuugagcugccuaaugggauguugggaaccaaacuuagaguuaagagcagaagacucuaacugccaagcuaucucucuagcucuuuccuuccuuccuuccuuccuuccuuccuuccuuccuuccuuccuucuuuccuugccuccuccuccucuucuucuuccuccuccuccuucuuuuucuucuucuuccucuccuccucuucuuucuuuuuuaaaguuauuuuuuacuuguuuggagcuuuuggcuuuccacuaugucaccuagacuaaccuggaaccuguagcccaggcuggccuugagcucucagcauucuccugccucaccauuuugagaacaaaugauaaugcauuugugacuccaacucuaugucuauguuuuucuacuaugaaagugagagaauucccgaagaaguguccauggcucuuuugagaaacuugaauuccaugcuacugugucuuaacaaagacuguugauauaaagaaugcuggaacuccaccuuacagcugugggacugcuuuucuccccuacaaacacccuucugcaacuucacuuugaacaauauauuuugaaaacuguguuagcaggcacaguuaaguuaugucauaggcugugaagcccauuauaguuuuacaguuuuagaaaaaaauuucacugugacuucccaacuagaauauguuuguuuucuuucaucuucaggauuguuugucauucaguuguuaccuguauaaguagcguguauucauaacuggagcugcucugugucuuccguggcuucacuuagaccacugcuucucaaccuuccuaaagcugcaacccuuuaauacaguucuucaugucguggugaacccaaccauaaaaugaucuuguuacuacuucagaacuguaauuuugcugcuguuaggaaucauaauguagauaucugauacgcagauuauuugauaugcaaccucugugaaaggguugguugauccccaaagcggcuuugacucacagguugagaaccauugcuuuagauaaugacguuuuggaaaucugaauacgaaguagcaggauauucugaguugucuagaugaucaugauuuuacugacuaaugaaauggguugucaguccuuuauuuacauaagguuaagaaauuauggggcugcaaacaccgcaaacaacugcugagggaggagaccucuugagcugugugcaagccgugcaaagggcuucccugacugcagcuucugaguugucaccuguguugggauggacuuuugguaaaaaccccucacuugagucaucccuaguccuguaaguaaccacaacaaagaugcauugguucaccaaguuuaacuuugguagaacuguuauuucccuguguuacauguucccuaguugggugagcagauguaugguccauuuuaugucucacauacaacauucucugacuccacaugguucacuguggcaugugugcacucacacacauacaauaaauaaauaaauguaugugauaaaaauguaaaggaaaucaggacagaauuacaacuaggaaguucaauggcuuuuugauuuugguggugguuaagugcauaaaccacacucaauacugaaaguggagaauuuaaagugaagugucacagcuuccauuucuagugccgaugcuaccuguauauaacuccauuaaguugcauagacuuuaggucugguuaauauugguguguggauuuuuuuuauuuauuugcaaggauuuuaaaaaaauaauauaguuugccccaaaaaggaggucggucauuuagcuggccagaacuaucguucuguaauagauuugccuuacaucuacaaagggucaaugccaaguacugucgaaagaaaaggagggagggauaaaggagggagagaggaugaccaaauaugucagcuuagacuucuguaugcuauaaggaauuaacagaagacagaggugggauuugugguuuguuuguuuuuuaaguucauauggaucucugggagccaagggcaagaauacagaugcaggcuuagauucugcacuucuacauauuuacuuuacuuuauuuuuggcaguacuggggauuaagcccagggccuugugccugcuagguaaguacucugccacucagcucugacuccagcaccugucuaaauauuuaaaggucauaaaucaagcucauauaaagcugugccuggaaaaggacugaaaggugauaugaagacaacugcuacuggucauaucuggauaaucuugauauuuaauucacaacaaaauaaauauauacauacauacauaguuuauaaauuauuuuaaguauauauaauaaaagaguuugucuuuuuaucaacaaaauaacuauuuguauuauaauaauaaaauuauguguuguuuuuuauaaaagccauugcccauugaugauggaaguuggacagcucuuguacaacuauacaucuuaaguaguuuuuaaaucauuuuaguuuggagaaaauauuugcuccaguauggaaacaacugaaacuucuaauuaaauaacuuuaagcaguguguaguuucagaaaugagagggugugggguuagagagauggcucaguggcuaagagcacuguguguuccuacagaggaccacaguugggguuccagcaccuacaugucugcuaacaguugucugucaugccaguuccaggggauuugauguucucuucuggccucugcaggcagacaugcaggcaaaacaccaauacacaugcaauaaaucuuuuuaaugauagguugggguguagcuuaguugguagagugcuugccuacugucuuagucaggguuucuauuccugcacagacaucaugaccaagaagcaaguuggggaggaaaggguuuauucggcuuacacuuccacacugcuguucaucaccaaaggaagucaggacuggaacucaaacaggucagggagcaggagcugaugcagaggccauggagggauguucuuuucuggcuugccucaccuggcuugcucagccugcucucuuauagaacccaagacuaccagcccagagauggcaccacccacaaggggccuuucccccuugaucaguaauugagaaaaugccuuacagcuggaucucauggaggcauuuccucaacugaagcuccuuucucugugcuaacuccagcugugucaaguugacacaaaacuagucaguacaccuaccaagcaugagaccccugugucacauaaaucuaguaugguggucccaccugugaucccaggaccuggcagauaaaaucagaaagaucguaaagucaagguccuccuccacuacauacggaauucagaaggaaagaaggaaggaaggaaggaaggaaggaaggaaggaaggaaggaaggaaggaagggaguugcacugaaguuuuuuuuuaugacauauguguugcauauuauauuaaagcauuuacucgaggcuaccauaauacaauaucauuguuuagguaucagacucuugugccucaguucuagguauuagaaaguucaagcucaagacgccacaagguagguuucauucuggagcaucuucuccuggcaaguagcuggccccucaugcacgacccccucauguuugcuuugggagagagccaacaagcuuuccaggcuggccucacacucagagauuccccgcuuuugcugggauuaaggcugugugcuaccaauaugccaggcaaaaguaucuuacggagacaagacacaucauuuugcuuguguuuuuccagugccuuacacagcacgugagucauuagauguuuguugaaugaaugagugaguuucagccuuucucuucuggagcguugaacugagggccucaagccuuaggcaagcacccuggggcuaauggucaucuccagcuccacaugccaacuuuaacuggacuuaaauuaaacauuagucaacaccgcaccugccuggcauccuuccuggcacuuggagaauacugaaauacuggaaacuugguucucuagaggcacucaaauuauaaauagguguuaggaaaucauacguuggcaaucacgcagccauuccacaggaaaccuagugcaguucagaaagcccucuaaauaacccauggaaaacaccaggguucaauagagccaauaacgaggcgggcuucagucuaauuacaaauuaucacacauuaaagaauggaggaugcauggcagcuaguagcauauagccauguaucuacuuuccuugucuucaugcaaagcaggagauguucaaguccaaccacauauuaucacacagccaggcauggggaugcagagagagaguaaaaaguuuggauaccaguacccacuuacagguauaauccuuaggcgaccaacauccaauaccuucaccaucaauuccaaacuauucaucuuuccuuaucugguaaaacugucaguucucucauacugucccgugcuccgcucuuugcugccaucuaccggacagaucgaugagugccucccccgccucgcugccccucucucucaucaaaccugcuagcuaucuuuguagagaaaauaucuugaagauaauucauucuaaaggaaucaggccauuuucucuuaccuagaugauccucuuccaaggcuaacaauaucccaaaaaccaaccaagcagacaaacagcaacaacaacaacaacaacaacaacaacaaaacacuugcugcucucccagaggacccagguuuccaccuguacauucaaacacauaaaauuaaaacaaacaaacaaacaaagagauaccucuaaucaaugguucauacauccuaggccuagcuccucuggaagcugagucaguaguaguacuuaagcccacgugcuugagaauagccugcgugacauaauaagagaaaggagaaagaaaagagaaugcacaaauagucuccugggugguucuaugguucaggcuccuuuugguuauacaaguucacaauaccucccuccccuuguuuuugagacagggucucccuaugcagcccugacuggccuauagaaguuccaagaacucucaaggagaaaacaaaaugauuucaaggguuacuagucacaaaaaucaaaggcaaaacaauuggccaugaguaaaauuuaucuuucugcugaucauguucccccuuuuuagucauacugaacuggucagggaacuacgaauuguuuuagaggaacuuucuuccacuccuuaaacaauguucuuuuagaaugcccacuauuuuaauguguuauuauuuuaacuacuguguaggcaguuauaauaguaagauguauguauucacgaggucaugaucaggggaguaaacauuuucagcuguuaacccuuuuauuucccccguuugggaauuaaagagauuccugugcccugguucuugcacugacuacuugcgcaacaggaaaaaaaaaauucuccuaagaauagagaucuuauuuauuuuuuaagucagccucggccucaccaggaccuuuuaacugaaagaauuuguuaggauuuuaaagcuugaauaaagcuguguuuucccagcagaucacagaagagacucaaacuuuauuaccaacaugcuuuauauuuucauuaguuacuggaacuggaugugaaggcucaggccuguaagugccagcauucaggaaguugagacaggaguuuucccaucugcagccugggcuacaaagugaguucaaggacagccucuguguaucaaaacccugucucaacggggguggggugggguggggaaucacaaugagcugguuccagaggaaucccuaauacuuugacccuuuaaugcaguuccucacguuguggugacuccagacauaagauuauuuucucugcuguuucauaacuguaauuuugcuucuguuaugaaucauaguguaaauaucugauaugaaggauaccuuauauguuaucccuguacacaaguugaaaacugcuauucuagggcaaagacaauauucagaaguuaagaauuugguagaguuuugggguuuuagcucagcucauugcuggauacaauguaguaacaccucugcuucccauauacaaaucacaggaaggcauaaacuaauguagagcaagcaccuagcacguggaaaacaugcaacaauuuuuuuuuucugugaacuaaguaaaucuuugguauugaacuuacuguuucaguccuggacugugcauuguaaacauuagcaaacaucaauuauuauuuuagaaauaagguuuaaguagucaauacugaccuuaaacuugcuauguuccuuguucaagcuacauaccuuggacaaaagauccucuucccacuaaauucccaaggcuggauuaagaaguauacacuaccaugcccaauuuuauguggugugagguaucaaauucagggccuccuguguccuagacaaggacucuaccaauuuagcuacaucuccaacaucccaaauauuaauuaagagcacaggugcaaguuguggagagugguugauaaucacagaacaaauacaccuuaaaacauauuuaugucuuuugcauuucuguuuauuuguuuguuuguuugcaaauaggguuucucuggguagcccuggcuguccuggaacucgcuuugaagguuggccuugaauucauagagcuaugccuggcucugcccccccccccccccccccacgccaccaccgccuggcaaacgcuuuuacgucuuaagguaaacgucuggauuuagcgugaggcuaugcagcauaggguaacuuccaguagcaucuugguguggcguucacucuuuuguuuguuugcuuuugagucggggguuucucuguguaauccugacuguccuggaguuugcuaugcagaccuggauggccucaaacuucgagagauccgagauccgucucugccuccaagagugcugggaucaaaagcaugccucacugcucucagccgacacuuucauuuuuaaaauucagauuaugcacacuagugaaaacuuguaccuauuuagugcucaccuuguguauaauuauugacucagacgguaaacaacaaaaauauuccugggaugguuguuaaaaccugaaagugugcucaaccucccucugaagcucuacugaaguggauuaacaucaggguuaaauaaauccugacagacagacagacagacagacagacagacagacagacagacagcuaaucuccugcaaaccugaaggggaaaaaaaaagaaucaauuuaggugcuagggacccugcucuauuccugccaaucagcguuuggcuccgcccccaauuguacggccugcaucucccgugagccucuucgacugucauucuucggaagggaaacccuuuccggccgaagaaacgcuuaaacuacgaaucacuugggguagcguccguugcguccagucgauaggcgggacuuccgcuuccagggggcccgucagucaggaggcggaaguuggugccggcgggaagguuguagcgcggugcauugcugcacucucgccggguucugcgugggcgcgccccccugcacggcugcgaccggacagcgagcuuucuccaggcuccucgcauuccggguaaguaaaaaggacuggugacgccaagagaaggguggcccgaacgcuggccacggggcagcggccucgcgcggcauagugugcgaggguuucucacuucccguuggguuucgcccaccccgcgcgcgggcggggacuccugggucacccugacccuuucucaggguggccuugauagccuucgguacgagcucggcuucgcccaugccgugcuccagccccagccgugggagacgcgaguccuuuccacccggcaucugcuuagagcucgugucuucgcucaacaauaguucucuacuuccgcaaucccguucgcgccuuguuuuguuuugagucagggucgggcuguguagcccugguuggccggguacucgggguucuucugccucaucuuccagagggcuggaauuaccgcuaugcgcggucacguuuuuaaagagcacauuuguuaaauuaguuuuccuucccccgcccccuccauccccaaucccgugugauuacuugaaugaaacucaagggucgaggaguuugucuugugauuccggcguggccaaaugcaaaacuuuuauuucuaaacuuagagaugagcaggcuugggguuggagagguggcucagccgguaagagcacuugcccaagcauuagggucuguguuggaaucucccggcauccauggccgaagacagacaccugcaccccagagcugagggaaggcagagacggaggaucggugaggguggcagccuagcuccgggcucagugagagacccuguuuucaagggaagaagguagagagugauagcacaaggcaucugaugccuuuuccugcccugcucacacaugcaccacacacacaaaggaaccaggaguccagguuuccuuacuaguuuugugacuguuggccuccacguacauaaaaaugcucauuaaaaaacauuuuuggggacacaucuuacacaauauauggcgcagaguagauacuuguuagguugguugguucuuucuuuccuucuuucuuucaccagcacagcaaaugcuggaauuuguuuuuuaaaugaacggagagugcuuuuuauagaauuuuauuuuucuuccuagcacugauuauguggauacuuuacaaaagguugauauauuugguaaauacaucuugaugauguaaauuaaaaguuaugcuaaauguugguauuaacaacuuaaguccuagaaaaaaaaaauguucauuuaaugaagugcaugaggaauuugcagagcuaaauuucugauuuaagucuguguuuuuuacguguaucuuucuuaagagacuaagaaaccaaacucagccuagcuguucuuuuuugagucuguaauuuaaggccagugcauuuuaugugugcacaaaaauuuuuuuacagaugauuguaaaguccugaucaguggccacugaauauaauugacccagaauaggaagauggcagcaaauccuucaggacaagguaaugcaugcugggacuucuguuauuacuaggaacguucucccauacaguaaauauauuugagguagagaaaauuuaguauagagcaguuacugcauccagaauuaugaauagcaaaguggaaucucccaauuuaaaaucaguuuagcacuguauuagcaacauauuuuuuaacauuacuaauucuuuacuuuaaccugucaagauuagugauucacaucguaaacuuuuuuccuucuauuuacuuuuguauagcgugcaucuguguaucugcauguuugcauguguaugggugcauguguguguaggggugggcgugcauguggagacuagagguuaacaucgaggaucaucuuccagcacuuugcaccuaauucauugaggcagggucucucagucaaauccagggcuugcccauuggcuacucucgcuagccagcuuucucuaccguuccccucucugccuuccaaggcugaaauuaugcuacauauauguggguucucgggaucuaaacccugguccucaugauuuuugggaacaagugcuuaaccacugaaccaccuccccagcccacaucauaaacuguauccucuggcaucuguuuucuugcuuuuaaaaccguugucagauaauaaccaugccuuuaucuucauugcuauaaaaguuucagucauuucaccuguuacguuuuuaaucaaaucagguuagguacaaguugcuguuaaggaaauuuuuaaaaaauguuuuguugaaauaaaaauguauucacguguuuuuagcuuucugagggcuaugucuuggacuugugucaaccucuuaauugcuuaggcuuacaaguauggccagauucuuuuuuuuuuuuuuuuuuuuuuuuuuuuugagacaagguauguagucuuggcugccuggaacacacuauguagacuaggcuggccuccaacauagagcucugccugccucccuagugcuggaaucaaaagcaugugccaccacaccugguaaagguauuagcuaucauuuuguaaguauuuuuaugccaauaauugaaacaggucucuuuccacaucaggcccgaaccauuugacuuuuagguauguuugauucaucaucucagguaaagguuguauuuauggucucuuaacuucuuuugaaagguucagauuaaaguaauuuguauuugauccucaguaccccccaaccucugcccaaacugaaccacaaugaaaacuaugagaaauccauuuaggaaagaaaaaaaaaauacuaaaaaaagccacacaauaaaaacauauaaauuaucucauucuaacuuuucucucugcaauuacaguaggaacaaccccuguuaguguagcuuuuuguuggcucauagucagaucuacuaugaagcauccaaaaccuaaagaguaacuaguugguuaagucauuugacuuucauugccguuaggaauucuguugguaucaccauggagcugcugcuauuggacaccagcagggggagucuauaucauguucuauagacuugaagauuuucagugaaaaguuuaaaaaauuaauauucauugaugcucaaaaguuuuuuaaaaauuaauacuuguugauguucauuuauuuguuuugagauagggucuuuacuguauagaccuggcuuggccaggguuuuuguuugguuuuguucuuuugcuuucuuuguuuuuguuuuucaagacagaguuucuccauguagcucuggcuauccuggaauucacucuguagacaaggguggcgucaaauuuacaaggauaugccugucuguguauccagggugcugggaccauugccaucuggcuagccuggaacucucacacguuugaauguuuugccuguauugccuccaugcaugcauugcccuuggaggcuagacaaucuccacuccccuagacguaugggugcuggcaaucaaaccucggucuucugaaauagcaaccgcagcucuugauugcugagucaucucugcagcuccucaauaaaaauuuuaaaucuucauuguauuuuaccaccuuuaguauaacaucucuacuucucuguuguuugugugcauagaaauuagauggagguugauuaucaaaugccuugguuaucuuaaauaguaacggaaagaaacaugauuuucuuuuuuuacauuuuaaaguauacauuuuauuuuauuuuuauuuuuauuuauucauuuuacauacagauuauggcuuccuccccuccucuucucccauuuccucucuuucauauccccucccccauaucuccacagaagaggggagggaaucuuauggauaucgacccaccuuggcauaucaagcugcaguaagacuaggcacaucuccuccuacugaggcuagacaaggcagcccaauuaguggacaggguccaacagcagucagguaacagucagagacagcuccuccuccggcuguuaggagucccacaugaagacaaagcugcacaacuguuacacaggugcagaaggccuaggcuugucccaggcaugcaugcucucugauuggcaguaguuucuaagggccaagguuaguugauuuuuguagguuuucuugugguuccccaagcucucucuaauguuuggcuguaggucucugcaucugaagaaacaugauuuuuuuuuuaaaugaguguuaguauaugccuuauaauucauuaaugucucuggugcaagggccaaauauccauuguacuuacuuaauuauuggcuuuauugggagagccuagaagguaguuaagcacacuggguagauuugugagaauaguuaagaacaguguauguguggcuuguuauaucucaggaaccaucuguccuugggcaagggccuuacaguucagaggcagaguuuuauggaucaguaaauuaaaauuuaaaagauaacuuugguuuucacaugugguagcuuuuaauuguauucucagcacuugggagguggaggcaggaagaucaaaaaugagagaucaucuucaacuacuacaaaaagaaaagaaaaaagaaauuguuacauaaauaaacuguuaguuuuucuuguuuguuuugagaugccuugcuggguggcuuuaaacugaagguauaaaccaggguggccucuagguugugacaacauagcacugccuucaaguacugggguuucaguauuaucauuauacccagcucaagguaacaacuauuauacucuuuaaauuuucauuacaguugagcaacguauagacuugauauuucuuuuauuugaaagcauucugggguauuauguauguuuauaaagcaauaauuacaaaggcaaagcaaaaauccuuucaaaaauuuucuaagacgaaacauucagugcuggauaggaacuuuuuuuuguuuguuuguuuuuguuuuguuuuuuugagacagggcuucucugcgcaguccuggcuguccuggaacucacucuguagaccaggcuggucuugaacugagaaauccaccugccucugccucccaagugcuggauuacaggcgugcgccaccacugcccggccgaacuuauuuuuaaaaguuaguugucauauaguguaaacccuccauaaauaaaagcaccugggaauuucaaaagccuaauaaauaguugaguagccuaacaguuacucaagcuguaauucugggaaucuccucuugucuuucucccucucugugucuuucucccucucccagucucuuuuuagcuuauggugucuuagaauucauuucuuacuaguaguccagguuggccuugaauuccuagcaguuuuccuguuugagcucuuggacugggguuauuggugugaucuaucacaccuggguucucuuuuuaauauuuuaauugacagucagguuauccuaaacuggcuuuuuuugucuuuuaaagucaacuuuguggguuguuuguuuguuuguuuguuuguuuuuaauggucugauguagcccuugcuggccucaaaaccuuacuaugcagcugaagauggccuugaacucuugaucuugcugcuucuaccucugacguuagagugccuucaaagugugaguugggucaucauacccagcucuguagugugucuuuacugaggaagucacucuacauacucagugacaucauuagcugcuuugcucuugucugaccaaacaaugacugacaccagaggagaacaguguggaugccuguuacaugcaguacuguucuguuuccacuguccuugggacaagcucgccuucccuggacauucuauucuuggcccgccugaggcacuuuucacuaucugggaaagagaagggggcauuccagugacaugacaguugauguggauacccuauuguccuaagggagcaugucaucaggaaaaggguuuagaguuaggaugaagaguucucuggaaggcucauaaaaucaucuuuuuagaaaggucagaauguacugucauagucagcuauucaaaaggagucugcuguuacuagcauuuggugguauaacaagagcagagacggaaacugggagaggauaaaaugcuaaaguggauacagcauagauauauuuccccaaacuucuggccauagccagguugcuggugccugguuaaauucagaacugcaaguuccagcuaugugugguuaggccaguaucuaugaauguuuuauaucccaugccauccuaaccggccucucccucuaugggauguuuuccaccuacuaguucuaaauuaguguaaaauucucacaguccgucacauggguauuuaagugugcuuaggucuucucugcuugaaaauacucucauucuauaguccacucuagaucucuaauugucuccucuccucaauauccuuugugaguuuuguugugcuuugcuuuguuuucuagguaucaucagcuguagacaccuaaggacauaagagugcucgggauuauaaagcuugagaauggccuguagggggagaauauauaugccuuuugauucuggucucuugcugcuguggggcacacaucccuuguuagcagaucaugagauagguuugcagagagaugcuagagaucugaggauuuagaguagaguccuucacuguugacauauuggcauuuaauuuggauuuguuuugauuuguuuugagacaggguuucucuguguagcccugaauauccuuaaacucacucuguauagcaggcuggccuugaacuuagauccgccuguuucugccuccugagugcugggaucagaggcuugaaccaccacugcccagcuacuucaggacucuuugcaacaugugcugagaucuuaucuaaguuugaagcuuagaaucaagucaaaugcuaaguauuugauaaaaggagaugucucuauuccauaaguugugcucuacuucuuaggauuccuuucuggucuggucacuugcaguucuuuaguuguuucuugagaaaaaaaaaaaaguaucauuucugaaugaaaguagcugagaauuugaucugacuauacauaauaauuuuuuucauaaaacaguuuacagaccuguagauuuggcugugcaauauguugagcuaccagauuuuguccaaaauaaaugcuauaacccauaccuuggugaccaaaauuauuuagauuagaaucuuggugcugggauuauaguuagugguagaaugcuugccugguauauccaaggccaaaguccucagucauuuuuauuuugcuuacgugcccagcuacuguguucuuugcggggggcgggggacuguuuuuauuuuguguguguguguguauauuuuuuuuaaauguauggguguuuugcuuacauguaugucugugcacgauaagcaugucuggugccuacagaggcuagaagauggcaucagaugcccugggacuguaguaaguguugugagcugccacaugggugcuaagaauugaacccagguacucuggagagcagccaaugcgccuaacugaugagccauccucucucucucucucucucucucucucucucucucucucucucagccaaugcgccuaacugaugagccauccucucucucucucucucucucucucucucucucacacacacacacacacacacacacacacacacgcccuguuuuguuuuguuuuguuuuguuuuguuuuuuaaggauugaacuagcacugguuggcuuggaacucaaagcaacccaccugcuucggucuccugagaacauaugcugccauuacugggcuuuuggguuuuuguuguuguuuuuaagccaggguaucauauagcccagacuggccuugaaugggcugcuuagugaaagauggugauugugaacuucugaucuuucugccucugucucacagguguagguaugcacccccucaucugcuuuauacuauguuggagacugaauccaggguuuugugcauauuuagcaaauauuaccuacugaccuauuggguuuuuguuuguuuguguuuuguuuuaagagauagggucuaauacagcccaggcuggccuugaacuccaccucucaagagcuggaauuauaagugugugccuccaagucugguaguguuuuaugcucuuaaaguugcugggacauggccgguaugaccguguuagagaagaggaauuuuguuuucugguuucuacauggccucgcucuaaaaugcuucuaauucuccaucccuuuucuuuuucagguuuucaaaauaaaaauagaguugcaauuuuggcugaacuggacaaagagaaaagaaaacuacuuaugcagaaccaaucuucaacaagccacccuggagcuagguauuggccguucuuaaucguccuuccagggaaaagcagugccuucagcucucuggaggucccguaacgucagaauuaggucuacacucugagcuucccuuacucacaaacuucuguguucauucccauuauagcauggcauuguauucaucacggcugcuguugucugagauuuguucuacauacccauagaucccagugcuuagcacagagccagcuauccaggagcugcuuuacaaucucaugaauaagugacugccagguuuuucugaaaguucacaguuguuacgccugugugggacauggcuauccuaaguucaaucaucagauagacaaugauguuuuacuguuggugagaaucaugcuguuggcuaacaguuuuauuaaaaguccagugugguggugcgcaucuuuaaucccggcaccugggaggcuagaugucugggauuucugggaguuugaggccauccugguuuacagggcuaguuccagaacaaccagggcuacacagagaaacucugucucaaaaacaaaaacaaaagaauaaaauaguaaggaugaugacagacugaguuagaggggcuguaaauuaugaaaccuauaguauagauuacuugaauucccauacagauaacauaggcuuucuuuauaaauuaauguagauaaugggaagguagaugcuuuuauucuagaaggucuuuuaaaauuuuuauuuauuaaguuuuauaaacugauuuugcuguguagcuuuggcuggccuagaauuuuguguccaucccugaaguccugguauuauaggaaugcaccacuauaaucagcuuagagaugucuuugugucccuacacaaagaaucuacagggccugagcgcuggcucaguaggugaugagcucuuuccuccaagccugacguccccaagacucaugugauacagagaacugaucuccauacgugccugacacaaaacaagagaauugauaagauaagacuguaagauucaguguaaauccauacuggcuuagggauuggcucagugguccagucugcuuagugagcuugaagccuuggguaugauucuuaguaccacagauuaacaaaacaaaacaggugauacuucuucagauuuauuguacagcauugugauuaguuaauaauuauguguaccugaaaauuauggaggucuuguaucuaucucauaauaaaaaauauuggcauaugauggauugguuauucaguuugauuucauaauuuuaauguaaauagauaucagaacacaccauaaauauguacaauuuuauauguaagcugaaccucaauuuuaaaaguaauuuacuauaauaaaaaugugccaaucuaauaaauccccuuauauaauuauuuuuuuaaagaaaagaugagagucucuguguuugguagccaaguaaccaagguuuccguuuuagcaucucgcucuccagacccucucuuaccaaggacuuccgggaccaugcugagcagcagcacaucgcugcccagcagaaggcagcuuugcaggugagugaaggagccgaccgucccggcuccucauucuaucucagugggcaauagcaagcaacuugcuccacagauaguugugguggugccaguguucacucaugcccaaagggauugaaggaccacuauaguaauaaugaaaguaucuuuuacaaugguaauguagcaugauugauucucugcucugcuuugucaagggauuucuuguucacaaaauaauuugaauacauagaaugagcuagaaaacugaacuggcuaguuuaauagcacgguaaauauuuucaauuugccacagcauuacuuuaugugauugucuuccuggguuguuauuuagauguuuucgaugucuacgcugcugacaugggaaauauuucagagcucuuacuguugggcuguaagugaugguucagcuuggaaacaaagccaucguuuaguaguauauucaucuuagauaacggguucgcagagaucuuccgugaaaugccgccuuuuucuuuuguggauagguuaucuguguaaccccuguaguaucagcacuucaaggguggacaugggaggaucuuucuugugguuccaggccagcuuaggcuauguagcaaaacccuauaucauaaaacuuaaaaaaauacaaauuugaaaggcauaguguaaauugccuuugcuuuuaagcagaaucccagaauuagaaaggacauuauaaaaaucaucucuccuucaaaugacaagaggccuuuuuuuucuauuuuuuauuagauauuuucuucauuuacaauucaaaugcuauuccgaaaguccccuauacucucccccccacccccgcccuacuccccuacccacccacuccugcuucuuggcccugguguuccccuguacuggggcauauagacuuugcuccuuucagcaaaaucuugcuggcauaugcaauagugucugcguuugguggcugauuaugggauggaucuccggauggggcagucuuuggauaguccauccuuucguauuagcucuaaacuuugucucuguaacuucuuccauggguauuuuguucccuauucuaaggaggccuuuuuuuuuaaucgagggggaaauuacugauaguuuuaaaaugaguuccuuugcagccuugccucagcguuggugguuucagucaccagugccacucuucucgucccuucccaggcugccccucucucccaggcuuuuugucuggugaccuuugcugcuguuucuccccaugccagagaacaaagaaagagcccuacagaggcagauaaagaggcgcuaaacgcaugccccauaccuuguguuaauccgaauugugucccggucaguccauguaaacaaacuagaucuuaggaauucagaaaggauaaggaauuuuaaugccuugguuuaaaaaaaaagugacuuuucauaacugagcugguuuuguuuuguuuuuuuuuaucuuccucagcaugcucacgcacauuccucuggcuacuucauaacucaagacucugccuuugggaaucugauucucccuguuuuaccucgccuugaccccgaaugaagaaagcgccugcugcgacaagggaccuuguaauagcaaaugucaaaguucucacucagcucuauacaaacugacuuucagaacuuuggagaacuuagcuuuuguuucuuuaaagaaaggaaugaguaagugagggaaagagaagaggagcugggcgcugagaccucggggagcggcggcgaggaccuggcugugcuggccgaggcggacuucuuugcacugccauuggacuuucccugggacucaggaucgcuuagucucaugaacucugcaucaccuucaacaaggacugaauuaucaugugggaagcccuggguuugaccccaucacugcacauacaagcucugaggauggcacaugccugugaucucagcacuagaggaauugaggcagaagauuggaaguucaaggccauccuugccuagguagugauuuugagaccagucuaagguauaugagacugugccucaaaaauaaccaaaaucaccccaaaaaagccauuaauagucguaacuuuaaagagacgaggaugcuuuuuaaaaaagugaagagcgggcuuacguacuuugugguugcuugugcuaagaaacaagcuaucuagaaauaggcucuaagcuaauaacuacuucuaagaaaacuccccagucagacucaucuuaagucucuuucaaauaaaugcuacagugguagcaaaugaaugaugugacuaaauacuguuaugaaaagcagccuaagaaauguggcagcuguaaauggacguguacucucacuucauguugcugcagaaguggugggccugagugguuuuauuuucuauuuuuuaucuaauugaagacuuaaaauuaggcaaauuaaggccuuuuaaaccauuuuacauagguuaaacaaguugcucaacagggccaaacuugaacaagaacagaggugcuuauuuauauauguaccucccacuacccucccuuugcccuauagaauuagaguuugauuaaagugugaaaaguauggcuuagggaguccuauaauaccuuacacaaaggugucaugauuaaaauucuauuuuaugagggaguuacuuuguaaggauccugucauuuuucuguacccaaggauugaaccuaggacuuuaacaguuauggauguguuuuaccgagccucaucaccauggguaacugacugcaucuccauccucucugcuguugggggaauuuaaacaucuuuaguuggggcaauauucaguuuuacucccuucugauaguuugcuauagguguuuucaccagccacauacgccguccugcucagugcaagugaagcagcagugagcagucuuccugagucaucacacugcucccugugucugcugcugacccagggacccccuugcuccugccccucaaagggccauccagcuucccucugcaccuccuaguagucuuccucgucuugcauuucgcuaaguuccugugcagugagaucugugccugccugccugccugccugccaugcuucugaaccugcuacugacguuaggcagagagaaggguuucugcuguugaaaccuugccugcuaugugacuuuguaaucuaggugcuuguuuucccuuccugggucagaucaaauacccggaugaaagggcugaucuagauucacaguuugaggcacagucugucauggucaggaaggucaaggcagcaggagcuugaagcaguuggccacaucuccuccacagucgagaauucgagaacaaauggauucuacugugcugucuuuauguaaccaguauucuagccagggagugaugccacucaucaguggguggagcgucuaccucaguuaauacuaucaguaauucccuaaggcaugcccagaggcucaucuuguagugguucuagauguugucaugcugacaguccagucccacuaaccaggaggacuuuccagugguccucugcuucggguacguacccauuucuguggguaccuauuaauaucuacucugguauaugcuguguuugagggacaaaaaggucacagagaccugcauauggggagguaacauuguugaggaucccacucuggcauucauguugucguaaaguaagcaguuauggcacaagacaggcaucuugggcuagggcuagaagucuguagacgauagaacuggcaagggacugaagggacacccaggcaaaggucacauuuccagccaagcccagugugguggaucaugccuguaauccuagcacucagcuaaggcaggagaaucacuaugaauucaaggccagucugggcuacagagugagagcacaacccucccccaacccccaaagaaguaugaaaaagaaugaguuuuagggaugaaacugcaguguuaaagcuagcgcuggacucggaugaagccuugagugaauccauugcuggggucacgggugggugaugcaugcagugguggugcacacuauaaucccagcacucgggaggcagaggcaggcggauuucugaguuugaggccagccuggucuacagagugagguccagagcagccagggcuacagagaaacccugucucgaaaaacaaaaaauaggaacaguacacaacugacuauuguacuuauuuaggccaauguuguuuaaaguacaagucucagccuguuugagcugaaaaggcagcuugaugguuuaaugcauuguaucagcauuaaauaaacaaacaaacaaaaaaagaaaac

SEQ ID NO: 1930 - RNA, 4697 nt, Mus musculus
caggugaaguccaauguucucaaaaguaaacaguugaugaaaccuggcuacugacaccacuuugguucugaggucagugcuaucuguacaaagguugaagccuuuuuggcagcuauccccauagccuuggaagacuuuucuugauaaguuuuuaaaguuaacauuuacuguuuuuauguguaugugccugaaugaguuuauaugcaccacuuguguauaggaggcaacagggaucaaaagaaaguguaugguuuccuguuacugaagauagagucaguuuuaggaugccagguaagugagguaauugaaccuguguccucagcaaaagcaaguuucaaagaaucugauuccuucuuugaccuccacugcaccagaccugugcaugguacucagguacacaugcaaaaccaaugcucauacacaugaaauaugaaugaaucuuuugcaaaaauugaguaacucaacuucuuccauacucaccuuaaagcaaagauucuaugcauacuuguccuuccaguucauuccccacccacuccaaaacugucuuucugauuccaagccagauccaaaggugccucuaguuccagaucacaguucccuugaacacccacuguuuucuugggaauauguuuugagaaauguaagacuacuaaaucaauccauaggugaugauauugccaaguuugaaaauggcaggaacaauccuuggccucucaucaauaaaugagaaaauauuccacaaagccugacagagguagagucgacccauacaggaagaaaaaaaaaaaccuacugaacccagagaguauauaaggacaagcaaaggagcuagggaguggaguguaggcaacaucaccagaaagacgugguccugacacacagauaauucuauuucagaccaaaugaagcugcugcugcugcugcuguguuugggacuaacucuagucuguguccaugcagaagaaguuaggucuaugugaaggaacuuuaauauagaaaaaguacgaucagugaauuguauguaugaucagaaugugcuuuggggaaauguuuuagccaaguggauccuuugagggaaugguuauaguuccacaaucuauuagacaaaugaauggcuccagaccuugaaguaagaccagcuacucagaucuaacaauguuuugggaccucuguucucacugagagguagggacaguaugcuaaguauuguggcaacuggcaugagauauaccccuguguaugcucaggcccuaaugcauaggcuggaguucaaguggacacaugugcaugugguaucccugcuucuucucccuuaaccauuugcuuaucuacuaaagauuaauggggaaugguauacuauuauccuggccucugacaaaagagaaaagauagaagaacguggcagcaugugacuuuuuguggagcacauucaugucuuggagaauuccuuagcuuuuaaacuccauacuguguaagugagaggcuccuagcugagaaacaugaaaggaaaaccugguaugguaucaugccuacaaacacuugggauugggggaagagaugccucucaguaugcacacguguacacacauacugagucuguauccaaaucuagaaugcuucguuugacacugauccaagaucucauaacagguuguuuuucaaaagucagagacaggaguuggugacaggaauuaauucacucugaguucuauaagggaagaucagagauaccucugaagccacauuaaugagacaguauaucacaaguuaagauuaugugaucaugaaucaaauuuuucuuucuaguuguuagccaaauaaauccaccccuuuguacuuccguuuuccugcaguaaaggcgauaauaaaaauucuccugugugguacugggaaccacaucaggcaacauuacagagugcuaauuugaggcagaugguggaaaucuggcugauaaucuacaccgcuggcugaaguccagcauuggugaaacuuagaaguaguugcaguuguucuaaggaugagaagugauugucguuuucuaguuuuaaaauaauaggcaauuugugauugcuaaagcaucagauauaaaggaaauaauguaaauaaaaucauuuagcuaauuuuuccaaaauagucaaaaguuaaaugggaucagaaccuggagauauuuauaguguaguagggcaagaagccagccaguucaaaauaccuuacucaucaguuuacucuguguuacaguauagauuaagagugcuccaaaguauuuuugguuggugacaauacagaaaaggcugguaauauuaugugacauguguguauauaaaaugucuauauaucuauccacaagaugaugaguaaccuuaauaccuuuguguguguguguguguguguguguguguguguguguguguguguugcuuuagucugaacucaggaacuugaaccuacuagucaaaugagcaccaucgaauagcuaacacccuguggccugcaaguaggauaaaaagggggauauagaaucuauuugaugcugucugguggcuagcacuguugcacaucgcucaggguguagcagcagauaauuugauaaaacaaacuuaugaaagauauaaacauguugcuugaagcugcugagggagguagguaagccuaggagaggaugagagaguggugcuccuguggcuuacuguucacuaguggucuggaccucucagagucccuuuucuuagauauuacuucuugaaguucagaaagcuaaacacagaaaggaacagacaguuuaccaaucucuucuaggauauguauuuuaaugauuuuguguuugggguagaacaagaagaguguauccaucauuuccugcagaacaaagaauuucugagccaugucccacuuccuccacagaugauggauucaauucauuuacuauacugaagacagaauaugauaauuauauuauguuucaucucauuaacgaaaugaauagggaacccuuccagcugauguugcuuuaugguaaaguauuuucacacagacacugaucuuggagugggaaaagaagaaagaaccucuagcuuuaauauggucuucccagcuugguccugccucuuucucauguccuuaagauugaugcucaccucaaucaucccucaagcauagugauggaagcacucugaaaucucucagugggacagaaggauauucuauggauaccaaauacaggauagaucauaccaaugccugucaaucauguugccaaccauuuccacauccuuacggaaagucccuguccccucacucaggcuguggucaaugcacaaaauacagcugcuacacucacuauugcucuucucacagaccuagaaccagauuugaguucagacaucaaggaagaguuugcaaaacuauuugaggagcauggaaucguuagagaaaauagcauugaccuaucuaaugccaguaagucaggauucauuuacuuaucucauccugaauauuuuaucauagaggaaacaaacucaguuugcuaccagacauuuuugaaagcuggagaguccuauccuuucucuuggggaaauaaaguggaccugguaccugaacauguucuuguucucacacuacagaucacugucuccaggcccuagaaugaagauuggccugagccuccaugugggcaauauccaaugagagcaaagaggggguugguggucauagagaggcccuuccaaaaguauuagcauugugcacucaaauuacaauaaaaauaguuugauaaggaaacauugaagaaagcuuguaaauuggcuuugaauugucuggauuuguguccuaguccuccuuugagcuuugaaguaaagugacucaagcacuuaagcaagaaaaaaaggauuugaguuuugcaugguugauguaugcuuguguuaaacaggcucagcaauggguucaauaucauuaacagacagaguagcccaaugugguauagcugcucuucagugguccuccuccaucccacucgagauaauaacaucuuaaucugaacucccuacaaccuuggcuucuuaccugggacuggaugaaccugaucaccacuucucaaccagucuggagagcagacuccucuggcccucccuucucaucuaguccaagacuucacucacauaaugugugaagucuuuaauguagcuaaggcuuuuaucauuauuccacaauuuaccuaaccuucuucagagcuucuuaugacaaagguuguggaaauaagccucugauuccauuauggucauuuauucugacuuucaucccuguguucuggcaaauaauuccaguuagauugcaagggaagauccauuucuucauccccuuuuuccuauauaauagaaugucucucuguccagaggucaaucuaaaaaguacuuaaugaguuucuguauuauuucuuccuugauuacacaguguugaguggagacuucucaccaggacuccagcaucaucccuuccuauccauacagcaucccgugacaaguucugugaucugcuuucaaucaugucucacagagaauugcaaucccugucucuccagcaugcuacuaggauaacucaucaagaaucaaagucuuucuuuaaauuucucuuugauacacccaugacaauuauccuugaauuucuucuucuuccugaucaaaaaaugauuauacuugcauuua

SEQ ID NO: 1931 - RNA, 108319 nt, Mus musculus
caguccuggaaaccaaacucaguuuccccucaagggccugagucaaguuuuauuauuuuagucuuguuaguuucaaauacccauugaccucuuuuagaagauuuaaggcagagagagaagauacaugucccagaaccacaggcuaggccaccaugauuggucucuuaguucucuguugaggacuccccuaaggguccugacccugucgcagcaguucugaugagcccugggagagcaggagggcuuccaggucaacuugagaaugaaugauaagaaaaccuugggagagauggcaggaugcuugugacuggcugcaggugacccucccagcccuuccuccaugguagaguuacucacugagggcuguuacaacagcaguucugcagacagccucaugauccucuucagcaggucaggugggggcucagauggcagcuaacucagagcccugaaccacuaucucagaauguucaccaggacugcacccugaggcucaccuagacagcugugcaaacccaugcuuagggaagggcugggcgggaagccugcaugccugcuuccuaggucuucaccccagccagccaaugucaucgucaucaucaucaucaucgucuccaaaaagggggguuggaggcgggcgucccuucaugcucugacaaaacaggaaagagaggucaguccccacucauccuucacagguggcuuccugccuaggaggggaagugguccagugucuguccugccucugcuggaaaggagaugaacuggaaggacagguuucuguggccagagaacugaagcauucagauaaagauggaacaggcaggcacagaggaaagccggcuuucaacagagacaaaagaccaauuuuacuuggcugauuuuguaguuuauuugugaaacaaguguacugauuggacagauaugcuaacuuacacauuucauguuaaaaaggaagggucauugaggagaguugggauaagagaaagaaacagaagcaaagcagccugacaucggagaauaagggaagaugacggucauaucugaaagccagcugucaccugagguggccagucaaacucauaaagauguguauguagaagcaaacucaaguggaauaucccaagagauuuaacaaaagucucuuuaaugugggagugggaugaagguucaacggguaccgggacaccuaugagucccagccaaaggcuacuguguuaaagguucaagaccucacucagcuugguagcacugggagguggugggaacuuugcuuugguggggcccaguaaagucucagaugauuagagguugcccucagaggagaggggaacucugcccuucucucucagucuuucacuucuuuuuuccugcauuuucucuacacaucuucccacaggccuaacagcaauggaaugaacccagcuugaacuaacugugaaacugugagccaaaauacacauccagucuuuaugcacuuccugugucaagguuuguaccaggagcagaaugcucacuacacaaggagccaggcaggagccucuccuacucuucaugauuuaaacuucgguuuucccucugguuugcuagggcgacaacagggcuuacaacugcagacaaggauaauacuggacuauucucugaggcauuuucuucucugagcuucugcuaagcagggagccgggccaggggaagacuggguucauccucuaguccaucuauuagcagaccuguauuucucugcaggcaucaacuaggcaaucuugaaagugcccgugcaggacucugaaaugugugccgcagcuccuguuuuguuuuggccaagggucugcuugguguuuacucaucauauaaccugaguuacauuauuuaaucucagcagaagguuaaaugaggauguaguuuucugaguacccaagaaacagauuauuaacuuuauggaaaugacaguauuuccuuccauuucuaugcagaauuuguaguuagcauucucaaaugcaaacuugauucuuaagaaggcaggcuaauggaaggaguugauacaccuucucugaaggcaggcaaaaggaaggggcucugauucaccugagcuagguuccaggugucacugccuucuggaaaaagcaaaacacacuccagguggaugguguagaagggcaauagguuuugcccauauucaguaucauagcucugcccuggggauggacugcgccuaaugcucuugucuccucuacacacauuuccugacaaugaaaucccauuacagagccaaaauggucaagugucagaugcaagccagggcuccaaucccagcucugucagcaauuuccuuuguugucccuggcucuccugcccccuaagcugaagcuacacugucaacacugaagccaccugcugcccaggguguuaggaugacaaacaaacagcagauuggaagugggccggguaaacaaacguucuuagaaaccaguggccccaagaguggcuuccugaaugacccuucugacccaucuauuugucuagggaugaggagacccaacaagccgaucuucagauuucuucccaccuucccucacuccaaaugggauggauccccagggcccagagcuuacagugcccucuuaagaguacaguggcagcuggccaucgccaucauguuuacagagcugaccacucugagccccaagcuuacucccacaggguccuguacacagaguccaggaaacaagccaccaacagacuccuuuucuggucucugaaccugcagggaagagcccccaggugguggugugaggacucagcagagccugaggucuccuuaccaccucaucuucauccuccuccucaggcugggcugugggccucggaacuuucagagucgcuccuuuaaacagcucguccucuucaucuccagagagacuguuggagaaucaaaccacagauauguugcuguuucuguccaggucacagugcccaccaacuucaagagucaugggccuugaagugagacccacucacucaauuaaaaucucucuuccuacacugugcaucuguuccuccaaagaccacacccuguacaauggccuccauaguccauuagcccugcuacaaucuacacugaguuagccuccauagucuccacccugccucauuccccucacuuuacacuguaugucauuuccuccagucuccacccagucaguccuuacagacuacaccagugucagccccucccuagucuaccgucagcacaauucccagagcuaauacacagacuccaucacucuucugcuuaaguccacuuacuggcuuuuuacuguacuugcauaacauucaagcuuuaacagugacaggaaauagcacauaucucagcccuuuauuuccaacuucagcaugaccccagcuguccccuccuagcuucguuuaguuccuuaccguguguccaucccaccagagcaccugugugcuccuugccgccaucucuuccugcugucggucuggaugacucaguccuccuugaaucacagguaaaugcuaccuucuuagcuguguucccuaaccacccauuuuaacagaauucucccuucuucuucucaauacuagcacaguuuguuaucacuuaccucacuguuacaauacgaaaguauguacuggucuuacccacuagacuguaagcuccucagacugauaaaccacaccugccuugccuaccacacuaccacagugccugccugccacagagcccuggauguagaacuacugaggagaaaaugaaugaguacagcacuauggcaacccuaagaaagagcauccacuuucagacagccaucuuguggcugcucagauacacaccugcagugcugggaguccugguugugccugagggaugucccugcagcugcugaagcaagcucugugucuaacagcgucucacggggaccagagcuacuaacauccucagcuuguuugcacucaggaggcugagcuucuccuccuuggcuuucagggucuaaggcugguggcucucccuucucagggucuggagucagugacaaucuccuggaguugccuugcaguagaccaucuguggcuacuucccugacauguucuucucccaacaagccauugggcugcacuguucucuggucagcagcaagcaucuccucagacucagaguccauaguuacagguccuggagguuuaggugggauugaagucgggggccccaggacucugugagcugggaugccagcuggcugaggugggagagaacugucuuugauuucugaagguaccuccgcuucugcgggcuccccuuuccuugucugugcaccauucucuggcguggggagagccuguagaggcagugggguggucuccccuacuaccuguucuggcagcaccucgggagccuccugcgucuccccacuugggggugcuggaggcauccccgggguggcagggccuggcugcuccagggaaggucucaggggcuucuucuccucuuccuccuccucuuccucuuccuccucuuccuccugaugguucaacagcugcagcgucaccaucuguucaaaagccaaggaggaggugacacugacaggaagacagcauguacugacagguccuuguccucagaagcacagcugccacccaacucacucucucuucugugggaagaggcuggcuggacacacccauguggacauaugccauuucagggguucccaucacuuguaugagugcccacuccagugaagccccugacagcuuucuggauguaccuuaauuguaugcaugaugguccucagaauggucccuccaucauaagauuccuccagcucaaacucuccccucagugacuggaacaccugguucaugaucuucuugaccugagccaagaucaaaacugcaugcuacuaaacucaaggcauuaagggauacaucaaauugcugagucagaacucuauggaaggacagagaggcaugaguggcugguagcacugagaucugccaccguggagaaaacgguuuuaaguaaugaacacuuuuuuuaaaauuuuaauuucuuuuucuuuacuuuacaucucaauuacauccccaucucccuccucucuuuccagugggccaccaaccagggagacaaacaucuuuuaacagaaaggcuagcuaaaagaauuccacaucaagugaugguugaguauacaagacugcccaaagucauuuacugaucugaugucacuucaacucugagcaccacggaaagcugugugaccuuggccacagggauuaguggaugcuggguucugggugcagcacuacccuccaaccccucucuaugacuucagggcacuugccaugucugccacagcuucggaggaauagucucucugggcuggcuaccagagugguagauucuaaagagucaguuuuucucccagacaagugcuguaucaauaaagcuggagaaaugcugucggcaucacauacacagguauuuucucugaauacuuggugagcacauucacuacccugcugugcuagguuuacugcuucuuugaaugcccucaccuucucugaggggucagcagcagcucugccugcaggugccugggacuuagucuucuccagucgcugcauguguuccuucuguucagugaaggcugcgaucugggccuggagagcuaagcacugcaaagugaacagacuggggcuguggccuugggaaccuggaugacugugauggccaggaaacacacaagaaccauucugagcacaaguccugaccucaccuagguuugcuaggcccagcagugguccucacugcagaccggcugaugugggucacccuacucccucgacaaucaacuugcagcuucauucuaaccuccaucaaggauacuuguucccaaugaggucaaaaauagaaugaaaaugaggggguguggauagugguaguuacacacaaguagucagcagacuuuucaccuccaagacugcauucaagaccuccaugucaaagguuuuaacugguaauacaaggaacugcccuucagacaagggacuuccacagcacauccccaagcccccucccagaucucuacuccacccaucuaccuuacuacagcuaccugcccuuggcucuccucaaaagucaccuccucugagacuccuucccagcucuguuaggcacuuccucucagagcaccaaaucacuuaucugucucuuuuuugugauuaggauucuugagggcagaguccuuugcaugcccuuucgcuaacacaaagccaaacugacugauauucaggaaauauuugcuuaauauaugcaggaucaaauagugagaaacaaguccuagaauacuggcuuuuuuuuuuuuuuuuuuuuuuuugucucugaccuaccacccuauugacauguaaaagauaacugacuguaaguuagacuaccuggcuguguuuucuagcuauuaauacugcccagacucaaaaggcuggacaagcccccacagccuggaggucuuguguuauaaagcugacuuagauaaagaaguaccucauccugaaggagagccagcuucuguugaugggcaucccucugcgcgcacacuucucgguauugcugcagguguucaucucuugcagaggccaaaagcugcucacacuuagccucccacuggcucugcagcucagccugugcaagagucagcugccaagacagacaacagccauguguagugggguggagggugguucccacuacaacaaaggaagcccauucuucauagaauucaaagacccuuggcccauuuagguagaaaacaacuguuaaaauggucuuaauuacucugaaaguacccuuuuauuccuucuucgguucuauguugugauaucagggucucucacugaaccuggagcuuggcuggcagggagcgccagugauccuccugucuccauuauacacaaguagccauacccaacauuuuauauggaugcuggagauucaaacgcaaguccucacgcuugcacaguauuggguccaaaaugcccccccccccaaaacagcagagcuggagacaaaguccuaaauaggacucuggcuggguaaacagaaacccuucuuuaggcuuucuuuuguggguuucuguuuaccaggaaccucccuuaaucuaccaccaaaggccaacugccucaaaggccaccucugucccccaucaauccaaacagccuauauuagcucaaagaccuccacccugcugacuguuacauaacauuugcuggcuuuuccaccauuuugcuuagccccuagccuggggagacagacacaguagucugagccgaguaaaccuuucugucuacccauggagugguccagcuuggugauuucacccucacuuauacacagcaagcacucugaccuacucagucauauccccagacccaaagucagcaugacuuaaacauuaagggggaaugucaccuguugucaggauuuccacuauucucccaggugugaaaacuccagaagaaacaucuuccugagguaaguggaggcuauguguucuuuacagcuuccugguauugccaagagccuauuaccugcucugcagcugcuuggucuguggacacccgagccuuuuucaagagcugccgaagucuguccaguuccuccuggugugacuugcgaaucucguccaucucugccuccgccuggcagcgcuccugagcugacuucuuuuuccucucugagagguucuuaggaacaagagaacuauccucagcacuaguuggacaguguggaggggcaguggucagugaccucagcggucaucucuaggaacgauuccgucuuaagcggcccccacaccuuuauauuuugcaucccugcuacugagaugaacucugacagggaaaaggcagacaauagauucacugccauucuuuuaaaaucuggggcagcauaacuuuaguguagguacaagaaggcagacacaucuggcuggcuggugagaaaauaaauggacacaguuaucauaaaaagccguaagucauagucaaagauuauaaugauagucacuguuauagugucugcaauaagaaaaaacuaaaaacagcccuaaaucagaaggaacugcuuuaaaaagcacaacaaaaucaaaaaggaacugggaagauggcucacuggauaacucacuugccacacaagaaugaggacuugagcucagacucucuacucccauagagaagcagacuuggucucagcacuccuauggcaaaagaggaacuggagaccagaguauccucagaagcacaggccagcucaggaccucucaaacaagauggaaggcaggccugacaccuaagcuuguccucugacuuucacccauggaugugcaugcuguugcucucaugguaucucucucuucugucacacacacacacacacacacacacacacacacacacacacacacacacacacauuuuaaagugauaaaaaucccagauaauauugaccccuaaaaagguauuaggcaugaauagcuuuacuagaggcuuacuguaaccccaguaacaguuucuucuuuccauauuaaacuguucuagaacaaagaaaaagauagcaauugucuuagucaggguuucuauuccugcacaaacaucaugaccaagaagcaguuggggaggaaaggguuuauucggcuuacacuuccauacugcuguucaucaccaaaggaagccaggacuggaacucaagcaggucaagaagcaggagcugaugcagaggucauggagggauguucuuuacuggcuugccuaaccuggcuugcucagccugcucucuuauagaaccuaagacuaccagcccagagauggucccacccacaaggggccuuucccccuugaucucuaauugagaaaaugccuuacaguuggaucucauggaggcauuuccucaacugaagcuccuuucucugugauaacuccagcugugucaaguugacacaaaacuagccaguacaauugaccccuugucaacuugacacacaaaaacaucacuaguaagccucaacccuuacagucuuauucauccccauucuaaauaacuuuaaaagucccacagucuuuacauauucuuaaauuuucaaucucuuuaaaauauccaucucuuuuaaaauucuaagccuuuuuacaauuaaaagucucuuaacugugggcuccacuaaaacaguuucuuccuucaagagggaaaauaucagggcacagucacaaucaaaagcaaaagucaaucuccaaccguccaaugucugggauccaacucaugaucuucugggcuccuccaagggcuugggucacuucuccagccaggcccuuuguagcacacacaucauccucuaggcuccagaugccuguacuccacugcugcugcugcucuugguggucaucucaugguacuggcaucuccaaaacacugcaugaccccuucaguccugggccuucauuugcaacugaggcugcacccucaccaauggccucccauggccucucacagugccaagccucagcugcucugcgugaccccuucaugccuucaaaaccaguaccaccugggugacccuuacauauuaccaaguccugcugcagcaggaguacaaccuuggccaucucucuggaacacauccucuuugugcuuucagaaaacacuucccagaaguugucaccucaaugauacuggucucuucuuaaucaccgcuaauuucuuagcuccagcuaaccagcaucaauagucccaguaaugcaaagguuuugcuuuaguaguucugguaucuuguuaaucacaacugauucuucagucccagcuaaccagaaccacauaauaaucaaacuccaaaauagcaaugucccuugaaaagucuuuaauuuucccucugaaacuucacaagccaggccuccaucuucugcacuguucucaacauuaucuuccaagcuccuacacaacauccgacagagcucuuaacaacgaauggaucuucaagcccaaaguuccaaaguccuuccacaguccuccccaaaacauggucagguugucacaggaauaccccacuccugguaccaauuugucuuagucaggguuucuauuccugcacaaacaucaugaccaagaagcaguuggggaggaaaggguuuauucggcuuacacuuccauacugcuguucaucaccaaaggaagccaggacuggaacucaagcaggucaagaagcaggagcugaugcagaggucauggagggauguucuuuacuggcuugccuaaccuggcuugcucagccugcucucuuauagaaccuaagacuaccagcccagagauggucccacccacaaggggccuuucccccuugaucucuaauugagaaaaugccuuacaguuggaucucauggaggcauuuccucaacugaagcuccuuucucugugauaacuccagcugugucaaguugacacaaaacuagccaguacagcaauguacccugauauuaaaacuuuaaucacugaacuuuuaaauaauauaugacucaaagauagcaggcuagggaagugagcugaagagacagcucagcaguuaagagagugugcuggucuucuaaaggaccugaguucagaucccagcacccauguuggguggcuuacaaccacuugcaacuuuaacuccaaaauaucugacacacucuuuugguuuccugaggcacccauauauauauauauauauauauauauacacauauauacacacacacacacacacccauacacaaaauaauaggaaugagggauuuuuuuguuguuguuguuuuucuuuuucuuuuuagagacaaaguuugacuauguaauguuggcugaccuggagcucauuauguggaggaggcuggccuugaauucagacagauucauuggucugcugccugaguauugagacuaaaugcauguacuguuaaacacaaggucucaugauguagcccugccuggccuaagacucauuauauaaauaagaccaagggccucaaacucacagagguucaccugccuccagaguacugggauuaaaggcaugcgucaucaugcauaauaaaucuuuaaaaaagaaaaaggagaagauuaaaauuuaaaaaaaauaucaagauggaaaaauguuagcaauguuuauggcugacaaaagauuaauacucuuaauaguucuauaggaaagaggauaaagaacuccaaaacagaauucacuggagaaauaauaggaaugaaauauaugaaagcuuuaugacuaauaaaaacacauaguugcugggcaugguggugcacacuuuaaucccagcacucaggaggcagaggcagcagcuggaggauaaccuggucuacauuacuccaggacagccagaacuacauaaaagacccugucuaaagaaccaaacacacacacacacacacaaaacaaauagcuauucagccuaaggagguccucagcaguuugaaaugaaaaacuggaaacauaaacacccauugauccaggucagcugcacaggaggcuaacaguaggccacugagcagcaguaauggguacagugucuucagcacuuucaaaggcauuuaauaugagcucaguauugcuuacaaaugcuaucagcacauuuguauacagagauaugcaauaaccuacugcccugagggcuaauguguugucuauaguuguuauuuauaacccauacaauuagagaagcaauuaaaaacaacuuuuuaauuuuauacuucucuguauuguuuacauuuuucucuaauacauucauacuauaaccauuuuaaaagaaaaacaaaaugguuuacuaaucagcuacgccugcacuuggggccaagagaaaguuggcuuuggaauuuaccuuuucaagggaggucuucucagcucggaggucagucagcucuuccuccagggauguuaccuugagcuccagcugccgccggcucugcuuuucacuuuugaauuuggucuguguuugcucagaggcuucucggagcucuaggagagagaaaggagacaugaucguagaaccagagaugcaguggacaauguggcaucccaggagcucuuucaaaguugcacgcuuuaaucgcccaaucccacugcauaagugagccuucccggccugcaguaaggauuagcaagcccugcacugacucuguuguccauccauguuaaacauggaaaggguaacuucuauauguauacaccuucugcgcaagcaaagugagagaauggucucugauagucagggaccaccuucauuccauguccaucgcuaaacgaccacaugggugucuuguugagcagagcucagagcucacagcccucucgcugcauggcuaggacucucagccuucuugguaguuaggacauuuaaccaagaauuugcuuucaaaauauuccuucucaaauaagguugggggugggguuauauuuuaauuuaauaugcuaaaacuaacucuugaaguaacugucacaaggaacugucaggagaaaccagaaaagcagaagugaaauaucuacagguguuauagaauauuugaucauacugugaacccugagauuguguuacguacuggaaaaacccgcccuagcacacaccuuuaauccaauuacuuucucuugaauauuguaaacaggauuaaauaaagucaaccaaggucaagaaguggagcaaacaaccaguugacaggaagugaacauaggauuauuaagaaaaaaaaaacagagaguaagagggagucaggaggauggagagagaugcacaggaaguagaagggagggacauugugaaggaggcuuuuugagacaucaagaaagagaggcauucauucugggacuugagcugaggaggaaggucaguugggugcuuucucugccucuaugagcuagcaggcuuuuucuccagcaucuggcucuugaguguuuauuguuaaacuugagcaauugagauuuuguugaaaaaacaacauccauucucucugcugcagcagccucuguuccugcccauggucccaguugccuugcacacagguuucucuaccgagacaugagggaacaugcuggcauucacaaacuucuagcuagucagcaugucuucgucacuacccugugccaagcacugaaguaacccucauauggaggaaaggauuuuacaaggaguacaucacuguccuugaccuucaggacuuguauucuagugggaagaauagauuuauaaaugaugcuuaucaaaggcuaccuugaugaucagaauaaugcaccuaagagauaaaggguuuaaagaaagaccagauggucuagaacaagcuggggaacuugugagaggcagauuuuagagcggauuggagauacuaugauggcgagcuugccaagugagcacacccucuaaacacagcuauuccaagaaaacacaaugaaaagcaaaacagaugggcuagcggaagagcggucagcagaguggucaguaggguugugcuuacggcagagcucugagccuccaguccaggcugcagcacugcaauccaggaaggaggaaaucuccaggaaggaggaaaucuccaggaaggaggaaaccacagcaggaagugcuucuuucuucacaauccaccaaguuaugacucaggauuuccucccacagagaaacagugcgacucaucaaguacuacugaauuucugagggagagcugucuucccguccauguaaaacaccugaggaguuuuucuaccagucccccuugaagcucaguccuucacgagugccaugagcauuaggccgaagggaaggagaggaaggaugccauuuaacucaaguuuaaauggagccaugcugccguucuccucugagagcuuacccgagaggucagccuggagccuggugacguggccccugagaagaucugucuccuucaaguugucugucagcugcaacugcaauucugucuccuucuucuggugagccgucauuuucagcugcaggugagacaccugugcaguagcugcugcuaacucuucuguuaccuuggccugcacagugacaaagggcaccaucacuuuagaugugggcauuccaugugcugauucaaccuccuguaacucuaagcugacaggacugaagggaggaaaggauaccuuccaccugcacuggacuaaaaucauaccucgaaagugcacaaggucucaggcugaauucuguugcagaaaugccuuauaccuaguaaguacuccacaagccaauguggugguacacagcugaaaucccagcacuuuggaggcugaggcaggaggauaaggaguuccagacaagccuuuguuauguaaaaagacuguuucaaaagcaaauauccgagaaacaagcacuauaagagaugacaaaaguuuguuuuaaggcuguucaaugcagcauuaaguuguaagagaaugcaaaacuaacacaaaacacugaaaagacuuaagcaaaauaggaaccauguauccguaugcuaucaacauuauauauuugaaaagaacacucaguggcguggaauacagcuggaaccuacugcuaaaugaagaauauaaguagauuaucaaauaguauguuaaauauuauucuguuuuuguaacauggucuguauguaaagaacuuucggguauuuugcaccaauagccaaucuacagagaaccugagugcuuucaacuuucuucuugcugauuggauuauauuuuacaugagucuuucaaaaugauuugucacaaauucuuuaaaaagauaauguucuauuguucaauuuuuaaaaaagacuuuaaacagugacaaaccccauuuuauccaguucuguauugccucauucugauaaucauagagaaauauuuuuuuucaggagcuggcaagauagcucaguggguaaagaugccuguugccaagaccgacaaccugaguuugaucuccaggacucauauggugggaagagaaaauugauacuggaaaguugaucuccacaugugcacuguaguaaaugcauacccacauauauauauaugaacacaaauauauaaauaaaaauguagcaaaagacauaugcauucaaauucccauuuguauaaagugauucuuuauauacauacugagucuucacacauuccagauaaaacagcagauauguuauauauucuucaauaguacauaugggucuucuccccuccccccccuuuuaaaaucugaaucauauuguaguguguggaugugagguaguuuauucuguauuguagcacacauggaguguuuguugucuuucucaucauaccugugagcauuucagcuccauuguaugcaaugauccccucaguaugcaagagccuuuuagaauauuucuagaugcagaacugcuagaucagaguaaauccaugugaaauuuuguauauuguuaguuuucuuccaucaggaacauauucuacauguuucaucacccuuuaaccaaaaguucaaucaagcugaugagaaauagcauuugugccaccuaacacuucuaugcuaggcaagcaccagcugaaagagcccagauguccucagggaccgugugauggaggugaggugacugaggacucucacaggguauucugagcaccagagaugaugacaacaaugaugacggacagucacaaaaagccagcuacugcauccguucccuugaacugccgcuccacagcacacaaacucagacgucgcaaggcagugugggggugcucuguggggaucaggcuugcuucugugguugggaugacuucccuaugcugugauauugacaccacgauucccucuacauuguugcauguuuuagugcacaguuuacagcugucuacuuucuucuguuauuuguagcuucugaugguauucacugugcacacaugguacuuauugcugggacugaggcuauaucucaguagcgggacacuugccuagcauguacuaagcccuaaauucaaccccuagaaucacauauacaaaaaacugucuauuccuugccuuauucccaaauauuuuaucaacuuucuagcuucaauuuaaagucugguauuuuggcuccccuaaagguaaaggaaaugaaacaaauguguaugacuuaaaaauaacuaggccacgaaucugagaguauaaaugaccuuuacaguaagugugaaagcuugaguacaaaugguccccauagacuccuguguuugaaugcuugccccauagggagugguauuaugaggggauguggccuuacuggaauggguguggccuugcuggaggaagugugucaaugugggggcagguuuugaggucucagaaacucaagucaguugucucuugcugcuuuuggagcaagaacuucuuagcuccuccagcaccaugucugucugcacacagacaugcuuuuccaccaugauagccagccccaauuaaauguuguccguuguaagaguucccauggucacagugccucuucacagccauagaauaccuaaguaagcauuuagauuuuuauuuuuaucuagaaucuccagagugggcuucaucuuccuaacacagaauaaagaguaaaguuuacuugcuauucuaccucacacagcccaugaaaaaugaacuaacauagaacucagacagcuuugaaccucuguguagcuuagagaguucaccaauuagagcagagccccuaucaagaccuuaaagacacaucuugucuaaaaggacagaauaggggacucucaaaagugcuuccccacaauuucuuuuaaaguggcaucucacuguuuagcccagacuggccucaaguuaaugauccucuuaccccagcccaaaugcuaggauugcaggcaugcacugcuaugaucagcuucaaacauuucuaucucagauucuuaccuacaaaggccuaguauagaagcauaaaaauacucccacacaaaugcaugcccuuacucaaagacgacaauaauauauuaaccaugguuaucuuugaauggaaggauuauagguaauuucuauguuauggguauuuuauuagaaugaacagauccaacuuuuguaaauuagaaaagaguacauguuacuguguguguguaugaagcuauuuauagacaugaucauauuuuuaaaauugucagggauagcaauguccagaaggaaaggaagucagcagaaaccgacaugguagugggaagacucucugguuccuacucuggaacaauguccacgguugagguggagcuaggaaacccagcaaggauucaaagacaagaaagcacugacucuagaagcagaaagcagcaucagcagagacacacgcuggugugagaggacggggcugagaaugaagcccugagcaagugcuuucuuccuucugggccggccaggauuuguucuuuuuaaaguaagcccaugaagcccagcuccucuaacuggucucccacucuggaucauuacuuuauaagaaaacugauuuuuacauagcucacuuaccaaauauuccuugaacacuuaaccauauuuccugagcaaugcuuggcagcagaaaucugccuccugaaaggaacugcuguucucccuucaagagaggucgcagggagagugcuagaguagauuaaagcuggugcacaccuucaaccccagcacucugaggcagaggcaggcacaucucuucaaguucaaggccagccuggucuacauagcuaguuucaaaccagccagugcuauguagugacacccugacucaaacaacaaauguuuaaaaaguaaaucauccagggauaguggcauacaucuguaaucccaacacuuagaaaacugagagggaggcuggagagucugaggcuagccugggcuacauuccaaaaccuggacugaacaaaccugggcuacacagugagaacuuacacaaauaaauaagaaaaaacaacuaccaggggacacuaaagguguaaaacgucucacugaaauaaugaugaucaguggaauacaugguacccuagucaucagcugggaggaucccuggggcacaucuagacucuagagggcaccaggcaggugugagcugcaguucugccauggaucuucuccuguuguuuagcuauuauacauagggcacugcuaggcucagugccagacaccuguugaguuuuaaaaugcaaaaccacaaguggauuagcaagcuaaguaagagccugauaaacucugacucauagaccaauuggagcacuacuuguuuugggaauaaaguuuuauuggaacauacuugugacuacauguacauacaacagugauauccaacauggaggucacauauugaacuuagguaaaaacaaaaguauccagaugccacauccagagacuaugacaagagacuaugacuuggcagguacuagaauacaggagagcuuuggaaaaguuuuaucuuggucgcauauaguaaguuagaugaagcuucaaaauauguaguucugaucaaguuucucaagggauucugagguagcuaaaccucuguugggaugucucuggucuauagacuauguuauagucaccauuuuaucccugaauaguaccaaugcggaaaaagaguauauuuggguuaccccaguaggccugcaguagggaagauaaaggaaaaggagaggaaaaacaaagauaaaacuagagacaggagacauacucauaaggcacauuucauggagaacaaugaaguuccaggcuguugaccaugaccaggucauuaguagauagccacaacaaugaaugcagucgcagugggaaagaaacaguaaugaaacaggaggagguugugcagggcaaggcacagcucacuggaugauaccugguugucuuaauuacuguucuauugcuguuagaggggggaaaagcauuucacugagggcuuccuuacagguuccaaguaucaauccccagucaucgugguaagaagcaugggagcaggcaggcaggcaggcaggcaggcaggcaggcaggcaggcaggguccuagagcaguggcugagagcucacaucugauccacaaguuauaggcagagagagcaagacccagccuucugugggcuuuugaaaccucaguuacacaacuccucuaacaaggccacaccccuagcccuucuuaaaagguccaucaacugggaaccaaacauuuaaauguaugauugggaccuguaagggcuauuuucauucaaaucaccagucacaggccaaagauauuacuaacagcacauugugguuaagcgaacacagauagcuuaaaccauaaauaagagauccuuauuaucagaauacaagaaagcaugucaacacuacaagcuacaguguccauucuguucaauuuugcuuaagauuucaugaaaaaacacaagauaaaagcaacgauuucccggcugaagagugauaacccaaauaaggagucuguucuggauaguguccaguagacaagaagaagaaaacugggcucuagaaguagcugaucucaaucccaagacucacuagcacauuucucagugcuuuucagagguuaaaauuuguccaucugaaaggacuacaggaauucaucaccccugccuuccuuacuuguuuauuuauuguggcaggagcuugcguagcucaaauuuuggcuuccaacuuugugccuaacagagaaugaucuugaacuccugauacuccugugucuacaccccaugcucuaggacuauaggugccugucacuauguccaacucuuacuguuuuccuuuuguuuuguuucacacuauguagcuuugacuggccuagaauuugcuguggagaccaggcuagccuugaauucacagagaucuguuuguuucuuuaucucaaauaacagaacuaaagguauauggcaccucaccuggcauuguauucuuuaaggcaaugucucacuauguagcccagccuggccugguacuugcuauguaucccagcguggacuaacaacaauccuuucucuugaccucccaaugcugggauuacacacaugcaccaccugacuggcuccaaagucgcacuuuaaaaugcuuuugucagaccaaaaugaauaacauacuaaauacagacaaaggagcaaauuagacagucuaaaauuccacuaagaacauauacauguuacauggcauaacagaaauuuucuuuugauucuuguaacuauaagaaucucaccauuaucaaauuauuaagacaggcaauuggacuuuuuucuuuuuguuuucuuuuuucuuaaagaaaggaucuuacuauguagccaaggcugcuguugaacuacagauucgcccacaucugccugugagaaccugggguuacaggcaugaaacaguaccccuaauucaaucauuguuuuugagucaacuuauuguagaacauuuaguaaaacagaucuagagguaauuaauacaugaaaaucuguugaaggauuuccaggucucuucccaaagauggcaaauauccugcugcacagaaacugggaaguucuuuuguaggacuauuccacaccucaaugcaucccgacaugggccuuccucggcccagugauuuuuaccuucucuuguucagcaugcaauauucuugccuguguguuuucuguggcuguuugaagcgaguuguuccucuucuccaucaucagguuacucugcucaacauaucugaggcagaaauaaaggcaaagaaaacauucacgaagcauugaauguuugacagguacaaggcccucaguucucacaacauugcucuacaccuccaucagaaucaaugugaauggagcuggagagaaggcuccuagguuaagaaucuuagauguuuuuugcagaggacccugguuuaguucccagcauccacaugauggcucacaaccacacagaacuccagguccaagggauccagcucucucuuccaggcacuacacacacaugaugcacagauagcaagccaaauauccauaugaauuuucuauuuaauuuuuaaaaggccaaauaacaaucuaaaaccacauugcuuuccugagaccugcagaaauuaaccaagcuaucugcagugaccaaggaaggagguagcaaccugggucacauauugaagagagacauucacagggugcauguuaaugggagauggggagaaaagaaaaaagggguaagacucucaggggaaagaagaaaagaagcacuccuccaauccucucacguuagagacaaaaaacacuggauagugaaacacugaagugaaacuaguuccguuuaccuuucuaccuuccaccaagcccagaaggacccucuaaaagcuauaaaauaugcuuuauuaaaucaacgaggcucuguuugaguucugguugauaaaauagccuacacagaaaagagaagagaggacacaguuuucuaccuaacaaccauuuucugagaaagcuaggccugcagacauauacaaaauauccaaagccacacaauaaaugaagugcagggcugaaagucaacagcaguugggucuuacaccaaccacagccaccucagccuuuguacugaagaugaacaaguaauucacacaaggagcagaaacggaaaugguugaaauacauggggugggaaacagguugcagcucagaaguaucccauacucaguaugagcaaggugcucggguucaaaaacaaaacaacaaaguguagagaggagaauuguaacuaauauacuccccucaacagugugcauuauaguggaugaacguacaauaaacucuuugcccaccguccccagcccugccucgcccugccauuaccucugguugcguucaaugaggucacuaaucuugucauucugcucuucuauccgacugcuuuucucaaggagcuccugcuucagucucucauuuuccuaaauucaaauagacaacaugcaagguaagugccuuaaaagugcccacuaagucaggaagcaucuacauaguuccauuuccucuccacucucugcuuccugguuguagcugcaaugcgaccagccacuucguauucugcugccguaucuucccugccaugguagacuggauccccaaaacuguauagcaaaacagcuugaacccacaaauggccuugggaaacaaacacuaaaacuuauuuucccagagauguaacuguuaaaguagcaaaucauacuggcuggauuauaaucacuaggcuagauaggcugaggacugauauggucauaaaaugaaaggagaguuuaaaauaggccuaaaaagcaugugguuuuuuugacuacauaagucauacugcuauguagcauguagaauauagaauaauauaccuuaauaaaauauaguaucuaguauaauacagauacuugugguucuguaaugccacccauaggcucauauguuuaaauacuugagcaccagcuugggguggacuggcaguggagugcaauuagaggaagugggccccugcggcuguucccagccagguuccacuuccuguuggcucucugcucacugaguccaguugucuccacuccacuaccacuccuaucugccacccugggcugcgugcucucagacuaggaagcaagagaaacugcucccuuaaguuguuuccugucaaauauuuggucauagcgacaaggaaaauaacuaaaaugaaagauaagccacagaaccaaaguaagccauaaugguuuucccaacuccaggucucaucacaugcuacuucugggguguggggacagguuuacggguagcacaucugaggaggguguguggacaagcccuccaggcugucgugcucucccuccuccucaccuggaugaugcgcuggauguugcucauaaucaugcuuguuuccauugugaccgacaugcuaggaagaagcauggaguugccagagcuaugcuucuguaacuccuccaccugcgaaagggaagccaagaaggcugugagcauguuuuaguggagaauacaagucacccaggaccagucaugcuucuaagagagcuaagacauuucugaaacaauaucuaaauguaaacuuauuuucucugcuaaaucaaucccaaaguaaagaugauaucucuucuagggaaaugaccaaggaccgugaauaugggaaaccaaggaaaaguguucuuacagcuguggcugcucccauuuacauccuauguguugccuacuuccuguauccccccuuuuaacauuuuaauuuauuaucucuuuuuaaaauuaaaaaaccauguuucuagauuuauuuauuuucuuuuaugugucuuguauguaugugccugguucauccgagaugagaagaagauaucaggucuccuggaacuggaguuaugaaugacugugagccaccaugggggugcugggacuugaaccuggguccucugcaagagcagcaagugcucuucaucauugaacugccacccgagccugcuauuauuuccauauuacaauuucacacaucuaaacaaugugucuuuauugugucucucuauuaucaugugcucauaugguaugugugaguauggacauguacacacaccuguaccauggcacagggacgggagucagaguguaaugaacaagaauugguucucucuugagaaauuucaggaaucaaacucaggucacugugcuuguucagcaagugcuuuuaccugcugagccaucucuggcccaacagccccauuuucaacagagucuaagcucuaacucggucaccuuagucaugaggugauccauuuuaucagccacuuuguugacugccauucgaauuucaguguuguguugccgggcuucagucaugagaaaggacaucaugucuccugauccuaaacagacaugaaaaggaacuuauaaaccuggaaagagaaaacuauguauggaaaagucaagggcaguuuuagcagagcaaagaaggggccauguaugaggaaacaugauaggugauuucacacugucaggagaagcacagaacaggcaguagagacuaaaggacucccaagcuaauaauaacuaacuuauauuucugcaaaaugcuucaagagcuagaaucugguucaaaugcacacuggcccaaguguauccacucugaacugcuaugauccugcacuuacauuguuuccccauucauccaacugcaugccaggcauugcacaggcacaaggagaacagucaugaauaaauuaugcuuccaugucuuagugggcuacagcugggaaacugacacauaaacaaagcauuacaacacaguacuuuaaugcaagauggguagaguggcacaugacuguaacucacaagacaaacagaagauucagaguucaagaucagccugggcuaugugagauucugucuuaaaaacaauuuuuugaaggaggugauuucaaguguagaaaaaagaccaugcaucagguacaaaaguaguaccuuaaaaaauaguauuaaccuuuuggugaugaacauauguagcugugucggugggagcaguguauggagaggaaaugucagguuggacccaugucaaaguguuucaaagauggagaaggaacaggacuccagacaaaggcugcauucaggaagcccuucccacugcagaaaugcaacuuaggcuguuggauaaacuuguuuccucuugccacuauccugaugccaaagugauuaccaagcaaaagacaggcugcacaccacagcaggaaaccaacacauccaucaacauuucauuugccuuguuuacaaaagacaccuacacuugccuaagugcauaaaauacacacaaaguuacccaagcaacugugagagacacucuccuauggacagaaguuuaaugacagacagcacacuuuauccuacuuuguauugccugacauuuuuauuacagugaauuacuuucauaauuuacaauuuuuaacaaaacaguuuucaucagccacucaccgcccacagcagugccugccuccucccaguacccuccaguguuugcucuuauacuaucagcuaugagcuccugucacuaaagggcuggugggagagcauggaaggaaaaacacccggaacagaggcacaaagggccucugagggagauauaaguguucuaaaaauggauuguugugacagaugcacaauucugaacauuuccuaaaauaaauaaauaaauauauccuggagucugggaagaugcucagcugguaaaagcucggggaccugaauaugacuccuuagcaccugucuaaaaacaaucaaaauaguugaucaugguuuuuacacaccuguaagcccagcauugggggauggacacaggugauuccugaaagcuccuggcuagcuggucuaccuaaaauggcagauuucuaguucacugagagacucaaaaccaauacaggaagacauccaaugcccuacuccacauauacacaggugugcauaacugcacauucauauauaugcacacacacacacauauauacaauauguacuauaaugaaugcucucuuugaauuauauauuugaauaaaucauaugguaucuaaauuacauaucaaucaagcugcuaaaacaaacaaugaaaagaaaggguggagagcuguuggaggaaaacgaaaacagaaugggaggaggagaacccagcaaggguggaagaugaaaaaccggaaggaggaaguuauucucuaccuugaaaguggggagccugggacaguggugcuggguacaagggccgaacaggcugcagcugggaaguaacugagggugucuggggauaugcauaggcuugcacaccugcauagggcugagaaagugaugaguuacuuauuuaguuuccugugauagagcaaagcacauuaaccagggaggagacuuaaagcuacuaaagcuggaaaugaugagaucaggguuaggcaacugucuaugggacuugaugguaucuggucacuccagugcuacccaaaaccagaggaacaggaaucuuggguugcugcccaguccucuggcaauaugauuuaaugaaaugggaauuuauuuccuacuaucaggccuauucuuaaggaaaacuuauaacuaagcaaauccuguuuaguuucuuuugaaggaaaaaaaagguuauuuuucaaaguuccuaacuaagccagccaguuucugagauuuuucauaaugcuucuccccugcuagauucuuuuuuaauuuaaaguugcuuuuuaaaaucuauauguaugugugucuacauuaucuauguauggacaaauauggggggguuccaagccacccaauaugguggguucuuaacaguugagucauccauugcucagccucuagauucuguuuuguuuguuuguguuuucagacaugguuuuauguagcucaggcuggccuuaaaauggcuauauagcugaggauacccuugcauuccugauccuccugcuuccaguccuucaugcugggauuacaggcguaugccaccacguacuagauccugcuuaucugcgugaccagagcucuuguuuuucugaacugaaguauggcaacugugaaaggaagaugaaagcuuugggaaucugcuauaugagcuaaaugacacaggcaaauuauauuugcuguauuauaugagcuaauuaauacaggugaagcccccaagaacugccagauuaagugccuggcacaaggcaaauaaaugcucaauaaacaacaacuaucauuuuaagaacagucacucuuuccccauagaaacacuaguuuauuuccaagaacaauauaacaacccaaacauuaauuacuagaaaaaaaaaucuuagucuguggcagagggauuuuccaccgugggagccuuuucucaguuuugauuccccuuauccuaguggagcaaagccugcccaccauggcucccacaucuccacucagaaucgccuccaggguggguagggcaggagagacagcucuugcuauccuauguguacuagugggaacuuugcuaggugccaggcccaggccuuuaauaaguacuuugcuuauucuugcacuuaaucuucacaaaaacuugcaaacagaaaacuuugugugguuuuagagacaacagagcaguaauuuagggaaagggaaaugacaagcuuugacuuggagaacugcugcuguguaaaaaggagagagggaucaucuguguucauauaagaagaacauaaauuauaucucaugccuaaaagaguuuuaaaauacuauugcuaccugggggcuggaugugcuggugcauuuaaucccagcucucaggaggcaagaggcaagcagaucucugagaguuugaagccagccugaucguuggguguguguguguguuuguguguguguuuguguguguauaccaccagccaagacuacauagugagaccuucucucaaaauaacaaacaaaaaaaaauuaauuaauuaaaaaacaguuaccuggaaguucugugcauuuccagauacagccgagugagaaucaagggacacagcuugcaucaaggcagcagagggugucuggagcccagaaccagauggcugaggugcuaagacaaaucaagguauuuuuacuguuacccauccuugcuuguuuugucaaugcaaaaucacaacucucaccucaaaggagauaagagaucauuuauguuggagccaaguaugugcgagcaugucaugaaaccaaagguucagguuacuccacaucccaaguuccuacacaguaaacagacucaugaaguucucacaaaccuagacacuuuaaauacagugguuuaaaaauaucagggaggcauauuccaggaagucaggagauccauuuauggccucagauacuaucugaccacguucuuagcuuuuaguugguagaggcuaguacucuguacauuccaaaggauuuaccuaauaguguuaggcuacauacacagaggggcaauaaacggcuauuaaguguugcaggauguuugacacaccgugaaccuaagauuguguuauuuacuaaaaaacaaaaaacaacaacaaaaaaaaaacccaaaagauggcuuuaguugugguauggcccagccuuagcacacaccuuuaauccaagaacuuucugcuugaauacuguaaauaggauuaaauaaaaaccacuauuguuaauaacaggucaagaggcagagcaagcaaccaguugacaggaagugaacacagaauuagauaagagggacaagaggacagauagagagauacauaggaaguagaagggaggggcauucagucugaaggagguuuuuugagauggugaguugggaggaaugagggaucauuccuucuaagacauagccugagaaggaaggucagcuguguguucucucugccucugaguuagcaugcuuucaccccagcaucuggcucccaagucuucacuggucaaaucaaaagauugaaacuuuguuuaucaaacaacuaagggugcuaaagauagcccaagauaaauuacaacuggucugaaccugcuggaccccugccucuucacaauucuugacguucucaucagcuagccagccuugcagaagguucagugccauguggggcucuuuccaggaacuuuccuucacacuuguaagucugaacuggcacccaacauucccaugcuuuaaaccagaccacuuuccucccaaagcagcccaugggcagcccagcaaagguggaaacaguguucucuuguucaucugacucagaucccaucagcugacacgaguguaaaacaacacauacggagaugucucaacagcugagcacagacuuccuaaaggggcaaagcaacacagcagacauacaucuuagccucaaguguucuacucagagacaaacugacaagucuuagccccuaacccaggccccagcacuaacaauacuaguuaauaaucuaaggaacacagaugaaaauacugauucaacucaagggccgagccuuaucaagguuccuuucuuacccugugaggccaucugugguaauaccggaugagcuggcugaagagaaggcuggauagauggugucacaagggacugcccagcuccucgcagaacaguugcauccugaaaaaaacacaaggguugaucacuauguguagguuuuagcugaagacagaggcugccugucucuaacucggcucacaauacaggauuucuagucaagaaagaggaaggaaaggcaggcagaaagccaguugucagggauaugaguuguacaaaggaagaacucaauuaugcaagaguaagagaucuucuuccuauaaaucauaucaaauaauuaauauaauccuacagaaccaccaucagcuacccaacucuuccaccaagcagucucagaccucagagcacccacagaaaacuggacagagcagagcaagucacugcaccucacuagcaugcuggcuuggucaugucuguccaggacgcuuguccuaagucuuuuguuguuguuuguuugagacaagguuucucuaugcaucgugacuguccugaaacuugcuauggggacuuguuggccucaaacuccgagauccuccugucucugccuuaauugaaagugaugagcuuaaaguguguguuaccacacccagcuguuagcucucacuauuaaaagauucuuaaaaauucauaaaaccaaaacuguuaacucugagcaaagcugcccuguauuccugcuucaagcaaagacaagaugucauaugacaugagucauaugacuauaauuugcugugcugugguucaagggcugucaucucuggauuauucuuauacuuuagagcuuuccccagcaccaaauauugucuucugggaaaauaagcccacuuuuugauaauuacugaauucuaaaucaacuuaaaugucuaucaggagaguaaagggaauuaugguagagagaaggccaccuaguugucuuuaaagcaauacacuuuacauauauuauugacauucacauaggcauuuaugauauaacauuaaguuuaaaagucaguuuauaaagcaauauauaaggaaaauaccccuuuucuaaauauauucuuucauuauaaauuuuaauuauuaugcaauaaaguaacuuuuaguuuuuaauuaauuauauuuaaauuuuaguuaauuauauauaaaaauaauuuuaaugaacuauauuauucaaauuucauuuauagaaaccaggaagacaauuacaaaacaguaagcuuccauuuaaaauguuauauuuuacaucuuuccgggggguuggggaggacaauacucuaaaauauaaagccuauuucagagcauauuuuauaucuuuuuucauuuuauaucaaaugaaaaaaaucucaaaagucaaucaaucauauauuucaguucacuugagaaagaauuguuuuaucaguaacaaguuaaucauugaaaaaggcuuaaguuacuuuauauucuuauggauuaaaaauuuagaucuaaauaaauaaaaaauaaucauauuucugaaagucauaaugcuaugcuuuuaaaguacaaaaaugaagaugcuuuuccuuuguauguguguguuuauguguucauguauguauauagggaggguacacuuguguccuuauguauaugcugaggucagaggucagcaauggguucacuuucuauguuaauuuugagucaggguuucccaccaaacuuagagcacauugauuggcuaguuugucugacuugcaggcuggagggaucccucugucagggccuccucagagcugggaucgcagguacaagcuacugcauuggcuuuuacauggguacugggaagcuacuuagguuugcauggcaaguacuuuaccugcugaacucucucuccagcccugggaaugcuuucuaagcacaacaucaaaagugaaaagccugguagacuugauuucaauaaaaucuugaacugcuaaauaacauuuuuaaaauaugaaaaaagcacuauacauauagucauaaaagcuaacaguuuggccaggcgugguggcgcacaccuuuaaucccagcacucgggaggcagaggcagguggauuucugaguucgaggccagccuggucuacaaagugaguuccaagacagccagggcuacacagagaaacccugucuugaaaaacaaacaaacaaaaaaagcuaacaguuugauauuuaaacaacaguuaucaucaguaagaugaucaauauuucccaaguugauccaaauacucaaucaacaaacacagguggaauccagaagcaguggcacguaccuauaguucuauaggcuggggagacagagguaggaaguccuuugaaccuaggacuuacaagccuaggcaauaugguaagacucagucucaaaggaaaaaaaguuagaagagcugagcaccugucgacaugcagacaugcaugcaggcaaaacacccaugugcauuaaaaaauaguacaguaagacauuuuuaaagaguaaaagaaaccugaaaaaaagaacacagagccuguauggguugcauaucuuauugucuaagauuuuuuucucaucaugaagcagauuuauuacuuccaggcaggcagcuagagauuaugagcaauacagauuccagaucccaguuacugaacacuaagcaaccucuuggucuaauucuuggucagaugugcagaacuuaaccuccauuuggggaugggcuacucacaguuaaaagugucacaugugccuacucuguucucaaacagugacucugcauuagaagcaggaaaggcacuuauuugaagcaaagaaacagaagauggcagcaccugcacacaucucaauagagucaaggggacguacuucgguuucugagucauuggaguccagcuguggcggaaggauggguagcaugggcuggcccauuuuagccauccucgagaucagcuuggccuugaccguaucaggauucuaaaaggaaggcauaaacaucacugugacugagguuuauugcuuucaaauagcucuacuucuuugccuugugccaaaaccuuuaacccucuauuacuuagugaaagccauuucuucuagaaagcaagcauuauuuaugauaccaaauacaaugcaaauuaaugagacugauaauaugaacauuaaauuaagucccuacagcuugggaaugaauugcuuucauaugcaugaccucuuuuaaccaaguguccccacugcaaagugagagugcuuaugcacacuugguuuagagcaguuucuacuacaucagaccaacugucagugaagugcuuccuucugugguugagugugcacaggcuggagggaagaccuggcuucacccaccaccuacuauccucagugcuaggagaaggccuugcuugagcuugaaguccuuugucuaccaucugguccacgugcagcacauucagagucugcauggaccaagccgagcagcagcaaaccaccuuuuacauccuuccuaaaggcacucaaauccaaauguacugaaauaacaguuguuccucuccucucaccauuggggaaacaaaaccagugaccugcucaaagucccccaguggaugaagacgccugaauuccucugagaggauggaaguagaggaugucuacuggcucagguaaaugagugcucuccaaugccccucccccacagcaucuuuggugggggcaguaguaguaguauuuuguucguuuugagauaauauauauauaacaaaguuauauuagcaucuauuauaaugugaacaaugcuuuuuaagcacuuaaaauaucccaaacauaauucugaaaacugaaaaaguguucacuuccuuauaucaauuuacagacaaaaaaauaaaccucuguuuacagaguaaauucuucauagucacacagaauaagcaacaaagaaaaccaaaauuaacuuuuaauccauuccucuuggaguaaauggcaacuggaggauggaagugagcuuuacccgaggguucacuccuaguuucacaucauucuaguaauaccacagcucccgcucauuaaaaacagcuuuacacagucucugugcucagggauuuaugaacuguaauugggggccgugaaaauuauuuccacuguaacaaugaagaaacugaggauuuaaaaaguuagaucauuuucucauggccauauaccuacaauucagaucuaugaaugcaaaaguccaggcuaauuucuacugacugauuuccaaguaggauaaaauaaauaaaguaguaauuaauuucuauacugucaguggcucucaacuacaugcaaggcaaaugaaacaacauuccagggcuuagggguacagaaucauacuuacugaauuuacaguuagcuguucgcugagagaguuagauuuggaacgaagacccgguucccugaaaucaaauaaaacauccugagauaauacaaaaucuaucacugcaaacccaaauuaaacuggcguaaaagcauuguuuuugaaauagucaacugaacagcuaaaacagaauuuagcuccuuuuuauuugcauaauccuugaaagcuccacuuucccaugggccugcauucuauguuccugcccuuugcccuuugcucagaguuuugcagguauuccuagcaccacuuugacagcuauuaauccauugucaaaugaaucugauacauuguuuuccuaauccugacuuuuguccuuuucaauuacuaaaacuugauugcaguuuuaaacugcaucucaggaaccacgcugaagaaucccagagcuugccacagccuuacccagguuugagaggcaauggcaggggugucacaacaggaucagcagagaggcugucagaagcagggaugggggaaggggcugcagaaucccgggagcucacacuguggccaucagagccagaaucucuggcaaacuucaccuaggguggaacagaguauacacacucacccuuccauacucucauuuauuuauuuauucucuagcauaaaagcuauugccuauucaguacaggcaaaaucaaaacaugcugaaaaaaagacaaaggaaacuauacuggcuaguuuugugucaacuugacacagcuagaguuaucacagagaaaggagcuucaggugaggaaaugccuccaugagaucaaacuguaaggcauuuucucaauuagugaucaagggggaaaggccccuugugggugggaccaucucugggcuggcagucuuggguucuauaagagagcaggcugagcaagccaggggaggcaagccaguaaagaacaucccuccauggccucugcaucagcuccugcuuccugaccugcuugaguuucaguccugacuuccuuuggugaugaacagcaguauggaaguguaagcugaauaaaccuuuccuccccaacuugcuucuuggucaugauguuugugcaggaauagaaacccugacuaagacagaaacaguugugauucagcuaccauuccaucaucuguguguaugaaugagugcaugugugcuuuuacaaauggagccauagcuuuguagcuguucugcuuaguuacuauacaggaauauauuuccacgucacuaaguacuuaucuucauuguuuccagcuacugaagagcaugucucaccucaaggucaugcucauuccugcuauggucuacaagguaaagacuccaaaagauucuugaacagaaaucauaaacaugaauguucuuauaaaaaucuauuucacccaggacagccagagcuauacagagaaacccugucucgaaaaaaaaacaaaaaccuauuucacauagacggcuuauuacuaucacaaacaaugcuuuaauggauagcucuaugucuagaucuuugcacaaaguauauuuuaguacucucucccucaucucucaccccuacucuauucuccuucauugcuuccuuaccagucucuuuuucucuccaacauaugcuuucucuaauuucuuucuuccucccuccccccuccuucccucccuauccuuccuuccuuccuuccuuccuuccuuccuuccuuccuuucuuucucuuugagacagggucucacuauguaacucuggcuguucuggaacucacuauguagacuagguuggccucaaacucauggagaucuaccugccuuugccuuucaaacacuggaauuaaaggugugcaccacuaugccuggcucuaauuucuugauuacuguaaaguagaaaacuuugcuuauguuuacaaguuaguaucaauaguuucaaaauaguuugcuaucauuacccaugguuuccuugagcucaaagaaaacuuaagggaaucuauguuuagaaaaaaaaggcaucuggggacaugccacuguaagauuagaugacccaacagagaaaccggucucccauuaggaggguaccucucugcugugacaaacauaacgacuauauagaaauagccauaaaauucauuauuuguacuguguuuuaugguuuauagucaccagcaccauucaaccuaauaauaucagggucauuuuggagaaggaauacuauaaacuaaccaaaaguuguugcuauuuuaguauagaaaacauauucaaagguagagucucucugugugacccuggcuggccugaaacucauuaguaguccaaguuggccauaaacucauuaauaucugacugcuucugccucccaagugcugggauuaaaaauaugucccaccacaccuuacugacaagauuuuuauacauugaaaaaagacaagaugcuuaacuccaaugccauuuucagagaaaaucauucaucauuucuucuaaagcuuugaagcaugagugugugugugugugugugugcgcgcgcgcgcaagcgcauggcuauguauacaaauauguguggucaauacaaaucugcaccaccgugucaguauguuuauguacguccuggggacugaacucagaccucaugccugaaggaaagaacuuucccaaccuucguccuacccuaccacuucuauuuuaaaagcuagcuauaucuucagaaucugauuuauaagaacacaggccaguuucacuuacccgccuaacuucuaccucaaacaccaggauggagucuguuggcugaguccagccuauuacuccuucagagccagcagcgcaggcugaaggagugauaauuaagcgcuuuccuccuuucuucaugcccaguagcccguccucuaagcccuagagacgucagaagugaggaaaugcucaucagauaaaauacacgugaacaaagaauucuccaaagaauuugagucaaacagccauaggcaauacagugaaaacaaacuuuugcacauggaugaauggacacauugcaaagcucuaacaugcccaacacaugacacugcacauauguaaaaugcucauugaucaagcaaaauucacaacuugcaucccagaguagggcuccucgugcugcgucacaucaacaagauaagaaccaagcagcugcuaaauaaacagugccgccucuccauggggcugugggaacaaugggaucacuuccucagagccacagaaugaaaaagauggagucuaagaaaacaaauacacuccucuucacucuagccucucacagguaaacaucucccauauguugacagugucaaccacgcauguccagacuguagauaagaacagguuggagauucucaacauuuaaacuaaauuccaaaacaggccuuuaccuugacaacuuuuccugauccuaauuuuaggcgaagcggcuuaucuuuguuagcaguagaaucaaaaaccugccauuugauaaaguaaaaaaaaaaaaaaaaaaaaaucagucaguuucaaaaacaauaaucgucuuaaugauaaucaacuaagggggucagugcuucccaaacaggaaaugacagguguaacggcacauagcuccugaagaaacugagaagauagaacagguuggaguuuaucgcaaugaauaucccugugaacaauaauuugccaaauugggggcaaacucauuuccggcaccauuaacugaagcacuuuuugaacuauaaaauauuuucaguaaauguacuccuuuggugcuaaaacaguccuuccaagaaagcagagcaaggaucacugaccuccaugcacgaaugggaaaaauaagagcuuagagaguugaucaaggucagacugggauacaauuggaacuuaauugugacuccuuaauuuuugauacaggguuucacuauguagcccugacuggcccaaaacucagagaucugccugcaccugccucccaagugaugggauuaaagaccugugacaccacacauucacacuauuuaaguuauacaguucuuucuaucauaucacauugcucuaaaaaacuuaacaguauuaaaaacacaacaagggcuggugagauggcucaguggguaagagcacccgacugcucuuccgaagguccaaaguucaaaucccagcaaccacaugguggcucacaaccauccguaacgagaucugacucccucuucuggagugucugaagacagcuacaguguacuuacauauauuaauaaaauaaaucuuuaaaaaaauaaaauaaugagcuaaauaccuaauaaaaaauggaaaaaaaaauaaaaacacaacaauugcaacauauuuacagugucuguuaaaaggaaaaugacagcuaaacacaguggcaugagcuuucaaucccagcacucugaagaaaggggcagaggcgggggcagaggcagaucucugugaucuucaggccagguuggucuacauagcaaguuccaggccauccaaggcuacauagagaacucuaauuucaaaagcaaggaaagagagugagaaggcuuaaaaauaagaucucuuucuuaaagauauauucaaguuuaaaacuggcagugaggacaagauguacacaugaauuauccuugggaaacugucugccccuaaauaugagacagggugugaggcucuaagcacauuugcacaggagcauucacgagugcaccccaaaagcaguuguggagacgaauucagccucccuaaauguuucuacuggccaguggccacaguucacgccccauauggcaggcugcgugucacacacagagaaagaacuugcagaacacacgguuuuaccuggcccagcacaugauucugaaggagccagcccguauaggcuacuucuaaagaaucuccaguuuccacagcagggcccucugcugcaaccagguccugacacagcacugcauccaaggaagagaugcuauugcacuuggccacacacaccugcgagaucaagaucagagcagcaugagcuugguuuaagcuucccagccaucccauugcugcuaauauucuuucucaaacggcugcacccacuaacaaagauuacaagguuagaaauaagccauuccgaagucaguaauccggcaggaaucaggguguccaacaagucagcacuggagucagaaugucuggguccagauccagguauugccaguucuuaagucugaccuuuggcaaauaacuuaaucuucauauacccacucguucccacuugcaaaagugaagaaaagagcuuugcaaaucuuacaagguagcuaugaaaauuaaacgggacaauauagagugcuuagcaauccagcugggaaauaacagugggucaccacucaggaccaccucccaaagacccaaccuccuaccauuaccuuagugaucagucucaguaaugugaccucuagagggaauacacguacuuauaccuauuacacaguuucuaaaaagcgauuuaauguauuaauauguguuacucugggaaguagagguaugauuguauguguauguggguggguuaaguuuguguggcgcacauguguguccagguacauuugcaugugugcauguacaugugugaaggcuuaaagaacugacuugcauguuaguccucaggcacuguccuuaaauuuugaaaaaaugucucucacuuuccaaauaagcucugcuauuugucuggugaaccuaggauccccauguuugccuccccagugcugggauuacacguaugcaccaccacucuuggcucuccccuuuccacaugguuccaggaaucaaaguccaguucucacuuguacauggcaagcaguuuaccaacugccccuuaaaugauuuuuuaaaauauuauuucuacauuuucuauagugagcucauaaaauuuugacagucuuuugaaauguuacuuuuacaaguuucauauaucuuuaagaaaauuguggagcaaaaaaaaguggggauuuuuuuuuauguguauguucaugugcgguauguguguucacaugugugggcacauggguauguggcuaccugugucuggaggucagagguuaaugucaggugucuuccuggauugcuguguuuacuaaggcaggaucucuggauaaaccuagcauucgauucuguuagucuuuuuuuuuuuuuuuucugagacagaauuucucuguguccuggcuguccuagaacucucuuuguagaccaggcugguuucaaacucagagagaucuaacugccuuugccucaugaaugcuggaauuaaaggaaugcaccaccacagccagcugcaacaagcauuuuaaccauuggaccaucucuccaguccagcaaaacaaaauguucgaucaaauaagcuuauguuuccccauuuucccuuuuaaacauuuccucaggcaauuucaguaagaucuauucuuuuccugaaaugcagcaaguuuaauggguucuuuaccuugucauuaauaacacagagcaguugugguuuugccauaacuaaaauaaggaagacuccaaauaagugcucuggcuuugcacaggaaagaguaagaagacgucaccuguuuauugaaugacacagcggccuucucugacucaaacaugauagaccaguuuugucucuggucaucauaaaaggugcuguaguuauugggccgaaccugggaaaagaaaaagggacguuuggaucauucaagcagagcagccugcaaguaacucugacugccucagcucacagaggagagcugaucagagcaggaucccuucucccccaccucagcccacgccaucccuaccucuucccuacacauuccuaggagucaggaaaccuuucugaaaggcugcuuacugcuguccgggacugagcagaucuuuuccuaucaggaaugcccaggcccaucucucccacaacccuacaggggcaagugauuccaguaugaggccucuuaccauuagcucaaaguucagaugaauuguagcaacagucacuggcugcugcugacugauguaaagaagaauccuauacuguacucacaacgggcagaaaaagaaaagagauguuaaaagguaacacagacucagcaguaagacaugaggucaugcuuccuacagcuauaaaucccaaaccugcccagacugaauucgaauuucucacugccuugcaccucuuugcauucuggccucacucuuuaacguuaaucagcaauagcuuuauuuuguuggcuuuuccauucauaugcaggagagcuaagagauggcaacuggauccuuuacagaaaauacaggucagaucuggugguauaugucuguaaccccaacacugagcaaggaggacugccacgaguuggaguucagcacaagcuauagaaugaaacaacaucucaaaacaaagaccaagcaaccaacaacaaaaaucuuuuaaauucgaggggaaaaaagauccuacaagucauauguacaacucagugaauauucacauguguacguacucauguggcuaccaggcagauugagaaaaggccaguguuuccuacauccuagauagcucccuuugccccugauuaucaauaucccuaccacagagguccaguacucugacucagucacagaucaacuucucuauaguuaaauuagugcaaacaaccuacaucuauugauuuuuuucccugcuucuuucacuuacaacauagacuaagccuuguuacuuuguuugucaguacuugauucgauacugucaguuauacuauucuaugugaacauaccacaaccuauuuauccacucuccuagucguggcuauucaaguuguguacaguuugaaaccaugacggauaacacaucugugaacuuucuccaugucuugaggaggacauggacauauacaccuccuucaaccuaaugaacuuccuucaaaguaucccacaguaacaaucuacuggcagugaugcucucaacuuaagauuguuggcagauuuauuuugcccuuauuucuuacagauuucuuucuuagcauagauugcacaaagagggucagggcuagagcaugugcuuagcauggucaugaguaagaaaaacauaaugaacuucgagggcugagcucauaaagcaagucaaccacaagaagaccaagaccgcuugauuccacuuacacgagggucuaagacagucagacucagcgauagcgcauuggagaauaugaaggaggagcagcagggagaugaacgguuacaccuuaauggauggcuuauguuugagauuaugaaaaaaaugagaacaguggugauaaguacuuaguacuggacaugucacuaaagccacuggagccggguuggaaagacagcucagcagugaagaacacgguuguuguuccagagauccugaauccaguucacagcacccacaaggugguucauaacuaccaguaacuccagccccaagggcuccaacacccucuucuggccucuucuggcaccaggcacacaugcaguacacagauauacauguaggcaagccaccauauacauaaguaaauacaaaauaaauuaauuuaaaaauagccacuagacuguguacuuaaaauguuaaacugcaaaauuuuauauauaaaaaauauauguuacaguuaaccuccauggauucuaguccuauaaauuuaaacauauuuuucuuauauuccuuaaauaaaauagcaacuauuuauguagcauuuacauuguauuagauaguacaaauaaccuagagaugauuuaaaguuuauggaaggauguacaaguacagcccucugccacuuuauauaaggaauauuauuuauaucacauacauaauuagucuauaccacagauuuucuuaucuauauguaggaaaggacccuggaaccaauuuuccagggacuuagggacaacaguguguauuauauauggauuaaacaagcaaaaacauccaaauaauuaaaauucacccucugggcuggagacaugcugguucagcaagaggagccucaaagucauguguaagacugacaacucuagggagcaguuacuuaccucuguuuuccgcaggaaccugcacauucucacaugcagacacaaauauauaaaaauaaauguuuuuuaaaagaugaaauuaguccuuagaaauucggggagcugugaaggcugcugugugauuuuaugugagauauuuauuuuauuuuucaaagugaaggguugaucaccccagucccaccauagccuguacugguuguaagaggauuagacauuauuaagaauugguuugcuggggcuagaaagguggcuuggugguuaagcacacuuagggugcuccugcacagggcccaggcuccuaguguccacacguggcucacaagcacccuaacucugcuccagaggcuccaacaccccuucucacuucugugggcacugugcacucagugcacagaaaagcaaugcaggcaaauauucauauaccaaagaaaauaaauaaaucuuuaaaagaaauuuuaagaaccagucuaccucugaguuguccugauucuuacucaugcaggaccuuuccaagcuuuuggcugaaagccuagaaagucucuaacuccuugguucuuaaaguuuuaaucaacaaggauuuuuagcugaauucuuuagcuacuuccccaugaaauucaaagucugguaaauauagggaaaggaagauaguugcuacuuguugcagguucucucccucuagaagugucucuccugugcacuacaaagcugcagaaauuguucugacucugguaguaccuggacuucuaaaccaccccugaauucaacaaaugucccacggggauaccgcuguugagcugcaagacuccagauuugucaguuucucuuuucucaagcagucucugguugugucauaccugcugccuacacuacaccuaaaccagcaaugugcucaggacacagaacggagacaucucacuguugggguuuuuucucuaagauuuuaauuucucuccccuucaucauuucuacagcucuccagugaguuuuuuuuuuguuuuguuuuguuuuguuuucccaaauaacuuuacaauauaauuguugcaauuuuucuuuuucuuucuuuuuuaagacaagggucucacuauguaguccugaacccucucuguaaacuaggcugaccccugagcccacagagauccuccugucucucaaauccuggccaccacccagcuaccagcuccuacucuuuauuuaaugugaaugaguguuuuguuugcauguaugucugugcaccaugucuguacuuugugucugaugccuguugaagucagaagagagcauuggauucccuaaaacuggacuuacagauggcugugagcaguggugugggugcugggaauugaaucugggucuucugaaaacacagucagggcucuuaacugcugagccauuucuucagcccccauaauuuauuuuauuuuuuugaguauagauguuuccccugcauauaugucugugcauuacauucauguaguaccuacacaagccagaagagggcauaagguccccugaauugggauuacagauaguucagguccccugaauugggauuacagauaguuaugagccauuauguaggugcugagaaccaaccccugguccucuggaauugcagcugguacucuuaaccacuaagccuuaucuccggccccuuaucuacuuucuuauaauugcuucuccaaccuaucaccucuuucuggcagucaagcauaggggggucucaaaaccaaaguucuagauaauaguccucagcaucugcuaacacacaacaagagacauacaucauuugcuucccgaugggaagaugaaagauuuaagagacacaggaaccaacugcaauggguaaccucacuagaugcugauucaaauagaaguguaagaaaaacaauaauagagaggaaaaagagaaauuugaacacauccugacuaaaauauucuguuuacuuuuucaguaaauagcaugauaauuuucuuucuaaguauuucaucucuuacaauuauaugcuaaagcauuuacugcugaaauuguauauuggagaucuguucaaauuaaccugagcgguaaagagagaggugaggaucgggugaccgauagaagacuaauggcugcaagaguuuaggucugauacucauggguaauacugaagucccacugacuugaagacugaguguuggccauuauaucagucaccaugggcaacuaaucuuagcuuugcguugagaauggcagagcagccauucugugucucugggccucuaaaauacuagaaugucuucugucugguucaauaaucucuaacucaaaauucuggagugguauuugagcuggauguaccaacacaaggaagucaggccugguggcauuuagugacauccacuauacuucacccuaauacccugaucaacugcucagccuuauuuucaggcuucaaaggauaaauauuggucuuuaacauaggcaaaacgauggaaugcacugacagaaugacgaaugaucauuagcuauccaacaaagagcauccuugacuguuuacucuaaagcuuuccagcucuuacacuagaaccgucacaaaggagaugucuaaagcaagcauuccgaacaacagcacuuguuuuaaugcauaacaguaagcaaacuagggccaucuacucaauccuagucauacacacucaguuaucaucaguagacauucuuaucaucuaacacauaagucucuauccaacagauaagaaacagacccgaggcauuaacaauucuugggauguggcguauaaaucaaugugggucuucucaccucucugcuugugugguuccccaggacagccgcuccaaauuugcccugcuuugcauauugaccauuuaugcuauugaaacaagaauacaacaaauaucagaaucccuuucaaccaugaagagccaguucucugaucugaaacagcuaguauuuggucuuuaggaaaggugagaggugggcaacuuuuaaucuaaaguucuucugcaacuucuauuucuuugagacagggucucauugguacaacucuggcagaucuaggaaucacagaaaaccuacagacucugccucucaagugcugggauuaaaggugagagccaucacacccagccccaacuuuuuauucuucagucaucuauuauccauaguaucccuaaaaucucagaaaguugcuguggagggcccaaacauuaacaacauagacaaaauaaugcugaguuucucugaggaacuaggcuacgaugagcacaggcuucugaggaaggacaggaacugcagccggcugguccacagccuccccagcucugagggcuuucucuuccaacuacuuacuagcgguaugcaugcacugcaguggcaaacagcacugaggacgugccugugguagcuggggcuggcuuuggugcugucugauuuccugaagaugaagaaaacaaagaugccauucauuuuuuuuauuuuuaaccucaaaacuagccucaaaaaucccacuucaugcuuuacaguuaguguaacaaugcuuucauuaccacuauccucauuggauccagagauagcucuguggccuugucagguacugaggaaacagacucuaaauaacaguagaugaggcuagacucacacuagccccaacaucauacaucagacaaauuuucuggcuauacaagaagucuagaaaacagacauacuuuacuacuuucuuuucucuuuucaaugcucugauagcuaagguauauacaaguaaagcuauuuccucucuaguaucaggaauguagggugauaguguaaacaagaguuccuagggggaacucuagcugauacuuccuacaaggcugaucaacugauuagaaggccaguaacuuguggagguaggaauguucuuguagguucagaccccaauuacgaccuauccugggcugucuucagccccuuaauagcccucccuugcccacuccuaucuaacagauggagccuuuuggaaucuauugacuuaaaaaaccacuagcuuccgcaaaccaaaaggcuaagaaugucaucagauagcaucugaggcuuacagcagagauuuuucucagucuguuugaaccucaugucuccaccacagcagugaaaagugucuugauuuguuacucuguuuguucuguacccauaaaacuugaccaagcuguuaccauauugcaacaugagauuugaggagaccucaaucuguguuccuggaccacaguggcucauauuuggccucagaauaaauucuuguccccuuugaagugaugacuauauuuuuacaucaacacucaaucacacucauugccuauaucgaucaagggcuuuauauaauguuuuaaaauagcauauuaagaguaaauugcagcagguagagguggcgcaugccuuuaauuucagcccuugggaggcagaggcagguggauuucugaguucgaggccagccuggucuacagagugaguuccaggacagccagggcuacacagagaaacccugucuugaaaaagaaaaaaaaaaaaaaguaaauugcauuuugauauuguuuugguuuuugucugucucuuugucugucugucuaauggagacagggucuccuuuauguaguccaaccuagccuggaacuuauggucugucucaucuccugagugcugaaacaacagguauucacuaccauacccagugcuaaacuccccagauccaugucuagauagaaaaguaaugagagagcacuaaggaaaacucacugagcuugcuuucaaaaccuucucucuuguuuuucuguuugaacaccuccucucaauuucagaguacaaguacauuguagaaagucagacagacaugaaaccacaaugaaaauagaaaccaccuagaaccucaucaaccaaaauuagacaucaguaaacucaaguguuuguucugaguccuuucuguguacacauaagcucugcagcagcuuuuuuaguauuuuaaaacaaauaaagauucaacuuggccucuuccacuucucccugacuacauuagaagucuucucuauagucucccaaacaaaccuaggcgggcggcacacagcuacugccugaaaugcugccucuugacagcuacacaaaacacuacgacgacugacucuaagaauuuuccucauuucuuagugugcuacauuucuuuggacagauaccaaauuuucucuguuauacauaaugcuaugaagaauaucuuuaaaacacacuuuuuggaaguggggguugacucuuuucuuaaacaaaguuucugauaagagaauucugagaugaaguagcauaaauagugacugucuuggcucuccacugccccagagagcguccuuugggaaugccucagcaauuuacacuccucccaucaagaguacagcuggacugcuccacaucaccagcaagggaaaacugucuuuuuaaaucuucaccgagaaaggacaacaggaaaggggcguaccaugccacugcugcuuuaugugaccugacugauuucggggaaguggaaaguaaacaugucccaggauccagaaacaggaugcuagcuuagaaagacugugaaugagcucugacaacgaaggacacuguuauuuacuuauguucuauguuuucuuacugugauuagaaagcuauaugcagcuaaguuuagugugcacuuugugguuguauacaguacucugguaaaucuuuacuccugaugaagcaaucuaggggaguggauggaaaggccagcguuacauaauguacauaaucuagacaagugugaaacccagaaaaaaaagucacuagcaggggaggccagcccagcauccuccucagggccagggcagcuucuugcaguccucucgggcuauaauuaccagagcucauauccuggaaaggaaaggcugcuucugccagggacacuggcagagcauggccaucauccugugacucuccuauuggcucaggauuccuccuucucucaagucagcauuauucucacucuuggacuuggcauucaagaggaaaucuuauaauguguagucuugaaaaaaaaauuuuuuuugagcaaaguuuccucaacuuagccuccuuguucaggaaaugauuagauauuuuccuuaucuucauuauucauuagugaauuuaccuugaguccuuuuuaaucucuucauuaaaaaaaaaaaggcuuucuucaaccaaccuacuguaucuuuaaagguaaaaucucugauuauuuacuccuauaugccuucuagcuucuccuucacuugaaaaauaauuuuucacaggaaaaaaaauaaaucuaccuacuuuuaugaagaaaaagaaaacaaaaaccaucaagggcaacaacaaaacuggaccuacaugauugaaggagacagcugacuccuacaagucauccucugaccuccagaccugagucauggcaugcacaugccuauauacaugcauauaugcaugcauaugacuacaugcauacacaaucaaucaguacauggggugggucaagacaggguuucucugcauagcucugguucuccugguauaccaggcuggccucgaacucacagagaucuuccuggccaugccuccccacugcuaggaucaaagguguuaugccacuacaccccaggcaaucaauccauuuuuucuuauuagaaaaaaaaaaaucaagcuauuucaucagauaagccugagaugguuuguuuuccucuacacuucuauggucagacacuuaaaucagagucagaaucgcacagccaaggaagaaaggagugaaauacacaaggaacacuuagccugaaggguuguggcaggguacaauuugaucuuguucccacuuccuaaauccuuuguaguuugcugaguaguaagaguagaaguguguuuugagaaaucuauuuggcucuugcguaaugccccucagaauuuccuggagucuuuugugauuagucccuuuagucauaacugaguuuaugcauugucaggcauggagacauaugcuugcaaucccagccuguaugaggcagagacaggaggaucucaagcuagagaccagccugaucuacguguugagcccaacagaagaaaccaaaauaguuacucauuuuaaauuccauaucaccaaggacaaaaccaacauuuuaagcugaaauuuuaaauaaagagagauaaauaauaccuaaauccccaaauuucauguggcugugucuggugucaugugagaugccucacacagaccaguuuuuauggccuauuuuccucuuuuaccagauaaggaacuucaaaauggcuaaucuacuuuucuggauuuuggauucuucaucuccuuuuugucuauauaaagccaaaguccuguucucaauucaucagaacaccucauuuuacugaaugguguaugucgauuuuagggcugcaaauaaaagccaguuaagaaaggucuuaaaacuuugcugaaauuuugucuuuugacauuguugcugagguaacucaggguggggcuccugaggacagagccagccaccagaaagacaaaguaauuacaggauuagggacuauaacuuucagcuacacucaacaauuuuaggaaagaugggcuagaacaagcuguauaaaacucuuaaagcacaaaguuugaagagcuuccagguuauaaagcauaaaagugcuagggggggguggucugcccagaaagaagguggugauaaacccagagaagggaguggugacucacucacagauggggcagugguacaaucagagagggagggugguccacccagagagggcccagaaacuaugcauccuuucaacuuacucagccauucucucuucauauguucaccuggcuguagcuauaaccuuauuguaucuuuucuauuacauaaacaaauauuuuucaaaaaagcaauuauggggcuggugagauugcucagugguuaagagugccaacugcucuuccaaagguccugaguucaaaucccagcaaccacaugguggcccacaaccauccauaaugaaaucugaugcucucuucuggagugucugaaaacagcuccaguguacuaacauauaauaaauaaauaaauauuaaaagaaaaaaaaagcaguuacccugagcuguaugagcaauuccugucaacuaauugaaccuaggaaaggaugucaugggacccuuggucagaauuacagauggccugacuaaagauuggcgucuuaggcaaagacaaucuuguaagaguaaacccucuaucugagggaucugacauuaugucuaggcagauaacuucagaauugaccugaaucacaggauacucacauggugucugcugcaagacugcuuagugcauaaggaaaauccuacacaccucucacaccacaaaagcaugcagcagggaguccagagaaauggacaggaauguuugugucuucgcccuacauggccauacaugagggaucugcuucaacugcuccucaacgacuugucaaggauccucagacuagucagccucaguccuggcacgggaaaggcccuccacacuuugaucuucaaguauuuaauauaaugucccucacuaccuacucuucuuagggcucuucaaugaccaaucccuuauccucuuuggcuucuuaccucaaaacagcaaaguguagaggaaagaauaaguuguagauucagaguucaaauuucaacucugccauuaugguuaucuaaccugauuccuaaacugcucaaagccuccaaagucugcucaugucaucuacuuuacagauuacuucgagaaugaaauggcaaucccuggggagcaccuaagacagaguaggcaccucagaagugucagucucucacucuccccuuucugucagaagaugccauaacgauccuguguccuccaugaugaaagaaccagaugcaaugaugagugcuucaggcaguuuuggagacaaggggcagaaggauuugccugcuacugugcucucaguucccaacuaagggcaucaccuagcugcuagaaaccagaaccugagagcuucaacaggcauucacuacuggggguaagcuuagcugacgggcagagaacagaggacuugguaugcgcacuguuaacuuuauguguuguuguaaccaaauaacugacagaagcaacuuaaggaagggagggaggaaggaaggaaggaaggaaggaaggaaggaaggaaggaaggaaggaaggaaggaagggagagagggagggagggagggagggagggagggagggagggagggagggagggagggagggagggagggagggagggagggagggagggagaggagaggagagggaggacucauucagguccaguuuaaggacagaguccaccaugguagagaaggcacugcagcaggagcaugagguggcugcacaucugcaccaaagucaggaagcggagaaucggaugcugccguucugcucacuuucuccucuuuacucagugcugccucccagcccaugcauggugccacccacauucggaguggguuuucccauccaguuaacccagcacagaaacuccucacacauauacccagaguuggucucuuaggugauucuaaaucuuaucaaauaaacaacuaauauuaaccaucauagcaugucacuuuccaaagacaguuagccauuccaaccaaccuauuaagacacagcccuaaugccucuuaacuuaccugcugcuguucccuggccuuucuuagguugcuuuggggcuguguacuggaagaauucauuuccauggcccauaguugcuugauccaguccaaaaagagaagccagcuuagcucuguuaaaggaaaaggaaaauaaaaugccauuugacauauccuaaacugcaaucacuccaaacacuguugcccauacuuaaguaucucggaugguguaacuccccauucaguaaaaaaaguagcaguugaggcucugaaaucaagacugugugugauuugacagcaauggcugacccaagcucuagcugauuguucuuccuacagaaagaucccucagaugcauucaccacuccccagaucaccgccacuuccgugguuuacgcugcccucaccucugucuagugggacuacugcaacaaccuccuaaggcaccucccugccuacaucuuaugcaguucuuuaucuccccugccugagcucuacugcaguacuggggggcugaccauacggccuagaacaugccaggcaaguguacuaccacugagcuauauucacuacuaccaccccuucuauguuacuucacuuuacagcggaauguuguuaaauugcccaggcuggccuugaacccucaauccuccuguguagcugggauuacaagguugugccacuagacccaauucuucauaucuacuucuuauauacucuacacacugcaucuacaugauuauuccugaugacucuucaauauuaguaagauacugacuuggaacuugggccaccaggaugguuuaguauaaguaaagguacuugucaccaauccugaucacaugugcucaaucuguagaaaccaugagguaaaagcugagaaacaauuccuacagguuauccuugaccuccaaacuuaugccaugacacacaugugugccugugcccaagcaucuacacauacaugcauaagcacacgcacacgcacgcacacacgcgcgcgcgcauacacacacacacacacacacacacacgaaauaaauaaauguaaaaaaaucuuuuuggggccgggugugguggcucaauccuagcacuugggaggcagaagcagauggauuucugaguucgaggccagccugcucuacagagugaguuccaggacagccagagcuacacagagaaacccugucucggaaaaaaaaaaaaaaaacuuuuuuaaaaaucuaaucucugcaagaugguuuuagaggauccuucaagauuucaaaaucucuccuuacgcaacuucauauuuggccauuucuuaucuccauuugugugcuacagcuauuauaaggaacuuuccauuucuuuucuuuauaaagauuuuuaaaauaauaauaauaauaaugauuaauauuauuauaauuauuauguuuuuguuucugagucagggucucacuaucucacuauauagcccuagcuguccuggaagucaugauuuagaccaggauggcuucaaaauuagagaaaugccuaccucugccucccaaguucuuggauaaaaggugugugccaccauggccagcaauaauuuuuuuucauauguauagauguuuugccuguuuauguguuugugucacaugcauccagugccugcagaggccagaagagggcaucagauuuccugggacuuguguuagaagauugugugagcugccauguggguuaggaaucaaacccagauacucuggaagccagugcuuuuaaccuguaggccaucuccauaucccuucaguuucuuauagaagguaagaaugcuuuguggggaagagggaggcaaauguuggagauuaaacucaaaagucucaugaaggaugaagacagacuugauuaagccauaucuucaggccaagguaagaucuuuuuuaaauccagccuuuagaaaugcuauuccuucugccugaggcauacuuucuggccguucuuucucgaagcuucccuaaucucaguuagauguuuuccuacagcuuaagagaaguuaaacacuagguaaacacaggugaacaagacugcauuauuuuuacagaaguuuauaaacaaaugaagcgguuaucgauuaaguaacguuuagucacaaaguaugagcuauccaaaagggcaacaguuauauggcaguguacccugccaauuaauuccugagcuucuuuuccuuaauuacuuacccagccuguuauauucuauucuaacaacacaaaucaacaagaaaauauugaacucucacauccagucuggcacuggccuccucuucuccaaaguuacucucaguuugggugcacaaacucugaagcuucucaacaauucaauucuucugacuuuuuaaaaaauguaauuuauguguguauauaaauauaaauuaguauuucaugaaauacauucaaugugauugggcgguggacgacacacaggaggaacugcagugggcaaguaagcuuccuggagauggucugccauuuugcacagccgcaaugaauguaccuggagaggcauagcccaggggcauagcuccagauuccuucuugcugcugcugugccuucucgguuugucauugcuguguuccucauauaucuagcauggugugaggggcaggggagacccucacugccuaccgucugguaugauuguuucuugggagacagaccacucuauuggacaauuuuccugcagaugaacuuucauaaaauaauaguuuugaugaacuaaugauuuuacagaauucuuguuuugguuuaaauagcuuuaggaaguuaggaguaguugacaggaaguuuaaggagauggcuuaaguuguuuucccaaaaagaucuaauaagguuagaauaagaguagcgugugcccccuccuugcagaguagugagggcugcauggaaaaagagcacagugaacuuucaugaauuacaagcauguaauuguacuuggaagggaaaaauaggcuuggaacaaguuaauaaucaaaaaagacauucauucuagguugggucugagcuccuggaucauaugaucuagggauguggccacagguuucgguguacaucaugaaaagacagaguuauaaauaaggaguaaauaauucucgucugaguauaaaacuagaaaauacaugacuaacaaguuuagcugaacaaaacuucaaaaauaagacauaagguaaucuggguuuuuuguuuuguuuuguuuguuuguuuguuuguuucgguaaauacaaauuguccucagcuaagcauaagaaaaaacuugcuacuacagacuggcuugcuuaaaccuuguuaaucagugacaaaagaauuaaagcuuugggguaaaaaaaaaauccaucuucauaaugaacuuguagaaagaaagauggauggaaaauguuuaguuagguaugaguuucaaagaacaauacauaaucaauaauccuguuguaauccuuaaguguaugauuucaaucuguccuugaagaauauguucuugugaugucuguucuuggagaauaugcaacuuguagcuacgagguaaccuuuuuuuuuacauaaagaaauugucuuaggugguauaaaaaaauaaaguuguuggagcuugcuucaucuaccaaacguuuguguguguguguguguguguguguguguguguguguguguguguaguugguuggagcuuugcuccauccacuauauauguguguguguguguauguauguauauauacauguguguauauauauauaugaaaggugguuagaacuuguugaaacuuccuucauccaccguguguguguguguguguguguguguguguguguguuuccucauccuuucccccaaccccagggaguuucuccugguccaagaaaaucacacuuuguuuccucagagaaguauucugagugaucagucgcuaacucuaccccugccucaguuuacucuggauguugaagcuggccuuuaacaguuugacgcuauucuuaaagaaucuuguaugcuuccuucaaguguccuauaaauggggccacagauacuuuaaagacaaagagguuuagaagacaaugcaaggguaacaccugagugagaguaaugcugauuuaauuaagacauuagcacacgcugaaagaacauagaagaaacugagauuuucuuuccuuuuggccauuaugaccuaaagacucccuccccuuccuuucuuuuuuaagacagugucugacuaugcagcccuaccugccccagaacucuguauguagaccaagcuagacuugaaccacagaaaucuacuuuccuuugccugcugugggccaagauuaaaggccugugcuauaugccuggcugagguucccuaaaggaguaaaauucuggaagaguugagcgauaucuuuaacaguggugaaagacuguucaaucuuacgugcacuuuaaauuuuuagaaacuuaucacuagugcuuauguaugauguauacaaguugugccaugugugucugagggaucaaagggcaacuuuguggagucgguucucuucuucuauccucaugugguuuauaagacuugaacuuagguugucaaggcuuuauccacuaagccauuuugcuggcccgaagcuuaaaucuagauaaggaauaauugcuuacacacaaauaauugguaauaaaaaaauuaagucaggugggagugcugcucagaagaucacugguagaauacuugagcucaggaauuuaaaaacguccagggcaacauaguaagaugugaucucaaaauaaauccuugugggagcuggagagauggcucagauguuaagagcaccuuuugcuguuacagaagguuuggguucaguucccagcaccaaggugaugguucgcaacauccuguaacuccaguuccaggcgaucugaugcccugugcacacacuuuuacacauuaacacuaaauauauaaauuuuuaagagcuuggugauuauguuuauuauuguuggauugauuuuauucuacugcuuaaauaaagugucuuaggcauaggaacuauaucucauuccucucuguauuaccugaagucaaauaugaaauacuuaguagacaugugccuauuucuucauuucaaagucauaauauaauggugggaaaagggcuaagaaagaaggagaaggcaugucuuuugauuacuacuuuuagguuaaccacugacuuuaagguuggagaacuuggccaugccugguggcucaugccuuuagucucagcacucaggaggaagaagcaaguagauuucugagucagaggucagucuaguauacauugugaguaccaggacaaccagagcuacacaguaagaucaugucucaaaaacaaacaagcaaguaaauaaacaaaaagaggcccgggaacuugaacagcagauuaucagucacugaaaacagccauccuggacuuuaggaugcuucaguuagcccucaauagccugaguaggaacaagaaagucagaagguuaagucaaacuuagggaagcaguuuuaaaguaaaccacauuuauaaaaggggaacuggaaagagcugcaguguucacugucagauguucuacuuccuuacaaaaccaauggaggaacagccaaaucagagaaugcacacaaaacuuucucuggucuucuuuucuucauuuuauuuuauguguuaguguuuugucuguauguaugccuaaacaccauuuguaugccugguaccccaaaaagccagaagauggucucggauuuccagggacuggaguuacagacuguugugagccaccaugugggugcugggaaucaaauccaauuccuccagugcucucaaccaccaagcuaccucuccaacucauuuuuccuagucuuacucuuaaguuugauucuguuuuccuagcuacuaccgggaacaaaauuuauuuuuuccuagcuacuacaggggacaaaaauguaucuguguguagcuuucucuguugagucuuuuaucaucaaauugucuguuuucuaugccuaggacccacaaucauauguguaaaguaucuucaauucuuaguuaagccuuccugggaaaggagauugauuccuuggguaaggaaucagaagagcacaugacugucacugucugccucgucagcagcagauucuuugaugcaugaaaguuggaagccuuaaaauaccuucauaaacugucuucaaauauucucacauacuaaagauuaugaaauuaaaauauaccuugagacugggugugauggcacaugcuuuuuuaaucccaucauccagggggaagacaggcagaauccugugaguucaaggucagcuuggucuauauaaagaauuccagccaggguuucauagugaaaccaugucacaaauaaauaaacaaaccuugaagauauucaaaaggccccauacacaggcauacauaaaacaggcuguagcugaauguccagccaacagcagcagaggcuguaaauguuuuggauaacauaggaaagaaaggauacaaugcccagucaacucaaaaguaauggagcaacuaaaugaauucaaaguggggcuaagugggugcaggcauucccaggggucccgggagaaugugcuggucagagagaaaugcagagccacucacugggugucaaaagaucuuaaguacugaagaccaaauaagaggggcuggguaaagugcuuauuguauugaguucagauccccagcaaccacaaaaaaaaaaaaaaaaaaaaaaaaaaaaaaaaaagacaaguguggugauggauggauacugggagcuugcuggacaaccagucuagucaaaauggaaaacucagguucagugagaaaacuugucucaaaaacuaaaguggaaguguacagagaaggaccccugauacugaaccucuguccucaacaaagauguucacaacaugcauacaugcauacaucucucucucacacacacacacacaaucaaaagaaagccagucaucuuauggucacuccuguauugacugcccaguauucuaggagacuaaucauuauugguaggaugaugugucagucauucuuaaguagguucaucacuaugcacaaaacuuguaaagcaggcguucaaagaagggcugugcaaagaugugagcuuugcaguuaacaagucugaagggagacaugagguccacuaggacaacgcaagggaaaacacugagcuaauuauuaaagggggggggugggguggaucuagccugccguuaaagacuucucucccaagauggcauauaugauguuugaaagcagaagaaaacgaauagucuuucccauuggcguuacaccuuagggcuuaaaaagcauaauuucgcaggcacuucgugagcaaucaaugugcaccaggaguuacuguucugagaccuagacagaaaugagcaaccauaagcaguucagucagggcuuagauuucaguagguuccaugugcuaaggcuuguggaaauauggaagaugaagcagacuauuccucccgggacugugaaagcaaagaaucaccaaaaagguaaccucugaaguaggcuuugaaggaugccagagauggcccaccagguccugguucaaagugucaccauccuguucucggggaagagaaagucucuugaguuuacagcucguauauuuauuauaggagcugacuccuauauaaacuccgaggcaagcagucuccccagcaauccucuccauuucacuggagaaagugugauucacaaagcaaaagggugucaagggagguuccaguuccugaacccagacgggccgaggugacaccgcuacucagaaugcgaaggcugagcgguggaacgcgccgagggucugucuagacccggaaguugggaagcggccugagaagagcccgaccccugcagccaccgcgccagucucucagcccagcgcucgggucccguuccucaaucacucacccgccgcuuggcgagaggaagucggugucauccucgucuccggcaccgaacaucacgucggcuuucgcccagcugaagggaggaggaaguuggauguucccagggccugucaccgccgguaacguaaaacgccguggcggcgagcugcuuuccggcaggacaaacucucucaggguagugaggcccagaggagacccagcgguggaggagguggagcaaaggcaaaugaggaggugagcucccagugacgcaaggccucaccagcccuccgaggagguggaguuccuagguucugagcggugauuggugggaucacccagggggcggguccagggcgggaauccgcggccuuuacugcggucgugggacacgucgagccgggcaguaguggcgggggcuugguagaaguccguaccggacuaggggauccaguucugagaggaagacuaaggcggcggggcuuacccugugaagguaaggucacuccccuccuuuucccaaacccggcguguucgcuguccuuuucccucccgaacccuggaccccccgcagcucccuuaagcugggcggaaggagaaagagccccggacuagaagucaugggaucugagccgaacaguggcagggaucuuacagcgacauugcuguuaugaccuuagggcagggugcucggugccucaguuuccccaucuacgcaaaggaccgcguguccagugucuccauaugcgcuuuuucaagguuuuaaaucucugaaaucaucgagucugauccgggucucuucguaauaaacugaucugcaggcaagaagacagaagaacuagccacuugggugacuaguccgaggucacacagagugaagagcagaccugguccuuuguaucaggguuuagagagcugaugagugaggaagccuggcccuuaacuagacuguguggcauaggacuugggaaaggacccuguuucuaaaguccagauaagagagguccagaagagcugggauauucgggaggguggaugauggacgagacuuugaagguagaaaguccucaauccaguuuugcugagcugaguuuuguugccaagguuuuaagucaacauugguugucgcugacuuuucugccuccaguuuucgcccacucuguugcaugucuuucuucuauauuucuuugguuagccuguuuuguuuuuguuuuuggguuuuuuuuuuuuuuuuuuugaacgaucuugcuuagccacgcuguggcuaagcagauagugugucccaguguccauuuccacaguucucauuggaguucuuucugguuuucuucccagucagguugauccuguaagugucccuuuccggaauguuuuagucucuucugaugauacuaaagagauuggaagcucucucccagagaacuuuguaccucuuggcacuuccccuguggggcuuuuuauuacaguuuuugaacuacuaacuuguaagucuucuugcccacaguggauucucauuaauuuuuuauuagauugaauaauauaacuuagcuuuguucccuuguuccuuaauuuacucucgguuuuuuuuuucccccgugcgacccaaagagccaagcaguggcucuugucuuuuauagguagcuuccagaaagauaaaaaugcuguacuggcugugaacugucuggguugcuuggucucuuuuguucauugaaggugacuguacuauugucuaaaacuccaggggagggggaaggggaaauaguguaguuagaaauauuauauguuacuuacaauuuuugugaguaaauuauuccuguuuaucugaggauaaggcugcuggccugcuuccuguguuuauuuuacagauuaagaugguuagaacagugaaaucugacugguaaagcagugauacacuggaaucugggugguaggacuggagccuguagcaguagcucuguuuaacuugugaaauugaguggguaggaaugaauggauaaguuuauuccaggaacgcuuucuuuauuuuuauuuucuuucuuuuauuuuuguuuauuuauuuauuuauuuuugagaugaucuauuuauguagcucuggcuguccuaaaacucauuauguagaccaggcuauccuggaaucucacagaauuacaccugccuaugccucuccagugcugggauugaagacuauaucacuauacuggauuuuaacaauucuuuaaaaaaaaaaaaaaagugagcaaaacccaagaaagucucagagcucuuucccugcauucugugggggaggugccucucugguggguguuugaaauguacagguguacaagaaaacgggaacuagccacuugggugacuaguccgaggucacacagaguaaagggcagaccugguccuuuguaucaggguuuagagagcugaugagugaggaagccuggcccuuaccuagacuguguggcauaggacuugggaaaggacccuguuuuuuucuuuauuucuuuucuuuuuuuuuuuuuuuuuuugguuuuucgagacaggguuucucugugugguccuggcuguccuggaacucacucuguagaccaggcuggccucgaacucgaacucggaaaucugccugccucugccucccaagugcugggaucaaaggcaugcaccaccacugcccagcuaggacgcuguuucuuuagguauucaauaacccuaaaacugguguguguggugauugggugaauuucauuagcaacauaagaaagggaaaguuggaaaugggucuuccucagucuuucaggcuuagaauuggaaauauaaaaucaggacccugauaaugcugucucuugugaggcuaugccggggccuagcaaacacagaaguggaugcucacagucagcuauuggauggaucacacggcccccaauggaggagcuagagaaaguacccaaggagcuaaaggggucugcaacccuauagguggaacaacaauaugaacuaaccaguaccccccagagcucguguuucuagcugcauauguagcagaagauggccuagucggccaucacuggaaagagaggcccauuggucuugcaaacuuuauaugccccaguacaggggaacgccagggccaagaagugggaguuggguggggggaggguauaggggacuuuugggauagcauuggaaauguaaaugaagaaaauaccuaauuuaaaaaaaaaaaaaaaaggaaauauaaaaucuggugcaucuggaaagcuagucuuccuggauuaaaauauccagaugacuacuauuggaauuggagucaggagaccugaauuccugucucccagccuugaacucacugaguuugggccaguucccuaaacaccuuaaaaaaggaacagaucauuccccaaaagauuaacuaggaaacagcaaauuuaauaauuccuuucaagucaaguuugcaaaagauaaccuuuauaucaggcaaacugauauuaaucuccuccagugguaaagagauauggauuaaauggagauuaaaaauguuucuguaguauucuauucacucaaguuacuaaaagcagaaauauuauaagacaacuagagaaacuucaccugagagucuacuguguguaaugcuagauuuuguguagguaguaaaugaacccucuaagaaauuacuguagaauaucaaaggaggaaaagaucauaucucuucaguauaaucucagucauuauaauccagggaaacuggauggaaguguuugggguuuuuuuguuuguuuguuuuggggguuuuuuuguuuuuuuguuuuguuuuguuuuuugagacagggucucucuguguagcccuggcuguccuggaacucacucuguagaccuggcuggccucgaacucagaaauccgccugccucugccucccaagugcugggauuaaaggcgugcgccaccacugcccggcugaauugaaguuuuaagauauauaccagugcccuauguaauguuuaccaugccuuaccucaagcaaucugcauaacaccuuguucuagggauuaaacauuuccuuuaucgccucuaaacuagcugaaguguaggguugcauaaacaguuugaagaugaguaggauuccaggaggaagcugggaggucugguuuuccagguugaaagggcagcuuuagcaaacacagguagauucguguuuccaugguaccagugauuggauccaggguuuggcucgugcuuggcaagcauucuaucacugagcuacacacuacuacccuaagggggcuuugcgaauguugucgcgacaaggguuacccuuucaccugcugcgcugacuaugacuggcuaacuaaaguuugcgaaaguauggaacuguacacauuuuccaugucuuacuccaguuuaaaacacaaauauccucuguggguuuguuguuucuaaccuaauaccucaacuuuuacuuggaaugugguucucagagaucaacagacuacccacaaaucucgcugccuguuucugcaguuuuguccgaacacaaccaggcucauuuauuuacguuaucuguggcuaccuuacagugauuccucauucugggaaaaaaaggucugacaccugggccguccaagaggaacccuuacuccuggaaagagguuuaaacuuguuagacacaguuuuuguuuauuacagaagacaauaaugucgagaccauaccuugacuaucacugcuuucaggcccucuacugaaucuuccuucucuucagaauccugaaggcagauucuguguguguaggcagggagggggcuauaacuggauuuuuuuuccccuuuucccaguguggccacauggaauaaaucucuucuuugucaguuaaauuuuuuaggaauucuuuaagauucuuuucugacuguuugagguaauauacacagagaauuaaaaaauaauauuuaaaagcaacccaaagccauauuuauuagaguccaaggugacaaguuuccaguuagaucagcaugaaaugauuuauacucuacaugacacaauuaauauuuuuggcugguugguuugauuuucagacagggucucaguguguguccccggcuauccuggagcuaugacaaccaggcuugccuucaagucacagagguccaccugccucugccuuucuagugcugggauuagaugcaagacaugauuaacauuuuaaaaaucugguuaguuuaggagucuguaaaggaaaaguuugccuuucuuggguagguagccccuuuuuuccuaguaauccuagaacguggggucaugcagacugguugaggugagguaaggcaugguaaacacuacuuagugcaaugauaguaaucuuaaaagcuucaauccauuucccuuuggauuguaaucucaauuucgaguugagcaaaacaaagauuccagacuguaaauaaacugaaaugaguugugaagguaauaauuaaguaugagaagucucugaucccuagcuggaaugguggccuguaaucccagcacuggggagaggaggaauucaagaucagagagggcaaguagauaacaagguuguggccagccucugugugcgugcgagcguguguguguguguguguguguguguguguguguguguguguguguuuuguaucuugaauguuucugcucuucaggucauucuuuugcccucuuguuucuaacuuucuaaguugaaauguuuauagugacaagauuucaacugaugucaaguaaaucacccagaaaacucugccuuuuaaauuugccaggcaagcuugacugggcagggaguagggcaauaggacguuggguucucaugccuauacucccacauucagcucuuagcacaaaaaagccaucuuuaaaacaggucuccuagucuuuuuaacuagguaugaagucuuauacuugauacauuacaauauuaaguacacacacacaccuuacugagaagaaaauucuuuugaaguuccauggcuuugaguuguaucauuuuaugauuuagguaacauccccacacagaggaggggcccauccuuaggaaugcaaaccccgccgagaaggaagggguugagaaggguccacccuaccuccuuuccuuuacacaauggccccagguuuuguacacaaccugcuuuuguaggcugaggacauuaugcaaugcagcaugagauggaagucugccucucaaaaguaaacuuggaaaaauggcuugagagcaaaacauuagcagcacauuaauaauggaccuuuucuagccuugcugagcucuuccgauugguucuugguaaagaacuauuuggaucgaucuaauuuucaagcaguucagagcaguagaaugcagccauuuaguuucuuuuggcuucugaaauaaaaggggaaggcuguuaacucucuguaccuguagucucuuagcuguuucugcuuuuuagaggucucaccauguagaccaggcugaccuggaacucacagauucaccugccucugccccucugccucucugccucucugccucucugccccucugccucucugccucucugccccucugccucugccccucugccucucugccucucugccucucugccucugccucccaggcauugcagcuaagaucggaaccagcauccaggagcaauuuuuuguuuucauuuguucucuuacugcacuuugauaaugucaucuuuuguuaauuagugguuugauggaacaucaguucuuauuauguauuuaauugcaguuuucuacugaauaaaaagcacaauucaacuguuuucuaauuucuguuucauaccauauacuggacacauccauugaaauccucuguaacuaaagaacagauuaaacaaugaaggaccuuggguuguagcaaguacagucugccuuugacuacagcaagcaaguaguugaagaaaugcuuugccccugcauguaucugaguagcuaguauucuuuaaaucaaaugaccaaaagcuauauacuuugggaagaggaagcaggaaaaucaggaauuuaggguuuccucagcuacacaguaaguucaaggccagccuaagcuauuuauuuauuuuuguaugcagguauggguauaggcaugcauauguguagagaucaaaguacaacuuugucgagucguuucuuuccuuucaccuuuauuggguuccgggaaucgaacucaggucuccagguuugcucaacaaaugcuuuacccacugagccaucucacugguguuuuguuuuguuuuccuuaaugucacauagcuaauauguggcaaucuucagucugugaagcauaaugcagucuuggcuccacucugauacuauauguaaaccauucugaaaucuuuacauaacuaauacuugaaauaguucuaauuacgugacuaaaaccacacccagacugcaguggagcaguaagagaaggaagaaagcggucaugucgugcuugcuugguuccgggauguggcuuaaccacaacaaaaaguagcagagacuuggaguacaguguccaggagauccacuccccaguggacuugagaccuucugccauugcauaacuaaagaaccuuucaguuuguuugucguaucgaauuugaguuguguauggggaacagacaaaggcuuucuaaagcccuuugcgaagaauguauuucuauaccugaucuccuuuguguggaaaggugagagugggccaaaggaaagagccucuguagugcuuacugccaaagcaggauacgugggcucagaaaccccuccugcuuagccaccucccagcaacccaucuggagacauggagggcagagcuuagagucccuucacagaagcaaauguaaaguuggcuaggaagaauguuaaugucauucucuaauagcaugugccuugguuuccccauauggaaaauaaaggaauugggcugaucauuuaauuuuucaaguuguaaacuuguguauauacuuuuccccuuuaaaauauguuuauaaaucaucguaugauguguucugcuccuccucccaagcucauacuaugucuggaaggucauccuauaaaggugugcagacauuccuuacucuuuuuuuuuuuuaaagauuuauuuauuuauuauauguaaguacacuguagcugucuucagacacaccagaagagggugucagaucuccuuacggaugguugugagccaccaugugguugcugggacuugaacacuggaccuuuggaagagcagucggguacucuuacccauugagccaucacaccagccccauuccuuacccuuaaauggcuguagaguauucaguuuccugggaauaugauagcuaauuuaaucagugaacacuuggguuguacuuucaguguuuugguguuucagacaguucuauagugcauaccuuuguacauaugauaguuuacauauuugccuguaggauaaauauuuugagcuguuucgaggugucagggaauauaugcaggaaacugauaacugaagacugacuuaugguuuguaggguuuuaaucgccagugcucgaugaaagaaagggaaaacuguuugaaaccuguugacaucuauuauuuagagaccaggucuucaguggggaccuuguauaggucauuuugucagccaugaaagcacagaugcugccaucuauucugccauccucagcagcacaagaaauucucugaaacauauagcaacacuaaagguacuuuaauauaggcucaaauacaaagauuaagagaaagacagacagauguacuuaagccucccaaauggagggagagacagcaagauggacccaaguacgggugugggcuuccucaagagaauauguaaccaucugucuagauuagcccuaucucauuuuggcgauucagucuuuaaaaaguugcuuagaaccuuguuuucuuuucucuuuugauaaguuagguggcucugcagaggccuugaacaggcuuaggagcugauaaagaagaacuaggagccacuaguauugcacaaggggauuguuuagcacgugucccuuuccuguaaaugggauuucugcagagaaucacaaacuaggacugugucacaguccuagacauuuucuaauguuuuucaauaugacauuucccuaagagcucauuuacaaggugacugacuauauucuaaacguagaaaaaugaaccaugucccaggcauacuuaccuuacuaacauauaggaacauucgcucuuuacaacaaugcauggagggauggagacuauaaauagcacuaugccgauguguuuuccccucuucucagauguuguaauaauuaugagauaacuuuguuguaauguguggcugguaacugucugaagugugugacaccuucacagcugugucuuuuugaguugagagacuauaaagcaggucagaagugucagccaauaacaacuuuuucuucauaauaauaauaauaauaauuuuuauuuugagucaaggucucuugugacuaggcuggccucaaauuccuuaaguaggugaagaacagccuugagcuuuugauccucuuaccuccaccuccggggucuuagcaguagaggcacguauguccccacguccaguuucuucccccaugcuucccuaagccuaaccuucucuucccuccuuccucaccccuucauucagcugcucaggcgccaaggcauuucugaaauuugcugugugcuuuugcagcuuuaagcuagagccuccugucauuucucuguggauuuucuguggccccugggacagaggguaccaaaucaaguaauccagcuugcugccuuuccagguuccugccuguccuuuucuccguacagcuuuguugccuuucaacuccucgucucuguauauuccagagaaaagacuaaagacgagcagcuaccuugagcucugugugaguguguguaugucacagucaugcaugcaaaugccuuucugguuuccauugucacucuugguugaaaauuuggagcacugugcacacacaguggacacagcauauggaguauauggaacacguacccuuucauucccauaaagcucacuuuuugaaaccauaaaacucuaaauaaggagauaacuuugguuuugguuucauuuuuguuuguuuggguggguuugguuugguuugguuuggguuuuuguuguuauugugguuuuggugguuguuguuguuguuguuuugagauagauucucucuauuauguagcucagacugaccuggaacuaaguuuguagaccaggcuggccuaaaacucacagaguuccuaaaugcugagauaaagguguacacuuaucacaucugacaacuaugaacucuuacagucaccaagauauacaauacaguaaaaagauacaauuugauuaguauagacuuuuugaauuuuagaauaaaauucacauguugaccagucucuaagcauucauagucuuucuguggaauggcuccaaugaacucugaggggcaagcaccaaccaggccaacuguugaacuaccaguccuagaaaugagaggacagaauuguaagcuagcacauggcuucccuggguacgccuacuaaagguucucagucuuccagggagaguugcuguugggugauugaaggcccacgggccacauuuuccugauuagcuaaucugucagaggcucagaaaaaaagacuuuccuuguuaugacuucaacaauaucaucuuguaccucugaucuauuccuguuccuaaacuugaaugcagaaaagauaaaacggacaagaauacuguauuaucuauguauauacacuguaguauaaucacauuccaucucaagauggcauuuugaacuuucaucuuucccuucccaaaauccuagugaaauuacuauaaauauauacagacagauaagauauauuuaaauaauguuuuaaagauuuuauuuauuuuaaguguaugagugacuacacuguagcugucuucagacacaccagaagaggacaucagaucccuuuacagaugguugugagcuaccaugugguugcugggaauugaacucaggaccucuggaagagcaaucaguacucuuagccacugagccaucucucuagccugauagauauuuaaagauagguaauuaugcuggaaggugguggcacaugccuuuaaucccagcagaggcagguagaucucugugaguuuuagacagccuggucuucagagugaguccuaggagagccagggcuacugucuggaaaaagaaaaaaaaauuauaagaaaaaaagcaucuuuuguagucagaaagcaagcagaagugguaacuuugaaacauuguagggaaaauaaggugcagcagggaacuaggaaaaugccugagcaccagauagacaugggcaaaggguagguaucccugccucugaaagguuggggaucacacuccugaaaccccagcugagaaggauggagacuggaaagaaggggggguggcccuggaauuuguaacugucauuguagaguagcagcuuaggaagggugaaguacugcacacuuuuaauuccaguugaucucagagaguucaaauccauccuggucuacauagugauuuccaggcuugcagguuagcagauaggccugccugaguguuaccugauagcauucuuagcccuucaguugguagcaaauaggauuuugugaaguaaauacaaagguuuucaucugcuuaucaggguguuaguucugauuacugagcuggcaagaauagcucuuugagaggucaagacaacccaaaagaaacccuaauuaagcuauggggucagcgguauccgagacucuucauuauuuuuuauuuuuagcagucagucagccucuacagacaccuucuuuccaggaauucucugagaaccaguuuuaucuccagaacucacauugauggaggaagaaaacuacuuccuucuacuccaaccucuggaguucugggauuaaagaccuacagacaaauaguagcuaaauagauguaacuuguaagaggguuguuugcuuugguuuuuuuguuugguuugguuucuucuuuauuauuucuaagacaggguucuuaacucagagaucugcuugccuuagugcugggauuaaaggcaugugccaucaccaccuccucccagucuuuuuuaaagaagaaauaguuugggaggguuagggggcaggguugggggcaggauuuguuguuacuugcuuuugaggcuguuucuuccuuugucccucuggcugaccucuagcucucagcgauccuccugcuugugccucccagggcugagguuuaagggaugcacaugacaccugacaauguaaugacucugaauguuccuggaggacuuacuggauucuggcacugugcuugaauguuuacauccacuuugucuugaugcagaugcuguugcuucuucucuguuuuacuuauuugauugucugaggcaaugucucacucaguguuuagcccaggcuauccguguagcccuccuggcucagccuuauggaugcaggcuggaauuacagccaugauccaccacacccagcuuugucaccccuauuagugggaauuagccucuucucuugugcugcuaccgcaguggagucuugauaauaucucuuacagcaauccucugagauaaauuacucuauuuuccuugucuagcuaaggcacaaagcuaguacguaauuugcccuugggcacacagccauuaaguaccaccucaccauccuacccacuggaaagugaauacaggucacuuaaaaaauugcagaauugcuauaacuaaaaaggaaaagugucucuuuccugugcauagcuuccuuguuuuuaaaaccggaaaggcaaaacuccagaaaguaugcgauuuggggccaguaagggaugguuuaggguagacgcacguggcaacagguuucuuugccugcugaacuaucucacgggcccaucugaagaguagcucaauguauuauacuugucucacaaccacagaacagagacugaauggaguuagagauuacugugaccugucauuuggaugcuagaaagaacagcaaguguucuuaaccguugaaccaucucuccaccccuugcuucuuuugguugguugguugguugguugguugguugguugguuuuugagacaaggucucacuagguagacuagguagacccugaacuuaccauguagcccaaguuagccugcaccucauaauccugccuccuuaacucccuggguuuauacucagcaguguuacugguaauucugauccaaguagucuuuggacuuugagaagcacccgaguuaggaagaaagugauuagcauuuauuauuuauuguguauguuauuaggguagcaguugcuuucauguauacauuuacguuugauuuuuaugauguugugacguuauuaucccaguuuuauguguucguauaugaguuccugucugaguuccaguguugagcggugcaccuggucagcagcccaucuuggaggcagucuccacuuuggcgaaaugccucucagaggagaugcuuaucugagagugaacugccaagugcagaugaucugugugugugauaaguaagugcuagagccucggaaaggucggaauguugaaagcauaucaacucugaggcauucagaaaggcaaguguguguuugcuuuauggaaacugcuguccacaucugaacuuuuaaacugaauagguacuaaagauaaauuauucuguccuuugacuaagagaacuauaaaagguuaaauugcucaauguauaaggaaaauaaucagggcuagaacuaaaauuucuaauuguaauuaucauaaagguucagguggccuuaaacucauguugccugggaauuauguagagaagugugaagucuaugagugggaauuauuuucuagcugugugagagaggcuaaggaugcuauuaaacauccuguaacguggcaguuuguaauaaaggauugucuagcuuaaaaugucagugauacugagacuaagacguguuuuacacaaaauaauucugcauggugagguuggaacaagcauccaacuugugaacucagucuuccauguuguccguugucuuuaaagcaggauauuaaaaacuggagcucccuacuccuagccacugacacuguggggggagguacaagugaagccugagugaggucuguguuacuguagaaagcguucugguguaacagaguuaugagguccagugagauaagcacuugcuguuuuuauauucugcugcguguucuuccuggaacuuagucuaccuguguuuuauuuguuugcuugacuggcuggcuggcuggcugacaacagauuugaaugguuucuccaagugcuuugaauuuagcacaacuucugaacaugguacuuacugcaguccuaaagaccauggacuguuuaaagaauuauuccaggagccagaaaugaacagagccagaauuugaaugcuguauaacuccaugcuugugucucucccggcuuacuacuugugaagaacgaacucccaguuacccuucagauacaauguauagacuccugacugauaaacucuuaaguccuuuaacugauacuuuuuaacucuuuccccaagagcaaggucugaacaaaggaacagccacuucaaucucauuaaccucuucucucccugacuguguuguugaccuuggaugcccugggugcuucucuugccucggugggacacuuuccugcccauauaccaagcucuaauaauauagcaguucuuaaaugccaccucuguaaaggcuccucauguuaucauccucccugccccauucuauccaauuuuguuccuuccugggucuuccauuuacagauguuuuccccuucauccacuuaucauaaauuguguauaacuacacauauuuauuugcuucuauaguuaaugaggguuuucucccuuaggggagcuccccaaaagcaaauagguugucauuuuuaucuaauuccauguaaauggauauuagaaucuaccuggguuuuauaggaauuaauaaauacuuuugcuuugugcagaggggaagacucuuauguagcauaggcucgccuaaaacucacuguguacugaagauaauuugaacuucugguccucuguucuuacauccuaaacacuaggaauacagacaugcaccaccaugcccuguuuauguggugcugcugggguggagcccaggguuuccuacugcuggcaagcccucaaccaaaugggugagcuucauacacagccccgcagaucccuuugaaagacugcugguagauguucuuccagaggcuggaagguaggaauuaggaaguuucuuguccucaaggaacuuagggaauaugugugauauuuccaucuuguauguuaagaacuauugguuaaauguuucauaaguagcaaaguccaaaaaaauggauuucuuuaguuagaaauacaaggcaacccucaucaaagggauacccuaguuccacagagagaacuagagugcacacucaacagaaguuaugggcucugauuuauucucaguuugggugcuguguguguucugcacaauaaguguaaauaggaacaggauuuggaccuauggagauacggggggaaaggaguuucaagagggcauagucaggaaaaaaaaaguuucaaagugcuaaaaucauucagaaaagcuaagaucugucuuagugaaacacauccauguggagagaauuagaauggggagaggggagggaggaagggagauucccaugugaagaggauuacacugagauaugaagagagugagacagacacagagugaacaaagagucaggugaaaucaguguaccaugagggaaauagucccucauacugcagccuagaaagcaguucacagcuugagacacaccugcacuugagauacuaguuuaaccugggcugcugguucuuagaccaacaccaucaccaucaaauagcacgauucaaaucacuguggagcaucuucuguauuuggcuuggcuggaagaguucgcuuauauuucuggaauggagcaauacaugacauguccccacagguguuggagcaguuacuaaaaauuacuauauuuacagauugguccaugcuguaacuuuucuaagguuuuuccaguuauuuguuucuuugggguccuacuuucuugaaaccaggcuucuuuccuuagccucucauaauaauaauaauaauaauaauaauaacuauuauaauuaugcccaaagguggcaacagaaguguuuugaaauauuuguaguugugagaagaaauuuuggaguaaugccuccagucaacuguuucuucugccuucucucuacaccauucuguuagcacgcugacagaagaaauaagcacagauugaaaaggucaugaagccaggcagugguggcgcacgccuuuaaucccagcacuugggaggcagagacaggcggauuucugaguuccaggccagccuggucuacggcuauacagagaaacccugucucaaaaaaccaaaaaaaaaaaaaaaaaaaaaaaaaaaaaaagaaaagaaaagaaaagaucaugaagacaguuuagggauuuguugccaccuagccccaguuagacuuacagaaaaagguucauguuuuacagauguguaguagaugcuggaagcuagggaggacuuguuucacaaagacauuggaaagauggacauuugaggcuggagcacaagagugauugauguaggcacaaagguggcaacagagcugucaauaaugaaacccccaaggccagccagaaggugggaaaaucuaugguuccuggccgagggccucacucucuaguacaggagaguauaugaguaggccacugaggcccucugcaccucgcuucuuccagccuuuuuguuuuguuuuguuuucugagacagggcuucucuguguuacagagcccuggcuauccuggacuccgcuuuauagaccagacuggucucgaacucaaaaagaucugccugucuccacauccugaguguugggaggcaugcaugcaccaucaugcccagccccagaaaagacuuuuuaacaugcuguuuguuucauguucuaugcaauuauuuauuuaguaaauguacagaguaaauguacuuuaaguugaucuaaccugacaguucuuggauuuccucuguuguacauuuguguguuguuugucaagguuuagggccuucaaggcucaguuccuaggaucugggcuggcauuucaguccacuugaacuuuuuuucuuuaaagauuuguuuauuauauuuauaggaguacaccguagcuguuuuuagacauaccauaagagggcaucagauccuauuacagaugguugugagccaccaugugguuguugggaauugaacucggagccuuuggaagagcagucagugcucuuaauggcugagcuaucuuuccagcccccacuugaacuuuuagaaacaaguaagaauuuuauuaucagccucucuccucacauuugucaaucaaaauaaacauuuuuuaaaagccaucuaucuguaaaggcaaaccaguuaggccagaaauauaaauauucaaauuuguaugucaacauguagacuucugugaaauaaauaguugaagugagauuaauucauccaacucuuuuuuuuuucuuuuuuuuuuuguuuuugggggguuuugguuguuguuguuguuuguuuguuuguuuguuguuuuucgagacaggguuucucuguauaacucuggcuguccuggaacucacuuuguagcccaggcuggccuggaacucagaaauccuccugccucuaauucauccaacucuuaaaagcuuaccuugcaggcuggagaauguaguuucgugauaagaguucacacaagcuuugaguucagucccaccaccacaaaaauaauaauaauaauaauaauaauaaugaugaugaugaugacuaguccuaccugaaagguccccuuuccuauauuuacuugggucuguaggacauggaaagguaaguaaauaaaguggggugaucccugacauaaguccauagugaggaugauagaggcaaucuguucgacuagauacaagcagaaauguugagugaaguuuuaguuuuggguagggcuccacuaauaacauacugucuuauuuuuauaguuaaggaaaauagagcucuaaaguacaaaacaauuuucacaguaaaguaauuaucaugucucauguuuaaacuaguuauggcuucuuuucucaccuuuguugcuuauucauucauguuugaacccaagagacacaagugauguagggacuggacaaugggcgucagcaccauuugacauuagcaugcuuucucugauaaaugguggcccuuagucgcuaugcagggccucaugcagucaggcccccagcaucugucuugccccaacagguuuccuauucaugcuuguucagucugaacagcuuaauaagguggagugaugugggcugaugaaacucaugacacgagaaggugaccuucaacuaauagcuggaaacagagugcuuuuuugucuuuuucugauuacaaucagaucacagguuugcucucuacuauggacagaauuagauuuggagucucagggcagcugaauuacuguccugcugaauauauauuccuagccaagagccuccaggaggaagagccacuaauugauagcugcuguuuuaugauuuuaaaaacuugucaauccaugcagcauuucuuguuugccuagauuauuggccacucucauaaacgaaagcucuuaagucuaauuguuugaaguaguuuuccccuuuaugugucuggugguugguuccuuuugaugcagccugggagccuaauguaugaguaauucaacggcaagaauucugcugcugccugaauguguacaaugggccagccugguccccaccccccuuuccccaaaagugcuuuuggggacuacaggaacuaucucaaguaaugcuuacugugacaucuggugaagaaagaaaaacuaacauaaugagagugaucgcugaaagucuucaaagauucacuaaaucaguuguuagcccaaccuaaccagugcugugaagagaagcaggugagaauuuauagaugauuccuuuuugagcaaaauguuagagagucaaacugaagcauuguuucacuuggacuugggaugggggaaucucacuauguagcccuggcuaugccccccaagugcugggauuaaaggcagaaacaucaggaccagcucauuggggaacuuuuuaaaauguauaaagcuugagggaggggugugugugaagauggggagauugauuuucauaaagccaucaagacauuuugaaguuuagccauaggaaagcggccuguagucauccucagagguggacuaugagagagaucaauccuucauacaaggaaguuuugaaaguuacuugacacagagucuggccaguacgaagacuaucuacucgccugacacaggucauuagaggguggugucagugcggcugaacugcuuacuuggccauauggacauaguccauagcacgagucccuguuuacugugcuuuaauggguuugaccuugacuuucuccugucuuuuuuuuuuuuuuuuuuuuuuuuuuuuuuuuuuuuuuugccaaaagcaggaaagcugauugucugguuuguguuuguaccaauguaaaaggaaacuuaacccuuaugguuuuaagaauaaaagccuucuuaaucccccuuaucaccaaaguugggaaagaccuaggcagucucuagaaguccaagacucuagauuacaucugccugggcucgaaggagggccugccugccugccagacugacuacuuccuuauugccuuuugugggucuauuccaucaucccaagggaguauuucucuccuuugguuauggaauaccaggaaaauaaaagaaugugaagccuagagcucaccuguuagaaauacagcgggugccgagacucgcaguacaucaggauuuagaaauacagugggugcugagacucacaguacaucaggauuuagaaauacagugggugcugagacucacaguacaucaggauuuagaaauacagugggugcugagacucgcaguacaucaggguuuagaaauacagugggugcugagacucacaguacaucaggauuuagaaauacagugggugcugagacucgcaguacaucaggauuuagcuuucuugcugauguccuggcuucuguccacaaauucauuguucuuuugcuagagauucuaggacuuccgaagucuagcuuucuaaguauuuucuuuuccuuggcuuuguuuagcuuuuugagacugggucuccuuauguagccuaggcugaccugaaacuuguaaccugcuucccacaugcugagcuugcaggucuguaccaugaccugccucagccugccucaagugggucucuuagguaugaggggaggggagacugcuuuuucugguaguucuuagggguagacugaacgcauuauaauagaaagaaagcgguuuguaugaaugcacaugcuuaggugcaggacaagacaacacagaaagaacagcaggcuccccaauguucagugcaguuuucuccaccugaugggaucugucaagggcagaaccaaggucagucaccucuaaagauaagaugcucaugagaagcugaguagaaagcagaugucuuagcuguuguauggacuagguuccuuaaaaucugcaugguuuuguuuuguuuuuaucaguucuuagacuguuuuauauuuccauuaaaaauacaaguugucuacacuaggcuuaggaacuuccacaugccugccguuuaguuccuucacugcauuuuccaaaucaaaggggauuuucuaauuagggucccacuugaauucuauuaaagaaacacuagcuuaaucugagugggcaacaauguaaauaaaaguacaauaucucugcucucuuuaccugcuuauaagaagcccaguaacauaacaauauugcaaauggguuuuuaucagauuggaaguuaagagucaaggguuuuguuuguuuuucaguucuaucuauguuuugcuaguucuucuuuauaaauaauguguaaccccgaugaaaugacugcagauaaggggcaaagggacaguugaguuuuacugugaauugccauauacccauagaguguccaaacagaaacccauugaauaauugcuuuauugcagagauuuuaaguuccgccucuuacucaucacugcucaauccacuaauuacuuuuuaacggagaacucgauuccauaaaauguacaccggcuacuuuguggaccuugaaucggguucuuagaaagagguuguaaggguggaguuagauuacagaaaauaguucuuagagagcaaguugccaugaaguuugagaagcaagaauaagucaaacagaaaagcucuggguuacuaugagguugaaccauucagauugugaacuaagccaguccgaugggccuuuggguucugacuaauucauuauucuggcaguauccauuuuuguucuagaaugaacuaaguuugggucaacuuaaagcuaucacuagaaaaccagccaacaauacuaauuuuccuucuaugaauagaauuucuguuguacagggaauggguuaaguauguuugagaugcauguguccaauuugauugauugauagauagauaauagagugucgguuauccagacacauggcacauuacugaaaagcucaauuggcagaaaaaaaauauagacuagcauuuacuuauuaugaucuaaaauuugagaggauuagagagauagcucagugguuaaaaucacuggcugcucuugcagaggacccaaguuugauucccaguacccacacaguagcucauauccaucuaucaacagcuccucuuccggaggaucugaugcucucucugaccuuugcugugaccagacgcacacuuagugaacagacacguacacaaggcaaaaaaaccguacaauaaaagcaaauaaagauacaaaauuagauagauagauagauagauagauggauggauggauggauggauggauggauggauggauagauagauggauagauggauagguagauggauggauagguagauagauggauagauaaguaaauugccaugcugcugauugaucacagggccuugugcugggcaagugcucagccacugagcuauaacuccagcccuuauuuacuauguuuucauaaauaauuucuaaguucuucccgcuaugcauuaauauuauauauuguauaauuuauauaaauuugguuugacauaauucuguuggaucuuuccuaaucucagacucagagcccucacacaugcuaagcaaaugaugucucacugagcuaccauccucagaguaagcuuagugaacacaaggacuucaaguugcaguuugagcuucacuguugauuucugcccaucuguaucgcccuauucagacaccacuggguaagccuugaagaaggcucccauuacagaaguccauuguccacacaagaaaaacaagcagauugucuuccugcucucuucccugguguguuugaauguagaaugcacccuacacacacaaugcugcagagcaggugcacaguugaaagcuucucuuaagcuuugaacguaugaauguaugaauuccugggccacugggcugucugaagaguuuuugauaguuuaccauugaauagaucucucuaguuggaacauggcucuuaaacaaaagagaacaggucuucaacuauuauuacuaaaagcaguguuggcagaguuugaagaaaucaaggguacauauggggcucgaguagcuuguauugcuguuccugcuuuuaaagaguacgucgugaggugugugcucaacuucuccaacucuuucgucucuaaggaaagacugucugguucauuucuuuaucucucucggccucauagaaauaauagcacccaauaaaauguucacugccucuccaugaccuggauuccuguugauaacauggaaugaaauuaucuuugguacuuuucuguuaucgcuuccagccuuauacuggaagaaaauaaaauuuguaacuucuguuugugagccuuuauuagucauucuggaaccuuuuaucuugaugccauuucauuuauuugguucagaaucauaagucauaaccaauaaucccaccauuccuuuuuaaaggaaaauugcugacugcuggcccaugacuuguggacucacuauuauauuuuguuacuuaguguuuauuauaaaauuuucaugaacaaagccacuuaauaccauaacaaugguguuaaggggaaaagauacauugucaacucuauaaugauaagugaggucuagcaugaccauuacuggaguugaaaguggaacuugccugugugacagaacugugccuguuuuguaagccugcuaacauagaguccuggguaggaauugagaggggaggcugcaccuuugugcucuggaguuggacacgugguuuccugggugugaaagcucuggcugaggagcaucuccguacagcucagcaaugucacgcugcccugccucuccuccguagugcugcuuccaucacgagauuauccuguucaccucacugcuucucuccuuaucggcuacuuugcuuuaccugcuguggauugcugguacuuagcucugacuuuggcccuugcuaggagcuugauugaugaguaaucaaaagcauacacagacucgaguccauggauaccuaauugaaauuuuuuuacuguuuugagacaaggucagugucaccuacgauugccucaaacucagaaucugucucccucaaacuucugagugcuaugguuacagguguacaccaccaugcccuguuccuauuuugaauuucuucuacauacuggaguuguggaacacauagagagauuucaggagguagacagaugguucagagguuaagcaaacuuguuaguuggcucagagguuaaacaaacuuggugguuggcucagagguugaacaaacuugcugguuuugcagaaggcccaggcuccauucucagcacucuucaugguggcucacauguaucuguaacuccaguuccagggcauccagcauccucuuuuggccuccaugggcacugcacacaaaugauacacauucauacaugcaggcagaauacucauacacauacaauaaauaaaauuuagaaagaaaaaaaaaaaaacaggcuuuuaguggaggugggggacacaccugagaggcugaguuugaggcuagccuggucuacagagcaaguuccaggucagccagggcuacacagaaaaaccuugucuugaaaaaccaaaaaaagaaagacagauuuuuaugaaaaucucccucugcacauauaguccaacuccccaguccccagccuccacagcaaccaugggaguuacugccccuugacccauuuagaccucuguagaaaagcauuaacgugaugcaaagauacaaggcugaauaugcacuguccaaaccuaauuuaauauauucauccaauuuauaccuuguuuuucauguucuuaacucuaauguccuggugcgucugaaacugucucugaggucugggcacgcucuuugccuacggcagcaacagaccuuucuccagauuuaaaugagcucuaaguugauuguccucuaagccuaaguggaaucugaacauccugguuaaacacagccaccccaauuagaagacguaucugaagccuuggcuuuuaucuacugcuguuuaugauuaaacagccuuagagcaauugcauuuuguuaguggcuuauacuuauacauuauuacaaauuaucuauuuccugccaucugaaggggcuggguuuuucuaccuuaaauuaaacacacacuuaaucugugucuuagaggaguaacugcagauuaaggaacgagaucucaagccuucaggacaagcccuugguccuucuucucaaaggugauucuuaguccaaguugcugugcgucuaggagagcuuuuguucauuugggcaaaauucuguguagacaaaguauuuaucaagaaaauucuauguuguuuuucuugaaagacuuuuccacugaaucucaucuuuuucuggaaaacuggcaaugaaccauauggggaugaaccauauggagaugcaccaccauauggguaugaaccacacggacgacaacauuaccaugccaccucaccaccacccgaccaccucagccucacacucccacgguggaggggacagcaugaugaugaugguaagagucacacacucggggguuacccaagagggaaaccacagcacgcacacacacauacacccagugagucuagagacuuaccagcguucauguggcaggcuuguuacagagugacaccaaacccaacauuuucuacaauccuuucuucccuaauccuuuugaaauucaccuuuuccugaauuaaauccuaguguuugguuugugauacguguacaaaagagaaagacaugagauugggggcggggcggggggggggggagggaugcacucuuagugccaaggugguaaagccucccacugcuuugaguacuucuaauccugagguuaccuuuaacuguuugcagacucuuagaucauucccauuaggguccucagccuucucuaacugacuuguuugguuuucuggcagccuaugaccuucuacuuugacuuuaagaaugugaaucuauuguuuuccgguuugguaaucaauacaccuggaggugaguaaccaucagauaaccuucgaagaugacaaugucaugagagaugaugauguagauuuagaaaccuggcaccucucuguuccgucacugggucuguaugguugugcuacauaacaucacaauuccuagacccuaggcagaagaggcaacacaguuuugcuccuccagugagcuuccuuuauguauaugguuuggagcacuaauauauaauuaaaaugccagauaaagaucuuuuucaauucuuuucuuguuugcuaaguuacugauccuaggccuaagacuauauaauuaaaaugccagauaaagaucuuuuuucuuuuuuuggggguggggugggggguuaguugguuuuuuguuguuguuggguuuuuuuggguuuuuuggggggggguuguuguuuuugguuuuuuuuuuucugagacaggguuucucuguguagcccuggcuggccuagaacucacucuguagaucaggcuagccucaaacucagaaauccgccugccucugccuuccaagugcugggauuaaaggugugugacaccauugcuaagcuccagauaaagaucuuuuucaauccuuuucuuguuuguuaaauuauugauccuaggccuaagacuauaagcauacucaaauaucacaguauaacccaagguuaaaaacugagaggcagaggcaggaagaucuuugugaguucaaggccagcucauagagaguucaggcauagaugcugccuccaaaaacaauaguguuaaucucauaacuaccuguuuacagauaaaccuaagccucguguaguagaaauguuguucccugaaucacacaguuaguaucucagagcuaaaaccaggaccauacuuucuagaacucucuaaaccagugcucucucugcugcaucaaaugaugguuuccauaucccugaugcuuggcauaucauggagccucacuuccuuuuaagguagcugucauuuaucuuucuguaucuaucauagauugguaugcuuuacauuuaaacugcaguugcaugaguuuaauaggcaccuaaacugcauuagguaccaaacuuauuuuggaaauaaccuaguuugcuuuugggaguggaagagaaagcguuaguccuguuaguguaucauauaaauacacuauaaauacauuuaucuuaucaaugcuuagcuauauaugcauaaucccuuaaaaugccuauucaaaauauagaggcagcacuuguaaaagcagguuguuuuagcugaugugauagugugcaccuuuaaucccauugcucaggaggccaagaucaaccugggcuacacaacaaaguccuguuaaacaauaagacaacaguuggcuguuccuucuuucaguauucuguauauaaucagaaaguaugauccugagcagaggcagagacuguuguuaauggcucagcuccacugaguggguagaaacacaaccaugcaguuuauucacaaacugagccugaugcuuuuucuguuugguuugguuugaguuaugccuugccauguagcacaggcuaauuguguacuugucauuuucugccccagccuccugagcacuggaaucauaggccagugccaaugugaccgaccagcaguaugcucacuaaguuuugacuguaccgucaccucuuccuucuuuucucucuuccuccccuccccuuucccguccuguccuuuuuuccucagaaauggcuggagccuucguggcaguguuuuuacuagcaauguuuuaugaaggacucaagauagcccgagagggucugcuucgaaagucucaagucagcauucgcuacaauuccaugccugucccaggaccaaauggaaccauccuaauggagacacacaaaacuguuggguaagaagaugcaacagauccaaagggaaauucuagagaucucuuaguaauguaguaaggcaggccuucuucuuccggaguuggugauucuaacuuuagaaguuccagguugugggcuaugguauuugggauccugcaaaagcacauacacguuuguucuauguuguaagugucacucugaaagaaguuuaacaguaucugguuuuuaaaauauuugcuauguaguaaugggcauuuuaagauauaguuaagauauaaaagaauggcagaaugcgauugauuccuuccugucgaguuaaaucuaaucagauaugauggaugccgguagucccagcacuuggagaaggcuggaggaccagaauucaaggcuauccuuggcuacacagugaauuugagaccagcuugggcucaugagacccugucucaaggaaaaaucaaaaguucuuuacagaugugugcgugcgggcgucaguuuccaggauagccgugcugcaguccaguuaggcuguucuccugagcugcaggugcccaggucugacucuccuucucugcuuauccccaggcagcagaugcugagcuucccccaccuccugcagacagugcugcacaucauccagguagucaucagcuacuuccucaugcucaucuucaugaccuacaauggguaccuaugcauugcaguagcagcaggggcugggacgggauacuuucucuucagcuggaagaaggcaguggugguggacaucacagagcacugccauugauaucagacuccacauauggccuuauuaauugcuguaggaagcaucuugggacuggaagauaugauucccuuuccaaucaucccuucucucuccugucuauacauacacaccuacugaauagaagccuagcugacagucucugaauagugguuuuucuaauaagaugagauuuuuuucucuugggaagucaccugugagaugucuucucccucaucauccugagccuuaucuaauccagguagcuuccuaguuaaagacuugguuaucugcuucuuuuuacuucuccagguuuugauuuguuuuguuuuguuuuauuugcggggggagugggauacauuuuguuuuaaacagauauguguauuugauaggugggauucugggucagugauaaaaaaggauuguaacaggauugauggcacuuagggacaucucauccaaccgggacuuaaauuucacacuagaaaugagcuccagucuuaacucagugaaugggaaacacauguuccucucuccagguuacacugaaaccuguguaguguguacagaguggguagggacuaaacacaggccuagcgucuaugagucuguauuccugcucagucaucaacuuguguuccuauugaacauuugaucagaaugaacuugccaaucaaaacaaaaacaggacaaucaauuuaagacaacagaaauagagauuguuaaauaaaaccauuaguauuuuacuuugacucaguaccuugguuugucccaacugaauaagaguuuguauuguguguguguuccuugaaaccaaugauuuucaaacuuuacagcuucagaaucacccagagggcuuguuaagacacuacuugguggaccucaaccccagaaccaccaaauuuggcauuucuaaguuccuaggugauguucuacucacagucaguccagaggauuaccuuaagagucucugcauuaaacuagaaaaguugcaccuagaagggacagaggguggggcuaccugcuaucaggcaugaacaugugaauugcugguuaguaggugguaugccuugggcacaugucacaucuaaaugcugcuggucgauacuuuaucauuccacaaacauuuauucacuuccaaauauguuuuauguauacccacauacagugugugggauuacagccaaaguauacuugucaacauauacgaagucucuaguccuaacuuuuaaagaucuaagguuccuuggaaguuauuugaaggccaagagaccuuugcucugcugugugagucagccagucaaaagcccagaaaggcaaaaacccagcuuucuuguuuggagagacauggggcaugugucugccaauagccaguuguucucagugugcacuauguagguccccauccacuacuugaccaccuuuaucauuuacggggauuuacauagauuacaguggccaagaccccuuucucaaugaaggaucucauuggacguccugucaaucauuaaucuacaugcaggcuuguucccacacuaccucuuuaaagcgauucuuccuaugcuggucuguucaauccugcccucuuuggugcuagauccaguugugccucagagcagaagaaacaaaccugcugucuuguuggcccaguguuucaguuuugaaguguguacuuucuccucugugugugccaauuacauauuagagaacaaggaauguguacuuugguggcuuugaaccaagaaaagguuuuaagccuacuggauggagucuaaaauucuuagaaaucaacuuuagagcuuugcuuuucucugaguucauccugcagugaaugacagguacugacagcccaacauuaaggugcaaauagccuguuugucauaucagaagccauggaauaauaaacccaggggaauccagaaaccacacuuagugguaacccuggugcucucuagaaucuccaaaugagcugcuauaaaacaccuuucaggggcugagaugcagcucuggugugagucacuuaccuagcuuaugucaggccccuaaaaguaaugcauaaacugucagaaucgggaccuuaucguugaggugaaaagaaccaaggcccguaggaacaaggugcuaugaaucugaaaccaagagaaaccucaguuuggcaugguucuucaggguagcuuccgaguagaaauagucugcugcaaauccuaaacuuaagaucccugcgcuagguugcuagagacugcgguuagugcagaacagagguaagccuaagucccauccucaugaacuucaaugcccagccuuuguguuuauuuuaucuaaaugucuccuuucaucugugggaaagcuauagcugagugucuuuagccccugcccuacuuuucccucucugacuuuuuucccagguagcuuaguguuuaacaucucucucaccauccugaugcaguagcauggcuauugcugagguuauuuuaccuaauaauuagaacuuuguauuuacaaagcaaguagaggucuuaaauuugcuucaagaagcaguugcuccacuggaauuucuauaaagcuggguaaaggguuagcagaauuacagaucuuaaguacuaacugcaguccaagauggaagaguacucagcagccacugcccucaucaggaaccuccucggcauccaucagucuccucacugcuccugugcgcagggcugucccucccacacucccuuccaggccguggccuucgcuuccucauuagaaucaggagagugaggcacaguguccaucaugccauuuaaucuugugccugcccuuuccagccucuucaaaagaugcauccaaacaacaggucugcauuugauguaaugccuuaauuacuggggccacauucacguugacugucucagagacuguaagcucccggagagcaggguugcuguaaugggaauguuuaaguguugugugcaagaaaacaaaauaaauauuuugauuuucgugauucuaugcaugucugucuacacacuguccaaauaagcugguucugggacgucagucuccuccauggcauggccuuguugcucuccugccacucuuaagcagaccuggugccugccacagggucagcaugaccuugugcauagcacauagcagcaaauauuucaguauaggagcgauucuuaaguucagaaacuaaccuuugccgccuuucauccguaguucauaaccccuguguucaugccauuaggcggcagcacuagcuuccaggaggcucccgggcagacugugcccaucccuguagcagaggggaaguauuacuguuaguggucuaaccgcuggcccaucaucaccucuucugcaaugcugugguaaacaucaccuuuggggacagcuggcucaaaucuaggcuacaccacauaggaacugcuauccuaacugucucaaagccauugauagucaaguguggugacacauaccuguccuuccaguguuugacguugaagcagaaugaucaugaggaaagaccuggacuacuuagugaaaggucuucaguuuggggguucaagggaaaacaggugaauuuuccuuuugggccagaaguuuauuaauaccauaaaaacacagacagcagcaugagcagcucagagagcucaggcccuaacaccaguaagucuaccucugcuuucuguggcagagagaagggagggaauucuaaaagaaugugccacucaggauauaggggaaauaaggaggagagguacauacagauggcaaaugugucccaccggagccccucuacuauccuagagucuagcaaccuggucuguaagucaaaggaaaugaaguauaauccugacaccugggugugguguuuacagacacuccacagcuucugucucucccuguagcagcagggaucucggaaccagcuauaaagauagagacagagaggacugcagguggguauaauugcaggugggccugggauucugcacagcgagggacucuguugcaaaaacaaauggcuauggguguagcucaguugguugagagcuugccucguaugccuuucuaagcucuagguccaaucccuagcaugcccugcaugugcauacacacaaagaaguacuagcaccuauuuaaauuaagaguaauacagauaaggcaucccacacaagacaggcacccaagccuuacuacauuuuuccuguguacugauuauauuacaccugaaggcuucaggaaaaugaaaggucacucuucugaauaaagugaccuccugggugcugguagucccgaaacaaacagauccuaaggaacacagcauugauacauauaauuuagguaugcccaaaaaagauuagcaauugcaguaaguccuggucuacugaugaauaauugucucauucuguuaauaagaaagcauagggcuggagagguggcucagugguuaagaacaccgacugcucuucugaagguccugaguucaaaucccagcaaccacaugguggcucaaaaccacccguaaugagaucugaugcccucuucuggugcaucugaagacagcuacaguguacuuagauauaauaauaaauaaaccuuuaaaaaaaaaaaaaaagaaagcauagaaaaucuuggaaacuugaaaauaggaaauuuucucucccccacacacugcuuucuuaaagacucagcugagaccacuuagagagcaauguaguugaggccauuaggagcaugggauuggaaagcagguggcuccacagcucccacuucguggcugagcucugguucgcaucugcaaacucagaauggugugcccucucaggaaguaagagagucggcacucagcacucucauacagcccucugcacgacagcugucaggacaaagggcaaaacacgagggaggcacaaaaacaacuguggggauccuacuggggaguugcagugaaggacugaggcaggcaggcagauccuuuccuuuguuuccuuugcccgcuggaaggccuuugcaggcugcaauaauaaagagucuuauguacagccugugucuuggggguuuuauuguguucuaagacaggaagauaacaggacuuagaagucaucaauaaaacuagaauaaagguuuuguagaaaagcuuggagcagaagagggaacuauacaucucccucugucucuaccuucccauucacaucacucuugaacuauccaaaauccuggguaaaucccagcuaaggaguuucuuugaaacuugauuccagauguucuggcuuccacagcuggugguucugucccuggguuuuaugguaaaaauagggcaugguaugaaaguauccagagcagcucucagaugggugcugcgcaagugaagucccaagugaagaacagaaugucucucacuguacagcuguuugugcuucccccccccccccccccgguguaaagcuuccuggaaguggguuuaauucugacaaucugaucauuugaauccagucuccaguuuguuuguuuguuuguuuguuuuugacauuuugagacaggguuuugcucuguagcccagacuagccuucgacucuuugagauuccuacuucagccucccaagugcuggauugcagccugagcacacucaucugggaucucuguugcuugaaggauggucagcagacagugaauaaacaagucagcccaggggaucaacugcaaguguuuggggccuggggucuuuuuguaaagacaaggagaaugaugucacuuguagcaguuaccugucagagcuggcgauuagcagugcuacuaccuuuaaggacgucucacauuuuuuccaaaaauaaauuuauuuuuaaaaacaaaaaucaguuaagccuucugcgguccaacuuuccaggaagaagccagaauuuggcuuccagccaaucagaaagguuggacagcaguaauuucacacagaagucaccucucccugcaggagacagaaaaccuucugcuugguugcacacacuuaauucucuaaaucugguugguacuccugucaucauuguauucugucccaggggucuggcauacaagagaauccaucucuaaaauucaaaguuuccaaacugagaugugcgguuguugcucuugaguugggguuuauaaccaauucgaucauuaaucauuuguucccggcuuuuggggucacugcugagcccagcagcuccuucuccaucgcugguuccuacaccuuccacaucuuccuucugcuucuuacgggccuagaaguauaaaaaaaaaaguuaggauauagcacagcauucuuucaauuaacaaauguuuagcuagaauguaccauauacuagguacuagguauggaacaagguuagggcuaauaaacaauaagcugauagcacaaguuuaggauaguaacaaggauacggacaugcaacuguagaagauauaacccuacaucccaggauaucacagucuagaaggcaaaugggcauguaaacuauuaauuauagcauaaaguacucuggauuguaaugggaaagcccccaaugccaaagacacaaagagggugugaggaauuaguguaugcuacaaaggcccagcaggaaccugcaauuggauauagcagauauagggcaacaaaaguugauucagcaaauuacugucagugagaacaguggucaacgucaugacuagcagccaccaaaagcccacagccuggaagacuggcuccaugcugacuucagugacacaauauacagagacauuaugcuaucuggaggggcuuccuucuggcuuuuaaauuuuauaaauuaaucaccuaccuauuggugauacuaggaguugaauccaagccuuaugaaugguaggcaaguaagcaaccccugugcuauauuccaggcccuguguugguuuuggguuuguuuugaauuuuuuuuugaaaacuuuccucuugguacuacuaguacugcuacucaccaaguaauaaaucugaugcaaugaaaagaaaaucuacagccaggagguggugcacaccuuuaaucccagcacucagagggcagaggcagguggaucucugaguuugagaccagcuuggucuacaaagugaguuccaggacagccaaggcuacacagagaaaccugcuucaaaacaacaaaacaaaccaacaaagaaacaaaucugcaauagacagaugaccuugaugacaauccagcuggcaccacauugugucaacaguuaccacacuuguugcaaccugugacuuaggaccuccuaaacaagaaggguuuccugcuuacacuguagaaaccuuccuguuauggguguuacucccgcuguggcugauuuccuagacuuucuuuaaggcauguggcuggacugucccuaaguaacccuauagcucuccugacaacucuuaucuaagaauggaaguccuucucugcucuguuuagaacucugcuacuugccagacaugguggugcaggccuuuaaucucagcacuagaaaggcagaggcagggagaucucuaagauggaggccagcguggucuacaguggucuacagagugaguuccaggacagccagggcuacacagagaaacucuaucucgaaaaaccuaaaaaaaaaaacaaaaaaaaaaaacaaaaaaaaaacaaaacagaacagaacucuugcuacuugacuauuacauguucaaggccagccugggcuacauagugaaaccuuacuuuaaaaaaaaaaaaaaaaaaaaaaccagaagaauuuugcuacaucuccaccaccaccugccugaguccuagucuaugauuugaucgauuuccaaagccaugauaguucucaccaugcugcaauuauaccaguggcaaauuucccuucacuggcaucaucauguauugaaccacuacuguuucuuccuuagguuccacaucccaauucuguuuacaaucuauacagccaccauagccugcuccacgacaaccucugugccaccaccuccaccacuguagccuuccuugcuauccaguggagugcaucuugcucaaagggggccaugucaaaaugaugccaaugaacagaguuauuucugagucaacugaccucccccaccguuuuuacaacuacugcuuucaaucuugccauacaguucaaagugguacaugcuucugaauauuuuuuuucacuaucaccaauaaaaaucuccacuucugaugugcacaaagcauccagaaucaucucuagaaagggcucuuugguuccacguuaugccuaucaaccaaccugguguggauaagcaaacacugacauaucuguacaagaccauaaacaugggguuuccucaagaccagacaauuuguaaguaugccccacuucuccuaauauccucuuaagcucucaucuguaucuucaaagcuucagucaauaaaguuuuaccaaucaaggcuugguuccucugauucacaacccuucuuccucccguggugguaacagugaggagcccagacacacuaaccuuaugggcauuuggagacugaagucaaccuuuccaauucaagugaauaugggauacagagggagaguuuggcuuccuucuuucacaaaugagguguggccccaagucaccaguggcuacagaauucccauagccaccacugccuaacuauaaagauggcacuggaugucaauaacucuuuuuaaaaaugacaguagaugcuuuaucucuaguucuuuaccgggagcacagcucacgggcucugaucacugaaauuauguugguaauuacauaccaccuacuggcaaacuguaaccccucaaaucccaacaucgguuaacuaacagucauccaguaaggcaaggcgaaggaucccuucucugaggugcuugggaccugaccuauuugaagcucaggguuuuuguuuuuuuuuuccacaguuuggaacuuaugcauuaguuacagagaucaagcaucccuaagccaaaaaaauccaaaaucuaaaauguguccaaaugugaacuucccugugguuaucuuuacguaacaaauauaaggaacuuggccagcaagacagcugccaagccugauaauccgaguucaauucccagaacccagacuucuuaaaaaacaaacaaaacaaagcugcauauagugggagaucuggagcaccaacacuccucuaacaacaagcugggaggcagagccaaccagaagcucaugggcaaagcuagccugaaguauauacaacauuaacaggaaaaaacccugcuucaacaaggugggagagaaccaacuccagaaaguugugcucugaccuccacauaagcaucuuagaacacaaacacccucacuuccuguuggaucgaugguuuugugcaguuuauuauucagacacugauuuuugcucugacuccaggccaucuguuacuccaguugcucagcaccuagguuguauuuugugaacacucccccacucccuucugauggguuugaauaaaaaagcggauggccuaugacaaugggagagggcaggcaggacuucugaagagacugaacucugagaaagagcccugccugcaugggaagucaccaugucaccagugagaugcagaugaagaagcaggugccaagaagagaccaagacagacaugucugaccacaggacgggacaaacgccaggccaguacugucagguuugaaaagcugagauucuccccccauagugcccaaagcuuauuaagucucuguguccuuaugugggagcugggcaguuccaaauaaaguugcuuuacuuucuauuuuauacacuaauuggcucuaucccacguguaauugcucucguuucaauucaaaacucaauagcuacaacuuacacuuaccacguacauccuacuacugacagccuguguguguuuaguccugagagugaaggcugacucuaacacuuggcagcaaggguuacucacugcguagucuucccagcccacggcuguuugcuucuuaagaacucagauugggaguaauuuuuuguuguuguuuuuugguuuuaucgagacaggauuucucuguguagcccuggcuguccuagagcucacuuuguagaccaggcuggccucgaacucagaaauccgccugccucugccucucgggugcugggauuaaaggcgugcgccaccacacccagcuuggcaguaauuauuaaggauaagguuuccuuccuuuuuuuuuuuuuuuuccugagauagggucucacugcguaggccagaguggccugaaaucuacugugaucuucugccucagauuccugcgugcugggauuguaggcaugcaucaucaggccugaaugaguuucaaguaugguuuaaacuucaguguaaugagucauaaauguuggcaggauggguucugucucugcagagucagcucacuguugaguuggccuuuccacuaaaagggggguuggggggauguugguguccuuucaagcagcuuuggaaagagggacacucuugcaaugaauuaaaugaaaaccguagaaaaagugugucuuccucugucccucccuccuucccugguuuaagucuauagcccaggcugucuaacuucuccugcccaugacucucaaguacuaacguuacaacuguguucuccugugccuggcucuggguuuuugguuuuuuuuuuuuuauagaauagaguuuauuaagggcauagggaggugagucaagaaaguaguagaggcagagaaaggcagagaaagagagagagcgcgcacagaaguagacaaggggggaagggacaaggggacagagcgggagcaagaaggcaagagagcaagagcugcucugcucuuuuuuuaaaaaaucauuaugaagguuuuaauguaugaaucuauaccaugugggaggccagaggggggcgucaggaccccuggaacuagagucccagauggcuguaaguggccaugugugugcuagugacugaagcgggguccuuuccaagagcagcacuuuucuguaacugcugagucaucucuccuccuccauccuucguacuucauuuuuacuaagcuuuguuuacuucucuguaacuggauucuggaacacucuggaguuguuacuuuugguuuuccagaguuuuuuugguuuuccgagacaggguuucucuguguagcccuggcuguccuggaacucacucuguagaccaggcuggccucgaacucagaaauccgccugccucugccucccaagugcugagauuaaaggcgugcacccaccacacccggcgugaaacuuuuuaaauuauuucauuccaacugaguauccucagagauuccucugcuucuuagaaguaguuuucauaaagauuuuuggggugaauuucuuaaagucaguucuuuguagcauuaacuaagaagagagugacaggaaguuuaauacacacauacauaugugcacacacacacacacaggcacaaagcaaaaacugacgauacuucgggaacacuacaguugcugggaugaagagcaagagaaaccuacauuaucagucuucauaugaacgauguaaagccaaucacauucuggguacauucagauguaaagcucccugugacagaaauaaaguagcucccugagcacgaaacgcagauaggccugcggagagcccuacuaagaguccagagcucaauauacaaaucccgccuuuaauuaaggagcuuccugccccacugaagaaaacagaccaacagagucacaacagaaagugguggcaccuguaagaauccagcacaggguggugacuuaacccagcuggggacuggaaggggccaagucaagacggggagccugaugacaggauaggcacgucagacaaaggaacaguacacagcugugaaaguaaagauaaccuggagaugaaguggagggaugagcaagggcccagccacaaaggaccucagcuaccaugggauuuggaauucauccugaaagugugaaagaaucuuuucuuuuucuuuuuuuucuuuuuccuuuuccuuuuccuuuuuuucuuuucuuuuuuuuuuuuuuuuuuuuuuuuuuuuugguuucucuguguaaugguccuagcuguccuagaacuugcucuguaggccaugcuggccucaaacucacagagaucuaugucuaccucugccuccaaagaauucauucuuauuaauggcuaucuaccauuauauggcaaagccagauuuagaaaaauacagcugcaagguaugguaucgaaugccuguaacucuuccacucaggaagcagaggcaaguucaagcucaaggcagccuggucuauaauggguuccagacagugagauccugucucaaccaaaaauauaaauaguacuccacuguaggcuagauucuagaaauucaguggugaagaacauuccuaauauaaaagauuuuacaauaaaugaccaaaugauugcaaggagcgggugaauguuggguugucuggugcugcuauauucaaauauguauucaaauacuaaauaguggaccccaagauccucauguauaccaaaugaugcuguaaaaaccuugcuccccaauuuaaagcuauugguuaaauaaaagcggcuacagcccauuacuggggagaauaaagauagccaggguuuuagguuacugggcuaggggucacagguaaggaccacaaggagagaagaagagaggaaaggagaagguaagaugaaagagagaggagaaggagaaagaagacagagagaccaggaggucucuauuagaugugauggcccaggagcauggagccgagugaaaugcccgaggacaggcugauggagcagaaauaagccagaggagacucaaacagcaaauacuugggcagcacagcugagaauaacagucuggcacauagaaaaaaagauuaaggguaauuugccuaguaacugcacuaaagcugauuucacaauacacaggacucugccuagauuacuggggggcuggucaggucauauuaauaacuaagaguaauuaaguaauauuuaaaauaccauuuacaggugaauguucaguaaauuucucucuaacauacacaagguccuacacugaucuccagcaucgaagggaaaaauaauaguagcuucaaguuauaauaaaugcuagcagacuaggauguugcuccguugguagaguguuugccuagcccaaaccugagacuagaucggccucaggccugggggaccuaagacaauucugcuaaaggaucagagaaauaaaaugaugacauguugccauggccacaggucuugcucagccccaccagaggcguuucuucuugcacgagauggggauuaacacagagacccacaaguggacaauguggaagacuuugaagcacccuguccuaacuggaaugucuucaccaaggcucugggauugaugaggaagaugaggcagaaagauugugagacccagaggugaaagaugagcccuaaggaaacagcauccugccgacaauagcacugaugcacauaugaacucacagagacuguggcagcacacacaaaaccugcacagguucgagccagaagggucucacccaccccgaaccaagaagcuaccugcaccugacaggaaaucaaucuucuccaacaucucccaugucacuccauggccaguaguugccaauacaaaaaugaacucaaugguacuuuuguggacuuuguguuucuuguuuuggggauuuguuuuuguauuguuuuugagagaaagagauagaacauaaaguuggguagguaaggaggaccugggggaauuugggguggggcaacaugaucacaaagaaaaauugaaaaaaaauaauaaauaauaguauuauuuaaaaaacauaacuguaaagggaucauuuccuguugucucaggccacugagcccuuaguucucugcuguuccccccaagaaccagaaacugaguccuuaccuccagguccuugcgaaugcucucaaacuccucaaugucgucgagcuugagcucuaagcgggucgguuuccgucgcagcauagugaagucacccaggacuucaggggagccagagcccgugagcugggggcuggugaaauggcaggagaggaaaagcugcaggugccaagccucagcuacaaacagaugaaucuguacacaggaacaguaaaaugaacaagacauuacaccaacucauuuagauuccaggcauagacgucaaaaucuguaggcaaccauuuauuacuggagcuaaagagauggcucuuuguucccuaagcauauacaggggacacaaguucaauuccugccuguagccccagcuucaggggagcagaugccuacgccuccuuggcuuccugcacucauggaccuacauauacacacacaaaaaaaaaaaaauugaagauuuauuuauuuauuuuauacaugugcguacacuguugcuaucuuuggacacaccagaagagggcauuacagaugguugugagccaccaugugguugcuggaaauugaacucaggaccucuggaagagcagucagugcccuuaaccacugagccaucucuccagcccuuacauacacaaaauuuaaaauaaaaucuuuaaaaacaaaacccagcaaguucccaucagaggaucucagugucucugucucugucucucucucucucucuuccuuuuuaacacuuuuugggaugcuuuauuccaaacccccugauagagcagaacaaaaccuauucucuguucugaguucuuaggucagaaaccaagcuugggcccccaaucucaggucccaagaccacuugugggcucccaagcacgacacccaaccaucaccuugugcuccaauauccuccaaaagacacacuagguaaaagaaacaagcugagggcagugacacucaacaacagugacagccuccuggggucucgugagcccagaaguuggagaccagccaaagaaacaaagggagacccuaucucaaaacaaaacaaaaaaaaaaacagacaagaaacaaaaggagcaaaagaguuagggagauggcugagcaggagcacuuccugcccugcccuguggaccugacuucaaauccccaccacccacauaaaaagccagccauagccagaccaguggugguacaacccuuuaaucccagcacuuggaaggcagaagcagguggaucucuaugaguucaaggauagccuggucuacagagcaaauuccaggacagccagggcuacacaggaaaacugugucacaaaaaaacaaaacaaaacaaaacaaaaaaaaaaaaaaaaaaaaaacauggucuuaugggggucugagaguuugggggcuugcuggcuauuagccuggcuccaaauucgguaagauauccugucuccaggagugaggcaaagugguauagagcaggauguccagcauacauccucuugccucaagguguacacucauguauacacaccacacucagacaguauauauagauacagacauacaacucacauacacacacaaaggaaacaagggaaaaugguuaacuauaucauguaaauugaguguccuuagggaaaguggauaugccaugccauuaauuaguccaaucugcuuucugugaacaucaucagagacugugaccauuccuagauauuauaaccagcuggcuuaaaucucaugaaaauuaaacuuaccaauucucagguauccacaggaucuaaggguccucaguggguaaaucauucauuaaucagaugcuuccuaugcugagauuaaagucacuaucgaaaucugugagaaaaacagacaacacaacagaccaggccaaucuugugucaaaacagaacccuaaggagggcccuccaacagcaccgcacaagcgucuaaccuaggcuggcugcuugggagugacuagggaucucagcucccccugggaucugaaggguaggcagacagacuuaagaccaaagaaguucaaagucauuucacauggcgaaugaaugucugugucagaacaaaaauguuaagcuggcagcacucuguagagugggcccugccacucaccugggcagcaguagagcuggucugggugacaaaggcaugggugagccagucccugaggacaugaggagagcugacccuacuugcugcuggcuguaucacuggguaaacuagcugggcaguguuugagaguucacccugguggugcagguacaggugagcugacgggcugaucaacucagcuaccucccaggaccaaaucuagggcuuggaguuggcccaucccaacaucuaccccuucuaugaucugugggcagguccuacagauccaaaguugcaggaugggaucuucaugacacagggcaacagcaugauaucugagaggaguccuagugagguuccaguacagauaguguagcaaaagccagaggccuuagaauagccagugacccauugaaaugaacauuuacaaguuuagauguguggacaaaaguguauacuaugugacgcaccaugacacacuacagguuccaugacaaauuuugguuuauucuaucuuauuuuauuuuaguggcgggaguaguugcaaggguagaggguggauacgaagggacagggagacgagugggauuggggugccugaugugacauucaaagaaucaacaaaaagcuaggcugaccuuaguacuguugaagguaucgucuuuauauccucuacaguauccaugauaaauaaaguuuuggaguaaacugagcuacacaacaauagagaaggugaaacuaacuugucgggcagugagagguagccugguccucaguugagcuaaaaaggcuuugaagcccuggggacccugaagagaugguagguaggaccuucgccugcucccaggcaccaggccccugucacuaacugcagucccccauagauuuguggccaucagucauguaagggcaaugccccaagccccccacccccaacauagaugaggcaucacuaacaucucagaccaagacaagaggaaaagaaacgugaccaccauaggaucaagccagaucuccauucuaaugaguugccuaaaggccuggagggcauaagcaauaagcuuuccuucccagacacuccucccugcaaaauguauuuaaccucaggcccacccugagaagugggggcaugauuuuauacauccacuuuccucuaugacaauaaaugccuuacuacuauggacugccucuuuucaucgggauccaccauggggagccauggagaaggccuucgacuauagagccacugucuaguccuguagaaggccuuucugcacucccagccaccacugcccaccaagcccaagcccaagccugcagucaagccaaggacucuccccgugugaccagccauuguuccccuuccccccaccacacacagccagccagcugcucccccacuccauucucagcucuucuggggcucccagcggggccuggauguuggaaagccugagaaccgaccaccccagccucaucacaagcaggcagacccccaaaccagcucccacuguuccaugccucagacugcccgcuuucccaccagcaauguccuggggcuucccuauggcccagcaccagcccugagcuggcaugagguaagugcagucaaacucccuguguccugccuccccaagcugcagagcagacucaagacccacaacccuacacuaacuuuucuuaaguucuagacucuaccauuauuggguuuuuuuuuuucacuuuaguaacuaaaaauuuuugccucuuaaaaaaauuauuuaauuauguauuggguguuggugaaagcacacaauucacaagcaucggucagaggacaacaucuggggucaguucucuccuucuaccauguggggcaucacacuuagcacagguuccuuuacccacuaaaccgucccacauucgcauucuuuguauuauuuuaauacagacaccuugggaaacuugaaaaauuauuccaguuuuauaaaguugaagcaaacaguuuaguuaauaucagaagccgggcaguagugacacacaccuuuaaucccagcacucugaagucagaggcaggaggaugucuguaaguuugaggucagccuggucuacagaacauguuccaggacagccagggcuacacagagaaacccuucuugaaaaacaaaaaaugugggcuggagagauggcucagcaguuaugagcacugauugcucuuccagauauccugaguucaaauccagcaaccacauaguggcucacaaccauccguaaugagaucugacacccucuucuggugugucugaagacagcuacaguguacuuacauauaauaaauaaauaaaucuuugggcuggagcaagcagggagagcggggccugagcaaaaaaaagaaaaacaaaaaacaaaacaaaacaaaaaaaaagcuaaaucagcauucuauaaaaguuacacauaggggcuggagagauggcucagugguuaagagcauugacugcucuuccagagguccugaguucaauucccagcaaccacaugguggcucacaaccauccguaacaagaucuggcgcccucuucuggagugucugaagacagcuaguguacuuacauauaauaaauaauuuaaaaaaaaaaaaaaaaacaaaguuacacuuagaccacuaaaauaaaaagcuaaaugauagugaucuacaugaaaguuuugcuauagugugcauucauagaaauuauuauugcgugcauccagaacgaaacaaaacacuacaauguauaggaaacauuuacacuucucucaggaggcuuagcacagcaaggggugaucuaaucaaaacacuggcccgugacauuucaaaacugcuuuauucuaucagauacuacuuucuaccagauccuuacguagagaaauggaagucagcuccaagggggaaaggaagaaacacuuagaaaaacaacaacaacaacaauaauucccuacuugcgagggaacuuucugaaagccucaccacuagagagcaauaaugaguacgaguuaaaagcgcggcucggcggcucgcgaccugccacguuacuaauucuacuacuacggcuccagaacgaccuuuucucaccagaauguuuuuugguuuuuuucgggcuuguacucuuguccgugacugagaugacuaaaacagaauaagcucguugcgcguaacucggcauuaguaaguccucgaaaaggaagugcucuucuaauuggaguuguucggggcagggccuugaguguggaagugagucuguucagcucggcaaacgcgcauauuuuuguaacccccacaacuuucauguaaggauuuuuuuuuuaaaaaaaaccuuaucucugauggccuaacauucauuggagcuacuacugcugauaugcucuuuaucuggagccuucauggacccuuuauuucaaagaacacagacaaagaauaggcuguagacaaguaaacccacaacaaacuaggccgcagcuccuccaccacaucucuauuuuagccuuagaaggucuuagaguuuaauaucuucuugaagcccaaacugauuacguagccaccgaguuacgaggggcccccgaaggacuuccgucguggacaacaguccucuuucccagcuccaaggcugcagaagucuagggagagauuuccauggcaacacaggccucagcuucgaaauggcggaaggccucccgaaggauaacagagacccucguuuuguuccagauuaugguugcgauccgcaaaccuaccucuuuucaggccucugcaguuccccagaaccucaacucccaccaugacuccauugcugcgcagcccaaacuacaccucccaggcugcucugcgccucucuuccca

SEQ ID NO: 1932 - RNA, 33034 nt, Mus musculus
cagggcgggaauccgcggccuuuacugcggucgugggacacgucgagccgggcaguaguggcgggggcuugguagaaguccguaccggacuaggggauccaguucugagaggaagacuaaggcggcggggcuuacccugugaagguaaggucacuccccuccuuuucccaaacccggcguguucgcuguccuuuucccucccgaacccuggaccccccgcagcucccuuaagcugggcggaaggagaaagagccccggacuagaagucaugggaucugagccgaacaguggcagggaucuuacagcgacauugcuguuaugaccuuagggcagggugcucggugccucaguuuccccaucuacgcaaaggaccgcguguccagugucuccauaugcgcuuuuucaagguuuuaaaucucugaaaucaucgagucugauccgggucucuucguaauaaacugaucugcaggcaagaagacagaagaacuagccacuugggugacuaguccgaggucacacagagugaagagcagaccugguccuuuguaucaggguuuagagagcugaugagugaggaagccuggcccuuaacuagacuguguggcauaggacuugggaaaggacccuguuucuaaaguccagauaagagagguccagaagagcugggauauucgggaggguggaugauggacgagacuuugaagguagaaaguccucaauccaguuuugcugagcugaguuuuguugccaagguuuuaagucaacauugguugucgcugacuuuucugccuccaguuuucgcccacucuguugcaugucuuucuucuauauuucuuugguuagccuguuuuguuuuuguuuuuggguuuuuuuuuuuuuuuuuuugaacgaucuugcuuagccacgcuguggcuaagcagauagugugucccaguguccauuuccacaguucucauuggaguucuuucugguuuucuucccagucagguugauccuguaagugucccuuuccggaauguuuuagucucuucugaugauacuaaagagauuggaagcucucucccagagaacuuuguaccucuuggcacuuccccuguggggcuuuuuauuacaguuuuugaacuacuaacuuguaagucuucuugcccacaguggauucucauuaauuuuuuauuagauugaauaauauaacuuagcuuuguucccuuguuccuuaauuuacucucgguuuuuuuuuucccccgugcgacccaaagagccaagcaguggcucuugucuuuuauagguagcuuccagaaagauaaaaaugcuguacuggcugugaacugucuggguugcuuggucucuuuuguucauugaaggugacuguacuauugucuaaaacuccaggggagggggaaggggaaauaguguaguuagaaauauuauauguuacuuacaauuuuugugaguaaauuauuccuguuuaucugaggauaaggcugcuggccugcuuccuguguuuauuuuacagauuaagaugguuagaacagugaaaucugacugguaaagcagugauacacuggaaucugggugguaggacuggagccuguagcaguagcucuguuuaacuugugaaauugaguggguaggaaugaauggauaaguuuauuccaggaacgcuuucuuuauuuuuauuuucuuucuuuuauuuuuguuuauuuauuuauuuauuuuugagaugaucuauuuauguagcucuggcuguccuaaaacucauuauguagaccaggcuauccuggaaucucacagaauuacaccugccuaugccucuccagugcugggauugaagacuauaucacuauacuggauuuuaacaauucuuuaaaaaaaaaaaaaaagugagcaaaacccaagaaagucucagagcucuuucccugcauucugugggggaggugccucucugguggguguuugaaauguacagguguacaagaaaacgggaacuagccacuugggugacuaguccgaggucacacagaguaaagggcagaccugguccuuuguaucaggguuuagagagcugaugagugaggaagccuggcccuuaccuagacuguguggcauaggacuugggaaaggacccuguuuuuuucuuuauuucuuuucuuuuuuuuuuuuuuuuuuugguuuuucgagacaggguuucucugugugguccuggcuguccuggaacucacucuguagaccaggcuggccucgaacucgaacucggaaaucugccugccucugccucccaagugcugggaucaaaggcaugcaccaccacugcccagcuaggacgcuguuucuuuagguauucaauaacccuaaaacugguguguguggugauugggugaauuucauuagcaacauaagaaagggaaaguuggaaaugggucuuccucagucuuucaggcuuagaauuggaaauauaaaaucaggacccugauaaugcugucucuugugaggcuaugccggggccuagcaaacacagaaguggaugcucacagucagcuauuggauggaucacacggcccccaauggaggagcuagagaaaguacccaaggagcuaaaggggucugcaacccuauagguggaacaacaauaugaacuaaccaguaccccccagagcucguguuucuagcugcauauguagcagaagauggccuagucggccaucacuggaaagagaggcccauuggucuugcaaacuuuauaugccccaguacaggggaacgccagggccaagaagugggaguuggguggggggaggguauaggggacuuuugggauagcauuggaaauguaaaugaagaaaauaccuaauuuaaaaaaaaaaaaaaaaggaaauauaaaaucuggugcaucuggaaagcuagucuuccuggauuaaaauauccagaugacuacuauuggaauuggagucaggagaccugaauuccugucucccagccuugaacucacugaguuugggccaguucccuaaacaccuuaaaaaaggaacagaucauuccccaaaagauuaacuaggaaacagcaaauuuaauaauuccuuucaagucaaguuugcaaaagauaaccuuuauaucaggcaaacugauauuaaucuccuccagugguaaagagauauggauuaaauggagauuaaaaauguuucuguaguauucuauucacucaaguuacuaaaagcagaaauauuauaagacaacuagagaaacuucaccugagagucuacuguguguaaugcuagauuuuguguagguaguaaaugaacccucuaagaaauuacuguagaauaucaaaggaggaaaagaucauaucucuucaguauaaucucagucauuauaauccagggaaacuggauggaaguguuugggguuuuuuuguuuguuuguuuuggggguuuuuuuguuuuuuuguuuuguuuuguuuuuugagacagggucucucuguguagcccuggcuguccuggaacucacucuguagaccuggcuggccucgaacucagaaauccgccugccucugccucccaagugcugggauuaaaggcgugcgccaccacugcccggcugaauugaaguuuuaagauauauaccagugcccuauguaauguuuaccaugccuuaccucaagcaaucugcauaacaccuuguucuagggauuaaacauuuccuuuaucgccucuaaacuagcugaaguguaggguugcauaaacaguuugaagaugaguaggauuccaggaggaagcugggaggucugguuuuccagguugaaagggcagcuuuagcaaacacagguagauucguguuuccaugguaccagugauuggauccaggguuuggcucgugcuuggcaagcauucuaucacugagcuacacacuacuacccuaagggggcuuugcgaauguugucgcgacaaggguuacccuuucaccugcugcgcugacuaugacuggcuaacuaaaguuugcgaaaguauggaacuguacacauuuuccaugucuuacuccaguuuaaaacacaaauauccucuguggguuuguuguuucuaaccuaauaccucaacuuuuacuuggaaugugguucucagagaucaacagacuacccacaaaucucgcugccuguuucugcaguuuuguccgaacacaaccaggcucauuuauuuacguuaucuguggcuaccuuacagugauuccucauucugggaaaaaaaggucugacaccugggccguccaagaggaacccuuacuccuggaaagagguuuaaacuuguuagacacaguuuuuguuuauuacagaagacaauaaugucgagaccauaccuugacuaucacugcuuucaggcccucuacugaaucuuccuucucuucagaauccugaaggcagauucuguguguguaggcagggagggggcuauaacuggauuuuuuuuccccuuuucccaguguggccacauggaauaaaucucuucuuugucaguuaaauuuuuuaggaauucuuuaagauucuuuucugacuguuugagguaauauacacagagaauuaaaaaauaauauuuaaaagcaacccaaagccauauuuauuagaguccaaggugacaaguuuccaguuagaucagcaugaaaugauuuauacucuacaugacacaauuaauauuuuuggcugguugguuugauuuucagacagggucucaguguguguccccggcuauccuggagcuaugacaaccaggcuugccuucaagucacagagguccaccugccucugccuuucuagugcugggauuagaugcaagacaugauuaacauuuuaaaaaucugguuaguuuaggagucuguaaaggaaaaguuugccuuucuuggguagguagccccuuuuuuccuaguaauccuagaacguggggucaugcagacugguugaggugagguaaggcaugguaaacacuacuuagugcaaugauaguaaucuuaaaagcuucaauccauuucccuuuggauuguaaucucaauuucgaguugagcaaaacaaagauuccagacuguaaauaaacugaaaugaguugugaagguaauaauuaaguaugagaagucucugaucccuagcuggaaugguggccuguaaucccagcacuggggagaggaggaauucaagaucagagagggcaaguagauaacaagguuguggccagccucugugugcgugcgagcguguguguguguguguguguguguguguguguguguguguguguguuuuguaucuugaauguuucugcucuucaggucauucuuuugcccucuuguuucuaacuuucuaaguugaaauguuuauagugacaagauuucaacugaugucaaguaaaucacccagaaaacucugccuuuuaaauuugccaggcaagcuugacugggcagggaguagggcaauaggacguuggguucucaugccuauacucccacauucagcucuuagcacaaaaaagccaucuuuaaaacaggucuccuagucuuuuuaacuagguaugaagucuuauacuugauacauuacaauauuaaguacacacacacaccuuacugagaagaaaauucuuuugaaguuccauggcuuugaguuguaucauuuuaugauuuagguaacauccccacacagaggaggggcccauccuuaggaaugcaaaccccgccgagaaggaagggguugagaaggguccacccuaccuccuuuccuuuacacaauggccccagguuuuguacacaaccugcuuuuguaggcugaggacauuaugcaaugcagcaugagauggaagucugccucucaaaaguaaacuuggaaaaauggcuugagagcaaaacauuagcagcacauuaauaauggaccuuuucuagccuugcugagcucuuccgauugguucuugguaaagaacuauuuggaucgaucuaauuuucaagcaguucagagcaguagaaugcagccauuuaguuucuuuuggcuucugaaauaaaaggggaaggcuguuaacucucuguaccuguagucucuuagcuguuucugcuuuuuagaggucucaccauguagaccaggcugaccuggaacucacagauucaccugccucugccccucugccucucugccucucugccucucugccccucugccucucugccucucugccccucugccucugccccucugccucucugccucucugccucucugccucugccucccaggcauugcagcuaagaucggaaccagcauccaggagcaauuuuuuguuuucauuuguucucuuacugcacuuugauaaugucaucuuuuguuaauuagugguuugauggaacaucaguucuuauuauguauuuaauugcaguuuucuacugaauaaaaagcacaauucaacuguuuucuaauuucuguuucauaccauauacuggacacauccauugaaauccucuguaacuaaagaacagauuaaacaaugaaggaccuuggguuguagcaaguacagucugccuuugacuacagcaagcaaguaguugaagaaaugcuuugccccugcauguaucugaguagcuaguauucuuuaaaucaaaugaccaaaagcuauauacuuugggaagaggaagcaggaaaaucaggaauuuaggguuuccucagcuacacaguaaguucaaggccagccuaagcuauuuauuuauuuuuguaugcagguauggguauaggcaugcauauguguagagaucaaaguacaacuuugucgagucguuucuuuccuuucaccuuuauuggguuccgggaaucgaacucaggucuccagguuugcucaacaaaugcuuuacccacugagccaucucacugguguuuuguuuuguuuuccuuaaugucacauagcuaauauguggcaaucuucagucugugaagcauaaugcagucuuggcuccacucugauacuauauguaaaccauucugaaaucuuuacauaacuaauacuugaaauaguucuaauuacgugacuaaaaccacacccagacugcaguggagcaguaagagaaggaagaaagcggucaugucgugcuugcuugguuccgggauguggcuuaaccacaacaaaaaguagcagagacuuggaguacaguguccaggagauccacuccccaguggacuugagaccuucugccauugcauaacuaaagaaccuuucaguuuguuugucguaucgaauuugaguuguguauggggaacagacaaaggcuuucuaaagcccuuugcgaagaauguauuucuauaccugaucuccuuuguguggaaaggugagagugggccaaaggaaagagccucuguagugcuuacugccaaagcaggauacgugggcucagaaaccccuccugcuuagccaccucccagcaacccaucuggagacauggagggcagagcuuagagucccuucacagaagcaaauguaaaguuggcuaggaagaauguuaaugucauucucuaauagcaugugccuugguuuccccauauggaaaauaaaggaauugggcugaucauuuaauuuuucaaguuguaaacuuguguauauacuuuuccccuuuaaaauauguuuauaaaucaucguaugauguguucugcuccuccucccaagcucauacuaugucuggaaggucauccuauaaaggugugcagacauuccuuacucuuuuuuuuuuuuaaagauuuauuuauuuauuauauguaaguacacuguagcugucuucagacacaccagaagagggugucagaucuccuuacggaugguugugagccaccaugugguugcugggacuugaacacuggaccuuuggaagagcagucggguacucuuacccauugagccaucacaccagccccauuccuuacccuuaaauggcuguagaguauucaguuuccugggaauaugauagcuaauuuaaucagugaacacuuggguuguacuuucaguguuuugguguuucagacaguucuauagugcauaccuuuguacauaugauaguuuacauauuugccuguaggauaaauauuuugagcuguuucgaggugucagggaauauaugcaggaaacugauaacugaagacugacuuaugguuuguaggguuuuaaucgccagugcucgaugaaagaaagggaaaacuguuugaaaccuguugacaucuauuauuuagagaccaggucuucaguggggaccuuguauaggucauuuugucagccaugaaagcacagaugcugccaucuauucugccauccucagcagcacaagaaauucucugaaacauauagcaacacuaaagguacuuuaauauaggcucaaauacaaagauuaagagaaagacagacagauguacuuaagccucccaaauggagggagagacagcaagauggacccaaguacgggugugggcuuccucaagagaauauguaaccaucugucuagauuagcccuaucucauuuuggcgauucagucuuuaaaaaguugcuuagaaccuuguuuucuuuucucuuuugauaaguuagguggcucugcagaggccuugaacaggcuuaggagcugauaaagaagaacuaggagccacuaguauugcacaaggggauuguuuagcacgugucccuuuccuguaaaugggauuucugcagagaaucacaaacuaggacugugucacaguccuagacauuuucuaauguuuuucaauaugacauuucccuaagagcucauuuacaaggugacugacuauauucuaaacguagaaaaaugaaccaugucccaggcauacuuaccuuacuaacauauaggaacauucgcucuuuacaacaaugcauggagggauggagacuauaaauagcacuaugccgauguguuuuccccucuucucagauguuguaauaauuaugagauaacuuuguuguaauguguggcugguaacugucugaagugugugacaccuucacagcugugucuuuuugaguugagagacuauaaagcaggucagaagugucagccaauaacaacuuuuucuucauaauaauaauaauaauaauuuuuauuuugagucaaggucucuugugacuaggcuggccucaaauuccuuaaguaggugaagaacagccuugagcuuuugauccucuuaccuccaccuccggggucuuagcaguagaggcacguauguccccacguccaguuucuucccccaugcuucccuaagccuaaccuucucuucccuccuuccucaccccuucauucagcugcucaggcgccaaggcauuucugaaauuugcugugugcuuuugcagcuuuaagcuagagccuccugucauuucucuguggauuuucuguggccccugggacagaggguaccaaaucaaguaauccagcuugcugccuuuccagguuccugccuguccuuuucuccguacagcuuuguugccuuucaacuccucgucucuguauauuccagagaaaagacuaaagacgagcagcuaccuugagcucugugugaguguguguaugucacagucaugcaugcaaaugccuuucugguuuccauugucacucuugguugaaaauuuggagcacugugcacacacaguggacacagcauauggaguauauggaacacguacccuuucauucccauaaagcucacuuuuugaaaccauaaaacucuaaauaaggagauaacuuugguuuugguuucauuuuuguuuguuuggguggguuugguuugguuugguuuggguuuuuguuguuauugugguuuuggugguuguuguuguuguuguuuugagauagauucucucuauuauguagcucagacugaccuggaacuaaguuuguagaccaggcuggccuaaaacucacagaguuccuaaaugcugagauaaagguguacacuuaucacaucugacaacuaugaacucuuacagucaccaagauauacaauacaguaaaaagauacaauuugauuaguauagacuuuuugaauuuuagaauaaaauucacauguugaccagucucuaagcauucauagucuuucuguggaauggcuccaaugaacucugaggggcaagcaccaaccaggccaacuguugaacuaccaguccuagaaaugagaggacagaauuguaagcuagcacauggcuucccuggguacgccuacuaaagguucucagucuuccagggagaguugcuguugggugauugaaggcccacgggccacauuuuccugauuagcuaaucugucagaggcucagaaaaaaagacuuuccuuguuaugacuucaacaauaucaucuuguaccucugaucuauuccuguuccuaaacuugaaugcagaaaagauaaaacggacaagaauacuguauuaucuauguauauacacuguaguauaaucacauuccaucucaagauggcauuuugaacuuucaucuuucccuucccaaaauccuagugaaauuacuauaaauauauacagacagauaagauauauuuaaauaauguuuuaaagauuuuauuuauuuuaaguguaugagugacuacacuguagcugucuucagacacaccagaagaggacaucagaucccuuuacagaugguugugagcuaccaugugguugcugggaauugaacucaggaccucuggaagagcaaucaguacucuuagccacugagccaucucucuagccugauagauauuuaaagauagguaauuaugcuggaaggugguggcacaugccuuuaaucccagcagaggcagguagaucucugugaguuuuagacagccuggucuucagagugaguccuaggagagccagggcuacugucuggaaaaagaaaaaaaaauuauaagaaaaaaagcaucuuuuguagucagaaagcaagcagaagugguaacuuugaaacauuguagggaaaauaaggugcagcagggaacuaggaaaaugccugagcaccagauagacaugggcaaaggguagguaucccugccucugaaagguuggggaucacacuccugaaaccccagcugagaaggauggagacuggaaagaaggggggguggcccuggaauuuguaacugucauuguagaguagcagcuuaggaagggugaaguacugcacacuuuuaauuccaguugaucucagagaguucaaauccauccuggucuacauagugauuuccaggcuugcagguuagcagauaggccugccugaguguuaccugauagcauucuuagcccuucaguugguagcaaauaggauuuugugaaguaaauacaaagguuuucaucugcuuaucaggguguuaguucugauuacugagcuggcaagaauagcucuuugagaggucaagacaacccaaaagaaacccuaauuaagcuauggggucagcgguauccgagacucuucauuauuuuuuauuuuuagcagucagucagccucuacagacaccuucuuuccaggaauucucugagaaccaguuuuaucuccagaacucacauugauggaggaagaaaacuacuuccuucuacuccaaccucuggaguucugggauuaaagaccuacagacaaauaguagcuaaauagauguaacuuguaagaggguuguuugcuuugguuuuuuuguuugguuugguuucuucuuuauuauuucuaagacaggguucuuaacucagagaucugcuugccuuagugcugggauuaaaggcaugugccaucaccaccuccucccagucuuuuuuaaagaagaaauaguuugggaggguuagggggcaggguugggggcaggauuuguuguuacuugcuuuugaggcuguuucuuccuuugucccucuggcugaccucuagcucucagcgauccuccugcuugugccucccagggcugagguuuaagggaugcacaugacaccugacaauguaaugacucugaauguuccuggaggacuuacuggauucuggcacugugcuugaauguuuacauccacuuugucuugaugcagaugcuguugcuucuucucuguuuuacuuauuugauugucugaggcaaugucucacucaguguuuagcccaggcuauccguguagcccuccuggcucagccuuauggaugcaggcuggaauuacagccaugauccaccacacccagcuuugucaccccuauuagugggaauuagccucuucucuugugcugcuaccgcaguggagucuugauaauaucucuuacagcaauccucugagauaaauuacucuauuuuccuugucuagcuaaggcacaaagcuaguacguaauuugcccuugggcacacagccauuaaguaccaccucaccauccuacccacuggaaagugaauacaggucacuuaaaaaauugcagaauugcuauaacuaaaaaggaaaagugucucuuuccugugcauagcuuccuuguuuuuaaaaccggaaaggcaaaacuccagaaaguaugcgauuuggggccaguaagggaugguuuaggguagacgcacguggcaacagguuucuuugccugcugaacuaucucacgggcccaucugaagaguagcucaauguauuauacuugucucacaaccacagaacagagacugaauggaguuagagauuacugugaccugucauuuggaugcuagaaagaacagcaaguguucuuaaccguugaaccaucucuccaccccuugcuucuuuugguugguugguugguugguugguugguugguugguuuuugagacaaggucucacuagguagacuagguagacccugaacuuaccauguagcccaaguuagccugcaccucauaauccugccuccuuaacucccuggguuuauacucagcaguguuacugguaauucugauccaaguagucuuuggacuuugagaagcacccgaguuaggaagaaagugauuagcauuuauuauuuauuguguauguuauuaggguagcaguugcuuucauguauacauuuacguuugauuuuuaugauguugugacguuauuaucccaguuuuauguguucguauaugaguuccugucugaguuccaguguugagcggugcaccuggucagcagcccaucuuggaggcagucuccacuuuggcgaaaugccucucagaggagaugcuuaucugagagugaacugccaagugcagaugaucugugugugugauaaguaagugcuagagccucggaaaggucggaauguugaaagcauaucaacucugaggcauucagaaaggcaaguguguguuugcuuuauggaaacugcuguccacaucugaacuuuuaaacugaauagguacuaaagauaaauuauucuguccuuugacuaagagaacuauaaaagguuaaauugcucaauguauaaggaaaauaaucagggcuagaacuaaaauuucuaauuguaauuaucauaaagguucagguggccuuaaacucauguugccugggaauuauguagagaagugugaagucuaugagugggaauuauuuucuagcugugugagagaggcuaaggaugcuauuaaacauccuguaacguggcaguuuguaauaaaggauugucuagcuuaaaaugucagugauacugagacuaagacguguuuuacacaaaauaauucugcauggugagguuggaacaagcauccaacuugugaacucagucuuccauguuguccguugucuuuaaagcaggauauuaaaaacuggagcucccuacuccuagccacugacacuguggggggagguacaagugaagccugagugaggucuguguuacuguagaaagcguucugguguaacagaguuaugagguccagugagauaagcacuugcuguuuuuauauucugcugcguguucuuccuggaacuuagucuaccuguguuuuauuuguuugcuugacuggcuggcuggcuggcugacaacagauuugaaugguuucuccaagugcuuugaauuuagcacaacuucugaacaugguacuuacugcaguccuaaagaccauggacuguuuaaagaauuauuccaggagccagaaaugaacagagccagaauuugaaugcuguauaacuccaugcuugugucucucccggcuuacuacuugugaagaacgaacucccaguuacccuucagauacaauguauagacuccugacugauaaacucuuaaguccuuuaacugauacuuuuuaacucuuuccccaagagcaaggucugaacaaaggaacagccacuucaaucucauuaaccucuucucucccugacuguguuguugaccuuggaugcccugggugcuucucuugccucggugggacacuuuccugcccauauaccaagcucuaauaauauagcaguucuuaaaugccaccucuguaaaggcuccucauguuaucauccucccugccccauucuauccaauuuuguuccuuccugggucuuccauuuacagauguuuuccccuucauccacuuaucauaaauuguguauaacuacacauauuuauuugcuucuauaguuaaugaggguuuucucccuuaggggagcuccccaaaagcaaauagguugucauuuuuaucuaauuccauguaaauggauauuagaaucuaccuggguuuuauaggaauuaauaaauacuuuugcuuugugcagaggggaagacucuuauguagcauaggcucgccuaaaacucacuguguacugaagauaauuugaacuucugguccucuguucuuacauccuaaacacuaggaauacagacaugcaccaccaugcccuguuuauguggugcugcugggguggagcccaggguuuccuacugcuggcaagcccucaaccaaaugggugagcuucauacacagccccgcagaucccuuugaaagacugcugguagauguucuuccagaggcuggaagguaggaauuaggaaguuucuuguccucaaggaacuuagggaauaugugugauauuuccaucuuguauguuaagaacuauugguuaaauguuucauaaguagcaaaguccaaaaaaauggauuucuuuaguuagaaauacaaggcaacccucaucaaagggauacccuaguuccacagagagaacuagagugcacacucaacagaaguuaugggcucugauuuauucucaguuugggugcuguguguguucugcacaauaaguguaaauaggaacaggauuuggaccuauggagauacggggggaaaggaguuucaagagggcauagucaggaaaaaaaaaguuucaaagugcuaaaaucauucagaaaagcuaagaucugucuuagugaaacacauccauguggagagaauuagaauggggagaggggagggaggaagggagauucccaugugaagaggauuacacugagauaugaagagagugagacagacacagagugaacaaagagucaggugaaaucaguguaccaugagggaaauagucccucauacugcagccuagaaagcaguucacagcuugagacacaccugcacuugagauacuaguuuaaccugggcugcugguucuuagaccaacaccaucaccaucaaauagcacgauucaaaucacuguggagcaucuucuguauuuggcuuggcuggaagaguucgcuuauauuucuggaauggagcaauacaugacauguccccacagguguuggagcaguuacuaaaaauuacuauauuuacagauugguccaugcuguaacuuuucuaagguuuuuccaguuauuuguuucuuugggguccuacuuucuugaaaccaggcuucuuuccuuagccucucauaauaauaauaauaauaauaauaauaacuauuauaauuaugcccaaagguggcaacagaaguguuuugaaauauuuguaguugugagaagaaauuuuggaguaaugccuccagucaacuguuucuucugccuucucucuacaccauucuguuagcacgcugacagaagaaauaagcacagauugaaaaggucaugaagccaggcagugguggcgcacgccuuuaaucccagcacuugggaggcagagacaggcggauuucugaguuccaggccagccuggucuacggcuauacagagaaacccugucucaaaaaaccaaaaaaaaaaaaaaaaaaaaaaaaaaaaaaagaaaagaaaagaaaagaucaugaagacaguuuagggauuuguugccaccuagccccaguuagacuuacagaaaaagguucauguuuuacagauguguaguagaugcuggaagcuagggaggacuuguuucacaaagacauuggaaagauggacauuugaggcuggagcacaagagugauugauguaggcacaaagguggcaacagagcugucaauaaugaaacccccaaggccagccagaaggugggaaaaucuaugguuccuggccgagggccucacucucuaguacaggagaguauaugaguaggccacugaggcccucugcaccucgcuucuuccagccuuuuuguuuuguuuuguuuucugagacagggcuucucuguguuacagagcccuggcuauccuggacuccgcuuuauagaccagacuggucucgaacucaaaaagaucugccugucuccacauccugaguguugggaggcaugcaugcaccaucaugcccagccccagaaaagacuuuuuaacaugcuguuuguuucauguucuaugcaauuauuuauuuaguaaauguacagaguaaauguacuuuaaguugaucuaaccugacaguucuuggauuuccucuguuguacauuuguguguuguuugucaagguuuagggccuucaaggcucaguuccuaggaucugggcuggcauuucaguccacuugaacuuuuuuucuuuaaagauuuguuuauuauauuuauaggaguacaccguagcuguuuuuagacauaccauaagagggcaucagauccuauuacagaugguugugagccaccaugugguuguugggaauugaacucggagccuuuggaagagcagucagugcucuuaauggcugagcuaucuuuccagcccccacuugaacuuuuagaaacaaguaagaauuuuauuaucagccucucuccucacauuugucaaucaaaauaaacauuuuuuaaaagccaucuaucuguaaaggcaaaccaguuaggccagaaauauaaauauucaaauuuguaugucaacauguagacuucugugaaauaaauaguugaagugagauuaauucauccaacucuuuuuuuuuucuuuuuuuuuuuguuuuugggggguuuugguuguuguuguuguuuguuuguuuguuuguuguuuuucgagacaggguuucucuguauaacucuggcuguccuggaacucacuuuguagcccaggcuggccuggaacucagaaauccuccugccucuaauucauccaacucuuaaaagcuuaccuugcaggcuggagaauguaguuucgugauaagaguucacacaagcuuugaguucagucccaccaccacaaaaauaauaauaauaauaauaauaauaaugaugaugaugaugacuaguccuaccugaaagguccccuuuccuauauuuacuugggucuguaggacauggaaagguaaguaaauaaaguggggugaucccugacauaaguccauagugaggaugauagaggcaaucuguucgacuagauacaagcagaaauguugagugaaguuuuaguuuuggguagggcuccacuaauaacauacugucuuauuuuuauaguuaaggaaaauagagcucuaaaguacaaaacaauuuucacaguaaaguaauuaucaugucucauguuuaaacuaguuauggcuucuuuucucaccuuuguugcuuauucauucauguuugaacccaagagacacaagugauguagggacuggacaaugggcgucagcaccauuugacauuagcaugcuuucucugauaaaugguggcccuuagucgcuaugcagggccucaugcagucaggcccccagcaucugucuugccccaacagguuuccuauucaugcuuguucagucugaacagcuuaauaagguggagugaugugggcugaugaaacucaugacacgagaaggugaccuucaacuaauagcuggaaacagagugcuuuuuugucuuuuucugauuacaaucagaucacagguuugcucucuacuauggacagaauuagauuuggagucucagggcagcugaauuacuguccugcugaauauauauuccuagccaagagccuccaggaggaagagccacuaauugauagcugcuguuuuaugauuuuaaaaacuugucaauccaugcagcauuucuuguuugccuagauuauuggccacucucauaaacgaaagcucuuaagucuaauuguuugaaguaguuuuccccuuuaugugucuggugguugguuccuuuugaugcagccugggagccuaauguaugaguaauucaacggcaagaauucugcugcugccugaauguguacaaugggccagccugguccccaccccccuuuccccaaaagugcuuuuggggacuacaggaacuaucucaaguaaugcuuacugugacaucuggugaagaaagaaaaacuaacauaaugagagugaucgcugaaagucuucaaagauucacuaaaucaguuguuagcccaaccuaaccagugcugugaagagaagcaggugagaauuuauagaugauuccuuuuugagcaaaauguuagagagucaaacugaagcauuguuucacuuggacuugggaugggggaaucucacuauguagcccuggcuaugccccccaagugcugggauuaaaggcagaaacaucaggaccagcucauuggggaacuuuuuaaaauguauaaagcuugagggaggggugugugugaagauggggagauugauuuucauaaagccaucaagacauuuugaaguuuagccauaggaaagcggccuguagucauccucagagguggacuaugagagagaucaauccuucauacaaggaaguuuugaaaguuacuugacacagagucuggccaguacgaagacuaucuacucgccugacacaggucauuagaggguggugucagugcggcugaacugcuuacuuggccauauggacauaguccauagcacgagucccuguuuacugugcuuuaauggguuugaccuugacuuucuccugucuuuuuuuuuuuuuuuuuuuuuuuuuuuuuuuuuuuuuuugccaaaagcaggaaagcugauugucugguuuguguuuguaccaauguaaaaggaaacuuaacccuuaugguuuuaagaauaaaagccuucuuaaucccccuuaucaccaaaguugggaaagaccuaggcagucucuagaaguccaagacucuagauuacaucugccugggcucgaaggagggccugccugccugccagacugacuacuuccuuauugccuuuugugggucuauuccaucaucccaagggaguauuucucuccuuugguuauggaauaccaggaaaauaaaagaaugugaagccuagagcucaccuguuagaaauacagcgggugccgagacucgcaguacaucaggauuuagaaauacagugggugcugagacucacaguacaucaggauuuagaaauacagugggugcugagacucacaguacaucaggauuuagaaauacagugggugcugagacucgcaguacaucaggguuuagaaauacagugggugcugagacucacaguacaucaggauuuagaaauacagugggugcugagacucgcaguacaucaggauuuagcuuucuugcugauguccuggcuucuguccacaaauucauuguucuuuugcuagagauucuaggacuuccgaagucuagcuuucuaaguauuuucuuuuccuuggcuuuguuuagcuuuuugagacugggucuccuuauguagccuaggcugaccugaaacuuguaaccugcuucccacaugcugagcuugcaggucuguaccaugaccugccucagccugccucaagugggucucuuagguaugaggggaggggagacugcuuuuucugguaguucuuagggguagacugaacgcauuauaauagaaagaaagcgguuuguaugaaugcacaugcuuaggugcaggacaagacaacacagaaagaacagcaggcuccccaauguucagugcaguuuucuccaccugaugggaucugucaagggcagaaccaaggucagucaccucuaaagauaagaugcucaugagaagcugaguagaaagcagaugucuuagcuguuguauggacuagguuccuuaaaaucugcaugguuuuguuuuguuuuuaucaguucuuagacuguuuuauauuuccauuaaaaauacaaguugucuacacuaggcuuaggaacuuccacaugccugccguuuaguuccuucacugcauuuuccaaaucaaaggggauuuucuaauuagggucccacuugaauucuauuaaagaaacacuagcuuaaucugagugggcaacaauguaaauaaaaguacaauaucucugcucucuuuaccugcuuauaagaagcccaguaacauaacaauauugcaaauggguuuuuaucagauuggaaguuaagagucaaggguuuuguuuguuuuucaguucuaucuauguuuugcuaguucuucuuuauaaauaauguguaaccccgaugaaaugacugcagauaaggggcaaagggacaguugaguuuuacugugaauugccauauacccauagaguguccaaacagaaacccauugaauaauugcuuuauugcagagauuuuaaguuccgccucuuacucaucacugcucaauccacuaauuacuuuuuaacggagaacucgauuccauaaaauguacaccggcuacuuuguggaccuugaaucggguucuuagaaagagguuguaaggguggaguuagauuacagaaaauaguucuuagagagcaaguugccaugaaguuugagaagcaagaauaagucaaacagaaaagcucuggguuacuaugagguugaaccauucagauugugaacuaagccaguccgaugggccuuuggguucugacuaauucauuauucuggcaguauccauuuuuguucuagaaugaacuaaguuugggucaacuuaaagcuaucacuagaaaaccagccaacaauacuaauuuuccuucuaugaauagaauuucuguuguacagggaauggguuaaguauguuugagaugcauguguccaauuugauugauugauagauagauaauagagugucgguuauccagacacauggcacauuacugaaaagcucaauuggcagaaaaaaaauauagacuagcauuuacuuauuaugaucuaaaauuugagaggauuagagagauagcucagugguuaaaaucacuggcugcucuugcagaggacccaaguuugauucccaguacccacacaguagcucauauccaucuaucaacagcuccucuuccggaggaucugaugcucucucugaccuuugcugugaccagacgcacacuuagugaacagacacguacacaaggcaaaaaaaccguacaauaaaagcaaauaaagauacaaaauuagauagauagauagauagauagauggauggauggauggauggauggauggauggauggauagauagauggauagauggauagguagauggauggauagguagauagauggauagauaaguaaauugccaugcugcugauugaucacagggccuugugcugggcaagugcucagccacugagcuauaacuccagcccuuauuuacuauguuuucauaaauaauuucuaaguucuucccgcuaugcauuaauauuauauauuguauaauuuauauaaauuugguuugacauaauucuguuggaucuuuccuaaucucagacucagagcccucacacaugcuaagcaaaugaugucucacugagcuaccauccucagaguaagcuuagugaacacaaggacuucaaguugcaguuugagcuucacuguugauuucugcccaucuguaucgcccuauucagacaccacuggguaagccuugaagaaggcucccauuacagaaguccauuguccacacaagaaaaacaagcagauugucuuccugcucucuucccugguguguuugaauguagaaugcacccuacacacacaaugcugcagagcaggugcacaguugaaagcuucucuuaagcuuugaacguaugaauguaugaauuccugggccacugggcugucugaagaguuuuugauaguuuaccauugaauagaucucucuaguuggaacauggcucuuaaacaaaagagaacaggucuucaacuauuauuacuaaaagcaguguuggcagaguuugaagaaaucaaggguacauauggggcucgaguagcuuguauugcuguuccugcuuuuaaagaguacgucgugaggugugugcucaacuucuccaacucuuucgucucuaaggaaagacugucugguucauuucuuuaucucucucggccucauagaaauaauagcacccaauaaaauguucacugccucuccaugaccuggauuccuguugauaacauggaaugaaauuaucuuugguacuuuucuguuaucgcuuccagccuuauacuggaagaaaauaaaauuuguaacuucuguuugugagccuuuauuagucauucuggaaccuuuuaucuugaugccauuucauuuauuugguucagaaucauaagucauaaccaauaaucccaccauuccuuuuuaaaggaaaauugcugacugcuggcccaugacuuguggacucacuauuauauuuuguuacuuaguguuuauuauaaaauuuucaugaacaaagccacuuaauaccauaacaaugguguuaaggggaaaagauacauugucaacucuauaaugauaagugaggucuagcaugaccauuacuggaguugaaaguggaacuugccugugugacagaacugugccuguuuuguaagccugcuaacauagaguccuggguaggaauugagaggggaggcugcaccuuugugcucuggaguuggacacgugguuuccugggugugaaagcucuggcugaggagcaucuccguacagcucagcaaugucacgcugcccugccucuccuccguagugcugcuuccaucacgagauuauccuguucaccucacugcuucucuccuuaucggcuacuuugcuuuaccugcuguggauugcugguacuuagcucugacuuuggcccuugcuaggagcuugauugaugaguaaucaaaagcauacacagacucgaguccauggauaccuaauugaaauuuuuuuacuguuuugagacaaggucagugucaccuacgauugccucaaacucagaaucugucucccucaaacuucugagugcuaugguuacagguguacaccaccaugcccuguuccuauuuugaauuucuucuacauacuggaguuguggaacacauagagagauuucaggagguagacagaugguucagagguuaagcaaacuuguuaguuggcucagagguuaaacaaacuuggugguuggcucagagguugaacaaacuugcugguuuugcagaaggcccaggcuccauucucagcacucuucaugguggcucacauguaucuguaacuccaguuccagggcauccagcauccucuuuuggccuccaugggcacugcacacaaaugauacacauucauacaugcaggcagaauacucauacacauacaauaaauaaaauuuagaaagaaaaaaaaaaaaacaggcuuuuaguggaggugggggacacaccugagaggcugaguuugaggcuagccuggucuacagagcaaguuccaggucagccagggcuacacagaaaaaccuugucuugaaaaaccaaaaaaagaaagacagauuuuuaugaaaaucucccucugcacauauaguccaacuccccaguccccagccuccacagcaaccaugggaguuacugccccuugacccauuuagaccucuguagaaaagcauuaacgugaugcaaagauacaaggcugaauaugcacuguccaaaccuaauuuaauauauucauccaauuuauaccuuguuuuucauguucuuaacucuaauguccuggugcgucugaaacugucucugaggucugggcacgcucuuugccuacggcagcaacagaccuuucuccagauuuaaaugagcucuaaguugauuguccucuaagccuaaguggaaucugaacauccugguuaaacacagccaccccaauuagaagacguaucugaagccuuggcuuuuaucuacugcuguuuaugauuaaacagccuuagagcaauugcauuuuguuaguggcuuauacuuauacauuauuacaaauuaucuauuuccugccaucugaaggggcuggguuuuucuaccuuaaauuaaacacacacuuaaucugugucuuagaggaguaacugcagauuaaggaacgagaucucaagccuucaggacaagcccuugguccuucuucucaaaggugauucuuaguccaaguugcugugcgucuaggagagcuuuuguucauuugggcaaaauucuguguagacaaaguauuuaucaagaaaauucuauguuguuuuucuugaaagacuuuuccacugaaucucaucuuuuucuggaaaacuggcaaugaaccauauggggaugaaccauauggagaugcaccaccauauggguaugaaccacacggacgacaacauuaccaugccaccucaccaccacccgaccaccucagccucacacucccacgguggaggggacagcaugaugaugaugguaagagucacacacucggggguuacccaagagggaaaccacagcacgcacacacacauacacccagugagucuagagacuuaccagcguucauguggcaggcuuguuacagagugacaccaaacccaacauuuucuacaauccuuucuucccuaauccuuuugaaauucaccuuuuccugaauuaaauccuaguguuugguuugugauacguguacaaaagagaaagacaugagauugggggcggggcggggggggggggagggaugcacucuuagugccaaggugguaaagccucccacugcuuugaguacuucuaauccugagguuaccuuuaacuguuugcagacucuuagaucauucccauuaggguccucagccuucucuaacugacuuguuugguuuucuggcagccuaugaccuucuacuuugacuuuaagaaugugaaucuauuguuuuccgguuugguaaucaauacaccuggaggugaguaaccaucagauaaccuucgaagaugacaaugucaugagagaugaugauguagauuuagaaaccuggcaccucucuguuccgucacugggucuguaugguugugcuacauaacaucacaauuccuagacccuaggcagaagaggcaacacaguuuugcuccuccagugagcuuccuuuauguauaugguuuggagcacuaauauauaauuaaaaugccagauaaagaucuuuuucaauucuuuucuuguuugcuaaguuacugauccuaggccuaagacuauauaauuaaaaugccagauaaagaucuuuuuucuuuuuuuggggguggggugggggguuaguugguuuuuuguuguuguuggguuuuuuuggguuuuuuggggggggguuguuguuuuugguuuuuuuuuuucugagacaggguuucucuguguagcccuggcuggccuagaacucacucuguagaucaggcuagccucaaacucagaaauccgccugccucugccuuccaagugcugggauuaaaggugugugacaccauugcuaagcuccagauaaagaucuuuuucaauccuuuucuuguuuguuaaauuauugauccuaggccuaagacuauaagcauacucaaauaucacaguauaacccaagguuaaaaacugagaggcagaggcaggaagaucuuugugaguucaaggccagcucauagagaguucaggcauagaugcugccuccaaaaacaauaguguuaaucucauaacuaccuguuuacagauaaaccuaagccucguguaguagaaauguuguucccugaaucacacaguuaguaucucagagcuaaaaccaggaccauacuuucuagaacucucuaaaccagugcucucucugcugcaucaaaugaugguuuccauaucccugaugcuuggcauaucauggagccucacuuccuuuuaagguagcugucauuuaucuuucuguaucuaucauagauugguaugcuuuacauuuaaacugcaguugcaugaguuuaauaggcaccuaaacugcauuagguaccaaacuuauuuuggaaauaaccuaguuugcuuuugggaguggaagagaaagcguuaguccuguuaguguaucauauaaauacacuauaaauacauuuaucuuaucaaugcuuagcuauauaugcauaaucccuuaaaaugccuauucaaaauauagaggcagcacuuguaaaagcagguuguuuuagcugaugugauagugugcaccuuuaaucccauugcucaggaggccaagaucaaccugggcuacacaacaaaguccuguuaaacaauaagacaacaguuggcuguuccuucuuucaguauucuguauauaaucagaaaguaugauccugagcagaggcagagacuguuguuaauggcucagcuccacugaguggguagaaacacaaccaugcaguuuauucacaaacugagccugaugcuuuuucuguuugguuugguuugaguuaugccuugccauguagcacaggcuaauuguguacuugucauuuucugccccagccuccugagcacuggaaucauaggccagugccaaugugaccgaccagcaguaugcucacuaaguuuugacuguaccgucaccucuuccuucuuuucucucuuccuccccuccccuuucccguccuguccuuuuuuccucagaaauggcuggagccuucguggcaguguuuuuacuagcaauguuuuaugaaggacucaagauagcccgagagggucugcuucgaaagucucaagucagcauucgcuacaauuccaugccugucccaggaccaaauggaaccauccuaauggagacacacaaaacuguuggguaagaagaugcaacagauccaaagggaaauucuagagaucucuuaguaauguaguaaggcaggccuucuucuuccggaguuggugauucuaacuuuagaaguuccagguugugggcuaugguauuugggauccugcaaaagcacauacacguuuguucuauguuguaagugucacucugaaagaaguuuaacaguaucugguuuuuaaaauauuugcuauguaguaaugggcauuuuaagauauaguuaagauauaaaagaauggcagaaugcgauugauuccuuccugucgaguuaaaucuaaucagauaugauggaugccgguagucccagcacuuggagaaggcuggaggaccagaauucaaggcuauccuuggcuacacagugaauuugagaccagcuugggcucaugagacccugucucaaggaaaaaucaaaaguucuuuacagaugugugcgugcgggcgucaguuuccaggauagccgugcugcaguccaguuaggcuguucuccugagcugcaggugcccaggucugacucuccuucucugcuuauccccaggcagcagaugcugagcuucccccaccuccugcagacagugcugcacaucauccagguagucaucagcuacuuccucaugcucaucuucaugaccuacaauggguaccuaugcauugcaguagcagcaggggcugggacgggauacuuucucuucagcuggaagaaggcaguggugguggacaucacagagcacugccauugauaucagacuccacauauggccuuauuaauugcuguaggaagcaucuugggacuggaagauaugauucccuuuccaaucaucccuucucucuccugucuauacauacacaccuacugaauagaagccuagcugacagucucugaauagugguuuuucuaauaagaugagauuuuuuucucuugggaagucaccugugagaugucuucucccucaucauccugagccuuaucuaauccagguagcuuccuaguuaaagacuugguuaucugcuucuuuuuacuucuccagguuuugauuuguuuuguuuuguuuuauuugcggggggagugggauacauuuuguuuuaaacagauauguguauuugauaggugggauucugggucagugauaaaaaaggauuguaacaggauugauggcacuuagggacaucucauccaaccgggacuuaaauuucacacuagaaaugagcuccagucuuaacucagugaaugggaaacacauguuccucucuccagguuacacugaaaccuguguaguguguacagaguggguagggacuaaacacaggccuagcgucuaugagucuguauuccugcucagucaucaacuuguguuccuauugaacauuugaucagaaugaacuugccaaucaaaacaaaaacaggacaaucaauuuaagacaacagaaauagagauuguuaaauaaaaccauuaguauuuuacuuugacucaguaccuugguuugucccaacugaauaagaguuuguauuguguguguguuccuugaaaccaaugauuuucaaacuuuacagcuucagaaucacccagagggcuuguuaagacacuacuugguggaccucaaccccagaaccaccaaauuuggcauuucuaaguuccuaggugauguucuacucacagucaguccagaggauuaccuuaagagucucugcauuaaacuagaaaaguugcaccuagaagggacagaggguggggcuaccugcuaucaggcaugaacaugugaauugcugguuaguaggugguaugccuugggcacaugucacaucuaaaugcugcuggucgauacuuuaucauuccacaaacauuuauucacuuccaaauauguuuuauguauacccacauacagugugugggauuacagccaaaguauacuugucaacauauacgaagucucuaguccuaacuuuuaaagaucuaagguuccuuggaaguuauuugaaggccaagagaccuuugcucugcugugugagucagccagucaaaagcccagaaaggcaaaaacccagcuuucuuguuuggagagacauggggcaugugucugccaauagccaguuguucucagugugcacuauguagguccccauccacuacuugaccaccuuuaucauuuacggggauuuacauagauuacaguggccaagaccccuuucucaaugaaggaucucauuggacguccugucaaucauuaaucuacaugcaggcuuguucccacacuaccucuuuaaagcgauucuuccuaugcuggucuguucaauccugcccucuuuggugcuagauccaguugugccucagagcagaagaaacaaaccugcugucuuguuggcccaguguuucaguuuugaaguguguacuuucuccucugugugugccaauuacauauuagagaacaaggaauguguacuuugguggcuuugaaccaagaaaagguuuuaagccuacuggauggagucuaaaauucuuagaaaucaacuuuagagcuuugcuuuucucugaguucauccugcagugaaugacagguacugacagcccaacauuaaggugcaaauagccuguuugucauaucagaagccauggaauaauaaacccaggggaauccagaaaccacacuuagugguaacccuggugcucucuagaaucuccaaaugagcugcuauaaaacaccuuucaggggcugagaugcagcucuggugugagucacuuaccuagcuuaugucaggccccuaaaaguaaugcauaaacugucagaaucgggaccuuaucguugaggugaaaagaaccaaggcccguaggaacaaggugcuaugaaucugaaaccaagagaaaccucaguuuggcaugguucuucaggguagcuuccgaguagaaauagucugcugcaaauccuaaacuuaagaucccugcgcuagguugcuagagacugcgguuagugcagaacagagguaagccuaagucccauccucaugaacuucaaugcccagccuuuguguuuauuuuaucuaaaugucuccuuucaucugugggaaagcuauagcugagugucuuuagccccugcccuacuuuucccucucugacuuuuuucccagguagcuuaguguuuaacaucucucucaccauccugaugcaguagcauggcuauugcugagguuauuuuaccuaauaauuagaacuuuguauuuacaaagcaaguagaggucuuaaauuugcuucaagaagcaguugcuccacuggaauuucuauaaagcuggguaaaggguuagcagaauuacagaucuuaaguacuaacugcaguccaagauggaagaguacucagcagccacugcccucaucaggaaccuccucggcauccaucagucuccucacugcuccugugcgcagggcugucccucccacacucccuuccaggccguggccuucgcuuccucauuagaaucaggagagugaggcacaguguccaucaugccauuuaaucuugugccugcccuuuccagccucuucaaaagaugcauccaaacaacaggucugcauuugauguaaugccuuaauuacuggggccacauucacguugacugucucagagacuguaagcucccggagagcaggguugcuguaaugggaauguuuaaguguugugugcaagaaaacaaaauaaauauuuugauuuucgugauucuaugcaugucugucuacacacuguccaaauaagcugguucugggacgucagucuccuccauggcauggccuuguugcucuccugccacucuuaagcagaccuggugccugccacagggucagcaugaccuugugcauagcacauagcagcaaauauuucaguauaggagcgauucuuaaguucagaaacuaaccuuugccgccuuucauccguaguucauaaccccuguguucaugccauuaggcggcagcacuagcuuccaggaggcucccgggcagacugugcccaucccuguagcagaggggaaguauuacuguuaguggucuaaccgcuggcccaucaucaccucuucugcaaugcugugguaaacaucaccuuuggggacagcuggcucaaaucuaggcuacaccacauaggaacugcuauccuaacugucucaaagccauugauagucaaguguggugacacauaccuguccuuccaguguuugacguugaagcagaaugaucaugaggaaagaccuggacuacuuagugaaaggucuucaguuuggggguucaagggaaaacaggugaauuuuccuuuugggccagaaguuuauuaauaccauaaaaacacagacagcagcaugagcagcucagagagcucaggcccuaacaccaguaagucuaccucugcuuucuguggcagagagaagggagggaauucuaaaagaaugugccacucaggauauaggggaaauaaggaggagagguacauacagauggcaaaugugucccaccggagccccucuacuauccuagagucuagcaaccuggucuguaagucaaaggaaaugaaguauaauccugacaccugggugugguguuuacagacacuccacagcuucugucucucccuguagcagcagggaucucggaaccagcuauaaagauagagacagagaggacugcagguggguauaauugcaggugggccugggauucugcacagcgagggacucuguugcaaaaacaaauggcuauggguguagcucaguugguugagagcuugccucguaugccuuucuaagcucuagguccaaucccuagcaugcccugcaugugcauacacacaaagaaguacuagcaccuauuuaaauuaagaguaauacagauaaggcaucccacacaagacaggcacccaagccuuacuacauuuuuccuguguacugauuauauuacaccugaaggcuucaggaaaaugaaaggucacucuucugaauaaagugaccuccugggugcugguagucccgaaacaaacagauccuaaggaacacagcauugauacauauaauuuagguaugcccaaaaaagauuagcaauugcaguaaguccuggucuacugaugaauaauugucucauucuguuaauaagaaagcauagggcuggagagguggcucagugguuaagaacaccgacugcucuucugaagguccugaguucaaaucccagcaaccacaugguggcucaaaaccacccguaaugagaucugaugcccucuucuggugcaucugaagacagcuacaguguacuuagauauaauaauaaauaaaccuuuaaaaaaaaaaaaaaagaaagcauagaaaaucuuggaaacuugaaaauaggaaauuuucucucccccacacacugcuuucuuaaagacucagcugagaccacuuagagagcaauguaguugaggccauuaggagcaugggauuggaaagcagguggcuccacagcucccacuucguggcugagcucugguucgcaucugcaaacucagaauggugugcccucucaggaaguaagagagucggcacucagcacucucauacagcccucugcacgacagcugucaggacaaagggcaaaacacgagggaggcacaaaaacaacuguggggauccuacuggggaguugcagugaaggacugaggcaggcag

SEQ ID NO: 1933 - RNA, 7713 nt, Mus musculus
uaaagaaugcaggcuagcuuuacuggaaacuguggcaagaaucaggaaaggcugaaaggggagacaagcacgugggcccacagaauugaaacacuuuccagaauuaucagcaacacacaaacagcucaacacugcuccagugaaagaggcuccgagcucucucaacuaguuggaugucuggguggugcuguccagcccuuuuggcacaacuugcuauguagccauagaacugcuucucuacccuccaugaccccguaguuuaugaucaggucccugguccuuuagcucuucucuuccuguugggccgucucuguucuccaagauagaccuagcagaccccugggcuguaaaaugagcaagaacgguaacaccaaaggauucgcaauaguccucgguccagcaaccacugagaaaggcucuguuccuuguccuggaacacagagugcucaccccaugccccaaaagaacugcuuaguccaaaagauggagaagaugagcagcagggugacacugaggaugacagccaucagauaggcgaagauccggaagugaggguugcggacacacucucugagagaguagugacuggggaugggcaccggccuggugucaggggcuguguccugagggagcccagucuggcucccaggcucagcgccaagguccaggguguagacccgaggcugacgcaggaaguagcggcucuugggcugguccuugagacagagcugguggcccucuaggaugacaugguggggcucuaggcggagcagggucagcauggcagugucuguaggcaagucagugacuggcugcccugaagccagcacggugggcugacgacagagugggcagagcaagcggcgccuggcugggguuaccaggcugaggugggccaggcauuccacacagaaggagugacagcagucuagcacuuuggggguguggaauguguuguugaaaggguuccagcagacagggcacucggcucugagcuccuggcccugugguucgcucauccucugaucacauacagggagccggaaccuccagaggaugcccuguuaggagggagaaagagaaaguauacccauggagugcugcugucccuggacuuggucugcagcucucggcucugagaggauaaaagcuauccacccacaugucacagguggaggaauggaugucugaaugcauuuuguccaagagcauccaggccugggucacagacucaagucugaugcuacacagcugcccaccgcccaggguggaggacugagcgacccaauggguuaccuuucuagcagcaccggaaugagaaggcagcggaaggaacagcgcuggggcuuuggagaugcuaaagaacaggugcuuccuucccugcaaacucaagucucugacuagagcagagaugggcucugucccuccucuggagacaaaugccagcccccucucugcucuuuccuuuggggccaguggccagcuuuucacacucaacugacuaguccuggugaacaguucuugagaagacuccccuacucagccccccagaccagcucugugugucucuuccuaguucucugccuccccugucuccucccacuuucucccaacacccaccuggguuucugugaauuguaggaggggaaucggaaagaccacucugaaaggucagaguuuccccugucucucccucuccugaauccgccuagcuuugggaaacugccacuuugccaccaaccccagggccguuuccaugacagcaugcucacagcaccuggagcugcuagguagcccuggcugcagccucagcacacuugccuggagucaaggccagaguggugccugggagacccaaaugagacacacagagaagcagucaugaauccccccuaacagacccccccagauacacacaggguguggcuagcaauugaauguagauacagguccaaagguggccccugucauaccugaaaucaccagauuggaaaggaaagggugacaguuuccuacuucuagaucaccaugaggauaagucuucugggucuccucucucuugggcccucguuucuuuucugaaaggcuggcaucuccuugcgcacaggagcugccugccauaugcuacgcuugcuacauacaccugaaagaucugacgaccaaauuccccaaagccuguuucucaccuccucuuuuaacuugguagcugcagccaaaauaggcaacccuuuaggacaggggcagucaacagucccagagcaaucaugaagagaagcauucugucucugcuuccucauuuuaagcggaaacucuuaacuuuuaucucuugcuuauauuguucacuuaaauuauuugaggagcugaguugcugucagaggggacgaggguggggauguacuuaaaacuacuucuccaucgaaaccauucgcuuuacauggaaacuagaagugauuccgucuaguuacaacaacaccggggugacacugggacauguuuuuggaauucuacaguuacaaacacagaaggcguccauucagucuaccugcaggguauguccaccugcaggguauguggaaagagcuaaauagaaaguauuccuguuccccugagauuccucgugucaguaaagacccaggaacuguguaagggaagauuucgggguagcuccaguuccuuagagaacuuaugugaugcucuguucccugaccaaauugaugucugaagcaaaaccucuguccacuuuuaccccgggccuccuggcuuuaucuacaucuuagucucugcucuaaagaugaagcucugaaaauguuucaucuuuaaggaaaugauauucagggagagaugguacagccauaaccaaagcaaggagggccccuaggauuugugcagaugccccaugcaaugagcuguucaccuacccagucacugagugcuuaccacaugccaggugcuguaccagguacugaaagauagaggggaauaaaauugaccuucucuuuucucucaugacauucauaggcugcugaggcaaaaacaauaucucaugaguaaugagaaacaaagaaauaacagaucucacuauaauauauacuguauguguauaucuuucauuauaauauauuccauauauauuauauaccuuuauauuaguaaaagaaugugccaucucacccacugaaauacauggcuuuaauuaaugucauaaagaauaaaaauggaagcuuucuccaaagaggugaugugauugcuaacacagucuugaaaagaaccagacagacagagugagggaagagcaugccagcccagaggugaguucugccagugugaggaagugaaaggcagauggcugaagggcuggggaaagcaagaguccaaagugcucacagcaaaggcaggaggcaaagucuguuaagucccaaaacucauuugaguuuuauugauggggguauaacucauccuugacuuauuuucauuuguuuuuaauuugagauagcuuagacugccuugaacuugcuguuuguccagccugggcuuguggaaauguaggucaguuauggcuacaacagcuaguucaaguguaauggugaugucugauauagcucaggugagagacacacaaugagcaucugaaaacauguucagcauccuuagccucaggaaaauguaaaugaacacucuauugagaucugaauggcuaucaauaaaacaaagaacagugacaagguguccauucaggugauaugugagaaauucgccaccaagucugaugaccugaguuccaguccuugggcccgcauaguagaagaaaagaaccaacuuccauaaguuguuggauccccugagauuggaguuauaagcaguuguaagccaccauguggguacugguuaucaaaccuggguccucugggacaagcaaccaaugcucguauaccccgagccaucuuuacagcacugaugcuuaaagucuuuaagaaggcuaaaacaucccagaguccacagugucauuucauacaacucuaggcuaacccaaaaucuauaauccauaaugaauauauggaggacguagggguaaauagagagggcaacuggaggagaaggaaauaucacaugcuucucauauguggaauggagacacguaugauauaggaaggggaccaacaaaggagaugagagaggagguaggaagggcagugaggggaugagucagcaaagugcaaugaugagucagcgaacuacaaagaucugugagcgugacaugauaaagcaugucauuucauaaacuagcuauaaaauuuuaauuuaaagagaaaggaagaaaaaggaaggaagagagagaaagagagagacagagagagagagagagagagagagagagagagagagagagagagagagagagagagagagagaagaaauaaugagaguggcaugaaaaacaccuucagagacagacaugcacauacaguucucuggaaggugguuuguauuguuacagaagauggauguaagaaagauauucuguagucuuuaaaaugaugugauagaacauuucuuauuauggagugugucuaggauauaauguuauuagguauuaaagauucagugacaaaacaaucacaacaucaucuacuuuaaaaaacacacugcacuguggaaaaauaucucccggaugauaaaaaaccaaauguuuuuuguuguuuguuuguuugcuugcuugcuugcuugcuugcuugcuugagguagggucucaagcccugacuauguagaccaggcuggccucaaacucagugaucagcucuccucugcuucccaaguucuaggcuuaauagugugugcuagcucuccuagaaagaacuaaaugucaacagugguuaucaaugugggcaaaaccauccauuuagauuauugcuacagcuuuugucuuuaauuuuauuacuugaaaauguuaacuuugggguugaccagagugagcagggccagagcaagcagagguccugaauucaacucccagcaaccacaugauggcucacaaccaucuguacagcuacagugcacccauauccauaaaauaacuaaauaaaucuuuaaaagaaaauguuaacuuugggguuggagagauggcucagcaguuaagaguacuggcugcccuuccagaggaccuggauacaauucccaguguccacauggcagcucacaucugucuguaacucuagcuccacaggguucaacauacucacacagauauacaugcaggcaaaacaucaaugcacaaauaaaauaaguuauuuuuuuuaaaaagaaaauguuggggccagagacauggcucagagguuaagagcacugacugcagcugggcagugguggcacaagccuuuaaucccagcacuugggaggcagaggcaggcagauuucugaguucgaggcuagccuggucuacagagugaguuccaggacagccagggcuacacagagaaacccugucucggaagaaaaaaaaagaaaaaaaaaaaagcacugacugcuccuccagagguccugaguucaaaucccagcaaccacaugaaagggaucugaugcucucuucugaugugucuguaaacaucuacaguguacauauauauaaauacauauauguguguguacauauguguguguacauauauguauguguacauauauauguguguguguguguauguauauauauauuuuaaauguuaaccuugggggcuggagagauggcucagugguuaagagcaccgacuacucuuccagagguccugaguucaauucccagcaaagaaagugguugggauaguaauggggaaaauuucccuuuuuuuuuuuuuuuuaaaguuaaccuuauuccagucaacuugucucgcuauccuuaaagaucucccuucaccacccuagaucagaccuacauucucugagguuucaugaccauagcucuaaauggauguucaauuaaaaaagaugggggcuggugagauggcucaguggguaagagcacccgacugcucuuccgaagguccagaguucaaaucccagcaaccacaugguggcucacaaccaucuguaacgagaucugacucccucuucuggagugucugaagacagcuacaguguacuuacguauaaucaauaaauaaaucuuaaaaauauauauauauaaaaauaaaauaaagaaaaaaagaaaaaaagaugguagcgguugcuuggguccuucucugaggagcuucucucaggcacccacugcacagaggucagugucucuaggagaccaagacgccagugauuuacaggccccagcuuccugcagaacagcucagcaacaguaaauucuaaauaccucccugcagucaucauuaacagaaacuugucuauagcaucugcccaccccuauguuuucagcauccugacagcaagcuggagaacuggcauccagaccaaaagggcuggcucuugcuagaagcuguguaugguaaccuuuagagaacaucuuugccuuuuacaaacuguuuccauuuucaugaggccauuugauuggcuaaacccagaaacaagaauagaccagggagugaaaagucucaccaauuugugcugauaugacucaauggcuucacuucuccgaacccugcuucccucuguugaggaagcccaugaccccuucuuacuauuucugugaggaagaagccagccucacucaguguaccacacaggguggucaguacacacguucaaaugagucuauaaagaccuacaagcuaggugggaaaacccaggcucagaauguacagugacuugggcaccagcuucagagccggagaggccgagcuugaaaauugacccagaagccugccuccuaggucagaguucacaccaaaaagcacaccugcuccucccucucccacuccuuaccagcuucagccagcuucuuccucucucagcccagccuugaggcagguugcgcuggcuuccucgcuggcuuccagguugcugggagccagccucuuuugcaugggucuccccagcucuugguccacucucuggcuggcuuucuucuuccuuccucggaugacuuuggaacucugcauauacaaaagaccuggacauuugcuuuugugagucaccccugcuuucucugagcuggcaggaggaaguccacucauccuugcaagcuucuguucuagaaagggaggggcccuagccuuuuuacccugggcugaccugucuggacucacacuuauccuggcuuugguagguagguaggagaucccugaaaccagauacauggcuacucugagcccuugcaaugaaggcacaccaaagcagauaacccagcagagggagacagagacagagacagagacagagacagagacagagacagggacagggacagggacagggacagggacagggacagggacagggacagagacagacugaggccugguaagcaugagcagcaagugccugaauucuucaacaagccagacaccgacccgauagguauccagagucaguggcuucugaaucaauacagguagugagggcaggacuucacuucuccaagccuugaguuccucaccugcagcugcgcggagaaauccaccuuccuuguggggugcaacuagggagacaguucaguggucagaguacuugcuaugcgagcacaagaaccugcauucaaaucccaaacauuca

SEQ ID NO: 1934 - RNA, 6040 nt, Mus musculus
ucacugcuaaauggugauuuuauuagggggccgggccgagcucagcauauuucuguaggcucaaccucagacccagggccugugaggcaacagaaacuugguggaacuugggcagaacggcugaggagaaggacucugguuguugguauaguuuugaagccaagccacugaggaagggacccuggaagaugugucaccuacuugggcauaugcauucggucugggagcucuucaauccuuucccacgaagcuccagaguugccuguaugguuggucccaagccaugucuguguuuugacuccucucugaaaauacagugccaagaagggcauggucacccaagccucggaggaaagaacaagucaggaagagauggcgguguuaauaacagugggaguguucugaguucccucuguccagaucuaacaugguguguauccacacacaugcacauguuuguaugugugugaguguguaugcacauggaggcaaaaggucaaacccaggagccauccacccuauuuuacugagucucacuggggccugagacuugcugauucagcuacccuggccagccagugagcccuagggauccacaggucucggccucugcaguguuggggucacaagcacaugccaccaugccuagcuuuuucccuggguguuggggaguagacucagggccacauggcuagugcagcaagcacuuuaccaacugagccacccugugucacgaucucgacuucacucauauuucagcacagugauccucuuaguaucagaggauaucuuucucauggauuaauucuuugcagccccaagucgugaguucagaggaaggagugaagaauuccgggcaugugguuuccccucacacaccugggguuacccagagguuagggcagucaccagggugauggccucugauuccucuggccugcaaggaugguggccuuucaggauggagagcucagccacccugcuuugaauaucaggaacagggacagcuuagccaucuugcguugaacagggucugaggccuuuccagagccuagagugccuguccggcuguaguuggcguaugccccaaggccgcuguucuuugaaaguuuaccaccgccagagccagagccagagggcugccagggcucgccucagaagcucagagcaaagccauauaauuacuauguuuggucagugaaacaggcgcuagaagaaauggagcugauacagguuuaggccagacauccucacaagaggugacagguggaaguuugccuucguggggcucagcagccggccugcaaucuggauuguucuaaaaaaaaaaaaaaaaaaaaaaaaaaaagaauaacuuggaaaaagaaaauucagcuccggagaaccacaccccuugccccauauccucagaguggcuugucagugcuccuuuagggaguggcuaccaccuagauugggcagguccuggcuuguguccucuacuagcugaaugaccuugguccauucauacaagaacgcuauaccucuguuugcuggaaaauggggcuaagcaguucucuccucucuggaagcagagagacgggucagguggcugcuuugugacucuugagaucuagggugaagauucuuugacagugcugggcagccgggccuagggaagaaaucucuuguaagucugagacuuagagcccccacaccuggauuuuuccacuguggauugcauccuucccucauuuuggucuggaugaccucagccccugcuugucagcccugcaugguuuuaccuucccugauccaggcugugcuuuguccggcuagccugucuguuuccagacuguucugugaccuaacuuacggcgugcuuccaggccuucucugccaugcuaccgccaauggcuggcuucguguuggagguaaucaauccauccugcaaucacacaccagccuggccuccaacccccguuucucauggggccuuuuuguuaguuccgcacugacucagcuggacagagagaacugucucaaauagggaaggagccugcuccgugcacaguugcucagcauuccgggcugcacagucagcuuuugagugaggaggacauggcucacauucaaggugucuuguccaacucaagucuaggguaggucuugaaacauagguuguauuuuuaccaguggaagaacaggcuacugcacagacaaccaaccugucaacccccagggccaggccagaaagaaagcuaugggacacuucuccugcaucugugccuccuguccccaucugggucccuguucuuuguauugucucagccacccuugaagagucaggaagugguuugagugcuguggccaggcugcgaucuggucacuugugggggugggggagaguugauuuguuuuucucaccucucagugagaaggagcauggagggggagggagagggagcaagugugaaaaccuucugggcuguuuccucuucucaguggccuuugcguugguggggagcuuccccaagacggaguugguucaggucaccugcucacugucugcagaaagcuagaggacgccugggcucugagacacaggcugggcuccuuagucagggagagucuggcugguuuccccuggcagcgggaacccuaggaaggagaucaggagugugugaaccucaucgcucaggcucgcuccuaccuuuucauucagaacacacacagcaagugccguguguuagucuauacaaauugauggugguggccagguagcuccugcuaaccuuggcuaguggaaguguggacccuggagcacacgggcaaagcauguugucuccauuaucgcagggaacagacuuuugugccuggcuggugaugagcaggcguuccgagguggggugguaacaggaugagcgugugugcccuguccugucucuugcaaagcuaccucugcuccaauucacguuccaugugggacggcagaugcugugaggucagcccugaguguuuagacgggaguuucuguugcauugugauuuuguugcugcuguuguuuugagaugggaucuuguugugcagcccgggcugcucaggcuucaaguucuucgauuucggguuucugaauucugagauucuuggcgugugccaacaugccuagacaauuucuugauuuucaaacgcccaaggcugauaaguggauagcuuuguuuuggugucugggucacugggaggggugggguggcagggcaacacucccugucacaguugugggcugauggcucuauccuggcccuggaguugcucuuuuucuucccacucaggaauccucaaggccgaggcugagccugguuggagugggauucacuaaauggacauuguuccuuguucuuacggggcggggcuggaucccucaagagacgaugaaaguaccucauuguccccaaccucuguuccacagaaccggggacuacuacuaaagggaaaucguacaccggccugggcaagaagucucggcucaugaagacagugcagaccaugaagggccacaguaacuaccaagacugcucagcccugagaccgcacaucccgcauuccaguuacggcaccuaugucacccuggccccuaaaguccugguguucccugucuuugugcaggugagccuguggcacaccccagggguccccucaggaggaagugagaacaguaagggaccuugguuccaggaacaaggguguaaacucauccaggauucagggcccucucuggggacagaaaaauaguuuccuagucuggagguuauaagggaagcagacguuuccagaaggcuauguggaaaaguguggagccaugagaggguccuugcccucccuucccagcucccucauccucuggggccgggacaggugcacuacagagucuggcagugaugucggcugccucacccagaggcacuuaugugugaaacugacugagggagagagacuguguggcuggucccucugcucaggcaaaugcaucaggauagcaguaguggugcaggagcacagagcagaaagucacgggagucacacacuucacccccucccccucccccccccccguaaucucccacuucuucaugucuccccuuccuccuuccccucuuccugccaaugaguuaauaagcauccagagucuuggguuccgguagagcauuuccaaccaugauuugccgucuucccccucuucucccacaccccugccccugguacgucucugcugucauaacgucuuuuccacccuugugucuucuguguucuauaccccucuuuccucaacaacgcuccucuccucuugugguucuuuuucuggcucuauggcucauaccuacacacacacacacacacacacacacacacacacacacacacagacauacauacacacacauaaaauaaaaguaucgaaagcuagauucuguauaugagaaagcauauacuauauguuuuagaucugcccauuuuaugcaaaugcuauaauuaaauuuuuauggcuggauauaagaccauugaauguauauaccucauuuucaagaugagcuuguuuuuuuuuaaaaaauaaguagauaguuaccauacgacccagucaugcuacuacugagcaaaggacuuuauauccuagacaaagauccucgaaugucuguguuuauugcugcuguggccaaaauacuaagggacuaacagcuuagacagccuauucacauggugaauagguaguaaacauguucuguauuucuuuccucucagaucuuuauuuauucugccccuuggauaucacuuuauggcccuuuaggucguucacacauuuuuuuaaauguaagaagcucuuauuuccccaccauguuguucuccacccccuccccacacacacuuucccuuuucuugcagugcuggggaccauacccaaggcuuugcucgugcuguccccagacaagcacugagcuaugcccacaguccuuggcuuuguagacagccuuucacuauguagcucaggauggcccaacucgauccuccguccucagugacccaaggacuagggucauaggugcgugcuaccugccugguuauuuuugguuuugucuuuuaauuuuuauuacaaauuaagucuggugagccaccccaguagggaaaggugcaugccgcugaaccugacaaccugaauuugaucccuggggccuguauggcagaaggacagaaaugacuucugcaaguuguccuccuacuuucacacccauugcauccacaugccuguuccacauauacgucucuguguguguguguguguguguguguguguguguaugugcgcgcacacgcaugcauacaugccuacucccacguguauauauguguauguguacaugccugcuccacauauuauguauuuuugcacauacacaccuauaagaguaguacaguuuuuaaauuuguaaauuauguuuugaggguuuguuguuuuguuuugauuuuuaguauuuuggagaaaggguaucuauauaacccuggcuuuccucaaccucucuguagaccagucuggccucgaauucacaaagaucagucugucucugccuucugaguguugggguuaaagguaugugucaccaccauucccaguuuuaauugguuuuuaaaauuuuaaaaacugaaaaaauuuaaacugugaaacacucaagccagaaagugguuggugcaugccuuaggaggcagaggccagcugcucuacagaaugaguaccaggacagcugggaagcugagacuacacagagaaacccugccaaaaaagaaagaguggggagcaggguggggugggggagaaagacuuaagauaagaauggcuuaagacuuacauaugccaaacagagaaucagagugaauaccuaccgaauagccgguagcuguccacauagaugcuguccacaucgaugcuguccacacagacgcugucccaccucuuccauauuacggcgcgcucccuucccaccagagaccuccccaccuugcuugaugacug

SEQ ID NO: 1935 - RNA, 6364 nt, Mus musculus
gggagucaccggacucaaaggcagucagucagcugagacaccgggcgguucuuuugacgguggggcggggcuccugcgcgcugcgcaggcgcagagucugggugguggaucaggugauccgaggggcuucggaggguguuugagcaguugacuuaggccguucucucagcccaaaguccccucagcaauggcgagucagucgcagggcauccagcagcuacugcaggccgagaagcgggccgccgagaagguguccgaggcccgcaagcgugagcuccgggacggggcgggaugcuaggcugggacggcgacuaggccgcgggcggaggccgggggacagugucggggccagaagcugucccggcggugucuggaagccucgaggcuggaccucaggugccuguggagacaguaguggguucguccacuucucgggguggagggcgugaagugggccaccccacagaaacugcucccacccgaucccgaucccuugcuuccggccgcggcccaccuacgggagccaccuccacggccgucgagucugcgaaccuaggucauucuggccaccucucccucacguucgucacuuuaaacgguucgcccagccucucuaaccugaucuccguccaucguuuuuuuuuuuuguuuuuuuuuuucuuuuuucagcaccauaguugaacucccugaguucauguggcuaccuaacucggccagucauuccuuucuuuguuccccugagaauguauuagagaagugccgaguucauauucaucacaggguauuucuuguuccagcggaggcgcacauaccaguuaggauguguguagcagugaaaggccaauauugagagggacaaaguggccagaaaagucaguuuaccacguguguaacugggaccaaggaguggaagaagccuguaauauucugcaacaaauuccccccccccccacuucagacaccugcuuaaaauucgaacauaacuuucucgucacaccuggccuuccacucagcacuccuuguccccgcagaauggagcugguauuucauaauggauuagaggaaguguuuucaucagucaggcuuuuguauucucuccuaagcaugucccugugagaaauucucuucccgcaguacugcgucgcuugaauccuaaaggcauccucauuucuggcccuccaggcuuuugcacuucguuugcccugaugguuaguuuuggaucucagaauuuggcagcgguuccucauucaggcucuuucccucacuaaugcuuguuuuugacguaguguuauaguaagcuguugguuuccauggccuugccgcuagaauaagcuuuuggaaacuggaaacugugucucaggaccuuuaugaaucuaguuuuccaagguaagaagacacugcguuugcuccuguuuuuuugcaggagggaaaaaugagacccagaaggugauuuggccagacucuggcuugagaggccuuucucaugcaagggauuuuccuuaguauaaaacuugcaguacacuuauguuacauacugcugacgggcugagaccucucagagaucugccugccucugcuucccagugcuggccugaaaggcaugugccaccaugcucaccccccaaguagauugaaguguggcccuggugggaguuaggcgauucuuuauuuccaggagauguuuucuguagaaugcuggggguggagagaagcccuuuucuucucagguggcuagaaaggccuguguugucaugcucucgauccagaauuuccagacugucuugucaguuuguccugugaugacucagccgcaguagcagguguauguguugggaauuaugugaggcuguuuggaggagaugcaagagcaaauacuuggacuguggugggaaugaccguguucccgggagauuuuaaaccuuacuuggcugcaagcuuguauguaucagauagcugaagcaguuuguuuuagagggguuagcuuacagccagcucacauuuuaauauuuucagggguugggaagagaggcauugaaaagagcugaaauaugagaacugucauccuugauuuguggucacacuugacuugcucaguuaaggguugggaaggaaaaguuguaaucucagcguucagaggcuuguggaucacugaguucgagggcaaguuccaggacagccagaaaaauccugucucuggaaaccaggagaaaacacauacacacagagacugggaagggucaggguauguuguaaaauaaucaagccugaguuucucaugaaaucauuacuuuguuagguuagaccauuuguaaggucugagaaacaugauuaaaaaaaaauuggggcugggagcaauuauacaugacucuaagggaaacugaucccacacagcagaaucccagacuucgaaccagcacaggcuguguuaacccccccccccccaaaaaaaaaaauuaaggcuggggacuggacgugugauugagugguagagugaggauguuugccaaaaggcauugguggucuuguuagggacugguucagggagcuauggguguugggaauaguaaauugugaaauuaccuuggaguuccugaauaaugguuggaccauggaugucuuugauagacuugguuuggaaaaggucuuuggcuuuaaauguagcccauguagcugauaggggaggacucucucugaaggauugggcuuagcacaggaggagugaacuuaaguaagugcuguguuuaaguguaggcuugcgaaguaauccuugggguguguagggacagacuguuucagauggcgcuggugccagagucauuacagguccagaauugcccuaaucaggaacuuugaugaguccacuuggguagugugcuuuggacaguugauacuaugucuaacaaagcuugaauucuagaugcaugcugccuuuugcuaucaccuauguagguugaucuucuagaacucuguuggugacacugggcauaguaguacaugucuuuacucucauaacuugggagacaggcagggagauaucugugaguuucaggccuauuuggucuauccauagugaauuuuaggacaucugaggcuacauagacccugucuuuuuuuuuuuuuuuuuuuuuuuuuuuagcagaaacucaaagcaaauguuggcugaacuugugguuugacaaccuagagacuuugccaaucuguguuaaacuggcuaucuuccagagaccagggagaccagagccuccguuucuccucccuuccaacugugugugcucuggcacagcauucagcauccucccccacagcuuugccucugccacugcccuggugccuaguuugcaggauuaugucaucauuuccuuagcugcaucuuaggugauacccuuugaguacauuaguucucagcaaacucuaaagagagccugcagcaacacagcacagcuagcuguugacuauuuggggugaggaagagcuccccagauggcugucaccuaucuuauguuaacacgguuuuaauauuuaugagaccaagacgacgccaugacauuccacgguauuuuccuugcuuucacagguuuccuuuugaguguguguguguccauguguacaguucuggacugcggacugcucauacacugcucacggcucuaaaggacauucccuuuuuugucuccacuuaaaggcucgaggcagaaccuauguuguuguuuagaucugcauucccucuuuccuuuguacuuuucuguuguuuaaauuauuuucuuucuugacugcuaaaauucauuaucaguaucuauuuggcuguagauacugccuugagacacuucuugaugucuuucucuucuuugaaacaggaaagaaccggaggcugaagcaggccaaagaagaagcccaggcugaaauugaacaguaccgccugcagagggagaaggaguucaaggccaaggaagcugcggugggccucccucuguuugucuucacuauugccuuccuuuuuugugcagaucugaaaagagucaguacagcuuagagccacuagugcaguuuugagagauugggguuuguuuguuuguuuguuuuugguggccuuugcaugcuaacaaguucucuaucaguuagccccuauucccaccccaucccuguuuaucucuugggauagucacauuuauaucaaauucuaauuuucauuuauuuguuuagcauuuuuaaaagugcuugacauaugcagguaccauguuagaugcuggcagaaguaguaguuuccauccaugccuucauagaguuuagcuuaccauaaauccuacaaaccuauagcugugaacacugcugugacaaucuaaaugugauaaaaugggagaccugccccucaguauaguauagagaucuaucacccuaguagcccacugugauucauaaagugauggacagagacagaucuuggugggggagaaaggacacagaggaacauguagaagcaggaagggagagcagagcuguguggugucccauacaguuaagugguucauacuuucuuugccuaguugaacacccaagugaaagguuugagauugcccacaucuagguguugaggguauuggauccccuguagcaugaguuacacaugguugagagccaccaugugggugcugggaacuaaaccuagguccucugcaguaaaugcuaacaucagugauacuguuguauuguuugucuauaaacugcuuauuuuacagucauauugcugaacuauucucuuguacagaugcgucauaguucauaaccacuuucaguuguuagauuguauguguguacaugcuuguacuugcugguaguggugcuaccagggauugaauuaagucaguuguugccuucuuuguuuucuauuuuuucucuugugccuaagcaguucuguucuuaccccaaguagcugggaucacaagugugcacccguguggguggugccguaguuguuaaaucuuuagguugguuccagucguuacucagggcugugcacugugcauugcagugagugcugauggagugugccugguccgccacacagcuuuucucacagguuacugugccugccgcugauguguugcauucucuuacuaaggagccggggcauuuccauaggccagcagguugcuuguuaaaugacuccacuggagacucuuccucauguucccuuguauccuguuucuuccccugcaggcauugggcucccauggcagcugcagcagugagguggaaaaggagacccgggagaagaugaccguccuccagaacuacuucgagcagaacagggaugaaguccuggauaaccucuuggccuuugugugugacauccggccggaaauccaugaaaacuaccgcauaaacggauaggagguggaagcgccugcucuguggguuggcaugagaucugcccccauagaauaggaaaaccuccacagagcuggaguucuguucuggaaggcauuaaauuauuucucuaugcuguuguaggacccuucacuuuuugagaguaucaaaucuagcuuuuuguacagacuucuuauguaccugaaguuucaucuucuuaucuugugugucuuuaaggaguguaugucgccuguuuuccugugucuucaugcaaguaaucgauaucaauguugacuuuuuuuuuuaauuagucuaguaggaaaaauucuuugaaggaagaaggggaguaaacuguucccuucuccuuucuuacaggucaggggcguuaucuaugaaaaaguagaaguagcuauuaguaacuccuaugaagaagcagccagccuuagaguacucuagccuggauaauuuaggacagucaauacgauaugcuuguuccggcugcuguuaguguaaccuaacccaaaucacuagaugcuaggacuuaacuuguuacauguuuuuggugugcuuauaaucauuuaaaaguaaaaauuugucuugcucuucacccuccuggcuccuuuuuuuugguaauacaaaguauaucuugacccagauguugagcagaauuucaucuaggagucagccgguguuggauguaaauguauaccuuaauaguaaauacucaggguguucauuugggaaugaaguugcuugugauuuuacccucugguuuagaaagcagcaagcaacuaaagagccuguagucugccuuuugucuacagcagugguucucauggcccuuuggggcgucauauauuagauauucugcauaucagauauuuaugguuccuaacaguagcaaacguagaguuaugaaguagcagucaauaauuuuaugguuggguggggguugccacaacaugaggaacuguauuaaaggguugcagcauuaggaaug

SEQ ID NO: 1936 - RNA, 1058 nt, Mus musculus
ucacuguccuugcuggggugggugguccaggcuuucuuauuccuuggaggccauguaggccaugagguccaccaccuuguugcuguagcuguauucauugucauaccaggaaaugagcuuuacaaaguugucauugagagcaaugccagcccuagcaucaaagguggaagagugggaguugcuguugaaauugcaggagacaaccugguccucaguguagcccaggaugcccuucagugggcccucagaugccugcuucaucaccuucuugauguaaucauacauggcagguuucuccagguagcaugucagauccacaacagauacauuugggguaggaaaaugaaaggccaugccagugaguuucccuuuuggcucugggaugaccuugcccacagccuuggcagcaccagugggugcagggaugauguucugggcagucccacagccaucacaccacagcuuuccagagggaccauccacagucuucugaguggcagugauggcaugggccauggucaugagcccuuccacuaugccaaaguugucaugaaugaccuuggccagguggcgggggaggcuaagcaguuaguggugcaggguucauugcugacaaucuugagugaguuguaagauuucuuaugguucacacccaucacaaacaugggggcauuggcagaagagaggagaugaugacccuuuugcccccacccuucaagugggcccuggccuucuccaugguggugaagaugucaggagacuccaugccauacucagcacaaacaucaccccauuugauauuagcaggacuucacuccuggaagauggugaugggcuucccguugaugacaagcuucccauucucggccuugauuguaccuuugaauuugccauggggggagucauacuggagucaacauguagaccauguagaguugaggucaaucaaggggucauugauggcaaaauucuccacuuugccaagugcagagacgaaggcaacccugguaaccaggcguccaacacggccaaaucaguucacacugaccuucaccaug

SEQ ID NO: 1937 - RNA, 87227 nt, Mus musculus
ggaugucuggaggcgaggcgucccauuacagaggaaggagcucccuauauaagccugccaaagcuggcugcuccggccacagccugccuacugucacgcgucucucccgcgcgcagacacacacccuagccucuggugggcacagacaguggcugggaagacgcuagggaccgcgcgcuugggaacucguuguggcuuaacccagguacuucuucacggagcuggugcacccagagacuuugcuuuucccgaccuggaaaaggugagucuguugaucccaucacccaggaucuuucuggugugcuccuggcauucccgguacccaguaagauguggguuuguaacuauaaaacuuuuguuuaauuuccaagcccggugugaucagaugcggcccgauuauucugugcuugcccuccugcggucauguauuugguauggaucugucaauagucagaggaacucagggaacuuuugguaaaguuuugucucugccuuucuuuggaggaaaugucuuacuuuaacucuuacccuuuuaccucguugauucucaccuguggauuuuccccuuuuggagcguuagagaaguugcauuuuaaaguggcauucacucacagcacuugggugggaugaguaccacguacccguaguagggagaacacaaccgugcaucuacacagucucagcacuugacaguuuucguuccccucuugucccauuugauccucaguguccacucuggggaaagauaagagcuggauaccagagcuaggagaugaguucugggcacggaugaaaagcccacaggcuguaagaugaaacuggugggcacgucuguggguucuugaagcagggugccauccuccugauucagagaccucagguggggcauguguagaagguuuggaggcaucugaaccccauauugcucccaaaucggccucccuccugacacuuuaucccagaaccccaguaacauauucccuucccuggugaacuuuggaaagagcacagagauuccucuaugccaucguugugacagggggaauaagagguugggguuugacccuagaaguggcuugggcauucccacuagugccacuacaacauaaaugugucaggaaaauauguaacuucuauggaccuuaguuuccacuucucuaaaguggggacagcagcuccccuuauaaugaggagcgaaugaggaacaaaaaagaucaaaucagcaacugggcaaucucugucauggcccaaagcugccaacacccuggacgugaaaagcggggccucuuaacccaguuuuucagugugucugcuuacccccaaagccucugccuucuuaucuugcccaaucugagacagccugcuagccuggcacguaguguuuuacaagcaagggguguguuggcaccauuaggagaaaagguggcagccucgggcuugaugugaaucuggaguucugacuccagaauguccucaggcauuuacaggcugaagugcuuggcuauggagugcuguguggcugguggucuuuggaaucagauucuuugccucagaggaugagccagacugggagcucucuuuaagagugaaugccucuuuuucguguguuuucguggaaucuuuuuuuuucuuuguuuuauagagcuuucccuauaugcaccuuagaaaugaaagcugcuccccaccccacugccuuuccugagaugcaacaaagcucaccagggcuggugagaggcaugcucugucuaaauaagcugauggaaaguucuccuguccuaugaaccaaggcuuucgaagggcaugggggauggggguagugugccuuggccugguacauuccaagaaugugaccacaucuagggaaagaagggggugcagugugugaauauucucuggguuacucaaauggggugagcacgagagagagagagagagagagagagagagagacagagacagagacagagacagagacagagacagagagaaugggugaagccaagcuugguaaucacccacucccucauuuguucaaaacaccuagcuucgcgcucuuggccucucuuuccccugucucaagaggugacaaggcuuccauccaucaguuuugucacucauacaaagagggugaggaguuaccucuccuggggcucugugacauacacaccagaagaguucaauagacagagguguuucuguuuaccuuguuacuagaucacagauacuuucaagauuaauguccuaaacaaauguuugucaaguuuaacaauagaagcaguuauuaauaaauuaugaacaacccuccucccugaguuucugacagauaaaaaugagguugcaugggcuaacaugggguuaaggggugcaaacacacuauucauaccccuggaacauuuuuaccacauugcaaacaaugggacacacagcuccagaucucacagcuaggcagugcuuacucagaucaguguucugaaauccagcagcuaugggaguaaggacaguuccccaaaugaaacaggagacaggaauuuuagaggcuuaagaaagguugguuacuucaaucaaugucaguaaucacuauagccagcauagaauuaaccaguguaugagcuauaggcucuugaugcuucccugggcaucaugguaucaaauggccacagcaggucucuggagcauggguguacuuauaagacagagagacucacagagcagagagauugggucuuggaacucaagugauagggccagaaucuaagcucauaucuuucuuuggaggcugugcuucuuuucaacgugucagcuucuuguauagcccucagagggaaagcacuucccuucugacaaaauaugccccaccaggcagacuguggccacccauaaauacagcaauagccugaucauauaaccagaauagaauuuggaaagggaacucaggcugacagaaugaaaaacauacucccugaauccuauccguucucauguucgcugugaacuaaaaccaccucucaucucucuucccgcaguuucaugaacuuacaaacuggcuuucacaaagcauaaaggcuccuccauacugaggcuguauggguuugaaaaguagaacuugagaaacaaauauuuaguugguucuccauauacaguuccucuaugguagucagacacugacauaaaauagcuaauagucagggaugaagugugacacagugauggggaagacugucuacuuaguuuucuaauacugcaaauuaugaaucaacagcuccauuuaauagauggagaaacugaggcucaaggaagcugaguagcucagcccaggaucuucucacaagagucagaacuggcugcaaacccaaacuuucuaaguaaaacgccaccguuuugucucuugugucacgcugccucuugaugucagacuuggcuacccaagugcagaacugugcacgguguccuuuggggaauggccagaagagcacacaagacuccagcuggcauuggugccucuugauuucacagaggagcccugcagcuaucguuuuucauggugcacaagaaagguuagcuggugguagugcaacccaaugcuuagaaacggaaacauuccaauuucagcugagggacagggugagugagggagaaaggagagagagagagagagacagagacagagacacagagacagagacggagggacagacagagacagacagagacagacagacagacauagacagacagagacagcagagagaaacagagacaggaagauagagacagaaacacaaagagaaagacagagaggaagacagagugagcagaaagagagaaaaaucacacacacacacacgagagagagagagagagagagagagagagagagagagagagagagagagagaaaggggguggcaagguugcagucauguccuuccuagugauuuucauggcaucagcccacacuucccauggcugugcaggugggagcuacaaaagggagaaaagggagacagccauaccugcaucuucuaagguguaggagagcuaaaugugugguuuuaagggggcugcuggggagauaaaaauggggcucucccaggucucuaacagaagucagggaacagcuauagccuccaugccacugauucugccgaagccucaaagaggaagauugugauucaaacaccucucaccacacaaagauagcugggaauccccuugaaucccgucccagaccaguccaaacaccuucaacauguggaaaacauuacaugaaggccccuuuccaagaaggaaaaccccuuaauguauagugagacgagccuccuaaaaaucccaauccuuuacaacacaaagcacacuggugacuuugccuucuaugaaaucugcacacacccuaugacuucuuguggaggagaaaccacugcauaguucucuugauuccgagccuggcgcucagacuuuuguucaguuauacccuuaaaucuaaucaucuuuguucuuucuccuuuucugccauauauacuuccuagagcagugguucucgacuauccucaugcugugauccuuuaauacaguuucucauguugugaugacguccccccccccgaaauaaaauuauuuuuguuccuucauaacuuuaauucucuacgauuaugaauagcaauguaaauuugcuguuuucugauggucuuagacaacuccugugaaagaguccuucaacucccaaagaggucacaagccacauauuaaaaaacacucuccuagacaguaagagccaccuggaguucagugcucucugccauucuugauucuccaccauggaacaaaaucagaaugcccacacucaaagcagguugugaacggaaaauccuuuccauguguccuuucacucuauuugugaguggaaauuuuuaaaagauuauuucauuccaagucaucucagauguuugaaauuuccugaaguucacagguccugaaaugugggcacuuaaacucagauggcuuuggcugguccuuuaaccuuccucaaacagacugccaagagacaaagguguuucauaagcccugaaagcagauagcuugcuucagaaucagccaaaggucaccucuuacccuaaaagaggaaaggugguuucuguuaacaucucuaaagaaucguccaaacuauccuugaugcggggagaugaaggguaacugugaaaguaacugcauuuguuacuuuguccauugucaaggcuuucauuuggguuacaguuugcagggacauaaucuguccuggcagaggaggcaaaauggcaggagcuggggguggcuggucaucccgcauccaugcucagggaacagugauugagagcugguacucagucggcuuucuccuuuguauggaguccagaacccccacugcauggauugaugccacccacacuuagggugaggcuucucacgucaauuaaugcaaucuagaaaaugacuaacagacacguccagagguuuguuucuagacccguauuuuuucaaaucuuaucaaaaaaacaaucaacauuaaccagcccacuaaauguugucaccuacucgaucaauacugugccauuuuaccauuguuauuauuugcaauaucauugccauucuaauguuggggaccuggggugaauuauguauguagccuguugaauaucaugcagguagaugauaggggaaaccuuaacauaaacccgggccaagucccuagaaggagguaaugaccaucaggcuaccugagccaugcuaggcaccaugcuucugcuccuccugucguggggaggucauuguccccagagucugccugccuucugcaggcaucagacccucagaauguaaugucugugaaguucucugcuguucccaauacaacaggguuugacuucuguaggugugcucugcagcucuuucagguuucaggacugagcaaguuucucaugugcaggacggaucuucccaacgugguaugcucaugaaccagugcauuaaugaaacacuccuauguacaucaccuugacaugcucccagaauauauacauaaaggcuuugcaggaagguaaaaugaggccuuuguuacuugcuuaaaguagaagguaaaggcauucagagcuccuucauaggaucaacaccaucgaguuuguuucccucgauaugccacaggauuguaaagaauugacucaagugucuacauaacaaaacagcuuagagaugacaggcuauuugcucgauaaacauuuauauuuuaagauuuguuuugaguuaugcauauggaugugcgucucuguugagguaggugcacagaaggacaguuucucuagggggucagaggagagugucagaucucuggagcuggaguuccaggcgguugugagcauuccuacuuagauccucagaccuggacucauccucgcugaaaggacagcacaagccaucuccacagccucacauuugcauuuuggaaagguaguuagguaaagcaggcaaugcuuaaaugggugaaugaaauaucaaugaggggcuuuagacaagucuguggauucugugcacuggaagagucauauaagacaguuaagguaaccguugcugaguuaaaaaguggaagagaaucaagacuguugggaaaagcauuaguuuuauucaaaauguuaaagcuauaguacuaggucugggaauguuggauaaaaguacaguguucagggaucccgagcagccauacaacaggacgccacugcaugucaccugaaggagcaacagacugagaucaaaagaagauaguccagaacuccauuagaccaucugccagcccuugcaacacacugaguguaagugccaguauaugaaaugguguaucuuuuuaaaaaaagauuuauuuauuuuaugugugagugcacuguagcugucuucagacacaccagaagagggcaucagaucccauuacagaugguugugagccacuaugugguugcugggaauugaacucaggaccucuggaagagcagucagugcucuuaaccacugagccaucucuccagcccugaaauaauaauaucuuaaaaauuuaaaaaaaaauguauacaucuaauacuaaagccaccuauggugauagaagucugguggagguaaccacagaaggagcuccggcacagcaggggagccugcuugcuggggaaagacaggaagccagacagcucccucccgcagugggcaguggcaucauggauagccuuugucauugacaaucauacagaaguagcuggaagcagggaugcuauagaagaacguucuuacagagguugcucucacuagaacuuagaauguuaaugcugaggaggcugauugauggguacccucaaagccaggagcuuacagaucagauucaaaaagaaauccagagguaauucaggagaugccauggagagaagggugagguaaaagucacuuucaaccucauuucaucuaaagccccucucuguuuauguuuugugcacggaacuuucacaugagauagaaaggaagguuucuguggcacaaaaagaagaagaaaggaggagagggaggaggaggaggaggaggaggaggaggaggaggaggagaaggagaagaaaaauguuuguacaaaucacuggccgacuuuaacaucuucauuuuaaagaugcugaaacugagacauggggaagagagauauuuuccuaagaugucaugccagcuggcagcgggucagggcagaaucuuggguauccugacucugcucuuagaauccagggacaacauaaaagucugcaguuaauauauccucuuacaaaagaaaaaugaacugucuuauucucuaaauaguauagcacauguggauugagcuaauaauucuauuaguuacuuacccaccacaaaaacauagucauuaaaaacaucacaggugcugggcaugguggcgcacaccuuuaaucccagcacuugggaggcagaggcaggugaauuucugaguucgaggccagccugguccacagagugaguuccauuacagccagggcuacacagagaaacccugucucaaaaacaacaacaacaacaaacaaaaaauaaaacaucacagguugugucuuauggcuucuauaggucuagaaucaaagcauagcugagcagaguuaggcuggaauuucuaggaucaguugucauuggccuggguuuagaucauaucugaagacuugaguggggaucagccuucuuccaggcuguaccuguugacuggacgccauuucucaggagguucuagacugaagcuugucaguuccaugcugccuuaauaacugcucacauggggcauuucaacaaagccauuuaucucauccaagccaaucacacacacacacacacacacacacacacacacacacagagagagagagagagagagagagagagagagagacagagacagagacagagacagagacagagacagagacagagacagagacagacagacaaagacauucgauaaauggaauuugcuugacaauaaucgcccaaaguaggauuuuaguuuuuuuuaaacucuucuaacuuucuaauuuuuuaacuuucuaauuuuuuuuuucauuuuugcagcacuggccuugaugcccggccagcaagcacucugccaguuuagcuacacuuucuguauucugagaucagguccuagguaauugauguuagucuugaacuuucucuguggccaaguuuucuuggccaacucaaugaccuugaguuuucuccagccuccugcuuccuagggcugggaugacuugcacacaccaccacaccugguuucggaaguaauccauugaacuaauuugaucaugaugauacguguguuauucauuugggggucuagcugugguucugugauacagcacacaaucuacaggauggagcagaguuugaaaugacuaggguucugcaggaucccaggcuggcugguugacucucucucucucucucucucucucucucucucuguguguguguguguguguguguguguguguguguguguguguguguagugggcuggucuuaauguuacagaucuuuuagacgaagaccuucuccaauggucuucaaugaaacagcugagaggacuuuagcuuaugcacguaucuuuauuugggcuggguuuguaugcauuuauucagggugaaccagagcuauauaugggccuuggagagcgggaaggaauuuucaggguaaauaaaaucauuggcuagaguuuaaaguucugugaaugccucauuuguguggagaggcauuccaggaaucucagguacuuauggugaggcuucuuauuggggguggggagaggaaguugaacuuguaggucugccaaggacuacucaccuuucccaagauagaaggugugagaaguuggguuccccaaacaaagucagagaaggggaagcccugcugcuaaugggaguccuccauuuucugcugaguucuguugauuuaaccagucauaguagacauuuacccuaaauuagcaggauuuccucacagacaaggagccaaagaaacaaguuuccuuguuuuacgaucuuucaugugagcugccaucagaaggugcuauccagauuuaagauugaccauccugcuucaaauaaucugaucgagaaaacccucacaggagugcccaguagcuuagauuccagauucagucaaacugaccaucaagauuagccaucacacaaaauauauuuuacugaacguucaagcagugaaaaugaaaaguaccugcuucuuaucacccaucuagguaugauaauuaauuuauaggcuucccagcauauaaauuaagacuaaacuuuagaauuucauuuucuuucuuucuucuauaccauaugcaguaugguguguccucuacugcuguuaugguguguuaggauauccacugcuaugaagagacaccaugaccaaggcaacucuuauaaaggacaauauuuaauugggucuggcuuacagguucagagguucaguccauuauuauugagaugggagaacggcagugucuaggcagacauggcauuggagaagcaccugagaguucuacaucuuguuccaaagggaaccaagggaagacuggucaaucccaccccuuacagugacacauuuccuccaccaaggccacgucuacuccaacagggccacacuuucuaguagugccacucccugggccaagcauauucaaaccaccacauuugguuuaaauauaaaaugcugcugaagguuuguucuuucagugcuuaauucucaacuggagauguuguuccagggacuauagauucuauagucaaagaauuuucaagggcaaggucuggguggcagaauguuacauccaucccugcucccuguuuuuaucucuggcuuugugcuuccuggcuugcaauaugugaguggcuucugacacaugcuucagucaccacaucuucuauauuagucauggcucucaagaaacaagacgaauaggaugaauauauauuaaagaagauuuacuagguuggcuuaccauauuaagauauugucuguaguauaacacugacuguugucauaauggagagccagagaacagguggcuacucugucuacaaggcuagaugccccagaagauccaaugugauguuuaaugucuggaagaauccugaagcaccccuaaucuuuaguccauauugggaagcuaaagaaucugaguccucaugucagugaaagauggcagcaacagagguaauagcggcaacagaguagauacacucaccagugggagaauaaugcaaacagacagaagagaaaucgcuuuccccuuggaucuucucauauacugucaucaaaggaaguucccacacacucugagggagauugcuucccuccuuaauuuuccuaguaaauaaccuuacagaccugccuugaacuucugagcuaauuccauauccauucaagcugacaacaaaaagcaaucaucacaacuccaucccuuguuaaacugauacccaaccacaucuccuuauguuaugcuucaauuccaaaaugguacugccaagcaugcuguaauuaucuguaaaugugcuauaccaccccacccacuacuccccagaauaggugacaaagucuuuugaggagaucuuaguauuuuacugucucacaaauuuaaaauauucucugucaugauggacuacaauucucugaaacagugagccaaaauuaaacuuuuccuucccuaaguugguucuuuuuaggggauuuugaucugaucaaugacaaaguaaguaucacaagucaagcacuucucugccuccccaugcccucuguuagcaaccuccauacucgauucucagugucuuauaaacgagccaauacaagagauuccuacuggggccccaucacaccuuugaucuaaaugacaaguuagaauuauagaggccagaaugucuaugcccaaauauuuccaaguaguuauuuucuacaaagaaaauucgcaucaccuaguuguuauuuaugguuuccuaucguccagaccccuggcccccaagcagacgcugggccucagcuagcaucaugcuuuccacacacagcuuucaugcuuauuuuuuucuuguaaaugucauuuucuauuacauaaaauggcauucucuguuuuauaucuaaaugaucuucuuucuuuaguugucuguucugaugccaccuccuccagguacaacagauacucccauagugugcccuuuugcaccaucccuuauaucaaacuguaauuauuauacaauagacaaacccuucugacacagcaguucucaagaggauauuuguaccugguucaccugaaaaucagcaugauucaaaauuaaucuuaaauaccugauaaagucuuuauuuccaagacucaaaaauccauuucucaugagucuugcuuagaaaaacuagaguuagaaguuauuuauguguuuccagcacuggacaggaaaccauguaggaagcagacuucaaggauuaucuuugcuuucaaggccaguccuaaaaauaacugccaucauuacuugggauuugggaaaagccaguaccaaggacagaggacaucugucaggggauuugagaaugagucagagauggcuguuguaacaagauugaucaaucaccaacuagugggaggaaugaauggucucagggaagagaugaagacaaggaucucuuuguguuuggauauguggaaaaucacaacccauagaaagaaaugaaucgugauuaagaguguggcuucgguaucugagggcucuggguucaaaauauuuuuguuugcuauguaagcuugacuaaauaacugcucuaacuuuaauauguaauauauaacguauaauuuauaauguauaauguaugauauaugauauauaugacacacuuagcaaugccuaucuuagaagaucaugaugguuauuaaauaguauuguguauuacauugcuuccaaaaaacugguaugugacacaaauagugauggucauucauguugaugcugcuuuugagacaguucuugguaauaagaccccacuuggucagcuguucucaaauuguauccuauaaaacagauccuuacugaaagucacuuaaagaggguucuguggcugcuaagucuggaaacacuugacaauaucuuggaaauucaggguucauauagucuuuucagcucuaguuccaaaggcugacaacacaguagcagaaacaauaagguaauauccuagaauucauuauaaaacuauuuuucuucuaugugggcuucuauggcaaaauuuugugugcuggguaguauggaaagaacagaaauccacuugccuggagaauuugaucuuaagaauaaagcaccaauagauuccaugucuuggaaguguccacauacugguucauagauuaagauucacagcugugccuacacagguuggaagagacaaggaggggaggguccauggggcaucacucugaaggacagugaucccauuauagaaagcccuauccacaugaacaguuacuuucuaacaaguaauacuacaauauuguuagguuccaauacaugaguguugggaggauccacaaauauccagaucaugccaugagggaagagaaguuauagaaaggagccagauuaacuccuaaaaccuucagaauggaauaugggacugaggucuuuagacauugguuaggaaucugaauaucccuguuugauuagaaacuaauggaauguuugaugcgaucaaauucagaaucugagaaauucuguccagcucuggugaauccauauccccaaucugaugagaccacugacacccuuauccauaugaaagcugccuuaaaauguguuggaccaugaucuuggaaacgauaccagagcaccaggcuccccagaugcuuaagggaacaguaaauuugcccucacacauuuaagcugacaguaaaaagggcaaacauccuacuugagccaaaacaggcaugcccaggucaggaaaccuagcuggagaggcagagacauguagagugucaucccaauuagcaacucuuucuggcuagggaacccagugagcaaagccagagucuggcagauucuggaacccugucugagccaaagagaacuugccaacauguacccaggagcuaauaaccacuugcaaacagugcaccuuggcuucagugcucuccagagaaaaagugcacgaaguaggagagccagccagagcucaaugaggaaggcagaggucgaauacuuccagaguuacauguggagacuacuuagacagcugcuaggggucugggaagcagaagaugaaggaacuguuucugcacuccuuaucuugucccuuacugagcaguucaacuuguaagguggcacuuuuuuucagaacugaagaaaguguuugaggagccaucccaguguggcacaauaugauugaaaugucccacaugagagucacagugcaagcuccaaaggcugcuucugucucauguucugucucaugacuuaguccuuaugcuucccugugucuuaguuuaacuuccaaacagguagaguaauuugcuccucacuagcguuuuaugucaguaauaaaaucaaugaaaaaccugaagcauaacauuaggcacaagacaaguuuguuuuaaugugugugugugugugugugugugcgugcgcgcgugcgcgcacacacacacacacacacaagcaggcaaacauauuuguggaagucagaggacaauuugacaacuuaggggaguuaguucucucuuuauuucacauuggucucagggauugaucucaaucacguggcuugacaacgggugccuuuauccacugaacuauuccacaggcucacaaaacagauuuauaaacaguaaauaagaaaauguugguuuuauugccaauccagcucuauuugaauauauaacaaaaacuguaauaaucacuauauuccuccaggggucagcaaaaugugauguagaagccuauuuuuguacauuuuuuuguauuagaaaaaagccauguuuguuuucauauuuucuauaacagugccuacuacaauaguaaauuuagauacuuaugaaguugugucuaugcgaccaaaauaccucacagaagcaacauagaggaaaaaggguuuguuugggcucggaauuucagagucuuacuccaggauggcaggggagggcagcucaggacucagccugaggugucagaagcaugcagcccuggcuugcuuaccuggauggcagggagcauaguaaauuagacuggaaagagauuggcucuaaacccacaaugcccaccacccaccuuucuggccuccuucuacccaccuggcccacauucccaaagacuccacagcauccaaauuauucccacagcugaagaccaaguguucaaacugggaacucagauucaaacccuaggagaaagaggugaucugacagcacauguauucucaggucauuuaagaaaauguuaacugacccuuccaaugaguaugccagauuuucaugcaguuuccaguuacugugaccuuggcaagccauauguuauuauacacauaauaagacaaagacagaaaugaaaguuuguuuaauaagucuucccagcacagguagaggcacaaugccaaacucuauacaagaaggaaguguagaagacugauagucacgacugugccccauccucccuuuauuuauuuugcacuuucucacucucuuacucuuuccucuuuccucccccuccaucccucccuccauuaucagcucccuuucccuccccaccuucuucuucucccuuuccuucuccuauggucuuuccuaacccuguucccucagguggaauauucugauuaucccaccauaugcugaaauaaauaacucugcugagaaggaauuuaauucucuuuccuucuuugaagauuugcuuguuuagacauaaaauucugccuccuucugaucacggccacugugauaaaaaauacucggagaaaaacaugaaaggguuuauuuuguucacaacuugggauccauuauuuugggacaguauagcacaaugacgugaagcagcuaguaacuacauuauauucaacaucaaaagaauuggguguugaauuaagggaugcauaucuuguguucaaauuacuuucuuuguucuuauauaguccaggauaccaugccuagggaaugguaccacccaugaugagcaggucuuucugccucaauuaacguaaucaaaacaagcaaacccacaaaccaccucaucuagacaauucauuauugagguuuuucucccccaggugacucaguugugucaaguuaacaaucccaauguaaaauuccaaaagaaaguuugaagugucagggucucugaaauuuucuuauguucugacugauuucuuggcuauacauaguaugaggcccaauuuuccaggacccauugauguuuaaacuccccugucugcuacaucuugcuuuaucauccucucauuuauuaacauucucucuuggccaagcuggaggggagcaggguguucucuuccagcucuagagaccugcuggagauacagacauuaguucacuuggcuucaggcccucuccucaagcccaaaaugguaaauaaaaucgccgugcgcaccccaguuuuccaauuucauucucccucuaugacuccaacaacuucauucacauuaaugaaacugaguguuccccuggcguuuaacuauuacauaaauguuaauuucugagaccaagcaauaaauccuguuucaaaaagaaaaaaaaaacacucaauaggacaaaaggaaccuaaacuuccacagaauaagacagagacaguauccuuuuuuucagauucaaguuguacugacuagauaacuugcugaacugucucaagccugugcuuuugauggcaggaaaauaugaacaguguucucugauugccuaagcuuggaucgugaugaaaaggcauuuguaaucgccaagaaccaaauaaauauacugauuugucucacccuaggcucuaguugcuugagcucuuccauccuggggcuucacccuuuuaugaaagacagguccuggccagguauagcaucauuucuauuguguaaggacugaaaagagagaggaucaaggguuuguccggugccaguacuuacugccccuugugugccaucaaacccaaccugugacguacuucaaacacaaaagaaucaaguaaguuugggaaacacacauaaacgaucuucuuggagguuuccacaaacacauaaaagacccuggaaaaucuugaaauaaaguaagauacguaauuuguuuggcuuaaaauaacauuggcuuuaaaaauagccuucuccaaacaugauuaacuaggaaauaacucuuugcucagcauuaauaccucucaacaugccacagacuacacauuaggaaauagcuuccugcauuuguauggcuaaauuaagccuaauucugaguuuaggcuuaucuuuaucucuauuuucuggcucuuguguaacuucauaaaguuguuuuacacuguuaauagggguuuuuuugggggggagguggcaaacucaagcuuauuuugaaguuaauccuuugaacuuagucaugcaaaccagccuuuggcuucacuaaauugcuggaagaaagcugaggguuaagaaugcugccucuaacugaugagucagaccaccugaauuaaacucuccucuccucuucuagcuaugugaccccaguuuccccauccucagggagaggaaaauaaaggaagaaaugucagggaucuucgagaagaagcaaugaaauaauccauacaaggcacagacaguacagauguuuucaaucaggacugguuauuauuguagcuuuuaggugaucccuuuuugagaaaggaaaaguagacaccaugugucugcaugccuuuucuaggcacacuaguuaauuacuggaguggacucaguuuuccauagugucugguuucuugcuaccaaucuuagagauccauuuuuauuucagaggucagguccuaucaaaguguaucaaggcuggcugaucuucaugccuccuggguuugguaacugccagugucucuaucuggcugcaucuaagagcaaaccucaggccagcagaauuccacucauuugaaugccaagacuguuauuucagaaaagguuuccgaacacucuaguccccaaaugccaaauauuuagcacaugcauucacaguguccugcuccuguguugcucucuaucuauaaccugucccuccugaauaaauagcucuaauucuuuaaccuuggcucaaucguuugagaccuaggaaagagccaacugcauuucuuaaaauucugauggaaauucaaaauagaggaggcuauuguuccaggagaaaugaauucaaauuuguuuuugaaaugauuuucaagaauuucauaggaaucuauaguguugccauuuggucaaacccacuuuuuauuuuuucuuuuaugucuaggcaaggagcagaagagggaaaacuacugcucugcagaaauuuuauuucaaaaauugaaaccagaccaucaggagguagcuuguggucugaauguaucaaugggccuagucauuuuucaucagagcugcucuuagguauacuaaaccacaaauaugaaucucauuauugugucuagauggaaauauuuuauggauuaaaauuuggggacuuaauuugguuagcaaugaaacuucuguucaagaagagggaggaggggagccacaaaauaccauucauccaaacaccugaaaggaaaaaaaaucaauauaauaucuggaucccuuuguauuuaauauuagccauuuugcuuguguuuaaguggaaggcuaaauuugguuugacagaacuauugccaaauugcaacaggucguuacaaccaagaacauucuaaaacuuugguugguuguaucuuagguacaguuuuuaguguuggguauacaccucgauaccacacauaacuugccuuccacauauaacaugaaacccaaaucccuauauagucuauagucuaacuaugcauaacuaaaucaaccuagcauaaguauaaaauagaacugaaacauuucuagacaucaaaaggcaauucaaaagacagaaaggaaaauaacuaacuuccaauaauggauggcauuuuaguuucacugggaggacagauuaagccuguccauucaaguggagcaaaugggcuuucaagacaccaagaccucucuccaauaauaagucagauucugcagcaucucagagguacccaacagcuugcuucacuccacagcagcaccaucagguucugaucaaacagaacagauagacuccccuucagccugcuguuugaaggucagauaggcagagcagcaacugcucucaaaugcuaacuccuuucauugacuuccagugcaaagggcagugaaugaucauggacucagagggacuuggguucacauccuuacuccuuagugacacuucaauuugcacauaugacauaauaauuauaugucucaguuucuuuaucuucaaaaugaagauaaaaaacuuuaucucgcaacuuggaaagaauuugaaaucauguguuuaaaauucuuagcacaagcucuagaaaaauacaagcaaugaaucacucaguaucuucuucacuucuauuaucauuguugguauccuucuccuugaacucucaagaacucuucaaccaguauuugguuccccugggccuuuccuccuucaguaauaccucggugagcuccuuggccaagaguacuacuuccauuccuuaacucuuucacugaggcuggcacugcuacuacucuugugcauguauaaucuccacaugcauuuccauaaugaccucugggaaaaggacacagcucuucacucagucgcuccuccccaguguccuucacacugugaagcccacagugaguaagaagcaauuaucucuggaaagaauuucagcauuccucccccuuucuguugggauagaaccauguaacaugcucuaguuuguaguggcacuugagaguagguugaaaaacaguuacguuuuggacugucuaggagguaguuuuaaguuuuauuacuguagaguucacauuuguuuuggcuacuguuguaucauucauacuuaacuagaggcuugacacacgguagguauuuaauaaggauggauggauggauggauggauggauggauggauaaaagaaaggaggaugaauggaggccagguagaugaauggauggauggauagauggauggauaaauggauggaggucagguagaugaauggauggauugauggauggaugaauggaacaaagacauacagaaucaagaauuguagaaagcucuuagcacaagaguccucucaguuccuuucuggaguacacuucucucuggagaccauuauaauggacucaaguuaagcauuaauggaaacuuuucauauguacuuccuucuauuauuuuuauuuuacuuuugagauuauaauauaauuaugacacuucuuucuuccccuucuuuucuccaggccuucccacauaccccaccucccugcuauccuucaaauccaaggccucuuuuuucacuaauugguauugcaagcauagauauaacauguccaguacuuagcauuauaaacuuacauguauguuucagggcugacauuuuagcacugaacaaccauuucucuggagaggaccaccucuuucauugccagugcauugcuugauuaccuagaguucuuuguguaggguuuaggccucgugggcuuuccauauuaacuuucucaugucuguuguuggcauccuuaguuagcucagauuugguuagccauuguuggugagacuuugugaggauagccguggauauuacuaggaaacacagauuuauaucagacuccucaauucucugauucuuacacucuuuuauccuaucuucuauaacauccccugaaauuuaugugugguugcauuuuacagauauauccauuagggcugagcuccauaacucuacaucuugauugguuaugguuuucuguagugcucuccaucuguugcagagacauauucuuggccuuauuuuuauuauuuuuucuagcuuuacugagguagaauuuaaaagcauugguguaguaguagacagacagauugauucuuaguagacagacagauagaaauguuaccacuuucaagaucauaacuaacauaucuaacaccacacaaaguuacuuuguuuguauaggaugagacuaacaaauaucuucagucuugguaaauuccaaauauacaauguaauauuauagauccauuuuaccauaaugguuuccauauauaaauauauguuaugaugaaugcauauggcuguuugggguaaucuaugcagcauaaguguacaguaggacuuucucagaacugugucauuauuugucugcauguacaaaguauguggguagcacuaauuuaccacuucuggacucagugauccucuccuguugguuguauucccugcucaguuaugauuuugauuuuauaaucugauuucugacugcauacggaaagcacugcgaggcugggccaaguguuuuccauuaagagaacaguuuugaaagacuaaaccacagacagucuguucugaagaaaucgcuggccggguaucauggacaaccaucccaguagcagcucucggccucagaaaagucuuggccaaaguucugaccucccagaaaagagcuccacccaacucauucacucccuuguuccugcuacugaauuagaugaaggcuaagggaauccugggucugcagccacagccuuuucgaucuccuaaggauuucagaaugcccugauaucagacuaacugaaacacugaggacuguaggcucccacagagaaagccacagugggaacuagaaagaugguucaguaggugauggugcuuacagagcaagccugaugacccgaguucagaucccuaggauccauguaaauaaccagauggaaucccaacaguguguaaucccgacauuccuacagcaggaagagaaucagggacagaaucaccuagaaguucauggaccugcuagcaaacugggcucagugcaacagagaagcaaaagagaccuugcuuccaacaagguggaaggugacaauuggcucccagaagcuggccucugcccacucccuguguacacaugcaugcacacagacccacgugcacaauuaaauaaaaccuaaugggaaaaaaggaaggagggagaagagaaagaggaggaaagagaaagaaacaaugagcuuaaggaaaacugaauacguuuggagaaaaggaaggacuucucgacaguaccuuaagaauuuauuuuuggucacaaaguagccuucugcuaaccgccuucuccaaacaagacaaagcaaucaugccuacuagacuuaaggucuaucuucuuuuaaguguuagcuaagaaaguguuuugcauaaauuaucucauuucuucucacaugcagcugguauugauguugucauuauacagauguuagcacagaggccuagacaagcaauauuuuauauccacuuccauagcaacaagguggaauuguguggaauugcugccacccaucguuuuuuaccuaaagauaauuugcaacuugcugugguucauacuaauaagaagaacagagucaagcauauuugucugccucuagagcagguggucccaaacaucacauagucucuucuaggauauuuauucacuuuagcaauuaugauuugucccaguaaauaucuguuucuaugacugccuccuugacugaccugugaccucaguacaaacacagagcuguccaucacuggucucugaaacucucuaccagccuaagucuaucccaagaccuauagcacaucauucaacucaucucuagugggaaaaaaaagaacaaaucguuuuuaagugacaagucucugaggcaaucagcagucccauugauaugcuacuggacaccaaucaagggucuaugauccuaucucaaauagauaaugacuugccgauacuaaaauucagacccucauggcucaggagggucuuuggcuugucaguuuaaguuuuuucugucuauuuuuucacccagaguguccuggauucacucaacugaggggaucagauguccuuggaaaacacaucuacacuuaaggcuauuuccuggcuccuggcucuuccugacacauuccaagaaggaauuuauggcuguugggagggacgaggagugaggaauuuguagaccauuuuagaagccuguguuagcagccccaugcuugacugaccuagcacaauaaaauuuucuccucuguuagccagaagaaaaauuugccguaauaccuuagaguugccaaaaugauguggaaacaaguucauccgcauuugaaaaaguagagucauuguugucuauccgaguccaggauauuccauguauguaccuaagucaaaaagauaaacacauuccaugagcuacuaaucacgaugucacaaguaacuaacacaaagugugucuccagccacauaaggcuauccagauaaaguugauacuugucuaaaacugaaaucauguauugcuuauucuccaacuaugaccagggaaaauauucaaagaaugacuccuuuaucucauaauggucuccagccugugaagagauaacuaaagauaaucuuuaguauaucucaugcuucuuauaggcguugaaguguccaaacuagucaccaacccagucauccauaaagagcaucuacagcagcacuuguucuuuuggguacaugaagacaaccccacaucuccuucucugggauugauauaugguaauacugauacacuccauguuggcuuccucagcuaugaaugaaggagcacaagucaucaguuuccuauaacacauucucuggacucuucauuucuagucacuucccauagauauaagaguccagggcacuggagagaugaaucuaugguuaagagcaucugcugcacuuccagaggaccugggugugauuccuagcaccuacaugguagcucacauccaucuauaacuugaguucuagauuagggguuauuauucacucuucuggccuccacaggcagcaggcaugcaugugguacauagauauacacacaggcagcaggcaugcauaugauauccauaaagauauacauguaggcaaaaacauucacacacaaaauauguuuuuuuaaugauaaucauuuaucuguacuuuuuaucaucuuuguaaauuaacuuguucauccugaaauuauaaaagcacaagcuaucugaacuugacuccccaugucuaaccucuaucucucaaacugcaaucucaacuaauuuccccaaagucuacccuagacauaaaccagccaguuaucugcguguagcagaauauuuuugcauugcuaaugucauuauuucucuccaguucuacacucucuagaguacacauuucuauuucuagcaaauugaucgucacaagguuuaguuucucauacaccagugauuucuacagcuucucugauccagauccaaguugccacugaauuugggacuggauucaacuaaggccaaguucugacuuaaacaaaaagugcuauuggcauagacucuugcuagugugugaucccaagagugcaccacaaugucaugaccuguugauugacuaccuauaaagcaccaaaguucugaagcuccaguacagaccucuaauccauaauucccccuggugugugugugugugugugugugugugugugugugugugugugugugugguguuuguguggguggugguggugccacagaagccagaagucaaccuuaagugucuuuccucaauuuccuccagagccaucaaccuuguuugggggguuuggguuucuuggggguaaggaggugagacugggccuaucccuuggucuggagcuugcagauuccaccuugaagccucggagaucuacaagcauguacuccuaugcccacccuuuuacauagauucaaagaaccaaacucaaguccucaugcuuucaugacaaacacuuuacuaacugagccaucuuugaaauuuuuucugagccuuauuuuauaaacaaggccaggguuguggauugaaugacaaguaucuugcccaaguuauggaaccagaaagggcuuagauguuccacaacacagaagauguggaugaucuuucccaaagcaccacccccaauccucagacaccaugagcugaugugaaagaaaacucucaaaaaugucauuccuccccucuuaacuacacuaugaaauagugucucucuucccacauuauccuuaagucuuccuuuggggucucaaccaacagcucagguguuugucauaaugagagaagaccuuagguaacuuucugucaaguauuuauuucucacauauaagccauuguuuuguaggucuuaaaaugagccagaauuuagcuaggcucucauguuuucacucaguaauuucucaagcaucuuugacagcuccucuacccuaccugaaugucugugcauaugaauggcaucgugacugaugaauaguuagcucagcagucaaaagaacuucaagguacaucuuccuccacauucugucucauuuaauccuccucacuaugucacauccucaauugcuuccuucccacuaagccauacuuugcuauucguuagacaauuccugugauuuucaaagccauaagcaguugacucuauucucagaaaacaaaucaucuacauucuuguuuuucuuuguucucuaaauacugaaaggauuguucuguuuucuuuuuaguuuuguuguuagaagaguccaugccugaucuuauauuuauuucuaccacccacagaacuuugguugcuauagaacauucgguauaaauuuucucgguaccagucaauuuaagaagucacuagaaacuaguggacaacucuuaauuuggguaccugauuccgaagugcauugucacguccuucuaaagcuuagauugcgcaauguucuggauagauaaaucaaggaaaagggaaucugagguacaaagaaaggaugcuacgcaagagccucaugacuagaaagaagcaauguaggaccuaaaaccucauuuuccccugaguacugugcuuccccccucugucuccagugacagagaaacagaagcacuuauuucagcuugaagaauuuauaauuacagucaggagucauugaacaucuccugcagcuacacuucacaggaccagaaaaauucccucagaaggcguggcuuguaaauacugagggacaaggaaugaucucaucgggucagccuucuaacccugccauuggccaggauuuucacuguaaaaagugaaacaagggacaaaguuaaguaacuucccuaagugcucagauccgaagcugcgauacaagccccugccuaccuuuuccuaauguucugccaggucuuucuuuucucuauugucucuuuacauuuucaaagguugagugaguaaugucaaucuuucaaaauugcaagauuuuucuagagaccauuuuauguccucauuaccauauauaguaaagggauaucaagaaaguuucagacccagggggcaagaaggcaaaaaucacucggaauuguggccacuccacaguguauuagggacagugccuaauaacuauuguuuuccuuuauuuauagauccuucuuccaagaagauuggggacauccaacuguauuccuuugaguacaucuaaauaccaaacucuacugggaguucaggcacccuacagaucuagagacaccuagccaguccaaccuccaccaugggggccgugaccuggcuacugccaggcaucuuucuagcuuuguuugcccucacucccgaaggugggguccucaagaaaaucaucaggcacaagcgagagagugggcuaaacaugacccugccagaagagaaucagccagugguguucaaccauaucuacaacaucaaguugcccauggguucccaaugcucaguggaucuggagucagcgaguggggagaaagaccugacccccacgccagaguccagugggagcuuccaggaacauacaguggauggggaaaaccaaauuguauucacacaccgcaucaacaucccccgccgggccuguggcugugcugcagcuccagaugugaaggagcuccugagcaggcuggaggagcuggaguugcugguaucgucucuaagggagcagugcaccauggguacaggcuguugccuccaaccugcagaagguaggcuucccagaaggcaacaggguucguugacccugucucugcaccaaugagaagauggugagcuuaaaggacuccaugagugauuuuuuaaagcugguuuccugggaaacuagacagacaagguagugauuucaaagagagacagagggagagauuuuaaggucaaggaaagguagagauuggagccauuucucuucuguucuuggaagaguugugcuaauaauagcucucacacuaauuuccuagcauuugaaaaaucuguuucauaaagcucuguuucacuuaauuauaucuguuggauuuauuggucugaagagugagcucagcaguuaagagcacuugcucucccagaggauacagauuccaucaccuacaugggcacucaaaacaucuguaauuccacucucagggaucaacacccuuuuagauccucagcguacaccagccauacaugcaaagaacucagaccuaugaaaugauaaaauaaauaaaucuaaauguucuaagauuuauuuauuugauuacuuuuguguauauauguuugugugugaguguguacacauguguggguauucagucaaacacucuuauaaacgugcacuaagggcagaagaaggccuggacauccucuaucacugccucucaauuccucugaggcagcauccuccuugaaccuggggcucacauuuucucggcuaaacuagaaaccagcaagccccagugaugccccugucucuacucacaugcaagaugaagauacaggcauacagucauaggagcugggauuggaacucugcuucucaugauugcacagcaagcacccucaucucucuagucccuacuuuaauuuuaucuuggucaaacauguuuggcucugaaauauaauuuguaguuacccuaaaacaucugagaauaacacagugucccuccucccaaaggcaucucucaaagagacugcuguguagccuuaucaacucacuguacaaauagggaaacaaaggcccagaggggagugagguucuccagguccuguugaguuagguguuaacacagucuuccacaguccuguguucuuacaauggcccauuucugccugggugguacugagccugugagaucaggaggagaguauucuaacgugauggaacaaacacagcgugauaaugggaagguggucaggucagagcugcccacacagccaccuguauguaccagacacaguaacuuucuucugugauccucccaacaacccuuuaagguaaaguuuaacaucucuaugugaaucuaaaaacugagguuuuaaaagucgaccaaauuucacaggaugauucagugauaaaggagaacacgcauagacuuuggaugugcccgggaacuucacucucucuggaggacacucgggacccuugcacaucuauuccaguaauccugcugcuuaggaguucauuauauccccccgccccaccucccagaauuccagaggaauacaaaagcauuaacuucaagucagaaaugaguaucuguuuccaccacuuagaaaauacuaucagaaagggcauugauaaugauguugagaguggaccugacuaccauaugcagggaguacugugggacucuaggcuucuaaggcaauuuucaaaaguuuaucuuuauuaauaaaucaauucauuuucucucugucaacccccuugaggaaacaugugucugagaagaccugguggguuuaaugucaguguggcuuaaaugugacugaauuccaucucauuuuuuccacuaagccucugcucuccacccaguugaugccuaggcaugcagcugaauuugagugagggcuuuuucaugugaguaccaaaagccagcucugauguacccagcuaaauaccuauuaucuucaaugcaggucgucuggacaccaggcccuucugcagcggacggggcaacuucagugcagaaggcugcggcugugucugugaaccaggcuggaaaggccccaacugcucugagccugacugcccugggaacuguaaucucagaggccagugccuugacggccaguguaucugugacgaggguuucacuggggaagacugcagccagcuggccuguccgaacgacugcaaugaccagggcaggugugugaacggggucugugugugcuucgaaggcuaugccggcccugacuguggccuggaagucugcccagugcccugcagcgaggaacacgggauguguguggauggcaggugugugugcaaagauggcuuugcgggugaggacugcaacgagccccuuugccucaacaacugcuacaaucgugggcgguguguggagaacgagugugucugcgacgagggcuucacuggcgaggacugcagugagcucauuugccccaacgacugcuucgaccgcggucgcugcaucaauggcaccugcuacugugaagaagguuucacgggcgaagacugcggugagcucaccugccccaacgacugucagggccguggccagugugaggagggacaguguguuugcaacgagggcuuugcaggagcagacugcagugaaaagcggugucccgccgauugucaccaccguggccgcugccucaacgggcagugugagugugacgauggguucacaggggcugacuguggggaucuccagugucccaauggcugcagugggcauggccguugugucaacgggcagugcgugugugacgagggcuauaccggagaagacuguagccagcggcgaugccccaaugacugucacaaccggggucucugcguacagggcaagugcauaugugaacaaggcuucaagggcuuugacuguagugagaugagcugucccaaugacugccaccaacauggccgcugugugaauggcauguguaucugugaugacgacuacacuggggaagacugcagagaccggcgcuguccccgggacuguagccagcgggggcgcuguguagacggacagugcaucugugaggauggcuucacuggcccugacugugcugagcuuuccugccccagugacugccacggccauggccgcugugugaauggccaaugcaucugccacgagggcuucacuggcaaagacugcaaagagcaaaggugccccagugauugccauggccaaggccgcugugaggacggccaguguaucugccaugagggcuuuacgggccuggacugugggcagcgcuccugucccaaugacugcagcaaccaaggacaaugugugucaggccgcugcaucugcaaugaagguuacacagggauagacugcucugagggugaguaucagcaagcuggccugcaaguggucaugaugguguauauacgcaaugccuaucagagacagauagugggauuuaucaacauaccaauucuuuuaaugugcccuguuaguauauuccuguuaaacacacacucuuuuucugacccuaugagggguuuauacucagucucuuggcacugggcaacuuagaucaaaggcucagagaaguaauacuguuguccaaaagacucaaaugauacuuaaauauuaucuaccucaacuguauugaaucagccauucauuguccuuuacuucguaucaguuuccuuucuuucucuacucuggcuaugaaccaacagcaaacaaaguucuuccauuugaauggaaaugauaauucccugggcucaacagacauuucuauuaaauaagauuaacuuauuaaugcagucaacuaaagaauggucucugguuaccugggaaccagaccugaugcguuuggugcuauccuuauccaaggacugugagcaucucccagaauacuguuuccaggaguuaucauaagcauaggcauauaguauguguucaagaaacauugacuaaaugaguacacagcaaagaacaaaaacaaacaaaaaaaaaaaccacucaugcucaaugaccguuuucucuucauuuuucucgcccucauaucaugauaaagaacaucuuacaaagguaggcaggaacaaauaaauagccccacuguuuaguaugucugaacugugcaagcuuaguaaagacauguggguucuaaaccugauguaggcaaccacagggaaaccucuugcccuuagucacagcuaaggaacaagagagucugguuagacaaacccuauaggacuaagucacaggggccaggcugaggugauaguuuucuauacccugguauaacucugagcuaagacccagaaaguggaaaagugucgaacacaguguugaaagcaacacuauuggccagggacuucaacauaaaggcaaugggcuaauagauuacaaagcuacuucuggugguaaaggucuguaaacccagcuccuacagaggcugaggcaagaagaucaaguucaaugccugccugggucacauucaagauaagccuaggccagguggucaaaauagauuggauggcauucucagagaacuaaugaaaauguuuuuaaaguaaaaagaaauagaggaggagaauuuucuuauagggaaagugacagaccucuuuuaaauacuuuuuagaguauuuuauuuuauuuuauuuuauuuuauuuuauguguguuagaguuuaccuugaauguauguguaugaaccaccuguaccugcagauguuaaaaaagggcaucagagucccuggaacuggaguuacaggugguugugagucauuacuuggauacugggaauggaacccugguccucugcaagaacaaaagugcucuuagccacugcguaaucucucuagccccuugacugacagaacuuguaucuaguacacucaguagagcucuggcugaguccagaagguugggaacaauguguuuuaagaacagacaacuucagaucucuauuguaaauagcagaagagacuuaucaagggaguuaagccuauaggguacuacacgaauacucuugaccuccaauauccuuucuuauuccucucaguguccccucccaaagaccuuauugugacagaaguaacagaggagacuguaaaucuggcaugggacaaugagaugcgggucacugaguaccucauuauguacacacccacccaugcugauggccuagagaugcaguuccgugugccuggggaccagacauccaccaccauucgggagcuggaaccagggguggaguacuucauucguguguucgccaucuuggaaaacaagaggagcaucccugucagugccaggguugccaccugugaguaggcagaggauucuggguagacucaccuagccuuggccaagcuguguagcacuaugcauacuuuaagugcccaauauauacuaacacacuucacccaaugagacagaagcaauuguuaaccccaugugcagaugaggaaacugagaccagacaguucaucaucuccucucaauccccacagcuaacaaagauggaguugggcuuuacccuggaaagucuuaggagauuagaucuuaaucuucuuaucaccauuguguggaguucuccucuauugaccucacugucucagguuauuccuuuaagagucaguacaauuaccuucaugccugagaagcaaacuguggcuagaaacuggcccuuacuugcuaagcaauaacagcauuggccuuuccuuacugagugugcacugcaugccaagagcuaggccagcagacuucacggaauguauuacucaguccuuggugcauaccugagggaagacacaguuaccaccuucucccaggaaaagcaaugaucucagagcuuuguauaaaucuuguccaaagucacaguguuaucggugguggguuagaugcugauccagguccaucugauuccaaauccuauguaugcuuugcuaauucaacaauaugaaaucauaaauaagcagucauaugauuggucauaauaggggcauucacauuuucucacaguagacugcaugccagaaaagccuuuaaguagaccccagauuugguuacuagccucaaagacagcugucugucacagguuuaguguaucccuagcuguguggcuaccuaggaucuugccuuuccuuauauccuauuugugcuguuacuuacagauuugccugcaccugaaggucuaaaauucaagucuaucaaggagacaucuguggaaguagagugggauccucuagacauugcuuucgaaacaugggagaucauuuuccgaaauaugguaaggggcucccuggaggaagucuuugauauaggagauucacaagguggucaaaggccccugcugcuucuuauguuacuugguuuccuuagcuuuggguggaagacugggcacuaucacuuugugugaucauuauguauuuaagugauguuaauuucuucccugcuguuaauaaauagaaaaguauagcauuuagagaugagaguccggacaaacacaaguuaaaucaucgauagguaccaacuugcaaaucucuauuugggauaacagaaacagaaccagucugcccuauacaguauuuccuggcacaucucaaguaugaguagaucuuccuaggacacaaagauuagguaaaucgguuuucugguuauaacccaggcccuguccccaauuaucugggaaagcauugggcaagccaccaacuuaaaacugcugacuuacagaaggaagggcugaguuacggaucucacagggugccguuugacaggaacaggauaagugcaggugucuacaggaggaauaaacaaacucgagaagcagcguucucaucucuguuuucucagcaucuaaccucccaaucugcugggcuacauaggaggguaccuaaugaauaaauuaaacaagaagcagaaacaagugaagcauaaagaugcauggcugucccugccucugaaucuuagcccuuuguuguuuccauccugcagaacaaagaagaugagggagagaucacaaaaagucugaggagaccagagaccuccuaccgccaaacuggccuugcuccuggccaagaguaugaaauaucucugcacauugugaaaaacaacacccgaggccccggcuugaagaaaguaaccacaacccgugaguaccagccaagaccugugauagagcugauugugucucuuugcaacuucuggcuuauagcauacccucugacacagcaucugcaucagugagaauuugcuuaccaauacaaaguccauauggagugccuuaagugauaauucugcagguuugcgauuuggacuugggcucagcugugugaugcuuguccuugacugggaucacuugugcaucuuugugaacugagacuguuuggccuagaaugguuccaguuaagacagucaccuguaauccuugcacucuagaagcugagacaggguauuagcaugagucauggccauccuggacuccauggugacuucuaggaugauauaagcuauggaaggagacacugucacaauaaaacaaaagcaaagcauaaugagauggcaauuuuuuuuuuuuauccuuggagccuccuugucauuggguuagccggggcaugguggcauggcuguugaguagacucaaaauugacauuucugucacugcugucagaggaaauucucaggccaggacacaugggagagacagagaaacagaugcauccccucucugaagcuccucaaagguauauucucaggacuguagaugcagaaaagguaaccauggagacgaucacaagucaucuaccacacgagcucauuuaauccuaacaccaagucucccaugacagaggugagguguauacggaugguacuguguaugaaaacgagugaauacgccuuggggaaguugagucacuuuaacaugauguaggccagacagucaugacucaagcacagcugagaaauggagaaaagaggauccccaaggcuugcugaucaggucaaggcuagccagggacccuggcucaaggaguaaguuggacaguccaaggaaagaugccuaagguugaucucuggccuacagauacauucacacauacauauacacucacauacaaucuuucacacauacacacacacacguacaucaaacacauacucucauacaugcacauauaaacauguauacucacauauaaacacaugcucacauauacacucacacacacugucacagucacacagauacucacaaacacacacaacuuucaaaaauacacauauacucaaacaaagucucauagauaauuucaaauacacacacacacucacacucauacaucuuucacuugacacuaauguccuuagaaauucguggggucaaguaggauuuaauaaacuagagacuucuaugggauauaacugaauuuagaauuguucuaacaguuuuguucuuuuuaaaaaacaagauacaggagaaauggagaaagagauccugcauuggcauuuagaaggaaaaugucucauuuucuucaagagaacagaggugccagcucuuuaagaaaucaacucugguuggcagggggugcugggaaaguuaaaucuguugacacaugacaaaaaggaacaucuugcacuuagaugcuugcacguuuugcauagcucagggccaguacgcaggacugucuccuucauaagcaaauguuuuccaucauccugacaacagcucucugugguagguaggaggcagguacugacaggaaaaaaaucauuagaucaccagcaaggcagagaaaagaucaaggaaaugcuuauccacuguagggaaaguacacugaagaggcaggugacuuuuaccugcccuuuccucuuuaauccaaauuauuuaaggcuuggcugcuuuguauucugcuuauuaagggacaaacccccagccuuugaaguuccagaauauguaaauaccaacguugauggacgugcacuucucuguuccuuuugugaccauuuuugagcauuuuugcagaguuaaaggaccuuaauuuuuuggugcaaaucauguuugaucccuucucccuggcaccucauugagguuuacugugaucauucuagacacaaaaaaaugcugacaagauccaucauccugugaugaugaagggauguggugguccugaguuuaaaucccuuccuugccauucucuuucacuuuggaacauccuacuucuuuaagccuuagauccaacguuuggaaaacuggguucauagcaucuuucucaucaaguugucuuaagcucaaggcacagauggcacaacaccaugggauguggucagcagagaguuaugucagucuucacuauuccgaacacagaguugggguuaucaguaucccuagccauacccuuagcaguguaaguggguuuguggcugacagcucugagaauggaagacagugucacugucuagguaauagcaucauuuucaugauguguuuuguggauucauuaaauacuagcugacacauaaccacuuagacuucaaaaaugaacaacacagcauccucacaaucuaucaaaaacuugguccuuuucccauacucugcaugaauccuggcuacuuccauuuaaaaacacuuaguggauggaugcuaaaagcauagacuaaacugcuuuuaaagauaaaaauaaacuuauacauuaaaugcccaggaugaccugaggaucgugaaggccaaacauccauuuucugaaugaaugaaugaaugaaugaaugacccagucuaaauguaaccuguaaggguccaugauuugcugaagaaugacaccccagacucaaauaguauguaaagcaaagaguguuuuauucugcagaaguacagcaugauggggucucccauuaccaaauuagagagacaaccaagugagcuugcaggcucaauuuaaaacacauuggaguuccagggcagaugagcuuugucuuacgcugucuuuaggcauucuggagacauuaucagggagugaagcuuggccauuuuucuucccucuuaguaauugacuggcuugggcuugccuggacuugcccaguucuuaggccuagucaacucaucugccaauuuggagucugucaugcaaucagccuagccuucucaaccaaacuguaaaaacaucugugacaagacaaugagcagcaguagcuacaaggaagaggauguauguacccuacagggaagaggaucuguguacuguacagggaagaggauguguguacccuacagggaagaggauguauguacccuacagggaagaggauguguguacccuacagagaagaggauguguguacccuacagggaagaggauguguguacccuacagggaagaggauguguguacccuacagggaagaggauguguguacccuacagggaagaggauguguguacccuacagggaagaggauguguguacccuacagggaagaggaugugugcacccuacagggaagaggaucuguguacccuacagggaagaggauauauguaccugguugacaugaaaggcaaagaggaaaaggaaaucucaauagauggaacaaaagaauagccuugucgagaccaggaggugaggaagcaugaaauccagguguauggggcaggaagugaguuuaacaggaugacacaggaauccccagaaugaggacaaaacaggccaugcuugaaacagaaauuacucuugcccugguuccuuucaucaaaaacauuuuuugaggcuggcucgguggcucaguuaggguaagggagcaugucaagccugauaaucugaauccaaucaucaggucccuccugcuaggaaagaaccaaccccagaagacguuuuccucuaaauuccacacgugggcuauacaaagacaugcagcacucacauacagacacacucagaaauacaugcacaaagagagacauguaugcauaagcaacacauauauagacacacucacacacacacacacacacacacacacacacacacacacacacacacagacauacacaacaccagcaaaggaaaggcuuucaucacccaucaccuguaugccagguuccguucucgaugcuuuauaagcuuucucuguuuuacuauuggaaaaaugagggcaaaagcccuccauguagaucuuacagucccuccuuucagcuugccagacagaaacugcagcucccaagggcaaaagaaaguaaggggucauuaugagucaaaugucuacuguggucugcugcaaaguccccacuacucucaaccccuucugccggcauugacccuuugguuccuuuguuggucucaggccuggaugcccccagccauauugaggugaaagaugucacagacaccacagcacugaucaccugguucaagcccuuggcugaaauugauagcauugagcucuccuauggcaucaaggauguaccuggagaccguaccaccaucgaccucacacacgaagacaaccaguacuccaucgggaaccugagaccugacacggaguaugaggugucccucaucucccgcagaguggacauggcaagcaacccugccaaagagaccuucaucacaggugaggaaagggcagaguaccaauucugccccacuccauccaugaguccuccaggcccauauagcacuaaagauggucgagggccuuuucaucucugugcauucauuuuagauaauaauuagugacuuuuucaaagaaagggggauuaaauaaccuuccaaacauacccaggcacaggcaaacaugugugcauaugugugcauguaugugugcaugcaugauagagagagaaaugggggaaagagggagagaaaagagaaaaaggaagggcuggucugauauucuuagacaacauuucugguuaaaguuuaauggcucaguggguaaaggcauuugccugacaucuuagcaaauggcauuacuucaaaggucaauuauauaucccauacacauuuugcaggaguuugguagcaccaggugaucaacacuaaguuauuaaaaauacauugauucaacagaacaguuuucauauccacagucuuauguugggggcuuuguauuauuccucagacacagaaaaugaaaucaauguagccaauugaaauuaccaccuaccaauccucaagaaaggaacugggacugugcucuuuaacuuugugaaucaguuaccaagacaggggcuucgggggaauucugacauuucuguccauuggcgggugccuuuugaaucucugauugaaaugucaaguucuccugcacucaucaaaccuggcauaaugcccaucuucccuuucccuccuaaacaggccuggaugcucccaggaaucuccgccgugucucacagacagacaacagcaucaccuuggaguggaggaacgucaaggcagacaucgacaguuacagaauuaaguaugccccuaucucuggaggugaccaugcugagauagauguuccaaagagccagcaagccacaaccaaaaccacacucacaggugagccgugacccagcggugcugugccacaggggcccucgaaaggacaggagcauaugucccuauuuugcaacccuguagagauuaugaaauaggcccagcuucuguccauuccucucacugucacugcaucaugugaugagcauauacaauucacaguggccagaagccagucuggggucacuuuuaaagucuucugggagccugccuucuacuagugcccaaccuucacauucucuuccaggucuaaggcccggaacugaauaugggauugguguuucugcugucaagggagacaaggagagugauccagcaaccaucaaugcggccacaggugaggugcauggcaaugcuaccguugcugaaguagacugaacaggaaaggcaggacuggugagaaaagucuaucuacaaauucaaagaaugagauuagaggagaaaugggccucuagugccauggagcccagaugucuacauuuaaaagaacgaaagcagaacucauaagcucacuccuaagggaacuacccuagcacaacucucuacagaggaaagagaagaaaggaaaauuggaagcaaauauuauaguaugccuguuuuuaguugucaacuuauucucuuaaaauaagccuguuuaauugguacauaugugaaguuuuuuuccccuuagcuucugagaaaauaccucccuagggcagauaguuaaguaaccauauagauuaacuacagcaucuacuacagcauccugguucccguagcauccuguagugccagccuugggugaagauuaccuagggcuggauuggagacuguuguuuccauccugaaguguuuuucugaaaaaaaucuacuacuagauacaucacagcuuuagauuucaguaguguugcacaguguguauguguguguuucugugugugugucuguguguaaaugugucuguguauaugucucucuguguguauguuugugugucugugugugugucuauaaaccacugcacauuauuuuuaauuuucuccaaaucccaaaagguaguguguaacaucuccugucuauaaaaggugaggucagucaggugacugcccugcaguuacaggucuccucagggcacacucagcuccagaagucccugugccuggcagccuaaagaugucucaucauucucucuccagaaauugaugcacccaaggacuuacgggugucugaaaccacacaagacagucugacguuuuucuggacgacaccccuggccaaguuugaucguuaccgccucaacuacagccuccccacaggccagucgauggaaguccagcugccaaaggaugccaccucccauguccugacagaccuggagccagggcaagaauacacuguucuccucauugcugagaagggcagacacaagagcaagccugcacgugugaaggcauccacggguaagucacccugagcucuaagcccucugcuaacucuggguggcagcuuugagucugccaggcuugucaggaaugugaugcccagaggagaaauaagcuccuuucucuccuccuggagcucucugccacacugaaauggcagcuuccuugucuuucgugaagauugacguuuuucuccugucagucaacugauugaaccaaauugccucauggagaaacgcugacuucuaagcaacacuaacuaggagaauguaaauagggagcugugauugucugucuugucucuuguugcuguuucauuugugcuccaugguauucuagaaauuucccauuucuccccuuuaaucuaaugacagcuuuacuuuucauuguuuuaaagaugcccaggauguuggacgucauuauuugaacaucuuccuaggaguguuuuuauuacagcucucuugcccuccucaggauagcccaggagaacggcacuuggucugaaaccugccacgcugccuucucacuuuauuucuagucaugaagcgucuucuggcucuccuugguugaucccaggucccuuuuaguccuauuagccagcuaaccuaccgacuuucucuccugucacuuuaauucacggacugaacugcagagagaaucuggagauaaaaaugguucuuccuguaugaaaaaugacacauccaauuucagccaugaaguuuucaagaucguuugaguuuucacaagugacagacuuagcuucccauuucauuagcaugcaugcaggcaugcagcuaccucaucuacugcagugugcugcuguuugaagaacgcugugucacaugaccaucauagccugauugacucccacacuccguagagucuuuggagaaaacuagaagcugggacuaucagagaucaggauguucaggggucacuagcgcuggucauguaacacagaagucacccagcugacccucagccaucugaaagagaaugacaaugaggcaauuuagaaaugucaugcagggcccaaguuaucuauuaauaucuucaacugaauacaacagaauuuucaaaugucagucuccuccauuaaauugaucugccaccaggcaguacaagagaaaguaaaauuguuucaaauuguucaggauccagacuccuucacucuuucucuuccaccauuuuuuuaggguuuagcuccgauucucaaaauggggucaguaucacuacauggcugcugcaauccuccaucauccagguucuaggcaguaggacggagauagagucaaagcuccaacccauggcucuuucuagagauuguaucaauaauuucccuguauaucucauuggcuguucuuacauaacacgagaaggcuagucuccuaucagaauagccacuguaaaguccacaggcauuuugaaggaaaacagagaaauuugugagacaaaaggacagucuaagcaaguaagaaaugagugcagugguuaauucugggaacagugcagacugcucccuccugagcuguagggugcugaggcuguccgagaagcuuagaaggaaaaguucaucaaagauagggaaauagaauugaaacgaguuagcuugaauaacuuguauaaucuacccuugcaugaguuuauuauugugugccaaaggcauuaaaaaaagggagaaccagaaauguaagaagaaaaagaacucucuccuuguuccuccucucccucuucuacucuuuccucuuucacaaagcuccagaaggagggaccccacccccaucuccccgcaucuccagaaucaaaggcagauguugcaagauuaacauuucuuaugcugguccuccugcauuuucuccaaggaagccccaugcuccagccacagcaguggcccaaguccagaccuccuccaugagguggcaccauauugaaagcagaguuaaucuucuuacccuucauuccugugcuccauaaaaaaaaccaaacuuguacauaacagcaccuuuccaagggcuggguggccuccagagucuggcuucucuggcuuagcuuccacuauucauguccuuggccaacacaugacuguccccuuguauguuugcugagccugccuccuccaccaggccugugcucccuuuguuauauuccuauucuguccccuguuuuccacuuaucauuugcucuagucucguccauuucaagugcuauucaaaccaagggcauucucugagcaagcugugaaacauacacccccccccagcccaccccugaugcugcuccaaggcuucguggcuacuuaccaacuugagaaugggcaguaaccaccucauugucccugaccuccacccacccgugagcagauuguagggacaaucuccuuugucuacugcugccugcagugccuggaacacauccaaagccagagugagggucaggaacaucugcagagauccagcugcucuggggacagcauugccacauuuuguuuucuccuuuuuguccuucucugcuguagcagcugucuagcacccuucaggagcaaggggcaagguaguuauucccuaggaauucuuuaaguuagugcaauauggaugacaaaaggagagagcaugaaagggggagggagagagggagagacauaaaaggggggggguagaggcaaggccugcucccauccagcacagaaggccuguguguuucagccuuguucucuucugcucccuccuccuaacucucccauacucuucucuccuccuucaguuuuuccuuuucucuuucugcuuuuacauuccuguuagcuaaacucugccuaaagccaaggcuacaaauucacuggaagcaauacaagacauaaaggaggacaauaggcaagagccaagggccaugaggcauauuuucacagcaaccuaagaacccaauugugucucgcaugaauuugggaggcggaaaaaugaaauuuuguuucuaaccacagcuucaagcguuaaacaacacuucgcucugauuuaccauuuuacuuuucuauggaguaaacugaaguggauucaaauaguuauccuuucaauguacauuuauuuauauaauauaugaugaccacaugcuaagaaucagacagaagagggggacauucgggacaaagagaaugagaaagagugcacugcagugggaaagauagaaccaacaugggaagaacguaguucugcuguuacagaggcauggggagucacaggaggacagaccugauccucaucacacaccugaaaaagagaacaaaaggcucugaggagucucaaaagaagagcuaccuagaugaguccuugaggagcaagaggaggcaagguucggggagagugcaguguccuucccagcagggggaauagcaucugagaggcuuagagucaagggauguucuguagucaucaaacaagcuuagcccugcugugugucuaaguagaaggacaguauuucuaaggcuucaggccuucuggaacaggugcaaagcacagauguucagggauuuuagcuuuauucuucauagcuacuaagaaccaccagaaagcuccaaggcagccaagacuucauauuucagguauuucauucucuagaaaaugaguuuggugccauuugaaguauucuuguagucuuccagcuugcauugaauucucugcuugcugugggagaaucacucucucacauacaaagcacaaaaagagcuucgggcucugcauccugccagccuaugguaaccaccaucuauacaauggugggaaucugaagggaugacgacauggccagaaauuccuuccugcagcugcuuggcccaccaugaguucagaugacaggagauuuggaaauucugacuuccugggcccacuggcauuacucagaggguaaauuccaaagcccagcuggaagagaaugacaauagccuuuucacuguggccuguaggaaagcuagggugcacacagacaaugcagugagcccacaaggaugucauucacccugaaaaugaggacucagcacuuauacacagcuuugcaguccacaacugccugcucugucuuuauucagagcaccccuccaucccucuaaguucaucgguggaaguuucaucuuucauauaugugagcauguguuuagggucagcuuagugugaguggugugccaacagcauccaguguagauaugaguacacaccacuuacauaaaggaaagcccuaucuguauccuucuugaucugccugugaaaagaaagggggaaagguggaggacuagagacccaaacaggauggaaucugagucccaauggagacagcauugugggauaguucucucaacugagggaagagguguggggggucaugaagcagaagcaccagagacacaggcaaaaacugaagugcagagaugaaaugagucucagaagagcucagucuaaugugcugucccuccacucuuuguaccugugagcauuuuaacagcuuucccugugaugaucuauaguacccuccucccuccuccgcauuaggcaagucuccuuacuuuaugcagccucaaaucuaagcucuuuucauggggaacaauaugauuaaugucaccauuagagauaaggcuuaagauaaauuccuggaaagaaaagauaguuacuuccucuucaccaugguauaaauucucaaugucagugaaguuucugauuagugguuuuagacagcaggagaaggaaauuuuuuucuguuuuuuuuuuuuuuguuuguuuguuuguuuuauuuucggccugaccaguacuuuccccuuaucccuacucuacugaagugguuuguuaaaaccugaccugaaacucaggaacugaaaaguccaaauuaaacuauaaugaccuucuaggaaaggccaaggcagcacaaagagaaaagaaaccuaagcagaucuaggaggcugcaaaaugcagagcgcuggaaaaagacccaagaccaagcugagguuauuccguguagugaaaaaccacucugccaacuggaaacugaggcauggagccucguuaacagaugagaauagucuucucuaggauacuuguaaacaaguaaacauauuuccaaaaggaaauucaacuguauaaaggcaagauuaaugcuacacuaaccaguuuauugcauuuugugggacagcaucgcugggcauacagugacagcauccugguacuggacucuaugggccuuggccaauggauuugcuggguucuuaaaaggcaagcauuugaugaauaguguaacugaccuugucucuguuauuguuuagaagaagugccuucccuggaaaaucucacugugacugaggccggcugggauggccucagacucaacuggacugcagaugaccuggccuaugaguacuuugucauucagguacaggaagccaacaauguggagacugcucacaacuucacaguaccugguaaccuccgggcugcagacaucccaggccucaagguugccacuucuuauagagucuccaucuaugggguagcccggggcuauagaacaccagugcucucugccgagaccuccacagguacuuucuuccuucauaucuaaagcuucuguuuuucucaacaggaaacugaccaaggauaaucacgcaucauugauuuuagaauggccuuguucagccacaagcugaagugacaugggggucugaugguggauagccaggccaucgcgugacauaguucuaaggccauguuaacauuucacauaaacaacacauugcugcuguauggaauccaucaucugagacaguccaaauaaaccaaggauggugaccccacauuaaggacugauuaugugcuagaguccaaaggaaauuagccacagaaggaauuccugaauucucugaaauugauaaacuaagaaagcaaauauuuccccgcccccuucuucugcucuuuccaagguuuaagauguuacaugaagcauguuuaucuaacaaaugucguguuuucaggggauguaaagccugcccuuggguucaggauuuccuauaucuuacaaugacuuuuaaacgcauucuuuguccuucucuagggacaacucccaaucugggagaggucacuguggccgaggugggcugggaugcccucacgcucaacuggacugcuccagaaggagccuauaagaacuuuuucauucaggugcuagaggcugacacgacccagacuguccagaaccucacagucccaggaggacugaggucaguggaccugccugggcucaaagcagccacccgcuacuacaucacccuucgaggggucacccaggacuucggcacggccccucucucuguugaggucuugacagguauuuuagaccgguucacuccuuuucuccucucccugucucugcuuaagaggaaucccaucucuaaaugagacuuagacccuuccauguuggggaaauccuagugaaucacuucuacuucaauaucuuaucccuuauuugggcagguccugcucuuagucuaguagacagcuccagacaaaauuccaccuacucuucuuuuucaaaagugagaggugacuucucucgaaaaguauguuucaaauuauaauaucuaagaaacuugaaagcaaaauuuguaagugaaaaauaaaaucacucugagcucauuuuacaaauacucaagagcuucccauaaaccuagugguauaucaagaauggaaguuuugagcuccuccaaaaacuaccuucuauucccaaaggcugaaagaaagccuuggcuuuaauucuaacaauuggagugugcucaguacugcaguaaaucacacaucuguagucaauacaaaccaaagagcucaucucaacuuuagucaaaccccaucucaccugaaccccagagagcaguucccuuuauaguaacgucaucccuguguauucucaugcagagaagguuccaagucugggaaauuucacagugacuggacugagaugggauguucucaaacuggacuggaacauaccagacagaacuuaugaccaguuuaucacuugaauccaguagaauagccaggcagaaugggcuggccuuauuauuccuggucgccuguguuccuuugaagucccaggccucagggcugguacucccuacacagucacccugcacugcaaaguaaggggccuccauacuaaugcaccugcuguagaguucaucacagguacaugaccauucuggacuggauuuuuauauaugccagucuggcuguucccagaauagcaaaacucccucauagguaggucuugccugaauaugguuugcaggcaacaugaaacugugacuuagcaggucuggauuagaauucuguaguacuggcuggauguuuuccuuugcaucucugagccuuuuuuucuugccauugaaucaaaaaugauacccugcuuuaguauccuuccaugagcaauggauggacuaagaaaugaaagggcuugacaaaauguucaucaucuagccaguguugaacagcuaagugaguaguuguauuauucagggucuucuagagaaacaaauuauagaaugaauauauaugagauuuauuacggaauacauaugggauuuauuaugaauauaaauauugaauuuauuaaaauggcuuacaaacuguagucuagcuaauccaaaaauggcugucuaccaacagaaaguccaagaauacaacaauuauucagucaugagacugggugucucaccuguucuuuaguaugcacugcaauccugaauacacaggcccucaugccagaaaaagaauggacucaccagcaagagugagaguagacagacagagagggagccucauucuucuguguguuuuguaaaggcugccaguuucauagagguuaccagcagaagguguggcccaguuaaaaagugcuucuuccuaccucaaaaaaaaaaaaaaaaaaaaaaaaaaaaaaaaaaaaaaagcuggauuaaagauauaucuuccugucucaagagagcuggauuacaagugggucuucccacuucaaaugauuucaugaagaaaaaaaucccgacagguguguccagcugguuagguuuuaguucauuccaaauguagucaaguugacaaucaagaaucgccuucacaguugucaacccaaccaugggaagacaaagcacaggaaguggguauuuuuuuggugcaggagagcagaacuuuucagagaaaucuuuucaauacugcccucagagacauuaaguaauacccaauuccgagucggaucccuucagaucuggaaacugaucuagucaucuuaugccgaagucaucuaagcccauuucugaagugcacuuaaaguaagaaccuuucuaagaaaagaugguauguuuaaguuccauguuuuccauuuaagcugaagagaaaaacaaauucaucucaguccuuggaaugccccuugaaauaugcuguuccaucuaucacacagagcuuuaugcuauuccaaggaggauggaaugaaugguaaaauuuguggugauaaaguuuugaugcuguaccccucuccauuugccuuguauccuuguauuuugauaaugccaucaaauuaccuaauucaaaccaucaauuuuccuacuuguuuauauauauauaaaguaaacuuguccauugcugugauguacacacauaccagauauaaggaagaugauuauguucauuuaccuaagucagccagguuaucauguugccuuauuccuggacuggguugagauaaacaaaggucgucugggaugucugcucuaggucagggaugcugaugagcuacguguacagucugcaagcccugcugcagcugccuagcuccuuuaguaaauggaauguucuggugaagucuuucgugcaguagauaaacaguucucagcaagugcacuucuguccccagaccucucagaaaacccugggucaguguugggacaucuuccccaaaggauccugggacacuuaggaacaagaauuauacacuucuuaaaaaaaaaggcuaagaucucuaacuucuaauucauggccacuucugccuuaggaagauggauaaggguauacuucaguuuguaaagggcuugccucucauccuugaggaccaggguuugauccucagauccucauaaggguauagaaguauaaauacuuagaaucucaacugagaaaaugggggcaagaggauuauauugaugauuucuggagagccaaucuaguugaaaugguguguuccagauucagucaaagacccugccugaaacuaaaguuaggagugauugaggaagacauuugaugccaaccucuggccuccugcacacaacugcauacauauaaacacucucucucucucucucucucucucucucucucccucucucucucugucucucucucucucucauacacacacacacacacacacacacacacacacacacaaauuagagcugagacuguacugaaucccaaacagugaauuuuuccauaccccaaaguuagacuuucuuaaucagcaauaacugaagaucguucuuacacaguuaaaaagaacaacuaacagugggcccugcuuugcacauguacuaagcaauacagacucacucuuaauuaaaaguaagcaagcugacuucacacagccuugcuuugugaugcagccaugcuucaugccaaggguuaagacagugggagagugcaagccaagccaggaaucuauuacguaacaucauguccuugaaaguugcagaaaaagcucagagauaaaccagaccaccugucaaaacuugggaacacgaguucuucagaagcccaaauacagagcagguagccagccacaagaugucccuucaccucaaguaauaaaaugaggcauggcuucgcauaugacuaagauauuccaaaacacaucaacaggcucuauguuuuauguugccauuuaucagacaguuucugugccuuguguaugacaugaagaugcuaauaaauaucagguaaucacagaacccaaugagaugguacugucacuucuacuuaaaacugaggcucagagagaaagccagacucccaagaugauacagcuugccaggucuguggaccuccaacuccugugcuuugacuacuccuacuuccuuaccccucuacaaucccacauuguccuggugccucuagccacugccugugcauucccagagauuuccaugcuucggccuuucaaggaggaaugaugcaaaguuuccuuuucugccuguuucaacucuucuccaaaaccauaaccagaguagcaaaaaucugaauacagaaauacccggagaucaggagcuacagaaacaaaacacucuuucucuccccuucugcuuuucuggaguaggguuguggggcauucggcugccuugcuugguuugcagcacuaacagcaaauucucugccuucuucagaggaucucccucagcugggaggcuugucugugacugaggucagcugggacggccucacacucaacuggaccacagaugaccuggccuauaagcacuuugucguucaggugcaggaggccaacaauguggaggccgcucagaaccucacgguacccggcagccucagagcuguggacaucccaggccucaaggccgacaccccuuauagagucuccaucuacggggucauccagggcuauagaacaccgaugcucucuacugacgucuccacagguaucaucuccacugcccaugcuuaggguucucucuugcgcucgcucuugcgcucucucucucucucucucucucucuuucucucucucucucucuucacucccccuucucucuccccacuccucucucucucucucugagauggcaagggaacuagcuuuucuuccuggcuaauuccuuucuacgcaugacgcaugcucagagcccuuucggugagcuguuccaucauuccaaugccuucgccacagcagugacgagccauguaagauacucacacuucuggccuccgacauccacuuucuugauucaccuagucaguaccacaauggcaccuuugcacggcggccucuguuuggagaaccagccuguuugguuuuaacuuccaucuguaguccuggcagagaaucaaaagcccacccuccccacaugugaguuugauggagcacagaccauuuauuuuagagacucuuuugcuguuugagcauuauuucaaaauuucucguggagauguguccuacagugcuuacacuuacacagugauucuuugaaaugaagugagcacaacaggagaacugaauuacccuccaguaggcaaaauucucucagcugcagagucauugcuagaacaucaaacuaucaagcuauccgucaaagagagaaaacauacaauucugaauggauaauauaccaaaguuacuguuguucuguagcaggacacucaguagcucucagagcaagaaguauuucaggcuauaaacggaacagaguugcuacccccuuuuugcucugugaaucaagaguuauuucccgaagcaagcucccaauuccuacaccagggaugcguucugguuuacucguuacacuguuacaguuauaaagcuuucaaugggacucuucccaagugaacggccuuuccuaacccuguuuucuguggcucgucuuuauggugugcccugaugaguucuuucucaugaaaaugccucccuuuuuuuauacagucacugugucucauagcaaaccauuacaucuuuguugauucaaaaggauaacucugugauuuugccucaguuguuacagaaacugucacugaugcauacauaaaacguaagcaaccccaggguggacagugaccucaggcugaccagagauuacaguugaggaucugcugacuuuucuccaggguucuugucugacauccacaaacuauucugucccagaaggcagagcaaucaaucacccgccacuucugaucuuuccugcagaucucgugguuuggaugccaucuguauucuuuuuuaugguagcaacauucuugucucugaggaguuggcccacggaggggaagggcuauaauuaaucugugaaucugggauuaagggucuuucuccucgcuacauagauuguacuggcuucacaaaugccucccaugugcacacacugcuugcuauaucaccacuucucaggaaaguaaaagcucuggcaggacaucuccccagaaaaauauuauuucuuagcuaaaaaggguugucugaacgguuuggcugagcugucuuggcugccaauacaggaccaaccuucuuggccuacauagacauaaguaaaagagaacaugcuauuuuaacagaugaugagaacagcuggcucucccuuaucuaaaguauggaaaaaaauaaucaagaguuacccugagaggugggaggaucuuuucaagugacaaaaucagaagccuccaggucccacucagggaggcccaugcugucagcauuauuuagcacucauuuagauagauaggcauucucucaaagcuaaugcaggaauccacauaaucuuggucccugagccugaaagcugucagcccucauaucuuuugacugauugccaauggcccugaggcagggcucucagagacagauccagcuaagaugaagccaauuccacugagacuagccagcccgucuucugugcugagguaucuugccaggccugaucaucaguggcaaaugcaggggagaaaagucuaacagcuauccccuccuuugcucagcuuccucuuaacaaaaccaguuucuccuucccuggcacugauuaguaguggcagcaucacuuugccuugcuauaacccugaacuaucagaccuuacuccccgggcaugauucuauuaaccaccuccaccuugaaacacagccaaauaacuaaaucauuugauuuuuucucucucucuccuucccucucaucuuucagccagagaaccugaaauuggaaacuuaaauguuucugauguaacuccuaagagcuucaaucucuccuggacagcuaccgacgggaucuucgacauguuuacuauugaaauuauugauucuaauagguugcugcaaacagcagaacauaauauaucuggugcugaacggacugcccacaucucagggcuuccaccuaguacugauuucauugucuaccucucuggaauugcucccagcauccguaccaaaaccaucaguaccacggcuaccacagguacaugagcguucucuaguuucugacgcuuucucuccacagucucucucagcaggaugaagccacuugauuucauuggccaaugagguauaaaccauugaauaucaacuuuccuagguugcugggcugcaucauugucuaacaaaauuuucuucugacagccaccuaaaugguacauuugcaugaauccauaucucugauuaucauaagcagaccauucuaaguaucauaugaaauuuuguccagguggccacaaauaaggaccucccuccuuugguaacuuuaaaaucaucaugauaauuguccuaggcuugcaaagaugucucuucuaaucaaauuuacguuucuuuuuuuuugauuauccuaauaucugucucucuguaaagucuugaauauccucauacccaaauauccuagugauuuaagauaauugucaacggugcccuguuuugcuuuuuuuuuuuuuucuccagcugggaaaauggcaagaaagagcaaugauaguuaacucaucagcuaagcaagagguacccacgucauccauauuaccucaaccugaaagccagcucaggaaaagauguccccugucuagaaugcugagagacacauagcaaaaagaugauaauaguccuucucagauaagaaaccuggguccaaagggagcaaacuguucuugcucugcauaugcaguccuguggcauguguucugugccagaugauuucuuuagugccuugaggaagacuccagagaggagagcauugcccacucaagcaacauucuuagcacauuuggggcaauaucuucacuuuacagauaaauuaacaugguccagacuagaaaaaaaauguaaggaaugcaguuuuuccuuauaguucacaaaagaagguccauauucuagggaacacaagaaaaggauugauauuauagcaucaaaauuaccuucugcuuagaucaccaaugguugauggagaccuaauuuauaugcuguuuuagacuguuaucaggguaguccuggaaaaaaaggagcuagggauacuugguuccuagucuauucauguuaaaguauaguaacacagaggggacaaaaguaaguugaccauguguacuuggguugaauugguuuucaacaaagaauaauuucuugccugaaaggcagagucuaaaaccuuauggacuuagucuucuguguuuuaaauuuuuucucuaauggugaauuugaugauuauacuuuuauauguaaucuuauugcugucauagacagcucuccucuuagccacaucucugccucaaauaugaccucaggagcuugccuuaaauagcuuucuuauagaaguuaguugguuugauugucaccaaacagugguauacucuaucaucagucaaccugaaacucugccaucuccagccucaaacaaggcaucuucuaauuacagcacuuagcugcccagacugauaggcagauagcguccucagacccugaugguccaugcagucacaaauacuacccauuagagguucuucggucuccauugagcucccuuugagcaacauuuuaaaaaucagccacugcuccuuuuucauccucuuacuucuaccagauccuuuuuaauuuaauguaggcaucuaaucaaagcuuuaaagcuuuaaaguacacuccaugccaaauaagggaccuucauagucuguuucucccauauaccccuugcaaucuggaguugcucugugaugaguuaauaugucuugcuuuuguuugaaguccuaaaucaucuuuuccucuucucuuuaacaauauccccucacagaacccauucucaccugucuguaguccuucuaaucaaagcuugccugugucccauucaaaggaaugucuacaugcuguucaaagucaaacaugaucuauagucucuuuucauuugccuggauuuuauauauugauugcuacccuugggaugcuaagaaagaacccuaaauugcaagcaauaagucucaugagaaaacccaguggugcccaucuuguucuugagauuuucguuuucuggauuccugacagauaggcauccugauagaugucucuuuugacaucuacucuguugagcaugcacugucaucugcuguugucuguuccaaagcacuagaacucucuucccauccaucaucuugucaaaguugcaaugcauguggugaauacucagagcauuaaaucuuuaaauaugucuaucuuucuuggaaguagacagcaugucaaggaaguguucguaagggaagugauaggagaaaaaugucccuugccugcauggaacacugaccaaauccuaacuagcauucuauuucuggguuuugucuuauaucucacaauucaccaugguugcauccucugagaguucacugaagguaaugcuaaccucuggaaccaaggccucccucccuccaucugcaugaugaauguguuagcacugccagacucccuacuguagcaugagaagaauuauagacuguaucuuuaauucaagagauagcuucuaaagcagaagacagugaagagcugaguuccaucuggaggacuuuauccuuugugugguuguaaaaacacugccaaagugguagcaaaacuacagcuuuaucagcaccucagaaugacaagacagaaaaggcaugccagcgcuaugacuguaagcuguuucugagccagauuggugggauccuuagagacuuuagagcauccaugccauggaguuuuguaguuaaauauugcucaaaugagccuauucuuaucucuaaauauuggagcugagacaaaacaacucccagguuggaaaaauacuuugccucuuuccaacucuaaauccuaucaauagcucaguccucuagggcuacugauucucuuuagaaucaaccugguuugacauacuucacauuuguauccuuuacuaaaugacuaggaguauggaccuacguacaucucaguugauacuagcuaugaaagccuauuauguuaaaugaguuucucauauuacuauuuaagaaacaagacuauuuuuuuuuugauuuuccgagauaggguuucucuguauagcccuggcuguccuggaacucauuuuguagaccaggcuggccucgaacucagaaauccaccugccccugccuccugagugcugaacaaaacauuuuuuuaccucaacagaauuuucucuuuacaaagguucuauuaagcaaacucccuaaucaaggaauuugauguuuaacuucaaguuuuccuacaucuuacauaucuacuagacauuuuuaauauaauccaucuucacuuguauagcauuuggggugagguauagauuuuccuauuaugcaggcauuuaaguuuccaauguccuugaagaaauuucacauagaugcagaugcuagccuuuaauuugugcauccauauagaucaaaugaacacuaagaaaacccuccagaagcacuuucuaaagacuacucagugggauaccaucucacugaggcauuuagagacauuccuaagauaugggauccauagccuagcaauguuggagucaacaagacugcauagauuuaguuauagaacaagcuuuucaaagccuuugaagggauaugugcucugugaaucuuauugguaaaagaaaaugguugcuguuuaugauggaugcuucaacaugaagcugucuuuaccugggacaucuugaccucagagauuuuggcaaauguagucacaauauauuuuauucguccuaucuguacuucugauggcuggcuaacuuaccuuuacaaauggcuccaaauguguuuacacuuuaaaagaacacaaauaaaugacugcagaaaaaucaguaacuucuuugucauauaguaaauguaggcauagauacugccugacauucaauuuuuucugcaaguauuugguuaaauacagacauuccucuuuuucucucuuucucucuuucuguuucugcccauguucuuucccuucagagccagaaccauaguugggcaugcuaaucuuuagcaauauuacuccugacagcuucaauaugucauggaccacacaagcugggcuuuuugcaaagauuguuaucacugugagcgauacucauucacuucaugagucucagcaacucacagucccaggagaugcgcagcaagcucacaucacaggcuugguagagaacacugccuaugaugucagugugacagggaccaccugggcuggugaccccagaggaccccuccccucacaccccucacugucuuugucauuacagguauucaaagguucucucugucaguuuaggaaucuggaaaaaggagauaggcacucuaaagaaaacuccaaucccaaacauagucuugacuccaaauauaaaggccuuugguuuuaaccuauaggaaaugaauauauauguauucaugucauauauaugucauauauacauauauauucauuaggauacauaugguacaaagugauauuuuaacauauguauuuauugaagaaucaccaaaucagaucaaauuaauuuaucaaucaugucaccuaccuuuugugauaauacuuaaaaucuaaucuuucggcuguuuggaacaucggcuacuauuaguuauuauuaacugaggcaacuauucugcgccuugguuagcuuauucugcaccucacugaagcguauuccuacuggccaguugaacuuugugccucuugaccaauggcaagcggccaaccccacuucuggugaccaguauucuucuuucuacuccuaucaguucaauuugucaagauucuccauaaaagggagauggugaaaugguuucucuuccucuucuuggcuuauuucacuuaauguucuccaggcuuacuugugacaucaagaaugauagaauucccuucuuuuauggcuauauaguauucuucuacauguacucagcaaauguuguuacuaauguagccauugagggaaacggauugcuaugcaauguuauuucuaauagcagagaggccaaauguaaauuucuagccacuaaaagcaauggcacuccugaaaggaggaggacccuuacagacccucuuggaagcucuuuagacauguauagagcuucgaguaucuuuuggccuguuuucuagaaugcuuaauccaugcagagagucugaagaaagugaaauuuaaauuagcgaugaucuagagcaggaauuauguccauaaauugagguauguacgguguaaagugccuaguguccuagaggguccccaaauccuauaauuugcaauuuaaaaaaaaaaaaaacaacccaaagccaaacaaaaaaacaaaacaaaaaccuuacucuuaaaacagucaagcacagaaacggacauguucaaccuaggaagauagauacaugcuaaacuuuauacacuuauuaaauuugagcugugauguuucuauggaucauauaaagagauacugccuauuuucuuuccuaaucuuaccuuaagucgaugguaaaggcugugcaugguuucauaaaaguaaaucucuagcuugacaaaccucuaaaaaaugcuuagaaauucucuucuacuaaacucucaggagauagacguagucaugacccuuaaacuaagcuagucccucccagagucuaaauuacuauaaaugagcuguguuaauaaguacagcuaacuaauugugguagcugagaucaaaucugguugauuucuaaaccuaucccacaucaucuuaccuacacauagcccuggcaaauuuguuuggagccugauguccuuauguuagggaagagggcacucacuggugcugcuggccaucuacauuaggaaucuagcagacacagugaaaaguaaccgccuagccuccacuggauccucuacuaguguuauguccuccuguugcuucccaacaguauaaggagagugggcuucuuaaaagucaauugggguguaggucaaaguuaaguccacaugucuggcaugaguaagaccuuagauuuguuccccauccacaagcccaagggaaacaauggaaacaugccucacaacuuacucuuagaacccuggguauguuuuagucuaagauuuuaaauauuuuuuuccuuucaauuaucaaauguaaauauaagcuggguuuuuuuuuuaaguacagcagaaagaauggggugagaggaagacucuuucuacccugagcacccagagcucaucaggcccuuacaugucaccuucugaaggaccucccacaagucagagagaagccagggaagcugaaagagcagcccucaggagggaaacagagauccaguuacagaauuguuucugcuaaucccuggugugaaaagacucuacauuuugaaagaggcauaccaaagaagaaaugaaaaugaauaggaaagacugugggaggaaaaaaacaagcccuugauugacuaauuagccugaaaguaccuguuuucucuggaauucacugcuuuaauagcauggaguuaacagaggccagcuaucaaagaagggcaccacuucucuaaacaaaaccaacauuugagaaccuuguuuuacaaaucaagacuguuugcaugguaaaaaaaaaauuucauauuugcuuugauagaguuacagcucuugggaaaucuuaugagaaaaauaaacucuaaaaauaaacauuaacuguuacaaaaucagcacaggaaguccaagccacaacaaagucuaauucucuacuuauggaugcauucacuuagccauccaggugccaagaacuucuuuuuaaacauugucuuuauauccuagggaaauuugaccauaagcauuaguacaaggucauuuaucacuuugaaaauucucaguuagaugcaacaacaugagcgagugagcaagggaaggggagaagagaagagaagagaagagaagagaagagaagagaagagaagagaagagaagagaagagaagagaagagaagagagagaagagaagagaggcucuaaauuacauguugcuaaagcagacuugggcaugggauuuucacccuucuccccuaagugcugaaugaguaugcaucggucuucucucucuuuucuauuagcgcuguguccccacucugagugugucagagcacuugauagcauuuacuaauuuuagcauuguguuaggaugugcaaagaauaccaagcuugcagcaagaaggccuuggaaaagucagagacuuucucucccaguugauguccuggaggccagcagacagauagcaacaccuaccuuacagcaucguuguguuagacuggaucaacauucuguagccuccucuacugggacuuguuuuggccaccauaaggucacuuuuuggaaagcucaaguaugugaaaagaucccuccacaacuagggaauaagugggcugggacacagauagacaaaacauaaaaccaagauaacaaaauauguucuugcuuucuaacuuaaccuagaaaaaccaaacaacuuaagaauugccaaacuuagaauuccuuccugguuuaagaacauaaaucguuaauuuggauaaguaacaacacaacaaaucuuauuacuccuguuauccaaguuuaugaacucaauaguuggcccaaauaauuguauucaaaauaugaaccagauuaagauaugaaauauaccagaaaaguaugcuugcaacaaccaauuuuuuuuaaaaaucugauuuguuucaaaacaagaaacagcaagaaguagauuaagguuccaaagugacacaagguguccuauuuguauagugagauauggauggcccaaguuaggcucagcuagaggccuugcucuaucauaccuugcuaaggugagacuugggcuaaaucaguuaaucauuuagaaacuuuucuuuugaccuaugauugggaaugauaguuacuguacagucuuguuaagaaauuuacucuauguaacaauaucaggcacccaagacauuauuacuaaauauuccuuuucugagcauuuaacucaugggaugcuugacucagaaucuaucaguguucuugguauuugagcauuuacucagaaucuaucaguguucuugguauuugagcauuuuaacucaugggaugcuugacucagaaucuaucaguguucuuaguauuugagcauuuaacuuauggggugauugucagggaaucuaucaguguucuuggagucaggagcauugaacucacaggaugguugacugggaaucuaucuguguucuuggggcugcacgcugccuuagucaaaucagugcugcuaaccugagucauuuucacuccucccuucuuucagaggccuugccccuucuggaaaauuuaaccauuuccgacacuaaucccuacggguucacaguuuccuggacggcaucggagaaugccuuugacagcuuucuaguaacggugguggauucugggaagcugcuggacccccaggaauucacacuuucaggaacccagaggaagcuggagcuuagaggccucauaacuggcauuggcuaugagguccuggucucuggcuucacucaagggcaccaaacaaagcccuugagggcugagaccauuacagguauuucaauucaagagagccaucugcuccucuuccuggucccuuuuccuguguagucugucuucggaucccugugguuucuaacauugucuguauucuccacuuaauccacacacguaccuuguucucucauguccuccacauuuucccuuuuuucagaaucuauugagugcucacacacaccccauccuagaaaggagaagauggaaacgugucucuuuaaugucccaaacccuuuaguccacgucuugccuguagcucucacgugcucacuacagucaccuucguuuguguucauccuggcugguugccagcuacauuucagcuuucucaaaagaaauaugccaaugaguauauuuugaaaaaguauuuuaaaaucuuuacuauuucagagucucaaccugugaucuuaaccaacuuacccaguggucuuaugauugggaacugaaugaaacuuacuauacaggccuuuaaaaaaaaaaaaaaacaacuaauaccagagagauucuucaacccagacuaaauccauaauguucucaagacuaauacuuccuauagaaauaucacauuaauaauuuuaacagucagaaaacuguguuucccaaaguauuucuagagaaaacaagcgcugauggcuguuuaaagaucucauuugauaacauuucauguucaguuaaauuuggaacuaggaucuuugaccacacaggcuuuucagaaucucuuauuaugcagagggcaguaguucccaaacuuguuugacaaggaaugcuuuguaaaggauggagccauacaacaggaagaguuugcuuugagcacacacacuuugggaaacucagcuucaaauuuauuuugacacugaguuuugucuaguuaccaaaaugaaacucuggaguacaaaguauauauaaugauaucucaagagguucuaagccucauccuaccaucuaaaugguaaacuagcaaggaaauaaaauuaaacaggauauacuaggagcccucuucuggauagcagcuccggagaacaaagccaaaagaccauaacauucuaaaucauuuugcucaggcucgagggaaauauaaucaucagaaucgucauggacagcuccacagaucauuaaagucgguuuauuugucuuuucaaaaggaaaagaaaaggagcucccagcagaccagcacucagccacuggaagacaaagagcaaauguaaacaaguuauggcuuugaacuuguuuaauaaugcacgggaggggccaaggccgaguccagauguggacugauacaguuacuuuuagacaaaacucacagaugcaagcgaaugcuuggcuuguauugaaugugucagcuccguguuuuccuucuccucccccuacuagacuuuuuuaauguggaaugauuuucuuuccugguaucucaggacacucugucucugaaaaccgaggcagcacugcauucugauacuccaccagaaggaagacugcauggauggcuaauuaaugcucugucuccuccuucuuccaccaucuucucucccucuagaagcugaaccggaaguugacaaccuucuaguuucagaugccacuccagacgguuuccgucuguccuggacugcugaugaagggauauucgacaguuuuguuaucaggaucagagauaccaaaaagcaaucugagccacaagaaauaucccucccuucccccgaacguaccagggacauaacaggucucagagaggccacugaguacgaaauugaacucuauggaauaagccgcggaaggcgaucccagccagucagugccauagcaacaacagguacuguaaacaagcaggugccauagcaacagugggaucuauacacaaacaggagaggaaaacggaaauccaagacuggaauucuucuuccuauaggguugcauaaucacaagagcucuggagcacagagaggcuucuguuuagauccugguuccuuuaagcauagacuguguucuccuggacuguguggacaaaucucugcaccauaaaaagaguaugauuuccuuagcaggguggugaggauuuagugaucugauucauguaaaaguaacaacauaagaccugggauguaguaagggcgucauagugucucuccuagaucaucaacuauuagacauuuaaauuccaaaaacuuccuucuauugaauaguauguaucggagaauaugaucccuuguucuuuggucagauguuacagucacacuagaugagugagggacaguggagacauggaaccgagaccugaaaggauuaugacauguuuauaaaaugucccacgugagccaucaguacugugguuagcaaacugaaggauggagcugguaaggcuagcaggacggucuucuugggcucacaaauacaagccgacacugcguguaagagcccuccacgggggaaauaagacccuuuuuccuaucagcuaugcuaaggagaaaggcaaagauacccagacacaucauuacuauggucauaaaacuuaugugacucuuuagagggagaaacaaagaccugaaaaugcaguacuuuaaaaaaaaaaaaaaaaccuggaggaauagucaagauggcauugcauagagacaacccccugaaaggaaucugaggaagaaucagaaaaucacaaggaaaggagaagcacugagaagugaugagccacacaccaaagaucuuggccuugucuauugauacaucaagaauccgaggcccagaaagcugaaguacugugccuaaggucaggcugcuauaaugggcuuauugugacagugugacuguaauuauuuuaauagucaaaccagaugacagguaaccagugaacagauauacuagcuaugucugacagauacagggaauauuaguccaagcucccuaagacauguuaagacauguuuuauuguauggguauguaggagcuggugugugugucuguguguguuugugugccugggcuucucuaugucuguguaucuguguguguguguguguguguucacuugcauguagaagccugaagucaacuucagguaucauucucagaagccaucgacuacucugucaucugucugucuguuuuucuguguguguguguguguguguguguguguguguguguuugugugugugugugugugugacagacaaagagacauacagagacauuguguauguccauuuauauaugguacauaugcaugugcaaaagucugagucuacagguacucaugccuacaugugcacagaggccaggggagaaaguaggguguccugcucuaucauuaucuaucuuguucuauugagacgaaguaucucacugacccuggagcugggcuuucagccagcaagcuccagggauuuccccucacauacacacacauaacuagcacuggaguuauacacacaaggccacugugccuagcuucuuauguaggugcaagagacuuccacccagcaccucauacuucccacugagccaucuccccagcccaccuuacuuuuuuauacuguaccucugacugacacccagggcuuaccaguccagguagacugacaggccagcaacacccagggauccagucacuguguccccaaugauuagaaagugugacaccauguccagcauuuugcauggcugcugggguuguggucagucaggccaucaugcuuaugcaguaagcaugcugcauacagaacuauugucugagcagcauggcaagauaauaguauugugacaagaggcaggaugcuacaaccugcaagaaucuacccauagaaacuauagccagugcuuguagacauggagacagugcauuagugugucgagaggaaaggcacugcucuuucugcuuacaguaccccccaguucacacacugguugcacagugcuuagcauagcugugcuccagaguaucccaccccaacauugaucuccaucccccauggcugccaaagaauggcuucagaucagaagcagagacugaucuugguuuauaaacacugcucuucaaagcucugaucacugauuuuguuuugcugauuuuuuuccuucuucuauaaucccuguaguucuaaagcaaaaacaaaaagaauaaucaugaguugauuugccuuuuuaagaacaaaagaaaaaccagagccuguuuuguuaggaagaacccccucuugggcuucucucugugggggucuuaaauucacagccaaagagaaaagcacauaugugucugugcagcguguguaagcaaugugucuaugugugccugcacacccaugcuccaggaccaggagaggccagaagacauguuguaagcagcacagcaaggacaugccuaccucaucuucaguccccagcuucaagugucccuuuuaucuguuuccacccccacauacacuucucucucuucccccaaagcaccuugagcucuccucaacaacagcaaccucucccucuuaccuccugguaauggucugcugugauuccuccuuguaacauauuucugucuggcuauaagcugcccacccuugagaauccagagcagcaaggaaggcagugcaagcaaguggcuagccaaugaucugggcaaacuccuggagcguagccauguuuuucccauuuagcagcugugugaccuugaccuugagcaaaucccaagacccucaucugaaaaacaaacuaacucaaaggucaacauaagauuuaaacaggacacgaauagugaggguuuaacucuuuccucugccuguugcaacaaugcuagcuauuauaugcuuggugaguuguccauuuuauuuuuaaugaacaacaaaaaccaauucuuaagaauauaacaguggacucugaccauguagcugcauauugauuuuaucuagaaguaauaaauaauaucacucucuugucucucuagaaacauacaaauagagaaaacacaacacguauugaauucuuugagcaguaacuucuuccuccucuaggaagauaaacacuuccacgucccugugcacaaccauaaagguuucugcaaaacaggcaagcagucccauuaacagagaaucgugacugcuauucucuuccagagacccuugcaacccaccaaaaauguuuaggguaaggaccugaaaguauuuccuuggucugucccaguaucuguccacacacucauguuccuaggucucucuuccaaucaugaggucuaaaguauaguugucaccucuuuucucaaacuucagaacagucucuacucuaaacugcccauauuucccaaucaggcacccucuaaacuccucagccccauuucaaucaagauagacuugaagccacacuuaccaagguuauuucuauuccaaaguucuugcccccaaacccaccaacuaccuccuaauugagcauaagccuaaugcauauuaaauaaccaaugcaaguuuguagaaugaggacuaaguguuagaugguagacaauugccaauaacagaaggcauucauuauagaauuugagaagcaagguuuuauauggauagcaagcacuuuaaggguuuuuaucaagcccaugcauuuagcuacuggaaguucuuuuuuauuauuauugagucuaauuggaaggaaagcauuguugcauagguaucucuaacucuugcauguguguguguguguguguguguguguguguguguguguguguguucacaccugugguacaugugugaaagaugucugaaagaugcaggugcauguguguuugugcuuauagaggcuguaugucuuccucuaucauauuuuaucuuauauauugaggcaagaucucacacuaaaacccagagcuugccaauucagugggucuagcuaccugaugcucauggaaggggaagagaucucuuuccucagcuuccugagaacuugaguuacagacaggucauugugucuaaccagcuuguauguggauacuggacaucuaaacucagaccuucauauuugugcaguuagucuuuuaguguuaugccauaucuccagccccucuccagcuuuuuaauagguaugacucugguguuuugugcuuagcuaucuguuguagggcucaggacuugaggaccccauagcagaaagcuacacacugaaguaacaaacaccuaggaagcucuuuaguagaaaaauaucaugcccacugcuccuggaauuccaucacgauugugacauugcuacagaugaugccugguggcuuuccuacuauguguuaccaaacacauggcccugaguaagucauggaugaggccacggguucugcagcauauaagacaguguagauauuacugucauugucuagaugagaaaacugagaucugaagaagaaagcuuuguuuauaagacacagauugugaaauguagcauaaccuacaucagccagcaagguuuccaguuagaacaagucagugaauugaauaagcagagaaaaauauuccaaggcagaguucauguacaucaguaggaucuacucucagcuagacucaucuagaucucuccugaggagugucuuaagguucaggguagacuguguaggaaaaggucgcauaaggaagaaacuagagaggacaauugcaccuagugaauucucugcaugccagagucuauacuaaggguuuuacauccauuaucucuacuaauccucaaaacauuccuguggguaccacuuucaccauuggaaggguguagcaacugaagcucacugaagggaagagacuugucccaggcugcccaaccucucagugguguuugaacaauuaagaucuuguagguuccucagacucuguggcuugaaaaagaaaagauuugccacguacagggagaauaaaaagaaaaagaaaaaaaaaggagugguagccgcagagaucuggguaguuucugggucacaggaaaaaaaaaacuguaggagcagauguguuagaugagagaaaaagacagaaauggguauggaaaaaauucucuccgaaaaccucuacguguuuccaagcuuaaugaccaaaacgggcugaagcagggaaguagugaggaagcaggcucccuugagacuggaaauuguuuccugaguuagcauggucagcugaagcaggcagaauccuaagccaaaaaacacacagagagaagccaaaggaauccagauuuggggaggagaagggaagacagcagccgggccccucuagucaugggcugcuucuugccaguggacccagugucccugguguagguuuaguuaugaccugaccuugcuucuuggcuuuggaucuccuugaagauacaugagugggcagucaaaauuagcuuccaaugagcuuaauuuccggaugccaggcugcccagugcagugauccagaaaggucccaucagaauaauguuaguuggagaagggaggcuuacuuuggucguuuguauaaugacuacaaccgaauuuucaucucaugcguguuuauaugagaaaugagcucuauaagaaagaaccaugcacuuuuauaucuuaccauuaaaaaagaaacguaaaacaaacaucuggaaaaaaugccaaaaauuaaaucaaaauaaguuauucagaucugugaagucacucuccucuccucuguggaaacuggccaaugugcuaacauccaucuugcgugaagccaauugaccaugaagcccacagucaccuggucuacguggucacuguaucugcugugaguuuucuuucaugucacaguguaaccauguaucaugcauucucuauuccugaggcuccguucagucaucaacucuagauacuaaaggcuccugggcaaggaauccaggggaaaaagcuauugauggacaacauagguaauguuucaggguuucuguuuuguuuucuccuuaacagccauggguucuccgaaggaaaucauguucucagacaucacugaaaaugcagccacagucagcuggagggcaccuacugcucagguggagaguuuccggaucacuuauguaccuaugacaggagguagggaaccuggagguggaagacgguggggagaacaugcaacauuaggguuaaauggcaaaugagacccuggguguucuuaucagacuuucuucaagcauuauggcuaaugaaaaucacuucccuccuucugagaucaucuagaaagaugcccuuuguaaagacauuuuggaaacuuggaaaaagucaccuuauuaacacucucugugaccuugauauuguaaaauauuuucaaggaaaugguucccuaguacuuuugaacacaaacacaagggaauuuauauaaacaaucuuuuuuuuuccccuuugaucacagucaucuggaaagcugagauaugugugagguuuuacccuuagggaccauauccuaucucacuacaggauagagaacugagucuuagcaauguuagaacuuggaacacauagacuuuaaugaagaccucagggaaguauaguucgaacacagccuagcagguagugagcugccucuuguuggagguuugaaaagacaggcugguugguaacggcaacacuguagcaucuccauuugggcguuuggccagcuggauugcaaauccuucacucuuccugaaauucuaagaaauauaaauuccagacuuccuaauaaauuuaagagcacacauuuaacugggaccaucuuuuuuaucaugacuaaaaucucuccaaguaagggggucuauagcaucuuaagucaacccaaugaguuacauagcuuggaucuaugcuacauugugagcuucccauauagugcauggagggacaagaauaaggaaaauaaaauuugugcaacaugccaacuccuucccgaaaggaaacuugccauuuuuaguauacugugacuucaugauuuuuuccuuuccugacuggguuuuuggcaucugcaccaauggaaaaaaacauuauacaaaaaguaaggucuuguccuucaugccagagggugggaugagaggagaggaacuccagagaaugaaauugaauaaagauauaauuuaauuuccaaguugcauccacccgguuuggaggcuaugacaaggaaguguggaagaggcuccccugaucuugcuuucgcuaaucuccaggugccccguccauggugacuguggauggaacagauacugagaccaggcuggugaagcuuaccccggguguagaguaccgcgucagugugauugccaugaagggauucgaagaaagcgauccagucucggggacucuaaucacagguguguguucccccaucauguuccauccuugcucuuggcauguugacucgugacugagaacagcacaaaugcuugcuccuggagucccagugggaagugagcuggaauuagagcauccagcaccucccucuggcucauccuuagccucuaauaaacuggguugccccagagacauccugaaugcccucuggccuccauuuccucugcuacuguggaaaggagugaaguauaggaaccauacugagcugagacccuaaauguguuagccacgugaguugucaguuaauuucucuggggucugaugaacuucucuguaaaguggguaugacucugcuucccuugucaguguugcaaggggucaguaagcauaaagacaacuuucccugucaccucacuccuucccccuguugccuggaaucauugugaucaccucccgggacaugugcuucugcagauaugggauggggaggacuguggccacgcuguccccuguuuagcaaggguugaccugaugcacuguguccucacugccguagucauuccaagcuuguaggagaggcaccugagacaugaggagauuacaaaacaacaggacuggaaauguggaagaaaacaagggucauucagacuaacccucucaaccauuuaaaauaaagguuguuuuccuguuaaaaucuaauuuaagaauaauggcugcuauugugggagaaugaaguggaaauuuucccuucagaagucucugucucuagacaauuuauccuuugagauaugacaaauuguccaacccaguccauucagugauccgaagaauaggccucccaggaaauuucaaaaauauacuacuuccauacaagaauugguaauguacaauuaaaacagccuaucuggacgcaaaguccugucuccucuccucuugggcuucaguuuucccuaagaaaucuugcauugaugauucuccacagccacagaaacaaaagcugggugugucuccucccaaggccacauugucacuagcaguuaaagaaaggucuguacacacaugagagaaucagggggacacugugaggugaauuauauugacucugacacugguuugucacuuccugacucuucagccaguucccuaaggcucggguaccagucugugagcugggcugcugucuccuaggcuguugagggaguaauuaaauuaucguuagaaaaaauaagagagagaucccgccuucccaucaacuuucaaggaagaaacucugaacaaggaacauacuccuuugaaagaagccagagauuaagaccccuggaauauccucugacaauauaagucauuugaaaguaacgcccaagggccagagcaguggcuuaucguuuuuacuuuccuuguuucuuucucuuuuuuguuuuuguaagauuuauuuauuuauuuauuuauuuauuuauuuauuuauuuaauauaugugaguacacugucagugucuucagacacaccagaagagggcaucggaucccaauacagaugguuaugagccaccaugugguugcugggaauugaacucagguccucuggaagagcagucagugcucuuaaccgcugagccaucucuccagcccauggcuuaucuuuuaagagcauacucugcucuuauuugaguccucgaauuuaauuccuaguauccauaaccgaagccuugaacaguuacacuuacaugcacauaccccauacagauaaauacauaccuguugucuuauccauauuugucauuguugucugauauaaucuuacuauguggcucuggguggacacaaacucaugauccuccugccucgggaccccaaggauugaaauaaaaaagacuaaaaaguuuuacaaaguauagcauuaauaacaaaugcugagagcuuccauguuauauaggcacacuucagugaaguggccuuuccaaagacauggagacacaggaaaauaagccacaauagaaucugacccuagagaccuccagguuauuaccuauaagauccccuaaauaaagauaucacccaaagcccagaaaagccucaggcaguagugaccauacaggucuccucuauguauguuuauuuauguuccuuuccuggaaaaaaggaacaugaauccugacaauaaccuuugucacacauuaaacauuguucaggaacugccuaccuguaacaucacauauaagucaaaaagaaaaagccagccaggauuaucaugcccauuuuacauaugaggaaauagagaccaaaacuaauacaacaguaaggaaaagagucaugauauaagucagguuagccuguucaaaggggccugacucugagcccaucuaagcacauguccucugauguuauccucuaacauuuugaagucuucuccuuuauuucuuuccagcucuggaugguccaucuggucuucugauagccaacaucacagacucagaagccuuggccauguggcagccagccauugccacuguggacaguuaugucaucuccuacacaggggagagagguaagguccugucccaccuucucuacacucugaugaggguucaucuuaccgcagacuccucccauuccccuuccaauguaccaugggaugagaaaacucagugguacgcuguaagagccagucaugucuuugccuaccuccacuguauccucgaaagacuugggcaagccauucaagugaaaagagaaagaaaaagaaggcgagucuggagcuuugcacguuuugcugacccaucccaccuugcuagacucuugaguuacuuuucucauugcuaugaccaaauaccugacaacuaguuuaagggguagcagguuuacucuggauucuaauucaagaagguaacucccaaaugucaagaaagugcucgcagcaguaacaggaagcugcuggucccaagguauccaaaguccggaagcaggaaauggggcccucuauaaagccuuagagccuaccucagguggcucacuuccuuaagcaggcuccaccuccucacuaaaccaaaaccuucucaagcaaggcuaccaacuaggaacaaaguuuucaaacccaugagccuguggggacauuucauauucaaagcaccucagggagggacagacucucaaggaagcagcucuuauucuuuacaaagaagguuuccagagucucaggucuuaaccaaauggcaucaugauguccuggggugccuagccuucucagaggccaugggagggccuaacugaagccaauuugacugaaagaaucugcuuuucccaucugccaccaucuguaccaacucacccagcaggcaaauuaaacucuugcugagaccaucaaccaaacacaaccaccaggaaguaaaucaaaugcaaucaaaugcaaaucaaauaaggaaaagagccgcuuucuucugauuccauucauauguuuaugaugaucuagucuagaaagaccucuguuauuucauuuucuaauuuucauauuuuauggcucaagacugcuuggcuuucacuggcaguauuacaggacaccauaacccauggggggggggccuuuuuuuuuuaaaucuucauucagcucuggcaaaacccugaguuuccugggaaaagagaaaagaugaggcaggaggagaaaauucaguucauccauucuccucuuuguuauucccuguaaggaaauucuccugagacagggagagaaugguguccccucccccugaacuuauggcuggagggaauggugaaaauuuuagaucaggacuaaucaagaccuagccaaagagguccagaacucugaccuucuuugcugugggggucacugaaagguugugucuuagaaggagguauaugugcuguuugccaagggguaacugccacacguguguguuucauacuuagugccagaaguuacacgcacagugucuggaaauacaguggaguacgagcugcaugaccuggagccugccacagaguacauccugaguaucuuugcagagaaaggacagcagaagagcucuaccaucgccaccaaguuuaccacagguaccaagacagccagagugcaaguucuccuuucugaguugcccacccacagccugcaucuuaaaccacauccccuccccugcucuuccucccuaagucaggcccuugcaguauaaugacaucaguaugaguaaaauuuaccagugcccacucaaucaagacccaaagaagcauaccauuuccccuugaacugaaaugacccaacagaugagaaaaggauauuuaagggaagcuuuuguaaguggaaaaacacuaccuacuggcucuaaacccagcauuuaaugauccaugcuccaggcugggaaauaguuuuuaagaaguuuucaggguaguuuccuuagauguucauugggguuuuauguauugagaucuuuuuacaaagcucaacauuuggagaaguaaaggacugucccuucuguuggggugagggccaauauuagcacuccucagcccugucggugagaaauaauggaucuguaaugauuuucaacccaaauccaacccaaaccacccaggaauauguugggcuuuuagacccuugaggugauaggacucauauaaccuuugacuuugguucaaguuccucaucgauagucaggugggauucuuguccaaggccaugguuaauguuauugaacaaacuugaggccaguucucuucuugcugucuguucuacaccuucuagcucauuugauacauauucucuucuccagaccucgauuccccaagagaauuuacagcuacagagguucagucagaaacugcccuccuuaccuggagaccuccccgagcaucggucacuggauaccuccuggucuaugaaucuguggaugguacagucaagguaucuauaaaucacacauugcuggguaaaacauuugaugugcauaaucaucaaaguagcaaaggauucgcugauacuguuucuucacuccaauacaacuaaacaccuaaaacaaacaaaaaacuaguagagacuggauauagaaccagaccuugugagucacaaaccacaugcucacuaaucuuucuuccuuuaaccaggcucaagcuaucugagcaacagccaagaucaacggcagugcuuuauaagacuuaacauuuuaagaguugggcucauggccaucuaauguuucauugagaaaguaccaacagccuuuucugcaucuuugccacguagugucaccaccugacugacugugaucuaucucaacacauccuugcaaugucacuuguuaagaccagcuacuucuauugcuaauauuaccuguguucuccccuccaugaacuuuacuguauuucuaagcuagguuacuuauucucuucauacuuagcuauaugcagcaucuccccuauauuuuuuauuagauauuuucuucauuuacauuucaaaugcuaucccaaaaguccccuauacccuccccccaccaugcuccccuacccacucacucccacuucuuggcccuggcguuccccuguacuggggcauauagacaagggaucucgccuauauucuguguagcuacuucacuuuugcucagaaauacaugucacugcuauuguagucuauagcucgggaauuauguuucuucuagaucacauuaguuuuguugcugugguuuggguuaguuuccacuguccaugcuagaaacuucuucccagugucuuuuaguccuggcuuauccuuucauacuuaugccaagaacaaagaaucugauuagaagcucagcugaacauaaggguuuguugacacugggguucaauguagagaucagcugcuguguaccuggaaauuugugggggaaccccauagugcuuaggcucuuauucuaugcaagcuuugcuugcucuuacacuuccaguguaguaucuugaccuccucaccagcugauccugguggauuugaauucagagccuccacuguaaugcagauugcucuguuccuugaggggacaaggagaauggggaaucaagcuauuccucgugcaaagcuucuaaacugacugaaccucucuugagucacacacuacauugccugcaaaggcagcuaugcuguuauacacaugcaucagaaacucgcugagugcuuccuuguaugucagccagccugggguaguucugcccacuccaggugguuccuagcacuuucugcucuggcacugcaggaauuguucccucuacuauacaccuucugcccagcaagguacauaggagcuaccuguuucuaucucuuccucccucccauucacuuuuguaguuucauuucuucugguccacuccuguuuuauaagauaugaaaaacacauagagaaauauugguauuucugaucugccauguuuaaccacaaguagacacauuucuagcuuuucuggaguugagacagaacucauaguaugaacugaagcugguccuuuauugucauggugucagugcccauaccuuuaagauacgagcauugcacuucuagaccccaaaagucuucugcagguuugagguucuaggauugugcuucccugguucauaaaccucauuucagacuauccagacuuagacaaaugaacacagaagcagagagcugauugccagucuaggcucaggcaauucaauaaaccuugcuuuguucccugagaguugauccuuccccagaaaccagagcugauggcaccacaaaggucacuaggucacuggcauugagugaacacacauaaaucauggauaagguggugggagacuaggaggacgugacacuguccucugccaucaacaaauuauggauugggagcaaguaucuuagcuucugggaaauucaauucccacacuguaaaaacauacauaacauacccucacuccaggaagucccuaggaagggaaauaaccuuccaguggccuccacucugaccuguuauugacuaaacccaaugaacuuggugaguucuagagaucagaauuguguuugccgugauggaggaggaauuccagucucaaacaccaaggccaucuauuaauaagaacuggagcccaguauggaucugaggcaauguggaucuuguagaaacugagcccaaacacuagucuagaacccagggacgagccauaagcauaguagggcucacacaucuguuccucccgggucagcucaagucuuuauccugccccacgcacuaggcuauuaacgucaucuugcaacucaagaguuccucgaccugaguuuuaguuucccuagagauacgucugccuccccaccuucugaaaauucagugagucuacacugaggcccagguuaucagacuguuuaaauguugugauaaaggcuaagcccccuuucagaacugcugacacaaauggucucagugucucuugccccuugugcaauucaccuuaccaucagcuuaagcuucuuaagccucaacagcuuaauccuguucaaaaccucucagaccucccaacuccuuguuguugauaaacgccaagccagucaagccaaagugcguaacaucccauuaaugguguccuguaaucccucuuugcccauuucuauuacccacccccaccuaaaauuaaguagaacuaaugcaaagcagugcuucuguguuauuuaaccccccugccuuucucaucccagagcuuuuacuuaugcagcacucuugcuaucucagacauuccagagguacacuuggaaucuggcaugcaguaggugcugggugggguuuuauguuaagugaauaaaugauugcauuagccagugagaggaagcaucuuugccgugagacuaucugggaccaaacugauucuuuugccugcccacaggaagucauuguggggccugacaccaccuccuacagccuggcagaccugagcccauccacccacuacucagcaaggauccaggcauugagugggucccugaggagcaagcugauccaaaccaucuucacaacaaguaagggguucagagaggaacacagucuuaagaucugaccuugugacagcuaaucaaccuuccacuuccccuucaacuucuaguuuacauuuucaaacaaaaaucugaaacguaucaauucccuauuagugcuuagaagccuggggaauguagauguaggcauccuagugaaaugaguagaggaccaaugagagcucaucuacauccaauccucacccccauguccuacuggauacagauuagaagacaccuauauuccaugagccuuacuuucuucaucuuugcaaagugauauaaaaaaaaacaaaacaaaccaaaagacuccccuccuucacaaguaucucaugggagaaguugagguaucauauuugaauuccuagcuuaucuguggcucuuauacuguuaaguuuaauauaagcucugucaugaggaacacagagaagcaggggcugccugcuuguaggaaccuagucacugcauagaugaacugaaguguguuuggacaguagccaccuccucccuccacucucacacucuuucucuuuauccugcaguuggacuccuguacccauuccccagggacugcucucaagcaauguugaauggugauacuaccucuggccucuacaccaucuauauaaauggugacaagacucaagcacuggaagucuacugugauaugaccucugauggagguggauggauugugaguacaacaguggguuuuagaguucugggacaugggcuuggaugaagggaaguguguacucucaaauacaugugcauaagacuuugcaagguaauccuugucacauggaagcccuucacaauuaucuauuuaaauaaaaaauagaaggcaaggacuggauauguaguucaguuaguagagcgcuugcuuagaaugaagaagguuuugaguucaaaccccagcacugcagaaaaacaagaacaaaguugcuaacugucuacuugcacucagaagguagaggcagaaggaucaggaauucuaggucauccuaaaauaucaguuuugagccauucuggacuaacagaaugagguggcaggaggaacucugcuaugaauggcagugacaaucaaaacuacuaguuacuauaaccaguguuggcuaaguaguuacucuuuaccagacuucugauaagaaugucagggcuuauuucaaucccaugaccauauugacuguauaggauuuucuuuuaucaauaaaacguguuuguaggucacacccccaaccucuccuccacuuucagcuucagugugaugcuucaugaagacugagaggcuaagauccaacgaugucaccagcacuaagaagcguuguccauuccuaguuuucugaacaccuagacguagggaggggagggacauuaugugcccaaagucacaaggcaaauaacuaagcaauggagaaagcuggauauggaugacuguucuucccucagucuggcaugccuccuuccaaaaagacaucuucucuucucuuccuuucuuuuacuuaaguauccauguuguuguagguuuuccugagacgcaaaaauggacgugaggacuucuaucgcaacuggaaggccuaugcugcuggguuuggagaccgcagagaagaauuuuggcuugguaaugcagcucugaaaguuugugacagauaugccuauuucuguccucuuggucacuuacccuccugucgugagcaacagggagaggaaaggaucaaaaggaaagaaguuugguaggagccacauaguguugaauuaauuaaauauuccaggucacaaaaauaaagcauuaucaagccagaccuguggacaaaccuugcauuaagucagacacuaaaaccaauuauggagccaaccucagugcugucgugaacugcuuuccucuuaagcucaaacacugagaugggucuccugguuguaaucuuucaccuagaacaucccugcaaagagcagaauucccaucuuacucaugagaaaacagacccucaaggacguuguaugguuugucuauggcaaucuagccaauugacaaauacacuguccuucaaauuuucccaaacuaguauaacagggccaucauucaucauggacacuuugcagcaaaccacauggacaaagcauuguuaucugcuccacuguccgagccuaagacaccccaucccaaaguuauccuuugcuucacauugguuauaaauuuuagaguguacaagucacgucccuggauuaucaccuuugaccuucacaauacaauaggaagcugauaagcaaagguguugaacuguuuucuucugaggcucagaaacaugagauuuguuuugucugccuucauaccagcaaacagagaauguuucaagcccaaguuuucaggauaugucccacuguugagugguagggaccuccucagucaccugugauugcuuaccagacauugcccgucauccacaggacuggauaaccugagcaaaaucacagcccaagggcaguaugagcuccggguggaccuacaagaccauggggagucugccuaugcuguguacgacagauucaguguuggagaugccaagagucgcuacaagcugaagguagaaggauacaguggaacagcagguaugggguagcuacacugugagucuggagucaugaaauuccuauggauucacgcauucaccacuccugguucugaaucaacagauauuugaaugucuucuggaugcugaucuagaagaacuaucauuaaaaaggucuaggccaacaucugcaacaucuggucucugagagguagaguaggucaagaaucuugucaacuaugguugaauuauaaugacucucauuaaaagaauauguuucuuauucucuuguaguuagugguuguagaguggugauaggaaaauggucuuucaaaggccuccaucuucaccagaagcuuccuuguaauggguaucugaugucucugagaaucugcugaugugugaauucugauauauugggaugucauggggagacguuaagaugaguuucuccuaaguucccuggugaugccuacauuccuagcauuguuagucuuuugacugccaagcaaccuuuuguucuucaccuaaauuauaacccuaaugggcuagguuaugauuaccugauacccaggcuaucugacaauauuuaguggucugaggucuuacuuaugacuguagccagauaccuuuguauauaagagacaugccaauuuauacuauuugggggagaauagagguuuuugucuuugacuuaaagugacccuuguacagcuuucuggcuccacauuaaaggagaaacuaauaacagagcuaugagauggcauccuucucuguagguauuuucaacuacugaacccucacaaacgucuuuuaggaaaaugauauaaagaggagaaaaguggcuuggaaaaauucaggaaauuucagcucacagaaggaguaugugaguguguguguguguguguguguguguguguguguguguguguguguguguacacaugcgcacccagccaugugugccuagagaacaguguaaacaaagaggggcugggucaagaaugcagaccaucuuguguaagccagggccucuuuggguggccuuauuuuaugauuauuuaaacaggagacagauuugugaccccucugggagccccuccagaaaggaaaaaaucuucaccuuugacuaauaggugccagagccagguugcaguaagaaggacacagagccccuuugagaggcaguuuggugugauggaagagagaaagccagggcuggaaauuauuuuaacacuuacaugccucaaaaaaaaaaaaaaucugacacuuuaucaccuaacaauaaauaccucuuuggcugagaucaugucaagaaggaucuuguuacuuggaaagaaaauccaccaaccaacaagaauaugacuuacguucucucuguaucucugguggaggagagcacuugguuuuucccuucacucagagccauguuuucagguuguagcuuccagcaugcuuuggugauagcgccucacaggaaagcuucaucaauaucugcuugcucuccugcaacucauggguaucaucauuaguuaaaaagacucugaaagagcuuugacagcuugcuccaagaucucagcaucaaauaccuggaugucuuagaaugcuugcacacagcccuauggcuugggaguaagaaggacucagauaauauucucaaguagcacucuaugaaaaagcagguucuuagguaagaaucagacaacaccagccugguacacacucuuuuaaaaaugauuacaagaaacccaggcuaccugacaacauuuagagagugaaggucuuaauuaugauuguagccagacaccuuuguauaugagggaccugcccucuguuauuauuuuugcuuuguuuguaaguuuauggggucccauuaugaagccuacguuggccucaaacauaugcacuuccugccuuagcccaucccaccgcaugcugggauuacagauguccaccaccaugccugacacacacaucauuauuaaaugcaaauuucucacccuguccucauaggucuuuuaugcaaagcaaauauagacaaaucauaaacaacaacccuggcucuuuguaugccacuucucccuguccagaaaaacguucuggacaguauauuagaacagcgcugugagcuagacagaauccacuggaugucugcauuuuuuuagaugagaaaaagaaagcuuagaggaagcucagccugugacaggucacaauuagaaagacagagagauggacuucaauggaacuuuccagaaccaccugcagccuucuuucuuaacuuauaacagugcuucugucagagauaagucuugggggugacauucaugucucaugcuuugauccucaguccgguuugagguucagugccaguguacccaaggaucuuucaguccccgccuuugauucugcccuugacaaccuucggagacuuugauuuggggggagucuuuauucucucuuaucuuucucccuuuuauucucaauaaggugacuccaugaacuaucacaaugguagauccuucuccaccuaugacaaggacacagacucagccaucaccaacugugcccuguccuacaaaggagcuuucugguauaagaacugucaucgugucaaccugaugggcagauauggggacaauaaccacagucaggugaguagucugacaagguuggagaagcaagaugugggugagggaaggacacuucaauuagaaaauguguuaucuuccaacacagugagaaaucucaauggcauggcagcugagugagcgaagaggaaaaacaguacaaauuaacucuuagaucccaaggagaaacacuguccaaauagcucacaaauuuagaacuuuccacacagauaaaauuacugauagaacucugugaagcugaucaaaguggaugcuauucaggggagacagggaugauauaaacccuggcagagcacaggcccacaagcaucuucauagucccaagaaggaccugggcagaaggcaugaacugcaaauccccuugacucaaacccugugagagcugaccuuccugagguugcagaaugauuuuggaagccagcuaugaaguuugcuucuucuucucaccuuuaugugggcucucaggucuccuggcuugagaggugaacuccuuucccuguugagcuguccacucagcucucacauggaagcacugauaugcaauccuaacccugcaugucaaguucaaagcuuauauccuaccugcacucuuuuuugcuguucuaugccaaacccuuaauaaaaugcccccaugggaaucuugugaauucacacacacacacacacacacacacacacacacacacacacacacacacacaguacccagcuucucauuauguugugcucauaaaaagauaauaaaaagguauuaccauaugcucuaugaggggggggggguaugggggaaggggaugccuugaugggcccaugccaaggcaucccuuccccugagggaccagccacacagugguauaguauagaauagaguuuauucaggguauggggaggggaguuaaaaggguauuagaggcagagagagggagagaauaagaaaguagaggcccgacaugaccauguggagagaggggagaagggaauggggagagaaggagcaagaggcaagggagagaagcaggaguaagagagaaaggagggggcaagcagcuccuuuuauagugggccaggccuaccuggcuguugccagguaacugugggaggagcaugccuggacauuuccagguagcuauaaaaguggaguuuagacaaaauaccaacaaaugucgggcacuauuuuauuucaagauggcugcccaaggcucuaugcaaauagcaaugauuccuaacgauggguaaagaguuuagauucagcuggcccauuugaaaguuuucacagcacuggccaucaagagacauucaagacacagcugccugcaaaaugccaagugguuauaagcuaaaaaaaaaaaaacccuuuguguuuugaugacuaaauggugauggcccaugaacauguguccaaauggaacuaacccaggggucucuguuuuuuuuuuuuuucugcagggcguuaacugguuccauuggaagggccaugaguacucaauccaguuugcugagaugaaacugagacccagcaacuuccgaaaucuggaaggcaggcguaagcgggcauaaauuccagggauaauuuggugagagaggaauggggcccagagaaaagaaaggauuuuuaccaaagcaucaacacaaccagucuaacagugaagcucuccuugggcauuugaugggcguccaagcagaccacacggaucacugaggcacugauguaggccccucugcaacgacuuccuuugcaccaaagacaacagucuacaaguuucuacuuucuuguuugauugagcaaagucuccuagugacagcaacaccaugaauuuuacuucucuugggugguucugggaaugggagaggggcaagcuggccauacaggggacauggucauucuccgagccagcuguguuuuacacaaagcuguacaauuguuauugguugaggucacaaagaugaaacuugugucauuggaaguuaccccuugccccacccccacccucgauguuuuguacauuuccuacaacugaagccagaaaagugauauuguuuaaauuucaaggacauuaauauuauuaauauaauaauggugauggugaugaugaaaacugaggacuuuaaaagagauuuucccuucccaaacgugucuggacaguaccugauuguauuuuuuuuguuuuguuuuguuuuuuaauaaaagcacaguacuuuucaguuc
